United States Patent 9,328,346 (POLYCOMB-ASSOCIATED NON-CODING RNAS) - sequence listing, part 151

SEQ ID NO: 192529 - RNA, 373363 nt, Homo sapiens
guuccccugcaguuguuugggcugucccuguggcugguucuggggugugcggccagccauggagcgcucugggcccagcgaagguggguuucaugaggcgaguccgggcggggugggccgugucgggggagcuggggcgccgcacuaacuaggccgccucucuuuuccucuugcuccagugacaggcucagacgcgucgggaccggacccgcagcuugcggucaccaugggcuucacgggguucggugagugacugccccaggcagagacccucuuccuugugcagagguuugaagauccgcagagugggaguggagaucgagcugucaacucggaauuauuguagcucgggugcauaccuugcaguuugucaauauucuucucccauuugucuucuauucugcguuauccguuggaaccaacucagaugacaguuaugagagucuggagagagaggaagagaaaggauuuuucuaauuuuaagucaccaauaaugcuaaaaugaacauuuuuguaaauaacagcauuuguacgaggauuuuuaaaaauacguaauucgguaggguagauuucuaaaagagaguguaguuuauucagaaauauaaauacuuaaaaagcugaaaaauuggguaugugccuuuuaaagcuucuugaugcuuauugccguaauacccaucaaaaaacuuguuccagguuauaccaaaguuaacagaauuaagaaugccauuuuuaccauaucccuaccaacacagaguagguauuauuauuuaaaaagaaaauuauuuaaaaaaugaaaacaaaacuuaguagacugauacaugaaaaaugauuucucuuuauuuuccauuuuaaaauuauaaaugcuguucauccaaacauugggauucuaacuucccugaaccuuuucucaaggucuucuuguuuucuuuugaccagcguguauuaauucuaugauaguaauuaaacaguagacuuacacauauuggccuuggguuguguucacacauacuaguucuguaguuucucuauucauucuuuuuuuuuuuggagacggagucucgcucagucgcccaggcuggagugcgguggcaagaucucggcucacugcaaucucugccucccggauucacgccauucuccggucucagccucccgaguagcugggacuacaggcgcccgccaccucgcccggcugauuuuuuuuuuguauuuuuaguagagacaggguuucaccguguuagccaggaugaucucgaucuccugaccucgugauccgcccgucucggccuccgaaagugcugggauuacaggcgugagccacugugcccagccuuuucuauucuuuuuuuauuuuuugagauggagucucgcucugucacccaggcuggaguguacuagugcgaucuucgcucauugcagccuccuccucccaggcuuaagccauccucccaccuuagucuccugaguagcugggaccacagaugugugccaccacaccuggcuaauuuuuuauacuuuugguagagacgagguuucaccauguugcccaggcugaucaaucuccugagcucaagcaguccgcccaccugagccucucaaagugauuacaggcaugagccaccccacccgguauaaauccuucauuuuaguacaucauuccuuuacucaggagugagaaaguuguccauauguuugugccaaauaggggaaaauuuuaagaguuuugauaaaguuacugggggaggaggagaauguuuccaugcucauccaguuccuuguuagagggcugagauuucuguuucccucuuagcuccuuaaaguaccugcauuacuucucauguugccccuuucgucuucaagccaacuauaaugccucaaauucuucucagacauuggaucucucugacuucuucugccauagcuguucugcaucuuugccuuuaagggccaaauaggauaguuucccuauuuaaaaguccauaaccuuaauuauauugcaaaggguaacuuuuggggcauucuccauuuugccuccccacaucaguguuguuguuucauaggguagggaucuagaggaggaugggaaaguugccugguuaauaguacuuagugaagggauugucagcagaaguuuucugugacucaaacuccuucuucugugauauauuaugguuauauuggagccaugcuauaaacuagacaaaguaaguguuuauugaucaguauugaucaccuaaaguuuggccaacuuacugcaagacaaucacagucucccauuuguucauguuuuagguaaaaaagcucgcacauuugacuuggaagcaauguuugaacaaacucgaaggacagcuguggaaagaagucgcaaaacacuggguaagaagcucagauauuuguucuuuuauugguuuaaguacuauguauaccucaugcaaguauauuaaaaaagagaaaagaauguuggcugggcgcgguggcucaugccuguaaucccagcacuuagggaggccaaggcgggcagaucaccugaggucagaaguuugagaccagccuggccaacauggugaaaccccaucucaacuaaaaauacaauaauuagcugggcauggugcaggggccuguaaucccagcuagucgugaggcugaggcaguggcuucaguugaagucgggaggcagagguugcagugagcugauauacccccauugcacuccagcuugggggacaagagugaaauuccaucucagagaacaaagagagaaaagaauguuguuaugcuacuuaucacuguuguuuuuuuuuuuuuuugagauggagucucgcccuguugcccaggcuggagugcaauggcaugaucucggcucacugcagccuccaccuccccgguucaagcgauucuccugccucugccucccgaguagcugggacuauaggcacaugccaccacgcccagcuaauuuuuuguauuuuuaguagagaugggguuucacuguguuggccaggcuaguuucgaacuccugaccuugugaucugccuaccuuggccucccaaagugcugggauuacagacgugaaccacugugccccgcuuuuuguuuuuuuguuuuguuuuguuuuguuuuugagauggagucucgcuuuauugcugggcuggagugcaggggugcgaucuuagcucacugcaacuucuaccuccccgguucaagcaauuuuccugccucagccccccagguagcugggacuacagguguacgccaccacgcccagcuaauuuuuguauuuuuaguagagaugggguuucaccauguuagccaggauggucuugaucucuugaucuugugaucugccugccuccuaaagugcugggauuacaggugugagccaccgcacccggcccaauuuaucauuuuaagaccaacaaugggccagguguaauggcucaugccuguaaucccagcacuuugggaggcugaggcaggugaaucacguaaggucaggaguucgugaccagccuggccaacauggugaaaccccgucuugacugaaaauagaaaaacuaucugggugugguguugggccccuguaaucccagcuaguagggagggugaggcaggagaaucgcuugaaccugggaggcagagguuguggugagcugagaucgcaccauugcacuccagccugggcgacaaaagcaaaacuccaucucaaaauaaaaaaaauaaaauaaaauaaaaugggcgacaagagcaaaacuccaucuuaaaauaaaauaagauaaaauaaaauauaaaauauaaaacaaaauaacuaaaauaaaaaauaaaacguuguacagcagcaauauccaguauuuggcagugugccugacaaaaaauauuuucagucuuuggaagaaaacuuuuuguggugaaaagaaagccaucuacauguacuauuuuuugaaaaaaaccuuucauuauuuguuuuauuugagacggaggccugcucugucgcccaggcuggagugcaauggcgugaucucagcucacugugaccuccgccucuuggguucaagugauucucuugccucagccuccugaguagcugggauuacaggugaccaccaccacgccuggcuaauuuuuuuguauuuuuaguggagacgggguuucgccauguuggccaggcuggucucggacuugugaccucaggugauccgcccgccucggccucccaaagugcugggauuacaggugugaaccacugugccaggccaaaacccaucauuauuauuauuauuguuauuuuuuugagauggcgucucgcucugucgcccuggcuggagugcaguggugcgaucuuggcucacugcaagcuccgccucccggguucaugccauucucccgccucaggcucuggaguagcugggacuacaggugccugccaacacgccuggcuaauuuuguuuuuguguuuuuaguagagaugggguuucaccguguuaggcaggauggucucgaucuccugaccucgugauccacucgccuuggccucccaaagugcugggauuacaggugugagccacugcacccagcaaaacccuucauuauuaugugaaauuucaaacacggaaguauagucaugaacuaccauguaccuaucaaucagauuuaacuacuguaacaguucauggcuagcauuacuucguuuccccuuucagaugauuucgaagcaaaucuuggacaucauuuuacucauaaauauuuuuguauauaccuuaaaacgauaaggauuguuuuaaaaaaagcuuaaccaagauaccuguaagagauaggaaaaaccaaguuguuuccuauccucuagcacuccucucaguacuuuccccccuuuuuuuuuuuuuuuuuuuuuauuugagacagggucucacugcuguugcuuagacaggugugcaguggcaugaccuugccucacugcagacuccacuucccaggcucagguaauccugccaccucagccucccaaauaguugggacuauagguuggugcuaccacaccccacuaauuuuuuguauuuuuaguugagauagauuucaccauguuggccaggcgcaguggaucacgccuguaaucccagcacuuugggaggggcggaucacgaggucaggagauugagaccauccuggcuaacauggugaaacccugucucuacuaaaaauacaaaaaauuagcugggcgugguggcgggcgccuguagucccagcuauuugggaggcugaggcaggagaauggcgugaacccuggaggcagagcuugcagugagccgagaucuugccacugcacuccagccugggcgacagagugagacucuugucucaaaaaaaaaaaaaaaaaaaaaaaaaaauuucaccauguuguccaggccagucuugaauuccugggcucaagugauccaccugucuuggccuuccaaagugcuaggauuacaggugugaaccaguacuuuauuucugacaccagauauguaggaguuuucccccacacaucaaccaguucuccaacuggguauccgguaacucaguuuaauucugacaccgucugccuggagacuaccacaagacugccuucacucagacacuaaucucaauucacagguugugaccagugcuucuaaucuacuggcuauaaaucaggguucccaugaccgcucuuuuugguuugauaauuagcuaggacggcucacagggaaacacuuuacuugcguuuaacaguuuauuauaaagaauauuauaaaugauacagaugaacagccagaugaaguaaugcacugggcaagguauggggugggagaggugcagagcuucugugcccucucugggugcaccaacuccccagcauaccccuguguucagcuacccugaagcuaaucacaucuagugguucaggagugucuaggcugggugcaguggcucacaccuauaaucccagcacuuugggggaccaagguaggaggaucacuugagcccaggaguuugagauaaaccugggcuaacacagugagaucccauucaaaaaaucuuacaaaaauuagcugggcaugguggugcacaccuguagucccaacuacuugggaggcugaggugagagggucaguugagcccagugguugaggcugcagugagcuaugaucaugccacugcaucacagccugaguaaaaaagcgagagccugucucaaaaaaaaaaaaaaaaaaaaaaaaauuucuacagaucuuaauuuucagcuucuccagagauugguggguggggaugaaaguuccaauuaucuaacccaucaguuuuuuaagugagcagcagucccauccugaggccuagggguccagcacuaagucacuucaauagcauaaacuuaggugggauccaaaggggcuucuaaugaauaacaagagacagcuccuaucacuuaggaaauuccaaggguuucagaagcucuguggcaggaaccugaaacaaagaccaaauauauauauauauuuuuugagacagagucuugcucugucgcccagacuggagugcaguggugcgaucucgacucacugcaagcuccgccucccggguucacgccauucuccugccucagccuccugaguagcugggacuauagguaccggacaccaugccuggcuaauuuuuuuuuuuuuuuuguauuuuuaguagagacaggguuucacccuguuagccaggauggucucgaucuccugcccucaugauccgccccccucagccucccaaaguccugggauuacaggagugagccacugcaccuggccaaauauauuucauauuauaccacaauaucaucacaucaaaaaacaauuuuaauauccucaaacgauggacaaagacaugcuaucugaggcauuuacaaauguuuuaaacaauuuagugaauguuuguacuaucacaguauagguaccuuguauuuaccauuuuaagcauauaauacaacauguuuugaacaaggauugucuuguuuggcuaugucggcuuuuuguuguuauuuacuuauuuauuuuuuugaguugcccaggcuggagggcaauggugcaaucuaggcucacugcaaccucugccuccugguucaagcaauucuccugccucagccuccccaguagcugggauuauaggcacgugccaccaccaccugacugacuuuuuuauuuuuaguagagacaggguuucaccauguuggccaggcuuaucucaaacuccugaagucaagugauccgccugccucaaccucccaaagugaagcuuuuuauuuuuaauuuuuuuauuuucaauuuuuguggguauauaguagauguauauauuuguggguauguaaguuuuauagccccuaguacuuugcuuuguaaaauagguucucaguaauauuuugagaauauuaaauugaauuuagaccuguaauacugucuuguuaaaaaaugaaaucuugcugcuuuggagaauguuuuaaaauggcacaaucugggcugggcacgguggcucacgccuguaaucccagcacuuugggagccugaggugggugggucaccugaaaucaggaguuugagaucagccuggccaacgggaugaaacccugucucuacuaaagauacaaaaauuaaccggguguggguggugggcaccuguagugccaguuacucaggagucugaggcaggagaaucgcuugaaccugggaggcggagguugcagugagccuagaucgugccauugcacuccagccugggcgacgagagcaaaacucugucuaaaaaaaaaaaaaaaugggcacaaucuguuggaaagagcuugggauuuuuaauugggggaccuagguuuaaggcccagccccacagucuacuagaugaguaacauuggauggauuuuccaauuucugauccuucauaauccuguuguguguguaucaucuaccuuggaaguuucuugaagagauuaagauguuggguguaguagcuuauaaacagcaaaguacuuuauaaauauuauuuuaaauucuuguaauuuuucuuaguaaagcauguaugcauuuuaccuaagaggaacuugggggguuauuaaauuuuuaaauuuuugaaaaauugucucaagacuaugaucuccuuugauuuuuguggacaaauuauugaacuuucuugauuuacaucuuuggacugcaauuucuaccucugaucuaaacacaugaaucuaaauugauuaucucuuugaaagaucuacuuagcuuuagcauguaaauagaaaauaccauugggauaauuuauagaaguaguauucaucauuauaugggaaguuauucauaagaguuuuuuuuuuuuuuuaguguucuuccauacuuggcaauuagauuacauuuagacuguggaauuaaaagugauucccugugagcuguccuagcaaauuaugaaauugaagagagggguugugggaacccuaguuuccuaccaugagacaguuugacuuacuuuucuuuaaaaguugaaaauucucauaugggcauuauuuaucucaugcuugguauuggagucuuuccccagguauugauaguacacuugaggaaacuaagacuuugacccuuuuaauagcaaguuugucuguauauggggguaugagcugucuugguugcuaagugcacuaguggaaaggaugaauuacgguaaaaccccaauaaaauaugugcugugaagggucuggaaaugauaaugguacaaauuuuuuuuaauguuuuuuauguucuugaaagcuauaaguauguguaggacauaugaaauacaaauuuuuuuuucuuuuucuugagacagagucucucucugucgcccaggcuagagugcaaugggacgaucucggcucacugcaaccuccuccucccagguucaaggaauucuuccucagcccccugaguagcugggauuacaggugugcaccaccaugcccggcuaauuuuuuguauuuuuaguagagacgggguuucaccaugcuggccaggccggucucgaacuccugaccucgugaucugccugccgcagccucccaaaguguugggauuacaggcgugagccaccacgcccagcugaaauacagacuuuuuuuuuuuuuuagaaguguuacacuaggcuggggacaguggcucaugucuguaauccuaguacacuuugugaggcugaggcagguggauugcuugaggccaggaguucgagaccagccuggccaacauggugaaaccccaucucuacuaaaaauacaaaaauuaggugggcauggugacuggcgucuauaaucccagcugcucgggaggcuuaggcaggagaauugcuugaaccuaggaggugaagguugcagugagcugagauugugccacugcacugacgccuggugacagagugagacuccgucucaaaaaaaaaaaacaaaaagaaaaacuaagggaaaaagagggaggacuggcauggugugguggcucacauuuguaaaucuugaggcaggaggauugcuugagcccaggaguucaagaccagccugggcaacauggugagaccccgucucuauuaaaaaaauaauaguaaaaaagggggaaauggcagcugaguaggcagccucaguaucuuuuccugauuaguaauauaauugacuguaagaccugagggagaagaugagccuagaguacaaaugcugcugcugccaccccccgaggucuggagggauuggcugaaaaaacagggugaacuaggagcuaagcaggcccauucuuuuuuuuuuuuuuuuucguggagauggagucucacucuguggcccaggcuggaguguggugguacuaucuuggcuuacugcaaccuccgccuuccggguucaagcgauucuccugccucagugucccgaguagcugggacuacaggugcacaccgccacgccuggcuaauuuuuuguauuuuaguagagacaggguuucaccugucgagaccaggcuggucucgaacuccugagcucaugcaagccacccgccucggccucucaaagcgcaaggauuacaggugugaaccaucacgcccggcuucaggcccauucuuuuuuauuuauuuauuuuuuuugagacggagucuugcucuguugcccaggcuggagugcaguggugccaucuccgcucagugcaagcucugccucccggguucacaccauucuccugccucagccuccagaguaagcugggacuacaggcggcugccaccacgccuggcuaauuuuuuuguauuuuuaguagagacgggauuuccccguguucgccaagauggucucaaucuccugaccucgugauccgccugccugggccucccaaagugcugggauuacaggcgugagccaccgugcccgacaggcccauucuuaaaucuggacacugcuuuuuuuuaaauuuuuuccaguuucuagcaucagagugcagaauuguugacucuugacccgccucagcccagaagacacaaaaaagucaacaugaucuagcacuguaauauuugccuuaccucuuccuggaggguuuugucuuccauauuugacaugaaagacuauguaauuccuuguugauguuugcuggguaagcuuauuccucauccuccaugucccagcaacuaaagacccuaaagaauacaacauuccacuugauaaguguccuuugcugcugcucaacuuggauuguauuguauuucauuauuaagugaaggaaaaaaauguuaaagauuaucucagguuauugaggaugguggcaauugagaaccaaacuauucauacauaauccuuuuucuuccuagugcccccacaauuguagagugagauuaucagagggaaaaaaguuaauauuuuaaauauuuuuuugucuuucuagaguaaacaacucuagaaaauuaauguaguaguuuuuuuuuuaaauauagugaaagcaaguuuauuaggaaaguagaggaauaaaagaauggcuacuuuauagacagagcagccuauaauauaaauuuuuuuuuuuuuuuuggagaccgagucucacucagucgcccaggcuagaaggcaguggcacgaucuuggcucacugcaagcucugccuccuggguucacgccauucucuugccucagccuccuguguagcugggacuacaggcgccggccacuacgccuggcuaauuuuuuuguauuuuuaguagagacgggguuucaccuuguuagccgggauggucucgaucuccugaccucgugauccgccugucucggccucccaaagugcugggauuacaggcgugagccaccacacccggguaguauaaauuuuauuaugauuuugauagcuagucucugaccaaaauucuaguguaggaaauucagaaaaaaagugcuguuuuuuuuuuuuuuuugagaugauguuuugcuuuugcugcccaggcuggagugcaauggcgcaaucuuggcucaccacaaccuccaccucucggguucaagcgauucuccugccucagccucccgaguagcugggauuaaaggcaugcgcuaccacgccuggcuaauuuuuuauuuuuaguagggaugagguuucuccauguuggucaggcuggucucgaacuccugaccuccagugauccgcccaccuuggccucccaaagugcugggauuacaagcaugagccacugcgccuggccaagaagugcuaaauuuauguuuuaaaacauuagaaaguuaauuaccuaaaaucucaccuuugaauacuuuuuaaaaaauauaucaccaucuacauuaugcuaauuuugcuuagcauaucuguuaauauuuccccagauuucuguuuucuaucacuauuuuuauuaucugcaguuaauauuauauugcuaugcaguaauuucguucaauucuuuuaccacauuggccauuuagguugauaaauuuuuuuucuaauuuuaaaaauuguuauaaaauacacauaaaauguaccaucuuaauauuuaagugcauaguguugugcagccaucaccaccauccaucucuauaacacuguucaucuuguaagacugaaacucuauacauauuaaacaauucuucauuuccccucccucuagccucugauaaccaccauucuacuuuuugucucugacuuugacuacucuagauuaccucauguaaguggcauuauacaauauucgucuuuuuguuuuucugugaguggucugucucacuuagcauaguguccucaagguuuauccaaauuguagcauauugcagaaucuccuuccuuuuugggugaacaauauuucauuauguggauauaccacauuuugcuaaugcaguuaucuacagauggauacuuugguugcuucuacauuuuagcuguugugaaugacguucuuaugaacauggguauacaaguaucuuuuuuagacugugcuuucaguuucuuuggauauauaccagaaguggaauugcuggaucacgugauaauucuauguuuaacuuuuugaggaaccaccauacuguuuuccaguggcugugguugauaauuuuuugcuguuacugcuaacacucuaaguuauaucuuugugacuauguuaauuuuuagccuuucuaauacuaacauauuuugaauuguaaccguugggauuuuuuuguuaaucuuuuuuuaaucuuuucagaagcaagagaaaaagaggaagaaaugaacagagagaaagaauuaagaagacaaaaugaagauauugagccaacauccucaagaucaaauguggucagagauugcuccaaaucaucuuccaggugccugauuuucagaaagacuucuauuaaacuaucaguuucuagguguuuauagaguuuuuuuuuuuuuuuuuaauuuuuuugagauggagucuugcucuaucgcccucugcagugcaguggcgugaucuuggcugacuguaaccuccaucuccuggguucagacgauucuccugccucagccucccaaguagcuggcauuacaggcaugcgcuaccaccccuggcuaauuuuuguauuuuuaguagagaugggguuucaccauaucggccaggguggucucgaacuccugaccucaguugauccacccgccucagccucccaaagugcugggauuauagacgugagcauccugaguagcugggacuacagacgugcacuaccacggccggcuaauucuuguauuuuuaguagagacagguuuuaccauguuggccaggcuggucucaaacuccugacaugaucuguccgccucauucucccaaaguccugggauaacaggugucagcuacugggccuggccuccaguuauuacuuuuuuugagauggaaucucgcucuuucgcccaggcuggagugcaguggcuugaucugggcucacugcaaccucugcuuccuggguucaagugauuuuccugccuuagccucccaaguagcugggauuacaggugugggccaccaugcccugcuaauuuuuuuuguauuuuaguagagaugggguuucaccauguuggucaggcuggucuccaacuccugaccucgugaucugcucgccucagccucccaaagugcugggauuauaggugugagccaccgugccuggcaucccaguuacuucuuuuuggcaaugcaacaauggccuaacacauugauguuguuuaucuugucagaaaaucaacguuuguuucagugauguuuuguuauucuuuuuuuuguuguuuggguuggagucucacucuguugcccaggcugcagugcaguggcaccaucucagcucacugcaaccuccgccucccggguucaagcaguucucugccucagccuucugaauagcugagguuacaggugcccaccaccaugcccagcuaauuuuuguauuuuuaguagagacuggguuucaccauguuggccaggcuggucuugaacuccugaccuugugauccacccgccuuggccucccaaagugcugggauuacaggugugagucaccgcgcccagcguuauuauucuuuuuuuagugucaaugucauuuguaguucugcucugauuuuuuuuauuuccucuaauaauuuuugguuugcuuuauucuuugccuaguuccuugagguacaucauuagguuauuugauguauuucuacuuuuuauguagguguuuauuguuguaaauguccuucuuaguacuguuuucuuuguuuuccguagguucugauauguuuuguuuccauuuucuuuuguuucaagaaauuaaaaaaaaauuuuuuuuauugacccuuuggucauuuggaagcguguuguuuuauuuucauguauuuguacaauuuccaagguuccucuuguuauugauuuuuuaauuuuuuuugagacaggguuucacucggucacccaggcuggagugcaguggcacauucuuaacucacugcaaccuucgccucccagacucaagugauccucccaccucagccccuuaaguaggugguacuacaggugugugccaccaugccuggcuaauuuuuguauuuuuuuguagagacagguguucacaguguugcccaggcuagucuugaacuccugagcucaagcaauccgcucaccucuaccucgaaaagugcugggauuacaggcgugaaccacugcgccuggccugauuuugguuuuauuuuguugugguuaaaaaagauacuugagggcugcgggagguggcucaugccuguaaucccagcacuuugggaggccgaacuggguggaucacgaggucaggaguucgagaccagccuggccaacaugaugaaacccugucuguacuaaaaauacaaaaauuagcugggcgugguggcucaugccuguaauuccagcuacuugggaggcugaggcaagagaaucacuugaacccaggacggggagugagcgaagaucaugcccugggacucuagagugagacucugucucaaaaaaaaaaaaaaaaaaaaucuguuuuaaaccagugcagcuggaaacuugugcguuaaucauaagggggaaaauuuuggaguaugaauagcuuaauauaaauuuguuuagucauucaacuauuacuuacugagcaucuacuguggauuacacaguguuuuaggcacugagauauagcaauuagcaagucaguugagaccuuuguucucacugagcucacguuguugugggaguauuugaagggauagauaacagacaacuaaauaaccaaauaaaauaacuuagcaggcauguaaugaagauaaacaaagguacuuaagguaaugggaagugguggugugccugaaaguuuagaaggagugugcccuuagacuucuuugaggaggagacauuugaggaaacuccaaagaugagaaagaggccguguaacaaucuaugggaaggguaagucagccgacagaacuacaagugcaaagaccuuguugugaaccaaacuuaaccuguucaauuagaaagaaggccuuggaguggagauuugagcuaugcaguggcucaaauguagaaacucagauuuuuauggagguuugcuaguucauauaccucuguuuaaggguaaccugaaugugagaauauauucuuuucaauuuuuaaccuagaugaaaacaaaaagaaaaaucucauguuuuuccgucaguagauauugagugccuguuauaggugaagcauuuuuuagaugcuagaaauauguuagaugcuagaacaaaacagaaauucgugcuuuccuggagcuuacauaccagagauacuucauuagaaggcagugacacuuuuaaucuuaucaaauauuugaaagauuaauugauacaauuaagaaugcugaaugcucaacucuggcggcagguggaggggugguagauggugagggcuaugcuuacagguguuugcuagagaccuuagugagaguguauaauaguccucaggugugguggauaggaaaccacuugggaaucaguaugcuaugcccuagacucucaagcccguccaaccugcguuauauuguuguuguuuucuuuuagacuuuuagcauccugaagccgugguuuuuaguuucugucucuagugauaaguagaaaagagggaugaggaaauggcuucacuggacaaccagaaacaaaauaagaacccaugacuguauucucucccuuggacaccccugguuagaguaugguguuuuuagaaugcaagaaugcuacauuuaauguuuuggcaauguaggaaacuuggauuagccguuagaaauaacuuguauuucagaaauuauauugaaacauuuugggaguaauauuaacuuccuuacaugacuggcauuauuugcuacuguggcaaucagggauuggauucaaauauaguuaauugaggcacuggauaucucagugguuuuuguccguuacuauuuuguaguuuuucuucuguauuuccuuguucaccucuuuuuaaaauuuuuaaauuaaauuuuuauuauauaucuguauuuugagacagggucucacuguuguucaggcuggaguagagugacgcagucauggcucacuguagccuugaccuccuggacucaagugauccuaccaccucagccuccugaguagcugguaccacaagcacaugccaccacaccuggcuaauuuuuauuuuuuguagaaacagggucucgugauguuucccaggcuagucucaaacucuugggcacaagcaguccaccugccuuggucccugaaagugcuggcguuacaggugugagccauugcacucagucucaccugucucuuuaugagugcuaauggucuaauggcugucuaacauauaauugcugugacccuuuauuuuugacugcguaagacgguuuuuuuuaacuuucuuaagauaaaauauuuggcauuaaacauuuaauguuugaacuacaaauuuaaaaaaauuaaaaaauacccaguuguuaauaggagaggaaaaguauccugagaaaugaauacuauuuccaaagugugcucuucauugcagcagaggcaaagaguuucuguuucuguauuuucagggauacgagcagcagugaaagugaacagaguucugacucuucugaugaugaguuaauuggcccuccuuuacccccuaaaaugguaggaaaaccaguuaauuuuauggaggaagauauccucgguccuuuaccuccaccucuuaaugaagaagaagaagaagcagaggaagaagaagaggaagaggaggaagaggaaguaaguauuucagugguaauuuaagaauucgguggaguaauaucuuuacuguagagaucaguucugcuaaacuguuuuucaugaguaagagccaauuuaaaaacugaggaaaggccgggcaugguggcuuaacaccuguaaucccaguuacuuggaaggcugaggcaggagaaucgcuugaaccugggaggcagagguugcaaugagccaagauugugccacugcacuccagccuguagacagccagacuccaucuccaaaaaacaaacaaaaaaccaaaccgaggaaaaaggccgguacaguggcucacacccguaaucccggcacuuugggaggccgagguggacggaucgcuugagcucaggaauugaaaaccagcuugggcaacauggcgaaacucuguuucuacaaaaaugcaaaaauuagacggguguuauggugcgcaccuguggucccagcuacucaggaggcugaggugggaggauaauuugggcccaggagauagagguugcagugaggucgacagauggcacuccagccugggcgacagagugagacccugucucaaaccgccccccccaacccccccgcaaaaaaccugaggaaaaugacuguggaguuuauuacugacagccuguauugaaagaacuucaggaggaagaaaacaacuaaaaaauaauaaauggagggcagaaagcaauguguuaaaaagaaaucaauggauaaaacauuuuguuaaaucuacguaugcggcugggugugguggcucacaccuguaaucccagcacucugagaggccgaggcaggagaaucgcuugaaccugggaggcagagguugcagugagcugagauugugccauugcacgccagccugggcaauaagagcaaaacucuguuucaaaaaaaaaaaaaaaaaucuauguaugcauugucugcaaauaauaaugaugauggguaaauuugggaggauuuaagagcaaacuggaucuaaaauuauugucaacaaugaaguagaagaugggagagugaaaucagaguucauugcuuuguaaauguuauuugggaggaggccagggauaccgguuaaccuuagauuaguuuaagccaaguauauaaguuuacaauuuuaagaguaauugcccggcagggcauaguggcucacaucuguaaucccagcacuuugggaggcugaggugggcggaucacgaggucaagagauugagaccauccuggccaacauggugaaaccccgucucuacuaaaaauacaaaaauuagccaggcguaaucguggcgcacgccuguagucgcagcuacucgggaggcugaagcaggagaaucacuugaacccgggagacagagguugcagugagccgagauugcaccacugcucuccagccugggugacagauucggucucagaaaaaaaaaaaaaaaagauauaaucuccaaaauacugaaaggaaagaaugcugaaggaaauggucuacauuuguauuugacacuugggguagauaauuuuuuuuuuuuuuuuuugagacgggagucucacucugucaccgaggcuggaaugugguggcgccaucuccgcucacugcaagcuucgccucccggguucaugccauucuccugccucagccuccugaguagcugagacuacaggcacccgccaccacgcccagcugauuuuucguauuuuuaguagagaugagguuucaccguguuagccaggauggucucgaucuccugaccucgugaucugcccgccucggccucccaaagugcugggacaggcgugagccacugcgcccggccgcacuugggguagauaauuuuuuaacaccucccuucuuuaugugaugaauuauuuuuaguaauaauuaugaaaugaaaugaaaaguaaucagaaaagcaacagcuuuuguaaaucugucaaugacugucaaaaucgguauucuuugcguauuccuucucaguacauaguacagcaaauuugucaauuugcgucugucuguaguugaucaaauaaagcuucuaauuucaauuuuguacauuuuucuuucauaugaaauaacagaucuauaguauauauacacacauaugcacaugcauucaugugugugcauauguaaaauuaagaaaacaaacaagaauaaaauaagaauaaauuuggcaguuucauuaaaauuuuuguuuuacaguaaguuccagaaauugcaauguugauuguauauuuuuucuuuuaucaguucuaguggcuuuuaaauaucucuguagguugaaauauuuugacugggcacuguggcgcacgccuguaaucccaguacuuugggaggcugaggagugcugaucacuugaggucaggaguuugagacuagccuggccaacauggugaaaccuugacucuacuaagaaaauacaaaaauaggcugggcguaguggcucacgccuguaaucccagcacuuugggaggccgagaugggcggaucacgaggucaggaggucgagaccauccuggcuaacacggugaaaacccaucucuacuaaaaauacaaaaaauuagccgggcaugguggugggcgccuguagucccagcuacucgggaggcugaggcaggagaauggcgugaaccugggaggcagagcuugcagugagccgagauggcgccacugcacuccagucugggugacagagcgagacucugucucacacacacacaaaaaaaauuagccaggcauggugacaggaggcugaggcaggggaauugcuugaacccgcaaggccgacucugcagugagucaagauugcaccacugcacucuagccuggcaacagagcaagacucugucucaaaaaaaaauuuuuuuuucaugaaaguguuuuuacagaaaauucauuuuauauuugguaaaaacuucuaaauuuuuuucucuaaaaaucagagaaaauggcuaaaugaugucaaacauugccauuaaaugauccauugcuuuagaaugcuuuuggugaaaacaauugagguauucaaacauuuaccguuuuaaauucuuuugccaaccaugucuuuuguuuuuucuuuuggcauccauagaaaacagaauuggauuugcuuagcauuuuguuucuuugucuuuauaaucuuuguuuauuuugaaucuaguauuuaaaugcagaaacguaguacaacagggauuggagauaggaaauuacccuugaaaugagcuugaaugauucugaaccaugaaaaacaguguguagagacccgaguaggugaguguguuugugcauguguguggugcagauaacugggaguucuccagauuaacuucguguagaauacagugguuauuuauuuuuauuauuuauuuauucauuuauuuuugagauggagucucacucuguugcccaggcuggagugcaguggcaugaucucagcucacugcaaccuccgucucccggguucaagugauucuccugccucagcuuccugaguagcugggauuacaggcaucugccaccacgccuggcuaauuuuuuguauuuuuaguagugaugggguuucaccauguugccccagcuggucuugcauuccuaaccucaggugauccaccugccucggccucccaaagugcugggauuacaggugugagccacugcaccuggccagaauacaguguuuauuaaaagauaaguaauacaaauauguuaauugaaguucacauauauguuauuaaaacucgauaggaaccauagcaaaaagaacauuaaguagugucuaaacuaacauuguuuauaauugccaucaccaggugauaauaaaaagcaggcuuaucuuugcuugauuuuaucauuguuuuuaaguucucuacagaaaaguguacucucuuauugucuacauuacuuccacugaucucauagaauuagugucuuuauaaaaagagucaccagaaagcgugcacuaacuccuccucucccacgggaaaggaagaauggcuuuuugaggacauagcagaaaguggucgucuacaagccaggaagagaggugucaccagaaaccacauuuguccauauuuugauuguggaccucuagccuccagaccugucagcaaauacaucucuauuguuuuaagucacccagucugugguauuuuguuuaugguugugugagcuaauacagguuugcaaggcugacuaauggcugauaaacagaagggaagaaagaagcauauugcaagccagaaaaaaauugcuauagcgaaggcccaaauguauauaaguacagcuauggucaugaaauuguaccugauuagugcauggcugaguuuucuuacuaggagaaaguagaaagaugaggaggaugagaucaaauccagaaaguaugaauaaauacucucuggaggauguguaauuugguaagcuuuguagaggauuacaguuuuuguguuuuuuugagauggggucucucugucacccaggcuggaguacagugguguaaucaaagcucacuacauccuugaccuccugggcuuaagugauccucccaccucagccucccgaguagcugggauuacaggcaugugccucuacaccuagcuauuuuuuuuuuuuuuuuuuuuuuuuuuaguagagaugaggucuuacuacauugcccagcucgucucaaacuccugggcucaagugauccuccugucuuggccucccaaagugcugggauuacaggcuugagucacugcccagccaaagauuaauuuuuuuuuuuuuuuuugagacggagucuugcucuauugcccaggcuggagugcaguggugcaaucucggcucacugcaaccuccgccuccuggguucaagcaauucuccugccucagccuccugaguagcuggaauuacaggcacgcgccacugcacccagcuaauuuuuuguauuuuuaguagagacggaguuucaccauguuggccaggcuggucuugaacuccugaccucagguaauccaccuaccuuggccucccaaagugcuaggauuacaggagugagccaccuuacccaggccaaauuuuuuauuuuuaaaauuuuuguagaggugggggucucaccaucuuggccaugcuggucucaccugggcucaagccauccugccaccuugacuuuccaaaguguugguauuacagacgugagucauugugccuggccaagauuauauuuuuaaggauuuuuuuuaauugacagauuauuuuuaauugacauaauuguacauauuucugggguagagugugauccuccacaccuguauacagaguguaaugaucaaaucagggugauuagcauauccauugcguaaaacacugaucaucucuuuguguuggcaauauucaaaauucucacuuuuagcucuuugaaaauauggaguaaacaguuguuaacuauaguuacuuuacaaugcuauagaacacuagaacuuauucuuucugucuagcuguaauuuuguaucuguuaaccaaacucucuuuauaccccucuuuuuccuacccuuuucacccuuucguuucuguuucuacuauucucuccacuuuuaugagaucaguuuauuuagcuucaucugaaugagaacaugugguauuuaucuuucugugccuggcuuauuucacuuaacacaauguccuguaaacucauguuuguuacugcaugugacaugauuuuauacuuucuaaauuuagccagauaguauuuguguguguguguguguguguguguguguguguguuuuaaauuuuuaaauccauucauuuauugauggacacguagguugauuccauaucuuggucauugugaauagugcugcagugaaaaggggagugcagguaucaaaaugugaauuuccuuuccuuuggauauauacucauuagugggauugcuggauuaugacaguuuuaguuucuaaaaaauugauaaauaauauauauauuuuugggguauauaugacaauuugauaaauucguaaaauguguacagauuaaaacaggguaauugggauauccaggauauccaucaccuuaaauauuugucucuuccuuaugcuaggaacauucaaauuauucucuucuagcuguuuuaaaauauacaauaagauuauuguuaacuguggucacccuacugauguuuugaauacuaggucuuauucucucuaucugaccauauauugguaccuguuaaucagccucucuucaucuuucccagcccccgaaccuucccagccucuaguagucacuaaucucucuuuaugagauccacuuuuguagcuucuacagguaagagcauguaaaauccauccuuccuuccuuccuuccuucccucuuucccuccuucccucccucccuccguuuuuuuuuuuuuuuuuuuugagucaaagucuugcucugccacccagccuggagugcacuggcacgaucuugacucacuccaacaucugccuccuggccucaagccauucucgugccucagccuccugaguagcugggauuacaggugugcaccaccacgccuggcuaauuuuuuguauuuuuaguagagaugggguuucgcuguguuggccaggcuggucuugaacuccuggccucaagugaucugccugcuucugccucccaaagugcugggauuacaggcaugagccacugugcccgguccccaaucuuucuaaccacucaugaauuauguucauauuuaaacuccaaccauauuguaaauucaacacaucuaagauaaaacuuaggcuuuuauuuugucacacuugaacuuuugcuguagccacuuagcuggucucuuugccucaaggaucuucuguuuuaauccccuuuccccacugcagcaagauuaaacuaccuguaacacaagucacauugcaacuaauaguacuaauucccuaaaugagggaaaacaccaccacagcagggcaggacuccaccuggcgauuucugaauccaauuugaguuuuuuauuguucauaaucacuguggcacuuuugacagucuauuuaauaggaaagcaaccaauuucacauaguggaguggcuagauauuuuagcaaauauuguugaaauuaaugggguaauauuuuuaaaaagaaccuuucuuuaaccuaguguuaacuuuuuuaaaaaaauuaauuuuuuuuuuuaaagauggggucuuguuucaaacaggcuggagugcagugaauuuuuuugacucucauucaagugguguaaucauagcucacugcagcuucaaccucuugggcucaagugauccucuugccucagccuccugaguaacuaggacuacaggugcauacaaccacaucuggcuacuucuuauauuuuuuguagaguggggucuugcucucuugucuguguggccuugaacucuuggccucaagugauccuuccacuucagccucccaaaguguugggauuacagaugugaaccucugcacccagcuaaccuaguguuucuuaaucugaauguaagaaucagcuuuggugcaauuaaaaaguaugcaugcuuagguccuguacucuggagauugauucaguauaacuguaguggaacuugccuuaacuccugcaauuuguauuauuuauaauaaaaggcuccacagguaauucuaauggauuucuucacagucuaguugugcuguuuacuuaaucacaguuggggucauaggguaacuuaggguaccucugcagauuaugaucugagucaugucucauggauaccuaaggauaugggauauugcuuauaaaauauuucuucuuaaaaaaagggaaugaaauuauugcuuuuuuuaugauagugaagccacuuuaaagguuucauauacccuuucauauagcucagaguuaauauauuuugaucaguauuuuaugaaaaaauauuuuuucuauaauaugugcauguuaaugucucugaagcauuaguguuuaauuucuuuugaagauggcauggcagaggccauaagcuccugguuuuuugaaucuuguucauuuuuauauccuuguagugccugaauuaacuauaccuauuaaaucauaaucauauucucagaagggccaugaacauguagauauucuggaaacugagccuguagcucugacaguuuuuuuuuaaucaaauuuaauuaauuuauuuuucaauccuguuccuucucuaaguuauugcuuuuauuauugaaacuuuauuauuuaguaucaggagccuugaaaauguucauuuccuuuacacucaauagccuuuuaaggauucuauccagaggaaguaaugaaagauuuggacaaagcuuucugcacaaaaauaauuaucacauuaguacuuauaauugugguuuucugaauguguugggauuacugcugggugugugguauggugagauggggucccuccuaucaguuuuuggccaggucagcucuguuuuuauguuaggcuuccucagagcuuucucuugaugaaagaguuccaagucugaaaauguuugaaaauaccagcguauguaaaauauuagaauaauuaggaagaauauaaauaccuaguaauagggagaaggacaaguaaauuguguuguggucauguagaauguuaugaagucacuaaacauguuuaauaaggguuuuuaguagcacuaggaaaggauguaaaacugaauagacaguaugauuucaguaauuuaaacaauagauauguguggaacaaaguacucccauugcuugcuucuagauugugggaaugaggauaauauauauuuuuuuugccuuauacuuuuuuuuuuuuugagacagacccucacucuuguugcccaggcuggagugcaauggugcgauuuuggcucacugcaaccucugccucccagguucaagcgauucuccugccucagccucccgaguagcugggauuacaggugugagccgcugugccuggcccugacucauacuuuuuuauguuuccaguuuccacauugaccauagcugugccgauaaucagaaacaauuauuggugcuauaaacaguuaauugucccucauuauaaagcaauuaugaccucaauucaaaaaucuagaacagauuaaaaaaacccaaaggaaacaauauugaacaugaauauagaauaagucuuaaguacuaguaaauaagcuuauauuuauuuuaccucaucucaaaaaggauuuaauggacuggucgcaguggcucaugccuguaaucucagcacuuuaggagcuucaugcaagaggaucacuugagcccgggaguucgagaccauccuugccaauguagugagacccccaucuccacaaaaaauaaaaaagccaagugugguggugugcaccuguaauuccagcuacucaggagaaugaggugggaggaucacuugagccugggaagucaaaguugcagugagccaugguugcaucacuguacuccagccugagugacagagugagacucugucucaaaaacaaaaaaggauuuaaugaagugaaaugcauagauuaggaagaaggaagggaaacuggaaaacuaaggaaaacaaauuaaguuaauuaauauaaaacaugagaaacagagucuuaaauaccaggcuauggguaggccaaaaaaccugguugccaucauuccucucuuucccucauaccucacauccaaucucugauccauuaagucuuacuagcucugucuugaaggcauauuaccagaucucuccaauucccugucuccauuacuaccacuuuagucuaauccuauaucacuucaguguuaguagccacuaaagucucccagcuuccauuccauucuugacuggacuaguauaguagaaaaaggagcaaaauacagauacagggaugcaauauagaaucgugauuaagagagugaguucuggagccagauagggcuccuucacuuuaaagcugugugauuuugggcacauuauuuaaccucucugugucugucuuucccccucuauaaaaugggacugauaaaauucuccacucagauuauguggauggauuaaaugagugaaugaauguauaaagaacccuuagaauaguaucugguauuuaaaguguucaguguuagcuauuaucauuaaggucauuuauuucaauaggauagcaaaagaggaauugaaaaacaaauuuaacaggauaucuaauaaaaaacuuaaacuaaaaggaaacuuucguaucauuugaaggaauucacucaugcaucauaccaacagucaguguuguacauaauuaaggagcaacagagguaacaaucauauuauuauuuaauauuauccuagacauuuuugccaguuaaacuaaaauuaucaagacugcauuauaaggaagaggugggaauauugguguaguuuauaugacucuaccugaaacaaaaggaacuaacgaaaacuguuagauucauuuaauaauguucaguuuaaaguguuaaaugugaaagauaacuuuuucacaauaggaauaacaacaaauaauuagguguaguccaggaguuugagauugcagugagccagccaugaucuugccacuguacuccagccuggggacagagugagacugucucaaaaguaauaaaguuagggagagaugggccugaauauaaagaauaguauaaagcuuuucaagacauaacauuuaaguaagucaggccgguguaguguuuacaccuguaaucccagcacuuggggaggucaaggggggcuggaucaccugagcucaggaguucaagaacagccugaucaacauggcgaaaccccaucuuuaccaaaaauacaaaaaauaauuagccggguguagugagcaccuguggucccaguuacucaggaggcuaaggcaggaggaucaccugagccugggaggcggagguugcaacgagcuaaaaaucguaccacuguacuccaggcugggugacagugagauuccaucuuaaaaaaaauagaaauaagucagaaccacuaaauaauugguaaauauuucucaaauuuuucccacagagguuaaauaauuaguccaauuuauuuauuugccuacuuuagcuauuaagugagagagauguuaugcacacguaggcuaucugugcuuuuuuuuuuccuuuuacgccuuuugucuguuuuuguagaaacggggucuugccauguugccuaggcugguuucaaacuucuggccuuacgagauccuccugccuuggccuccccaagugcuaagauuaaaggugugagccacaggcaggugagccacugugcccagccuaaccaugcuuuuacaguaugaugcugccucccauacuuagaagccuguggaauugaguguggagccuguuuuaaguguauauuaguuaguguauuauuaauuuggcugccagugacagaaaaugcaaaacaacaguggcuuaaacaagauagaagucuuuucucucccucacauuaaugaauaaggaguuaaauggaauagaacuaguuugcagguccaggauaucucagaucucgucugcgucugucuuuuuuucugccaucuuuaguauacaggcuucaaguuagaugcuguagcuguagccauuaauuuugcauuuuugucaguaagaagguagagggacaaggucaagcgcaguggcucaugccuguaaucccagcacuuuggaagccugaggugggugcaucaccuaaggucaggaguuugagaccagccuggccaacauagugaaaccccaucucuacuaaaaauauaaaaaaauuagccaggugucauggcacacgccuguaaucccagcuacucaggagacugaggcaggagaaucacuugaaccugggagguggagguuccagugagccgauauugcaccacugcacuccagcuugggagacagagcgagacacuuggcucaaaaaauugaaaaaagaagguagagggauaaggauaaagaagccuccucauuuugaacuuuguaucuuuguuuaacuugagaaguguaauaguuuuucuuuuuuggaggccaggagucuaccuaaaauuuaaugcuuccaauacaaagaauggaugauaaggggcaacuagcaacuaagcagugaguaucuauauucaauauuuguugcuuucaguuauagcaaugacaaguuauuuauuuugaauuuuuuugggucuuuuuagccauugugaaugguucuuuaauauuguguguguguguauuauauauaauauauauagcaugugugcuuauuugauuuuauuucauacuugugaacauuagcuaccuuucuccaaaggaauaaaaaguguaaaguuuauugguacuaaugcaaucuuuaaacucuuaagauuuggucagaguauuaacaugcaugaauuucauuuuuauuauuauuuuuuagauggaguuucaucuuguugcccaggcuggagugcaauggugugaucuuggcucgcugcaaccuccgccuccuggguucaagugauucuccugccugagccucccgaguagcugggauuacaggcaccugcuaccaugcccagcuaauuuuuguauuuuuaguagagaugggguuucaccauguuggucaggcuggucucgaacuccugaccucaggugauccacccgccucggccuccuaaagugcugggauuacaggcgugagccaccaugccuggcugaauuucauuugaauucuuuugugucugguucugcuguguaguuauucuacuguuucucuucggaaaugagauguaaucuuuuugguuuauuuuauuaagggaagauuccaaaaaacuagccucagccgagauuuuugucaagcuugacuguguaucugucagguuuguuuauaccgaggaucacugaagcacucauaagggaaaugaagguauaaaaacugccuuuuuccuugcucccacuaacaaaugugagaaacuggccuuacuuuuuuuuuuuuuuuggagauggaguuuugcucuuguugcccaggcuggagugcaguggugcgaucucgucccccugcaaccucugacuucuggguucaagcgauucucccgccucagcuucccgaguaacugggauuacaggugugugccaggaugcccggcuaauuuuuguauuuuuaguagagacggguuuucaccaugcuggccgggcuggucacaaacuccugaacaucaggugauccacccaccucggccucccaaagugcugggauuacaggcgugagccaccaugcccggcugagaaacuggcuuuuuuuaagagaauguuuuaguuauucacucuuucccguuauuuuucacaacuauuauaauucauuccucaguuagcaguggcuuuaucaguaauucagaauauuuuuucaaagacaugucaaaucuuucaucacaauaggcaaauauauagaagaccugaugcauaaaucuuucagacuucaccaaucucuauguugcccauucauuuucucugagaaagggguccacuaguguuuuuuuuuuuaagagauaggguuuugcuaugaugcacaggcuggucuaaaacucuugggcucaagcagugcuucugccuaagccuccuaaguagcuaggacuacaggcgaaugugaguccacccagcuuggaguuuguuaguuuuuuuuuuuuuuuuuuuuucuuuuuuagagacaaggucuucccauguugccaaggcuggucucgaacuccugggcucaagaaaucugccugccauggccucccaaagugcugggauuauaguugucagccacugugccuggccugagucugcuaguuuugacuugaguacugaugaaaacuuuaaugcuacuuucucauuccuccaguuucugcuuguuaaaauucuguguacccuuuagggaccauuugaaauauaauuuccucuaagcaaccucuccagaugcuagcugcauuugcuacuucccaggcuugguuucuggcuucuuguuguuaaaucauuauuugugugcuuguccuaacucccuuaccuuucuuuuccaaucauauauuaagaccucaaguacaggaacuuuuguaugaaagguaugguaguuuuuuaaaaguccugugucuucuaaugcaauaccuuauaaaugguauguacagaguacauauuuguuaaauggaauugaacauuuuugguuuuuauaaaugaaaagcuugugacauucaaauguguuuuuucuuuaugacacauagcccuuaguuucuauauggaaaauggaaguagguauggaagugugaacaaaggaaaugugagcauagaacuguaaauaaacaucuauuuccauaagaaccauuauacaugccuugcccuaaccuuacaauuuagauacauuauaguuuaauaauuguaagagcugccucaagauagagaugacuuaguuaauuaaauuuauagauuaaaacuuuauucucgcuuuauuuugauagcuuaugaaccuaccuggcaaaugaaucagaaaaaguuguaguuuucuuuccuuaaaacagucacacaauacuuucuaaaaagugugauuguuuuuauuaagguguaacuauuuguuuuuuuauuuuuauuuuguggaaauaaggucuugcuguguugcucagguuggucucaaaacuccuggccucaagccgcuuuccugucuuggccucccaaagugcuggauaacaggugugaaccaccauaccuugcuuuuaagguguuauuuaauauaauaaugugcacagaucuuaaagguucaguuuggugaauuuugacaguuguauauauuaugugaaaccaccaucccaaauaagguacagaacauuucugucaucucuauaguuccuugugccccuccuaguuacaauacuguuuacaaaugauuuuuuuuuuuggccagaugcaguggcucacaccuguaauuccaacacuuugggaggccagggcggguggaucaguugaggucaugaguucaagaccaaccuggccaacauggccaaaccccaucucuacuaaaaauacaaaaauuauccggguguguuggcacgcaccuguaauuccagcuacucgggaggcugagacaugagaaucacuugaaccugggagguggagguuguagugagcugauaucaugccaccguacuccugccugggcuacagaaugagacuccgucuugauuugaaaaaaacaauuugauagcucuaaaauuggaagcaaaauuaccagaguacuuacuaguagguacguuauaaaccacacugucccaacugugauuaauuuuuuuguuucuuauauguauuuuacuucaguuacuaguuaguaguuggauuuaguuuuacugcuaaaggcacuauauuaaaaauauuaauuauauuauaauuucuuuuugauaaacuuuuuuuuacuuauuuuauuccauuuuguuuaucuauaaugguaauaaaauuguucuuuccaguagaauuugaaggauuaugauuauuuuucuuagaacuaaguaaaaaaaaaauucaagugggaaguaucagagaaaacaggugaaaaaucaucuuuuggcuggaugcuauggcacaugucuguaaucccagcacuuugggaggcugaggcgggcagaucaucugaggucaggaguucgagaccagccuggccaacauggugaaacucugucucuacuaaaaauacaaaaauuaucugggcgugguggagcacgccuguaaucccagcuacucgggaagcugaggcaggagaauugcuugaacccgggagguggagguugcagugagcugagaucuugccauugcacuccagccugggugacaagagugagacuccaucucaaagcaaaacaaaacaaaacaaaacaucuuuuaaccauuucuauuacuuguucaugauucuaauuuuuuuuuuuuagggaugaaggagguucuaacucauaauuaaauggaaacuuuaggauuacugaggauuuucauuaucuuugcuauccuguuucccauuacuacagaaaauagaaaguuggauuuuuaugacuguaacuaagggcuggauguaacagcagcuuucuaguugugagcaccuguucuccaugaacucugucugacucccuggcuagcacguucugugguggggaguccaaguuugggccaccacuguguugcuuugucuucuggucugaggcaucucauccccuuggccuugaucauugccagccaccuguaucagucagucucuuucccugauacauggggagaggcugaagaauucaaagcgggagaaaacuaucuuuuaguucccaggaguugauguaagaauaaggugauucauguaaacacgcaacauaggacucauacuaggcacucagaauggcuggguuuuaucauuguuuucaucaucaauaccaauauuugaucaauaaccaauuuaaauuuaauugaaguugacuucaauuaaagaagaaaaguuuuaaaaaauugguaugagaaaacuuaacuauuuuaacuucaaaguagaauuaauguccuuuaaaacagaguaauuuaauuacgccugcaagguuaugucagcagaggaugcuagaagcuguguuccaaaacccagugacuauguuccuuaggguuucgaaacugcuaaugugugaaaaugggcacuagggggcaauagaagcucuuuggcaagcauccaguuuuucccuuugccugucuauaguggaaggaaaaaaaagaaucuuuuauaaauaaugucuucuacagacuggaacaagugaguuugagauugagauuaguguuggaauaauuacuuuuuuuucucugaagaagaaugcagaaaaauucucucaaauauauuuaaaauuuuaucuuaagcuuuuuagauaaguaacagagauuccugacugggcaccguggcucacaccuguaaucccagcacuuugggaggcugaggugggcagaucaugaggucaggaaauggagaccauccuggcgaauauggugaaucccugucucuacuaaaaauagaaaaauuaccugggcaugguggcgugugccugugaucccagcuacuugggaggcugaggcaggagaaucauuuugaaccagggaggcggagguugcagugagccgagaucgcaccacugcacuccagccuggcgacagagcgagacucugucucaaaaaaaaaaaaaaaaagauuccuaugugggaauuuuaaggauagcuuccucauacuuuaauauugaagucuauaaaguugaauaagguuuauuucugugaucauuagucuaauccaaacuuuugaaaauauauaucagaucuugccgggcacaguggcucacgucuguaaucccagcacuuugggaugccaaggcggauggaucaccugagauugguaguucgagaccagccugaccaacacggagaaacccugucucuacuaaaaauacaaaauuagccaggcgugguagugcaugcuuguaaucccagcuauuugggaggcugaggcaggagaaucgcuugaacucaggaggcggagguugcggugagccuugauugcgcauugcacuccagccugggcaacaggagcaaaacucugucucaaaaaaaaaaaaaaaaaaagaaaauauauaucagaucuugucacuucucugcuccaaacgucugguuucuuccuaucacuucagguucuuugccuuggccucugcaaaucacacugacuuuauccccuucuacccccuggcuugcucacuccucucuagccacauugaucuuucugguuuucuuuggagaccucuauucuuauucccgcauggaaacuuucuauuuacucuuucuuccacauggaauaauacccagaacuucacauggcucccuuauuuugcuuggaucugugcucaaguguuaccuucucuguccaucuuauauagguccccccugcuccccaucccaccucuuuuccuaucacugcuuuaugguacuuaucauuaucugacauuuuuguguauugguuuauugucuuucuucacauaagaauguaaguucuaugaggacagucuguuuuuuuuuuuuuuuuuuuacugcuguauccucaguggcuugacagauaccuagcacauaguagguacucaagaaauauuaguugaaugaauggaauggccauccuuggcugugggcauggcuacuuucuuccuaaacauuucauugaaucaaaguuagcuucugaucuagucacaauuauucuuuuuuuuuuuauuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacuuuuaaggagcaugcugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguacagaacaaaaugaaaagucucccaugucuacuucuuucuacacagacacagcaaccauccgauuucucaaucuuuuccccaccuuuccccuuuucuauuccacaaaaccgccauugucaucauggcccguucucaaugagcuguuggguacaccucccagacggggugguggccgggcagaggggcuccucacuucccaguaggggcggccgggcagaggcaccccucaccucccggacggggcggcuggccgggcggggggcugacccccccaccucccucccggacggggcggcuggccgggccgggggcugauccccccaccucccucccggaaggggcggcuggggguggggggggccugacccccccaccucaccucccucccggguggggcggcuggccgggcagggggcugaccccccaccucccucccggacggggcggcuggccgggcgaggggcugaccccccccaccucccucccggacggggcggcuggccgggcggggggcugacccccccaccucccucccgccgggcggaggggcuccucacuucucagacggggcggcugccagguggaggggcuccucacuucucagacggggcggcugccgggcggagggucuccucacuucucagacggggcggccgggcagagacgcuccucaccucccagacggggucgcggccgggcagaggcgcuccucacaucccagacggggcggcggggcagagacgcuccccacaucucagacgaugggccgccgggcagagacgcuccucacuuccuagaugggcuggcggccgggaagaggcgcuucucacuuccuggaugggauggcggccuggcagagacgcuccucacuuuccagacugggcagccaggcagaggggcuccucacaucccagacgaugggcggccaggcagagacgcuccucacuucccagacgggguggcggccgggcagaggcugcaaucuuggcacuuugggaggccaaggcaggcagcugggagguggagguuguagcgagccgagaucacgccacugcacuccagccugggcaccacugagcacugagugaacgagacuccgucugcaaucccggcaccucgggaggccgaggcuggcggaucacucgcuguuaggagcuggagaccagccugggcaacacagcgaaaccccgucuccaccaaaaaaauacgaaaaccagucaggcguggcggcgcgccugcaauugcaggcacuggguagacugaggcaggagaaucaggcagggagguugcagugagccgagauggcagcaguacaguccagcuucggcucggcaucagagggagaucguggaaagagagggagagggagaucguggggagagggagagggagaucguggggagagggagagggagagggcuugggagagggcuucuuuuuuuuuuuuuuuugagauaguuucccugugucacccaggcuggagugcaauggggugauaucggcucacugcaagccccaccucccaggcucaagcgauuuucgugccucagcccccugaguaacugagauuacaggcaugugccaccaugccuggcuaauuuuuguaauuuuaguagagucaggguuuugccaucuuggccaggcuggucucaaacuccucaagugaucugccagccuuggccuccuaaagugcugggauuacaggcguuagccaccgugcccagccacaguuacucuuuagaagcugagaagcuaauacuccacuuacacauuucuaggcuaguccuccacaauuaugucaaaagugugcagucuuuuuaaagcucccuuuccagguaagcuuuuguauccucucaaggguuguuucugccucugagcagugguuuuuauuuugcucaacaaauauuuugugcaucugcuaugugauggacacugcuaguauggaucaaaaugaggauacuuuaaggaagauggacuaaguuauaaagauaauccaaagcauacuuuaagugcagugacaaauauggggguacuuuuuaucugacuuugauuauagucucuuuacuuacaaguuuuuguuuuuuucuuuuuuugagacagggucuugcucugucacucagacuagagugcaguggcaugcucacuacucagcugcagcuuugaucuuccaggcucaagcaauccucccaucucagucucccuaguagcuggaacuacaggugggcgccaccaugcccggcuaauuuuucuguguuuucuagagauggaguuuccucauauugcccaggcuggucucgaacuccugggcucaggugaucugccugucucagccucccaaagugcuaggauuacagguaugagucacugcacccggccaccacccccaccgacguuuuuuuuuuuuuuaagagacagcguauugcucuguugcccagccuggagugcaguggcacaaucauagcucacugugaccucaaauuccugggcuuaagugauucuccugucucagccuucugaguggcugagacugcaggcgugcacccccaugccgagcuaauuauuuuauuaccuuauucuuuguagagguggagucuugcuauguugccuaggcuggucuugagcuccuuggcucaagugauccucuugccuuggccucgcaaaguccugggauuauagacaugaaccacugcgcccaauacaaguuauuuuaauguccagguauucagcaguaaacucugguaaacaucugucaauuuaguguauacauagcaaauugcaaaacuugcagauuuaaguaagugcgccauuaaguaaguggaaaugauguuaaagaaguucuccacuccacccaaagcauuguaaagugaggaacugguugaacuagagcaguuaguuccugauuggaaaagagaaaauugacaagaaugauacgugauuugaauaucacaggauuuugaaaaaauugaaguuucuauaaaauaauacuugauucauucuuuguggauucuaacauuuacuauauuaugagauuuguuaugacuuaaauuuugaauuaugaauuuuauuuuauuuuauuuuauucaggauuaaauaaaccuugaccuaaaaauuuuaauuuuauuuuaagauauuuuaguguaaucuuuuuauacccccucuucagugaaaauuugaaucuccuguuuuuuugagauggagucucgcucugucgcccaggcuggagugcaguggcgugaucucggcucacugcaagcuccgccucccggguucaugccauucuccugccuuagccuccugaguagcugggacuacaggcaaccgccaccacgccuggcuaauuuuuucuauuuuuuaguagagacgggguuucaccguguuagccaggaugguaaucuccuuuucuccuuuuuaguugacuacuucucuuauaaucaugaaaaaaaguuaggauguucuccuuuguaucauuuaucauuucuuauagccauauaccuucuucuauauucauagaacucuuguucaguuuucaaaaaucucuuggcauaucuaguacuuucuaaaaacuuuuuuucuguuacccaaggauauuuacuaucaucaguaauuuuucuucuucuuuuuuuuccuuuugaaauggagucucuuugucacucaggcuggagugccguggugugaucuuggcucugcucacugcaaccuccgccuccuagguucaagcaauucuccugccucagccuccuggguagcugggauuacaggcaccugccaacucgccuggcuaauauuuguacuuuugguagagacaggguuucaccauguuggccaggcuggucuccgacuucuggccucaagggaucugcccgccuuggccucccaaagugcugggauuacaggugugagccaccauguugggcccaguaauuucuguaaaguaauggaaugcucauuuuaaaaaaucuuucacuuucauuucucuuuuccuauuuuacuuccuuaugucuuccuguauaagcccccaccucuuugcuguuuaacucauguuucauuuuacguuaaaguguuucuuuuuuuuuuuugagacagaaucucacucugucuuccaggcuggagugcaguggcgcaaucuuggcucgcugcaacuuccguccugggguucaagcgauucuccugccucagccuccugaguagcuggguuuauaggcgccugccaccgugcccggcuaauuuuuguauuuuuaguagagacgggguuucaccaucuuggccaggcuggucuugaacuccugaccuggugauccaccugccucagccucccaaagugcugggauuacaggugugagccaccgcgcccagcugcuuuucuuuuuuuaaaaacugaauuuaggcugggcaugguggcucaugccuguaaucccagcacuuugggaggccaagguggguggaucaccugaaaucagaaguucgagaccagccaggccaacauggcgaaacuccaucucuacuaaaaauacaaaaaauuaaccgggugcgguggcaggugccuguaaucccugcuacuugggaggcugaggcaggagaauugcuugaaccugggagguggagguuacagugagcagcgccauugcacuccagucugggcgacacaacgagacucugucucaaaaacaaaaacugaauuuagugcaauuauauuuuucgcuuuguuuguuucucucaguuuacuauuuauuaaauuuauuuugggcuacuuuauuuauugauuacauuucuuuuugagauggggucucacuguguugcccaggccagucuugaguuccuggggucaagugaucugccccccucagacuuucaaagugcugggauuacaggcgugagccaccgugccuggcccauauuuuguuuucuaccuuaacagcuaaagaaaguauucuuggucagccacaguggcucucaucucuaaucccagugcuuugggaggccgaggugggaggauuacuugaggcugggaguucaagaccagccugggcaacauagacccagucucuacaaaauaaauuaauaaauaaauaaaaagagaaaaaaguaaguauucuuagaagcaagaaucagguaauuauuuuaugacuccucuaaauauuaaugaagacagccagaggaacagacauaucaauuugcacuuuaguaguaguaacacaguguuugaaaguaaaauaguuuccuugaucuuucaccuuuuguugacguguauacaaguagauuugccugugccaaucuugaaaaagauuuguuuuuuucuuuuuucuuuuuuagacacagauucuugcucuguugcccaggcuagaauauagugguauuaucauaacucacugcaaccucgaacuccugggcuuaagugaucuuucugcucuagccuccugagcagcuaggaacaaaggugcaugccaccaugcccagcuauuuuuuguacagauggggucuucauauguuccucaggcuguucccgaacucauggcuuuaaaugauccucucacuuugggaggaugacaugagguugagaguuugagaccagccuggccaacauggugaaaccccgucucuacuaaaaauacaaaaaaauaagccgagugugcugguacgugccuguagucccagcuacucgggaggcuaaggcaggagaaucacuugaacccaggaggcagagguugcagugagccgagaucacgccaccacuucagccugggcaacagaguaagacucugucucaaaaacaaaaaauaaauaaaagaauuaugacaugaaauaagcauaugcacuauagcaccaacaguucaacaguuagcggauccuucuuuugugcaauuuucuaaacaauuaagaugaauuaacucauauaauccuccuacugcuccagugaaguggagguacaguuauccauccccuuucgacaggugaggaaacuaguauucggaagugcuaaguucucuaaggccacgcagugguaaauggcggagucagguuucaaauuuagggaagcuacuccagaauccaugugcuuaaccauuaugcccuacuacacuacugguugugaccuguucugcuucucagggucaucucgaaucucuccuacauuugccucaugcccuaucuguguaaacugugaacagucuuugguucugacuguuucaugcauuccagaauacuuuuucuucucucuggaugcugaucaauacuuaguacaccucuauucaguggcauucuauguaagcugugacgcuuguaagguacuuugugacagaccuaucucuuucaucaaggaagaccuuuuucauuuuucagaauuauuuuucccugugaaaacagagcauuuucuccuugugaaaaucuucacugacucacaaaagugguguugaauaccuucucuuuugugcuaccucugauuuguuauauuccugucuuacauuuuuaguaacagaacuguggagauaucagggugaaguguguauuaaucuuuauucuacuucuaaaaagaugcuuuguuuccuaaaugaaucaaucaacaaauauucuuuguagagagaaggcuaaggauuugaggcuuugagaagaugguucagguuguuaauuugugugcaugagaaugggguauacaugagguugguauugccacugacauccuagaugagggacuuuuucagaaauaggaaaaauggugcaacucagacccagcucagcaggugaaauucucccucucucuuggugguuguaaaagaaagucuucuccuuggggugggagugagagugugggagggaggaguuucauuacagggucccaggaagccaggucgcuacuucuuaguucuguuacaggccauccuucucccuggcaagcucagcuucucucuucuuucauuccuaccuggaaugguuaauacugaggguaaaggauaaggauggauucuuaauacaaauauuaauaaguaauaaaugaaaaauaccacugcaaaugauaggcucuuuagagauuaguaucuuauaacaaaauacaaguauuugcuuucuaauuauguaagaaacuucugaaauguuaauuuuguuuaacuuuaccugaaacaguagucaaauguuguagaaaacuuuccuuuuuucuuuuuuuuuuuuugagacagagucucacucugucgcccaggccggaguagugcaguggugcaauaucgacuuaugcaaucuccacuucccggacucaagugauucuccagccucagccuccagaguagcugggacuauaggcaugaaccucuaugccuggcuaauuuuuuuguuuuauuuuauuuauuuauauauauuuuuuagacagagucucacucugucacccaggcuggagugcacuggcgcgaucucugcucccugcaaccuccaccuccuggguucaagugauucuugugccucagccucccgaguagcugggauuacaggugcaugccaccacacccagcuaauuuuuguauuuuuaguagagacagaguuucaucauguuggccaggcuugucuugaacucccgaccucaggugauccgccugccuccucagccucucaaaguguugggauuaucgguguaagccacugcacccagcccucagcuaaauuuuuuuuguauuuuuuguagaaacgggguuuugccauguugcucaggcuggucucgaacuccugagcucaaaucgaucugcccgccucagccucccaaacugcugagauuauacuugugagccacugcaccuggccaaaugugaaaacuuucuuaaacaaaaugcgggaauguugugaaaaguuuuugauugcuaccaaggugguggagagccauugaagguuuuugaugaaaaaugaccuaugaagaauaguauuguagagagcaguguggaaagaagugaagaggauggaagugagggggggccuucucagugacaagguaguguucacaguuccagaugugaauaaauucaaaguaaauuaugucauauaauucaugguaacuaaccucuuucacuuuuauaauugacaaagcugagguuuggugugguuaaacaacuuacugaagguuacaaguggaguuaaauauagauuccugucuagauuccagaauuucugacuuaggaagcaaauaagaaggagaguuacugugguggaguguucauggccaguauaauaaacaaaaacauuaaaaaaaaaaaagaagaaaaggaaaaaacaagggaagaaaaaggaagaacaagaguugcuaauauaggauuucuuguaugauuuucaacuaccauaguuucauuggcaauaaucauugcuuuuuuaaaaucaugacagaauuauaaauugaaacacugauuugcugcugcuuagguuguuuaaauguuuguuuuuuuuugucuuuuuuuuuuuuuuuuuuagauggugucuugcacugucucccaggcuggugugcaguggcgcuaucuuggcucauugcaacuucugccucuuagguucaagcuauuugccugccucagcuucccagguagcuaggauuacaggcagccgccaccacaccuggcuaauuuuuguguauuuuuaguagagaugggguuucacuguuggccaggcuguucucaaacuccugaccucgugguccgcccgccucggccucccaaagugcugggauuacaggugugaaccaccacacccagccuauucuugaacucccgguggcucaugccuauaaucccagcacuuugggaggccgaggcgggcagaucaccugaggucaggaguucaagaccagccuggccaacauggugaaacccugccucuacuaaaaauacaaaaauuagcugggcaagguggugcaugcuuguaauccugucuacucggguggcugaggcaggagaaucgcuugaacacgagaaguggagguugcagugagcugagaucacgccacugcauuccagccguggcggcagagggagacuccaucucaaaaaaaaaaaaaaaaaaaaaaaacaaagacaaaaaaaaauuaucuauuuauaaauauauugcugcuuguguguuuuuggaauuaaaguguucuuacagaugucucugugugguuagcaguucuuagaauugccuagguagcaugcaguaauacuaaauauaauuauaaaggcuacuagauggaucuuauugaccaaaagacaugccaaauggaggcaucaguacugcacuuugcaagugacaauuuaauuuuuuuccauuuuuuuuuuuuuaagggacagggucuugcucuguugcccaggcuggaguacaguggcgugaucacggcucacuguagccuuaagcuuccaggcucaagugauccuuccaccucugcuugcugaguagcugaaacuacaagugcgcaccaccaugcccggcuaauuuuuuuauuuucguuuuuguagagacggagucuugcucuguugcccaagcuggacuuggacuccuggacucgagcaguccuucugccucaccucccaaaguacugggauuacaggcaugagucaccaugcccaaccaacaguguaguuucaacagaauaucacucaucaaauuaacuuugcguugaugugaauuaacauuuuauuuguuuuauaguuauauuuaauuuguaauuuuuuccagcuuuuugucaaaaaaguauuuuuuuauaugugccuacuauaagcugaacauuguucuagguaccuagauacaucagagaacaaaacagacaaaaaaaaucuugcuuuuauggaacuugcauucuaauagggagaaauagauaauaaaggcugggugcgguggcucacgccuguaaucccagcacuuugggaggccaagguggguggggcucacuugagcccaggaguucaagaauagccugugcaacauggcaaaacccugucucuacaaaaaauagaaaaauuagcugugcguggucaugcaggccuguggucccagccacucaggcggcuaagguggaaggaucaucuaagucuggggcaguugagacugcagugagugagccaugauugugccucugcacuccagcuugggugacagagugagacccuaucucaaaaaaacaacaaagaagauaaauauaaacaauagaaagcuguaagugcuauagggaaagggaacauguagagcacgauaacauggaucagaagugcuaacugggagacagguuguaauuuaaaauagggcggucaaguuaggccuccuucagaagaugaccuuugagaagacuugaaagagauuaggaaguugaccauguagauaucugggagaauggugcaggcauaaggaacagcuaguguaaaggcccuaaggcaguaaugugccuggcacguucaugaaaaaagcucuuaggugaguauggcuggaacagaaugaacaagagggagagaaggaggagaugacugacaucagaacacuaacaggaggaccuguaggcaauuguaaaggcuuuuccuuuuaugcuguuuuuuuucuuuuuucccccuaagccuuaguuugucuauaauuauaaugauuuugagcaugauuuuugaguaauggcauaauuugaaagaugcuuuuuaggaagaauggaaaugacuugguaauugauuauauaaguguggugagagggacucaucaagauuauuaguuuuguagcugguagauaguggcaguaguugcugagauagaaagcaggaugagcagaguuuggaggcugagugauagggaagauuguaaauucaguuuuggacaauuaaguugagguauuucugagacauccaggcaaagcauccugaugacugcuagaaauauagguuuguuguugagagacauauagccugggauuauagauuuuagagucaucagcauauguauggcuauugaagcucugacaaugaacaagaugagcagaaagccuaggacagaaccccgagggacagauagagaaggaagauccugcacagguggccaagaaggagguagaagguaaaucaggguaauaagugucauggaaaccaaaaggaagauugugauaggaaaaaaauguguggucaauuguaucagaauuagaugaaguaaaaugagaagcaucuuuauuauauuuaaugacaaaguguaauuauuuuaacuuuaagcaguaauucagauuauaugagauuacuucacaguuuguuuuuuugccaaaucaaaacaucuuuacuguuuuaguuaucuacuucuauguaacaaaccaccuuaaacuuagugauuuaaaagaauagccaguauaauuuuucucaugacuauaaguugacuggagguuagcugcuucuucuggucuuacuuugaaucucucguguagcugcaguuagcauauagcauguucaccacggccuuacuuacauagcgggugccuuggugggacagcuggaaggcuggcuccguugaaacuuggggaaagcaccuucccucucucuagucuuuccaacaguguauccagacuucuuacuugaugauucugcauggaagaagacaacaagggugugaauauugagagaugugauuucuugaggccauuuuuggagacuaauuaacauauccaccuaaaaguaguugccuuaaagccuaaucuagguucuuuuuuuuuuuuuugagauggggucucucuugccagacuggaauacagucacggcucacuguagccuugaccuuccaggcucaaaugaucccaccucagucucccgaguagcugggaauacgggugugcacaaccaugcccagcuaauuuuuaaauuuuuuuuagagaugggguuucgcuguauugcccagguuggucucaaacucaugggcucaagugauauuccugccuuggucucugaaaguuuuagaauuacaggcuaccacgcucagcuuuaucuagauuuuugaacucuuuaaaaagaaacacguuggcugggcgcgguggcucacgccuauaaucccaacacuuugggaggcugaggcgggcggaucacgaggucaggagaucgagaccaucuuggcuaacacggugaaaccccgucucuacuaaaaauacaaaaaauuagcugggcgugguggcgggcgccuguaauccuagcuacucaggaggcugagggaggagaauggcaugaacccgggaggcggagcuugcacugagcggagauagcuccacugcaguccggccugggcgaaagagcgagacuccaucucaaaaauaaaaaauaaaaaaaaaaagaaacacgucauuucauugauucuuauacacaugcacacauagacguguauauguacauacauguacauguacacacacaugcauaaacacaugcacacaugcuugcacacauacauuucucuuuuuauuccuaauaggauucucaguauguaacuguucaggauaaaagauacauuucccagcugggcaugguggcucacaccaguaauccaugcacuuugggagggcgagguggguggaucgcuugaggaucaccugaggucaggaguucgagaccagccuggccaaccugaugaaacuccgucucugcuaaaaauacaaaaaauagcugggcgugguggcgcgcgccuguaaucccagcuacucaggagacugaaccugggagguggagguuucagugagcugagaucgugccacugcacuccagucugggcaacaagagugaaacuccgucucauaaaagaaaaagauacauuuccgagcuuuuccuguugcuagguauggcucuguggcuuaguucuggacagugaaauguaagugcaagaauauggacaacuuuugagaggaaaauuaaugggaagagauguauccuccuuuuuuuuuuuuuucccugcugucuggaaaccacagcagccuuuuggaccaucaccuagacuuguugaauuuaugagggcaacaagcugugguccugauugucuuagacauaugucaguccugacuuuauuuuggguuuuuguuacagccaaaacuaauucuaucaggcuuuuguuuuguuguuguuguuuuuguuuuuucauuaaaaaaauaaccaguuuugcuuuucugcagauaucagcaaaaaaaguaaaaauuaguuuuaucgagguauaguuuacacacaguaaaaugcaaccaauuuaugaguauaguuugugaaauuuuaaaaauguaagcaucugaguaaucacuacuacaaucaagauuuagaacauuuccaaaaauguuucuuucaagccaccuugcugucaauccauuuuucccuccauuuaccccuaaucccaggcaaaucuguuuuaugucacuauagguuaauuuagcccauucuagaauuuuauauaaauggaaacacuguacaaacucuucuguguuugacuuacuuugcacagcauaaugcuuuugagacuugcccaucuugucucauguguuagugcuuuguucauuuuuauugcuaaguaguaguauguuuaugaaucuaccauagauuauucaucuuuugauagacaaauagcuuguucuugguuuuuggcuauucuguauaaagcuacugugaucauucuuguacaggucuuuuuguagauauauguuuuuauuucucuuggaagcaaaauugcuagaucaugugguaaguguauauuuauaagaaacuagcaaacuguuuuuuagagugauuauuaccauuuuacacucucaccugcaaaauuggagaauucugccuccuccauauccuugccuacacuugguauuguugauaauuuuaauguuagcuauuccaguaaguguguagugcuguuuaauuguggcuuuaguuugcaauugcuuguugacugacauuaaaccucuuuucuugugaugaggugucacuguguugccuaggcuggacucaaacaccugggcucaagcaauuccuucugccuuaggcuccugagugucugggacugcaaugugcaucgcugugccuggcuaaugugugcaucauuugugaagugucuguucaaaucuuuuguccauuugaaaaauuagguugccuuuuuauugaguuuuagaguuuagaguuuauuuugagcuuaaauauuuuggauagaaguauuuugucacauaaauguauuguaaauaucuuuguccagucugagucugccuuuuauuuuccugaucaugucuguugaggauagaaauuuuaaauuuugauaaaauaugucaguuuuuuuuucuuuuugguguguauuuuuuguauucuaagaaaucuuuccuuaccaaugauugcaaaaauuuuuccuauacuuucucauuguuuuauagguuuaguuuuuacauuuauuaccuguuucaaguuaauuuuuauguaugguguaaggaaaggauuggaguuccuuuuuuauuuuuuccaaauugauacccaauuguuugaguauuguuuguuuaaaaggucuucucauuuggauuaucuuggcauuuuucuugaaaacaaauuuguauauguguggguuaauuucugauuuguuuauuucauugauaugcauggccauucuuacucuacuaucacaaugucucaguuacuguagcucaguuacugucuuaguuacuauagcucuauacaugaaaucauguaguguacaguucucugacuuguuuguuuugaaaacugauuugguuacucugagucuucaaauuuacaaauacauuuuagaauuagcuuguaaauuuguacagaacugccugcugagauuuugguugagauuguauugaaucuguagauuaguuuugagagccuuacuuuccuaacaauauuaaguuuuccaauccauaaacauuauauaucuuuccauuuauuuuaaguucuccuuaauuuuucucaguaacauaguguuaaguguacaggucuugcacauauuuuaaaaaauuauuucuaaguuuuaauguuuuuuguuauuaucuuaaauggcgugaaccacugcacccagccuguuuuaaaguuuuauuugugaacuuuccaauguccuaacuaauauaucucuuagagguaaaccuaguuccaauacaccuuuuuauaaaauaucuuuauugggauguaaggucagagaaagggagugauaagaugaaaguaaaguggucuacuaauaagguagaaaacagugugacugagugugaucugaagagagaacuguuguaguuaaagauuuguauaucuugguuugugguuuuagaaucaaagcagcacugggugucaauuaauucuagaauuggacaugaggguaaauggcugaauaaugguaaagaaaaugaaagacuaguguauugaaugcguuuuccacauugauuaaaaucgcccuguacuaaugaaguuuuuacuguuguaauuaauuaauacuuuguguauagauuuuuuucuuuucuuuuuuucuuuuuuuugauacggagucucgcucuguugcccaggcuggagugcaguggcaugaucucagcucacugcaaccuccgcuuccuggguuuaagcgauucucccaccucaggcucccaaguagcugggauuacaagccugcgccaccacacccagcuaauuuuuguaucuuuaguagugacgggguuucaccauguuggccaggcuggucucaaacuccugaccucaagugauccaccugccucggccucccaacugcugggauuacagaugcgagccaccgugcccagcauguguauguauacaguuuuuuuuuccuucuaucguccagguuggagugcaguggcgcaaucuuggcugacugcaaccucugccucccggguucaggccauccuccugccucaaccuccuggguagcugggacuacaggcuugugccaccaugucuggcuaauuuuuguauuuuuacuagugaugggguuucacuguguuggcuaggcuggucuggaacuccugaccuuaggugaucaggcugccuuggccucccaaagcguugggauugcaggcaugagccccugugccuggccauauauauuuaaaguucugacugucaucggauugcaagauucaugaaggcaggaaccuucuuucuuuaaaaccagaauaucaucagugcuaggcauagucaguacucaauaaauauuuauugaauaguuaauuauaagagugacgucagggcuuuggguggagaguaacagagcuaucuuuauuucuucacaucuuaaguccuuaagaucucuuauauaauuccucuuuuuuuuucuuuuuuccauucccacuguauuaugucaauucagguccucucuggauuauugcaagaauauuuuaauaggcuucccugugcuuacacuggcauuuaccuuauacugguaauuuccuaguucagccuccacaccacagccuugaugauuuuuuaauuauuaauuuuauugugcuaaaaacacauaacauaaaguuuaccgucuuaaccauuuuuaaguguacaauucaguauuguuacauauauucacauuauuguacaaucaauccccagaacuuuuucauuuugcuaacugaaacucuauauccauuaaauagcaacucccaguuuccuccugcccccagccccuggcagcaaccauucugcuuucuaucucuauuaaucggacugcucuagcacauauaaguggaaccauauaguauuugucuuuuucuaacugauguauuuuacuuaauauaaugucuucaagguucaucuguguuguagcaugugucggaauuuucuuucuuuuaagacggaaaaauauucuguuuuauguuuaugucacguuuuguugauuaauucauccaucaguggauacuuggguugcuuuucaccucuugguuguugugaauacuacugugaacguggauguacaaauagcucuucaagacucugcuuucaauucuuuuggguauauacccagaauuggaauugcuggaucauacaguaauuauauuuuuaauuuucugagauacuaccaagcuguuuuccguaguagcuauaccauuuuacauuccuaccaacauugcacaaggauuccaguuucuuuaccuccuuaccaacacuuguuauuuucuguuuauuugauaguaaaaguuuuuugauccuagugugaagugauauuucauugugcuuuuaauuugcauuuccuuaauuauuagugaugcugagcaucuuuucaugugcuuauuggccauuuguuuaccuucuuuggagaaaugccuguucaagucuuuugcucauuuuauuuuuaucuuugagacguagucucgcucuguggcccaggcuggagugcaguggcgugaucucggcucacugcaaccuccgccuccugaguucaagcgauucuccugccucagccuccugaguagcugggacuacaggcgugugccaccacgcccggcuaauuuuuguauuuuuuuuuuuuuuacuagagaugggguuucgccguguuagccaggauggucucgaucuccugaccuugugauccgcccaccucagccucccaaagugcugggauuacaggcaugagccaccgcgcccggccuuugagccaccgcgcccggccuuucuggcuaacuuuuuguauuuuaguagagacgggauuuugccauguuggccaggguggucuugaucuccugaccuuccucgugaucugccugccuuggccuccgaaagugcugggauuauaggcgugagccaccgcacccggccuuuugcucauuuuaaaaugaggugguuuguuuuuuucuguuguugagcuguagaaauuaaaaaacauauauaaucuggauuuuaaucccuuauauauaagauuugcgcaaauuuucucccauuucucuguagauugucuuuuuacuguauugauuaucucuuuugaugcccagaacaccuuggcgauauuuuaaaaucucagauuuuuuuuuguuguuguugaacagagucucagucaccugggcuggaguacaguggcacgaucuuggcucauugcaacccucaccuccuagguucaagcaauucaugugccucagccucccaaguaguuagaauuacaggugugugcuaccacgccuggcuaauuuuuguauuuuuaguagagaugggguuucaccauguuggucaggcuggucucaaacuccuggccucaagugauccgccuaccuuggccuuacaaaguacugggauuacaggcaugagccaccgugccuggccuaaaaucucagacuuuaucaaauuacuuucuaugacucagagcuuaaacuucuguuuuuuggaauuguauacagccugauuuggaacucucucucuggcuuuuauguauacaguuggcccuuugagaggaauuggcuccaggacucuccugcugauccccaaaugcaaggaugcugaagucccuuauauaaaaauggcauagugcuguauauguauaacacauacacccuugcucuauuuucugccuagcaauucaaacucuaguaagggaaaaauacuugaaguucagaaagugucaagauuuauauuauucucuccuggauguucaucauauucaucuagauaaccucuauuuuuugaaagauaccagaaaucucuuuucuaaccaccuacuuucuuaggcagaauggaauugagcacugaacccuguguauacuucuguuacagcaacugaaacauuuucauuugcccauuuguuuaccugucuuauuuugcuuuucuggacugacaguucuguguaagcagagucuuuguuaauaguucuuuuaucauuaaucuaacccagugugugguauguaauuaaauaauaaauguuucuuaagugaauguuuagugaguaaaugaagguauuaguucauucucacacugcuaugaagaaauacacaagacuggauaauuuguaaaggaaagagguuuaauugacucacaguuucacacuucuggggaggccucaggacacuuacaaucacggcagaaggcaaaggagaaacaccuucuucauaggguggcaagacagagugcgacaugcaagcaggggaaaugucaaaugcuuauaaaaaaccaucagaucuucugagacucacucucaggagaacagcauggggaaacugcccccaugauccaguuaccuccaccugguccugggaauguggggauuacaauucaagaugagauuuuggguggggucacagccgaaccauaucaaugaagaaaugaauuaauguuaaguuaguguuauuagaucuccauaguuucacuagaauagacuuuaauucugguugccugcacugguagcuguacuucagugauuucugcgagaaaauagcgcucauuuucaagcuucuuuuuggcaguccuuacugucuucccccagcacccagcaacuuuguagcagaucuuuguuauuggguagagguuuaauuauggcuuauaguuguaugugaccuuagccuagaaggguuguuucugauuuguaagucauuugaaauuucuguaaggauguucaucagauagaauugcucauauuauuuuagauauauuuaccaucauuguuguuauuggguguagaccacagagccugggaaauaauccuuugguugguuuucaaaauuaagccaaaacaaaaaaugguauauuuuccucucuuccauugggacuguagcucuuguuaugaauucugguaauaaauuacuucaucgaagucaaauaguuuaugauguuccuuggcaggaaaaucuugaaaauauuuuacuguuauagcaaauuucacacuaagcuauauuucaaaaagucauuaguaaaaguucuggaaaaagaacagucaccaucaagugauaugcuaccaaaagauggauugcuacuauuuuagaugauuuagcugugccaauuauaugggauuuuuaugaguuaugccaugcaugacuuccaguaaaacuuugauuuuaaauguaaacauuuauuuaaaugguuaauucacuccuaauauaaauacuaaguuguguguccuuguaaauuuuuuuaaguguuagaaauugucuauauauaggcacauucugcauugaaauaaaugaaauaauuuucauccuaucuuuuuggugacaguauuucuauuugcugagugaugaaaaaguaguuaugaaaugagguacaaacuaugauagacucuucuguaaguagaacauuucaaguauuaucuugguucuugcaagaauauuuagcacuuacaaaugaguuuucauuauguucaaauguggucagcugcaaagagaguagugacucagauuauucaguguaggaauaguccagaauuugaccuuuaaauuguuuuggaauuuguguuugaauauugauaucucugaaagagguaugugcagcacuuuccacaguauaguaaacaaaacaguaaugucuuugucuugaaaaaaacugcaauuccccaacuguuucuuuacagucuaaaacaaaacuaccuuuauuucuguauuguugcaaucuucaaucugcuuuuagucugggauauaauaauuuggucuuaaaagguuuucagcuuuugaaaaucuuaguuaucucuugccucucacuuaccaggcuggccugaugugauagcaccugcuuuucuuuauggacaugaucauuacucuaaaauuugagaguuaauuaaaaauuacaaucuagugugaugaacaagguagacagugggccauuuauucauuucuaaaaccucucuguguguguauguaugucugccauauaccagcuuuuuggugcauaggggauccagagaugauaaauagauauagucuuugagaagcuuauauuuugcaguuugauaagggggugguggugggggagauagguaaaaaauuacaauguauuaucguaaguucugugacugagauaaggaaaugccauagaaaugcauaagagggucauuuaacccaguguuugaaauguugagaagugcuuugagcagcuggucacaucugaauugaguuuugagggaugaauaaaaauuagccagguaaagaggaaaagaagccuggaaaaacacucuaagaugauguggccaauauaggagguaagccuuggaauacauaguggcuaucauuuauugagcucuaccaugugccaaacucuguuaggaguuugaaaccacuuacuucacuguaaccuguggggcaggugcuauuauucauaguuugcaaaugaaacugagagucauaacuuugcugaagucaucacaugguuaauuaauggcauugcuaguuuaaaaaacucuagcauuucuggcuuuuucuguaggcuauuuccucccagcaaaggacaguuucaagauggaggagauaaauaguuaccaugcuguugaaaguucguguauguagauuaaguucuguaaagugugcagagggauuuauagugacuuguuuguucauuuagaacuauuuacugagagccucuuaugugccaagaacugugcuaagaauuaggaauaaaaugauaaaugccaaaauugagguagggggugaaagaaaguggggacacugagggaagccauaguuugaaaaagcgggauugcagaagaaaagauaacgauugagcaauaaauuuuaggggaagucaguagucuuuuaguuuuuguuuuuuuacuaugguaaguauuaauacuuuguuuauaugcugaagagaaagagccauagcaggggaaagauugaagauagaaaaagcuguuaggucacauguuuaauuaaguagauugugagaugauucuugaauuuguaauagacauauaauauuaguaggauuagccugcucuugaguaaugagacuugaauaaacaaugaaaccucugauuuaaaugaucacuguaaccucuuaugucugauuuaugcauuccucuuuacugucccucaguuguucugcccauacuccugucuaugauagcauucauuauacugaaguagagccauugauaucucccuguuagaccauaugcuucuugugugggagggaugagaagagaccgugucugcugccaccuaacaacugguacaaucccacuucaguaaaugcuuauugaaccaaugaaucagugaaugauuuggaguuucuuauuuuuaccauuuuugaacaauuuucuuuuuaacuuugaaggguuaaaagguauauaguuacccugugaagguuuuguuguuuguuagaaauuaaguacuuaacacuuuaagguaugccccagaauagauagagaacuuaaaaaauuuuugauguugaaaggaccuuguugguuauuuuuuaggaaaaucuguaauuauuauuuuauacauagguuacaauaugcuuaaaaauaauuuuugauauuaaaguaugguaagcagauauaucaaccuuuucgcuccucuugauaaacugugauuuaaaggaaaaauaaauuucuaguuuuucuuuaugaauuauacuauuaacagcuacugauuuauuuuuacauuuggauuaaauuaaaauuucaauuuauguugacaauaagagauaauuuuauagaaccuaaugaguuucuuagguuuauccuuuuagagauuuaaaaucaguuuaucaucagagacccauuguaguguaucuagaaguguagaaaaaagauacucucacacuuuuuugcuguuuuuuuaagcuuuguguuuaaaaaccaaugaugcaauuuuaaaaaauuguauuuccugugaaauguguuguguaguuccccacaaauauguuauuuuaccauuaaugucaugggguuuucuuguuucagaauccuguucacaagauuccugacucgcaugagauaacgcugaagcauggcacuaaaacaguaaguuuaaaaaucuaguuuuuuccucucucaaauuacagggcugucauggaaaagugaacugauaagauacauuuguauuaaggcuaauuauacaaucaacugaugacauaaaagcuauagacauuaaggaaaaauagauuacuuuuauguucagucaaaauagccauuuccuuuuaguuaaaauaggaacaauuauugucacuguuauuguuggcuuuaaaaaucucuuauuuuuuaauauaggaacauuauaaguggaagaaagaaaugaaacucaaacacaauuuugcuuuuuauggugugggaaaauuucuuacuaccuuuagcuuuacuucuguaucaguaaaaggcaugaauuuguucauuuuucagaugaauguugagauaagaaaugaacuuuaaguaguuacuguauggcucuaaguauuuauuaauacuuaguuuacagauugcauguuuauauuguuauauuuacuuauguuugaguaaucuaaaauauuuaaagaugaauaauauagaauauuugagauguaaggugaaaucauuguaucuuauugcaaagccacuaaaaaguaguaguuaaaugagugaaacauucauaugaaaugaaaaaaauuaucuuucccuuuucagugaaacuacuuuuuucuaauugacauguaaagaaguaagaaaauacaucccauaauaagagggaaauaucaaucaauagagguagacccagaaaugauauaaacagggucauucuuacaguuuuucuuuugaaaauauuguuuucauaaaaauauuuauguuaaauauaguggguuuauuguuauuuuaaaugaaauggaaaagauguaaaaaucucuuaguuuuaauuucuaguggaaauagugauacauauaacucacauaaacaaaaccucuuuggaguccucauucguuuuuuuuuuuguuuuguuuuguuuuugagacagagucucacucugucaccuaggcuggagugcaguggugugaucucggcucacugcaagcuccaacucccggguucaugccauucuccugccucagccuccugaguagcugggacuacaggugcccgccaccacaccuggcuaauuuuuuuguauuuuugguagagaugggcuuucaccguguuagccaggauggucucgaucugcugaccucaugaucuuccugccucggccucccaaagugcugggauuacaggugugagccaccguucccggcuuggaguccucaguagacuuuaagaguguaaagagucuugaaaugaaacuaugugggaauugcugcccuaagacaucauuuccaucuaauucuuaauauauuuauuuuuucuuaaaucagguuuuuuauauuuuuguucugaaauuaugauggaauucuacuuuuuguguuuuuaaguaaauaaggaaaaauuguagacugaguauuuaaaaggaagcuuuucugucaucuagucuggagaauuuuacaacugagagaugggucaugaguuucacaaguuugauuuaaauauuccuuuuuucguaaaucaaguuuuaucuuauagagaaacauaacuuaaaaaauacuccaguauguuuuacacauugaaaaucaauuagagugucuaauuauacucuuggcuuaacucuuuuuuuuuuuuuuuuugcaauccugccuuuguucuacaugcaaauaaauuuauuuuuaaauaaauguuggauuagaaggugacuuuucucucugaucuuuuuuucuuuuaaaugaguuauuuuaaaaagguccauaaggccaaucuuauuucuuuccuauauacuuuacauuuuaguccccccguccccaccuuacaggauuauuuaaaagcaaauaccugacuucauaugauuucaucugugaauauuucaguaugaaccucuaagagauaauauugggcuguuucugaaugugcacacguacacucuuucugaaugugcacacauacacucuuuccuacauaauaccaucuuuauauaucuauuuuuucaauaauuauuuaaucuaauaucucauuaguguucaaauuuccccaguuuucucauacaucuuuuuagagucaguuuguucaaaucagucucuuaaugaugucugauguacucuuaggagaauuaucaucauguuuauuuuuuauaucucuauaagauuuugugcuuuuucuccuuuuagugaauauuuagugaauauacuuacuauggcauaauagucaacugaacccuucccacugaaugugaugauaaagucuaaagcuuuuugaaaggaggagagggugauacacauuaauucuuuuaauauaaauguuaaaacugaaaauuugugcucauucucaaguuggaacaagacacuuuuuuuuuuugagacaaagucuugcucugucacucaggcuggagugcaguggugccaucucagcucacugcagccuccaccucccagggguaagcgauucuccugccucagccucccgaguagcugggauuacuggcgcucgccacaacaccggguaauuuuuguauuuuuaguagagaugggguuuugccauguuggccaggccggucuugaacuccugaccucaggugauccgccuaccucggccucccaaagugcugggauuacaggcgugagccacugcgcccagccuccgagcucuguuuucuauuuuucuaauuaccuccuucauaucguuuugguaaaugaugaaucauauauacagucagcaacagagauccugauacuucagugaaugguagcauugaaagccucauuuuguaauuuugcuuuuuaauuugucaucuuucuucuuaggagaacagucaaguuugcaauuuauucuguucuuccuugauaaaaaggaauuugucucauauuugucagacugcauguuuguuuuacauaagauuuaacaauuuuuaguucuccuuucuuuuaaacaaauauuuaguagaguuuguauuuugugccauguucagugcugggcacagacaaggucucuguccauauggugcuuauacucuugagggaaggacagauacagaauagaggaaccacaaauggaguuguaauuuuauauuguguuguagugagaugaacacuggugggguuagccuuauuaggaggagaaauaacuuuuaaauuguaacaggagggaagaaggauagcauaaugaacguagaggcaagugaguuuguagguggugguagcagaagucacuucuagauuuuuaaaacuacuauucauuuauuuuuguuuuugauuguuuuuuaagacauuauuguucgggcauaaaaaaugacuuuguuuucacuuguauauuuuccuugacaucuuuagaguucaugucuaauuuuaacauaaguauuauuauuuauguaugauucccuuauauuaugaaaucgguauuugcaagugcuaauugaaaugaauauguuacuuugucaguaucugacuaauuauaauuauauuaauuacauuucaagucuauuuauuaggagaacugauuuauagaaacuuccuuuauguaaaacguugacucuggccaggugccguggcucacacuucuaaucccagcuuugcgagucugaggcgggcaaaucaccugagaucaggaguuugagaccagccuggucaacaagugaaaccccuucucuacuaaaaaauacaaaaauaagcugggcguggugcuacgugccugucaucccagcuacuuaggaggcugaggcaggagaaucgcuugaucccagcaggcagaaguugcagugagccgagauuacaccacugcacuccagccuggaugacagagugagacucugucucaaaaaaaacaaaacaaaaaaaccuuugauucuuuuacuguguccaauguauaguaaucgcauuaaauauuccuaaugcaguucuuuucuucuuagagggcaguagaucuagggacucucugcuuugagagaaagcuacauauagcuuaggaacaaugaguuacacauuggauauugacgugugaauuggaccuaggaaaguucacagggaaagcaauuuuuuuuuuuuuuuuuuuuuuugagacaggguuucaccuuguugcccaguuggagugcagagccgcaaucucagcucauugcaaccucugccucccgaguucaagcaauucuccugccucagccucucaaauagcugggauuacaggcaugcgccaccaugccuggcuaauuuuguauuuuuaguagagaugggguuucuccauguuggucaggcugaucucaaacucccaaccucaggugauccgcccgccuuagccucccaaagcgcugggauuacaggcaugagcuauggugccuggccugcaaauuuuuuuuuuuuuuaagacagagucucgcucugucacccaggguggaaugcaguggcacgaucuuggcucauugcaaccuccgccucccaaguucaagcaauuuuugugccucagcauuacaggugcaugccuccacgcccaguuaauuuuuguauuuuuaguaaagaugggguuucuccauguuggccaggcuggucucaaacuccugaccucaagugaucucccugccuuggccucccgaagugcugggauuacaggcaugagccacuguggccggccgaaagcaaauauuuuauggaaccaauauaaguacuauuauaaugugauuagucacuuaaaaauucagcuuuaaaaauaauuguuuaaggugaauauaccgagccauuugaccauaagggacagauaauucugcuuuguucuacuuuguuaaauagauuucuuaaagcucccuugguguuacucauuuugguaauuucagauucauaugguuuucauucaguuaugauuaucuuaaaaguuuuccucagauuguauguugaaaaugcugaauuauuguaauuauuuguaagauuuuuacuuguacacuaaagcaacuuaguuuaucuuauggaauugcagugauagcuauucugaauacaugguugaugauuugggacaaaauugucaaauagauuuaaaguauuuuucuuuauugcaaaagaauuaauauaguaacaaagucuaauaauauggaaggcaaccauccauuccugcuuuucagaaguaacaauaguuggugguuuguacuuccaaguccuauaacauagggggugggauuaaagaacagaaaugggagguuauaauugaccauaugucauuuugcuccggucauuuuauuuuauuuuuuuaaaaccaggugucugcuuugggucuggaucccucaggugcccguuuggugacaggaggauaugacuaugauguuaaguuuugggauuuugcuggaauggaugcuucuuuuaaggcauuucgaucccuucagcccugugagugguauguauucacuuacuuaauaucuucauauuugaccuaaugucuucacauuggaagacagugcuguuggcuuuggaaucccaucuacaaugauuuguaucaaaauacauuacguuuauaugacuguauacggccuucauaauuuaaaugaaguaaaacgagccuuacauuucuuuuguuucauaaacuuauauuuuaggcugggcgcgguggcucacacuuguaauuccagaacuuuagaaagccgaggcaggcggaucaccugaggccuggaguuugagaccagaauggacaacauggcaaaagcccgucucuacuaaaauuacaaaaauuagcugggcgugguggcgcaugccuguaauccagcuacucgggaggcugaggcaggagaauugcucuagccugagggguggagguugcagugagcugagauugugccacugcacuccagcccagcaacagagagagacuccaucucaaaaaaaauuacaaaaggcuaggcacaguggcgcaugccuguagucccagcacuuugggaggccaagguggguggaucaccugaggucaggaguucgagaccagccugucuaacauggugaaacucuaucucuacuaaaaauauaaaaacaagccaggcgugguggcucaugccuguaaucccagcuacuucggaggcugaggcaggagaauugcuugaacccgggagguggaggcugcagugagccaggauugcgccacugcacuccauccugggugacagagcaagacuccaucucaaaacaaaaaaauuaaaaaaaaaacaaaacuuuguuuuaaaacauuccaauuaauucugagaaaugagaaauuaacauauguuaagccauuaaccagguaccaaucuauuuuguacuguuuagguauggucggcuagcauuauguuagaaagggccuuccauguugcuacaaugagccagccuuucucuuuuuuuuuuuuuuuuuuuugagacagggucuggcucuguugcccaggcuggagugcaguggcgagaucuuggcucacugcaaccucugcuucuugggcucaagacauccucccaccucagccucccaaauagcugggacuauaugggugugcaccaccaugccuggcuaauuuuuguauuuuuuugguagagaugggguuucacccaguaguccaggguggucucaaacuccugaucucaaguaauccaccugccucgucuucccaaagugcugggauuacaggcaugagccaccgcgccuggcccauaagacacucucuuuucuguuuuugaccauaucugaucuucuggcauauugcuuucuuaugguaucauuuaacucaacgguccccaaucuuuuuugcaccagugccugguuuuguggaagacaauuuuuccauggacuagggguagcguggaggucgggguggugggaugguuucuggaugaaacuguucuaucucagaucaucaggcauuagauucuaauauggauugugcaaccuagagaucccucacaugcgcauuucacaauaggguuuguacuccuaugagaaucgaaugcuauuguugaucugacaggagccggagcucaggugguaacgcuugcucacccucccaacgccugccgugcaccugguuccuaacaggccauagacugauaccaguccauguccugggcuuuggggacuccugacuuaacuuguuucuuuaucuccucuccaauauuuccuguggaauaucaaaggcuuuaucauaauuauauuguaucacuucagauggcauguauugucuagcuguuucacuguuagugacuagaaauuaagguaaaucccuggauuaagguagugacaucugauuccuucauuguaaaguuaauauuuuauacuugagauaggcaagaacuucguagagagauaguuugguauauguaacuguccagauacucaucauucuuucacuuaaugagcucaguguccauugaugauuucuuccugaaucgguuaugucaccgagagcuacaaauuggugauuuuccuauucuguuauuucaucugcauuuauuuccuggcaucuucuuaaagaaaaacuuuuccauugauguucauuagggauauuggucuaaaauucucuuuuuuuguugugucucugccaaaauccucaauaaaauacuggcaaaccgaauccagcagcacaucaaaaagcuuauccaccaugaucaagugggcuucaucccugggaugcaaagcuggcucaacauacgcaaaucaauaaauguaguccagcauauaaacagaaccaaagacaaaaaccacuugauuaucucaguagaugcagaaaaggccuuugacaaaauucaacagcccuucaugcuaaaaacucucaauaaauuagguauugaugggacauaucucaaaauaauaagagcuauuuaugagaaacccacagccaauauaauacugaaugggcaauaacuggaagcauucccuuugaaaacuggcacaagacagggaugcccucucucaccacuccuauucaacauagugucggaaguucuggccaggcaaucaggcaggagaaagaaauaaaggguauucaguuagaaaaagaggaauugaaauugucccugugugcagaugacaugguuguauauuuagaaaaccccaucgucucagccccaaaacucuuuaagcugauaagcaacuucagcaaagucucaggauacaaaaucaaugugcaaaaaucacaagcauucuuauacaccaauaacagacacacagagaaccaaaucacgagugaacucccauucacaauugcuucaaagagaaugaaauaccuaggaaugcaacuuacaagggaugugaaggaccucuucaaggagaacuacaaaccacugcucaacaaaaugaaagaggacacaaagaaauggaagaacauuccaugcucauggauaggaagaaucaauaucgugaaaauggccauacugcccaagguaauuuauagauucaaugccauccccaucaagcuaccaaugacuuucuucauagaauuggaaaaaacuacuuuaaaguucauauggaaccaaaaaagagcccgcaucgccaagacaauccuaagccaaaagaacaaagcuggaggcaucaugcuaccugacuucaaacuauacuacaaggcuacaggaaccaaaacggcaugguacugguaccaaaacagagauauagaccaauggaacagaacagagcccucagaaauaauaccacacaucuacaaccaucugaucuuugacaaaucugacaaaaacaagaaauggggaaaggauucccuauuuaauaaauggugcugggaaaacuggcuagccauauguagaaagcugaaacuggaucccuuccuuauaccuuacacaaaaauuaauucaagaaggaucaaagacuuaaguguuagaccuaaaaccauaaaaacccuagaagaaaaccuaagcaauaccauucaggacauaggcaugggcaaggacuucaugucuaaaacaccaaaagcaaugguaacaaaagccaaaauugacaaaugggaucuaauuaaacuaaagagcuucugcacagcaaaagaaacuaucaucagagugaacaggcaaccuacagaaugggaggaaauuuuugcaaccuacccaucugacaaagggcuaauauccaaaaccuacaaagaacucuuaacaaauuuacaagaaaaaaacaaccccaucaaaaagugggugaaggauaugaacagacacuucucaaaagaagacauuugugcagccaacagacacaugaaaaaaugcucaucaucauuggccauuagagaaaugcaaaucaaaaccacaaugagauaccaucucacaccaguuagaauggugaucauuacaaagucaggaaacaacuagugcuggagaggauguagagaaauaggaacacuuguacacuauuggugggacuguaaacuaguucaaccauuguggaagucaguguggcgauuccucagggccuagaacuagaaauaccauuugacccagccaucacauuacugguuauauacccaaaggauuauaaaucaugcugccaaaaagacaaaugcacacguauguuuauuguggcacuauucgcaauagcaaagacuuggaaccaacucaaauguccaucaaugauagacuggauuaagaaaauguugcacauauacaccauggaauacuaugcagccauaaaaaaugaugaguucaugucauuuguagggacauggaugaagcuggaaaccaucauucucaacaaacuaucccaaggacagaaaaccaaacaccgcauguucucacucguaggugggaauugaacaaugagaacacauggucacaggaaggggaacaucacacaccggggccugucaugggaugcggggaggagggagggagagcauuaggagauauaccuaguguaaaugacgaguuaaugggugcagcacaccaacauggcacauguauacauauguaacaaaccugcacguugugcacauguacccuagaacuuaaaguguaauuaaaaaagaaaaaaagaaaaacuuuuccucauuaacugauguuauuugguuacccugaaauauaguuacuacugaagaggcaggauaaaagcuuaguuaucuuucuuuaauugcccauuuuuagcuuaagggcugguggugauaaaugaguuguuucuguuauuggugaucauuucuuuuucuuuuuugaguaucaguauuuacgauuuuuaaauuuucauguuucagucaauugcagucauuauucuuuucaauguuuaaauuguccuagauuugucuaguaggaguccuugauugcuguauaauuuugacaugaccuuauuagucuuuaaaacuuacuugguuucuggcacaacaugauguaggcuuccuguuacauuccuuuccaaguccuggaaucaguacuuccccgaguagcccgucuuucuuuuugugggagugguauuuagagaccaaaucugguugcuaggcaugcucauugauauugggaugucauugcuuuugaccuuuugauggaaagagguagaaaauauagacgcguauguauucaugcauauaugugucuauguuuaaauuacaaggucacuuugauauuucuauuucaauuucaaaauauuuaguaaacuuuuaaauuucagaauauuuuuaaauuuauagauaagcuacaaagauaguacagaguuuaugcauacacuucacccaguuuuucuuaugauuaacaucuuaugguccauuugucacaauuaagaaacuaacagucaguuacuauugaugaaucuccaaacguuauuuggauuucacuguuuuuuuuucacuaaugauuccuccaagauaccacauuaccuuugguccuuguauuuguuuagucccugacuguuucucagucuuucauuguuuuucaugaccaugacaguuuugagggguauuggucggguguuuuguagaaugucucucaauuugcuuuugucugaugcuuuucucaugguuagauugagauuaugaguccuugggaagaauaucacagaggugaaguggcuuucuuauuacaucauaucgggguacuucuaucauguuuuuuuagguucuucaugguaaaguuacuuuuuccuuuccuuuccauaugccauucuuuggcugcaagccacugaguacugcucaaacuagaggcaguggaaaaauuuggcuccacuuccuggagugaguaguauuuaaauaaacuuuuugguuuucuuguguauuuauuuuguugcucagcuuguuucaacuguggugauugggagcucuuuuaguuuggucuuuugucgcuuugacaugccuccuuucuuucguuuuuggaaauacucccuuaauuuuugauacugcaggaugcuccaggccgggcgcaguggcucacgccuguaaucccagcacuuugggaggcugaggcgggcagaucaccugaggucaggaguucaagaccagccuggccaacauggugaaaccccgucuguacuaaaaauacaaaaauuagccgggcauguuggugggugccuguaauccugguuacuucagaggcugaggcaagagaaucgcuugaacccagaagguggagguugcagugagcugagauugugccauugcacuccagccugggcaacgagugaaauuuugucucaaaaaaaaaaaaauaaaaaauaaaaaauaaauaaauaaauaaauaaaaucaaaugcuccaggcuauagaugcuuguauuuucccugccccaguucuagaaucaguucuuuuccccaggagaaguauauuagcaaauaagaucuagguucuuuauuauuauuauuauuuuuacuauacuuuuaaguucugggauacaugugcagaacgugcagguuuguuacauagguauacacguaccaugaugguuugcuguacccauuaacgcaucaucuacauagcuauuucuccuaaugcugucccucccauagccccgcacccccugacaggcccuggugugugauauuccccuccuuguguccauguguucucauuguucagcucccacuuaugagugagaacaugugguguuugguuuucuguucuuguguuaguuugcugagaaugaugguuuccagcuucauccauaucccugcaaaggauaugaacucaucuuuuuuuauggaugcauaguauuccaugguuuauaugugccacauuuucuuuauccagucuaucauugaugggcauuuggguugguuccaagucuuugcuauugugaacagugcugcaauaaacauaugugugcaugugucuuuauaguagaaugauuuauaauccuuuggguauacaccuaguaaugggauugcugggucagaugguauuucuaccucuagaagaucuagguucuuaauaugcucauugcuccugggaugucacugcucuuaggcugacucagcugacaaagcuaggaaauacaugcguguauauuauacuaaccuauguauauaguauauaguguuuuguaucucucuacauccacguuaaccugaacaccaguucauacugauguucuaacucuaauccaguacuauguugauuuauucuaaccuucaugcuuuucuguaucaucacuuuccaauggugagaaaccuagcuuccacuauccauuuacuuauucagccucaguauaccuguaaagcaauuuaagaauuguuaauuguaccuguguuccaauuuaaauuuagcguuacagaauuuuucuuaaugucuuuuaauuugauauucaaauuaaaagauagaagucauuuauaagaaaacacuuauuggucaagggguuggcaaaguuuuuuuauaaagggccagguagcauuuuaggcuuuacaggucacaaauggucuuuguuaaauuuaucuguguguguauauauuuaugugugugugugugucugugucuauguguguguuugugugaguguauacauuuucuuuuucuuuuuguguuuuuuugagauggaguuucacucuuguugcccaggcuggagugcaauggcgugaucucggcucaccgcaaccuccaccuccuggguuuaagcgauucuccugccugagccuccugaguagcugggauuacaggcaugugccaccacgucuggcuaauuuuguauuuuuaauagagucgggguuucuccauguuggucaggcuggucucgaacucccgaccucaggugaucugcccgucuuggucucccaaagugcugggauuacagacgugagccauugccucuggccuauuuuuuucaagaaaagacaguaaaaucugacuugaugccuuggaucuuugguuaagaaagaaaauaaaaucauuuucuagcuguaauuucuguuugauugaguauuccuagggucaucacuugaugauuccaguaguuuaagagugcuguccaauauaacuuucagugguaauggagauauuauguaucuguaucguccaguaugguagucacucgucacaugggguuacugaauacuugaaauguguuuaguaauucuaaggaacugaaauuucuuaaaaucgaauuuuaauuaaaauguauauaacuacacguggcuagguagcugcuguauuggauagugcauaucuugagccucccuuuaaguggccaaauccagugcacacaaacuaccacaauagauaacaagguaccucuagacauaaaaaauaugugacuuaaguucaaaaacaggaaugcuacuaccaaaaagucacuaaaguuuaaugcagauuuuuaaaugaagaaaaagugaggccaggugugguggcucacggcuguaauccccgcacuuugggaggccaaggcaggcggaucaugaggugaagagauuaagaccauucuggccaacaugaugaaaccccaucucuacuaaaaauacagaaauuagcuggguguggugacaccugccuguugucccagcuacuagggagguugagggaggagaaucgcuugaaccugcaaggcagagguugcagugagcucagauggcgccacuacacuccagccuggcaacagagugagacuccaucucaacaacaacaacaacaacaacaaaaaagaaaaaagugaaacauguauauuuuaauauuuauuuuccccuccaauuucauucucuuuauuuuguugaaucauuguucuaguuucugauuguaacacccaauggguauguuaaugaucgcugcuuguguuuugccaauugcaaauuuggugaauguacaguaaauucucauucagcugauaccuguugaauaugggagagucaaacucucauaugccauuagaagccuuucuuuauuuugagacugauuuuuuuuuuuuuuugagauggagucugucucauguugcccaggcuggagugcaauggcaugaucuuggcucacugcaaccuccaccuuccggguucaagcgauucuccugucucagccuccugaggaacugggauuacaggugcaugccaccaugcccagcuaauuuuuguauuuuuaguagagacgugguuucaccauguuggccaggcugguccugaacucuugaccucaagugaucugccugccuuggccucccaaagugcugggauugcaggcgugagccaccaugccccugccugacauuggucuguuaaccuuuuaaauuacguuuuucacccaagugagaauccacacaugccuauaacucagcuaaauucccccacaucuuuuugucacugaucuguauuauuccuauauuauccacaaagauaacuugagggaguuuguugacugucuugaagauauggaaacauaguaugauguuuucaaaccaucuccucaccuggaauagcaaacaucagaauuugucugagauccaagaggcagcaucauggugaguaaguggauaucaaagaggcagucacacucaaagaacgcccccauagcuauucaggaagggagauagaaguccaagucuaggagugaagcugagguaaauaaaguauucuggauuuugggcaucucugacgaauuucuccagaagagcucuuuggugcugugguauucuuagcuucuuucucacucaccuagcacacuuuaaaaagacugacauuauguguuuuuuacuuggucuaccaguauaaaaauugaauuuuaaaaaaugcuuuucuuuuguuguuaagcacaguuuauuauuugauauacauuauuuaccugaauauauuuuucuuucuugccgagaccagcucugucagggagacccuaacccaguggcacuagagaaauuaaagacacacacacagaaauauagagcugugaagugggaaaucaggggucucacagccuucagagcugagagccccgaacagagauuuacccacauauuuauuaacagcaagccagucauuagcauuguuucuauagauauucgauuaacuaaaaguaucccuuaugggaaacgaagggaugggcugaaauaaagggauggguugggcuaguuaucugcagcaggagcauguccuuaaggcacagcucgcugaugcuauuguuugugguuuaagaaugccuuuaagcaguuuucugcccugggcgggccagguguuccuugcccucauuccgguaaacccacaaccuuccagcgugggcauuauggccaucaggaacaugucacagugcugcagagauuuguuuauggccaguuuuggggccaguuuauggccagauuuuggggggccuguucccaacaccuucucuuugacauuuucaugguaaaauuauguaaacuaucuguaauagccuuuuacuuaauuuccugguuuuugcuucccucuguaacugucaucaaguuacauaauuuuaaaauuuuaucuuauuaagauccagugaccuucuuuugagucauguuucagcucaaaugucagcuccucagagagaccuuuccucaccauacugucaaaaguagcuccucucccaccucuccacugccacccacucuacccauuacccugauuuauuucuuuuauagcacuuagaaugaucagaaaugauguguuuuucacauuuguuuacuucuauuccagcaccuaaaacaguguuugggauauacuuggaacuuauuauucauuaaauaagucauacaauaguaguguuucauauuuuuuuuucaguaguuuucuguugagaaauagagcagaagacuguuuucagcaagguguacccaccuuuuggaaaagaaaggaagcauaaggauuucuuuuucuggaggaucugaaauccuuggcuuaaacccuaucaguucagggcaaguaaggaacaguuuuugaaaucacuggcucugcacuguaagugauaccuugagcuacaggcuuaaggcugauauguuuaguuuuuuuuaaaaaaauaaaaauauguauucugaagauaauugaauagugaguuuuauugcaucuuaugauuuccauucauuuuauauuaaaagugauugccacugagaaauuuccaucuauucaaaugguauuuguaguucuugcuauguaugaacaguuacuugauuaaagaguuucagaguucaaauaaauaaaaaaagaaaaaacagauaccuacuguuuugcguuucugagucaauccuagauucugaaauuuaaaaauuucuguuacuggaaaucagaauggaugagucaaugcuguagucauaaaguguuauacacugucuucucugcuaauuuagcugagcuugugccauaacuaucaguuuuagugggaugauggggagauuacuguccuagauuuucacugaaguauuuuuccuccucuuucuuuuuuauugcauauuaauugauguaaaauuuaauucuacaacuaaguauaacuauagacuuaaugugcauaauggaaugugagcauggauucugacucauaaagaucugaauuugaauuaugucuuggcuuguucauuugcuauaugacuuuaggcaugucauuuaaucacuuugacccuuaguuuccuugccuguaaaauagaauuaauacuaccaguuuuuugguguucugauugaugauuaaaugaaauaauguauauuuuauaaagugcauggcacagugccuggcaccuaguaaagcauucaguagauaauagcucaccuaguauuuauuuaauaugaaggaaucucagugcacagauucuuaaguugauaucucucaugucuuucaaguauuacuucccauuucugaguuuuuaguauuguaacauuggauuuuaccucugaaaaaucagacuacuauuuaagacuaucaccuguccugauuucuuucuuucuuuuuuuuuuuuuuuuuuugagguagagucuagcucuguugcccaggcuggagugcaguagcacgaucuugguucacugcaaccucugccucccagguucaagcgauucuccugccucagccugcugaggagcugggauuaaggcacgccaccaugcccggcuaauuuuuguauuuuuaguagagacgggguuucaccauguuggccaggcuggucuugaacuccugaccucaggugauccuccugccuuggccucccaaaguguugagauuacaggcgugagccauugcgccuuauccugauuuguuuuuugggaguauaggcuauuuagcuuuggcucucuguuaucuguucuccauuucccuuuuucucucggguccaguucucuuuaucuuuuuuuuuuuuuuuuuuugccacaauuugugaaaacuucuuaagccaauucacuuuacuaauuuucuacucuuuuaaugaacuuuuuaaaagucacauuuauucagguauaauuuacauuuaguaaaauuuauucuuuuuauuuguacaguucuaugaauuuugagaaaugcauacagucauagucauacacuaugauuauccuccaaaguucccuuuagccccuuugcagucagucccuccuucugacccccagguaaccacugaugugauuuugccucugucaguaguuuuguucccuuuuauagcuguguaguacucuuuuguaugacuauauuacauacaguuuaucucuuuaccaguugauagacauuuggcuuauuuccaguuuuuagguauaaggaauaaagcuucuauaaauacuccguacuguagaggucauuuuuauagacagguguuuuuauuucccugggucaauaccuaagugugaauugcuuugucagaugauaugugaguauuaacuuuauaggaaacugcccaacuuuuuaaaaaugccguaucauuuugcuuucuuaguggcaauguguaagaguuguaguuacuucauauccuuaccuacacuugguauugucaauauguuaaauuuuagccauucaguuggguauguagugauauguuauuggguuuuaauuugaauuucccugaugauuagugauauugagcuuauaugucuucuuugaugaagcaacuguucaaaaacuuucgcccauuuuaagaacuggguucuuuucuuggauugguugauaaaguucuuuauaagauaugugugucacaaauauuccagucuguugcuuagauagaaagaguuccauaaauauuuuuuaaauagaaaaaguaguuuccaaaaaaauuccacuuuuguaauauauaauuuauguauuuguguuuuuuaguuacuagggaaaguuugagagguuauguccuagaaauggaaguguauuauauggggguauuggagaacuuucauuuuauauuuuuauaugacauaacaaagcagcaugaauuacuuuuacaacuuacaaagauauuuuacacuucagaaaacaaaggacaucaaaaacaaaauuaaaagacaaauuauaaacaaaacauuguaacacacauugaaagcaaugggcuacuauccauaauacaguuucuguaaauaaagaaagggauauuugaaaacuaaaacuagccaaaggaaaugaauuaauagguaacagcagaagaaauacaaauagucaauaaacauaaagauauucagcuucauuaauaaagaaggaaaaauuaaagugccagugagguacuauguauuaccuguaagacuggcaaaagugaagagaacauauacuauccaaugugagaaggcuaagguggggguguaaaugaccagacuuuuuuuuccgcauaacacuuugauaaugucuuuuuuuuugagacagggucuugcucugucgccugggcuggagugcgguggcgcaaucuuggcucaccacaaccuccaccuccuggguucaagcaauucucaugccucaaccucccaaguagcugggaauucaggcaugcaccaccaugccuggcuaauauuuggauuuuuaguagagauaggguuucaccauguuggccaggcuggucuccaacuccugaccucaagugauccacccgccuuggccucccaaagugcugggauuacaggugugagccacugcacccagccaguauaucuuauucugauguaaacuguaaacuaugauggcaagauuuggagaaacaaauacuaucaggcauggugggaguguaaauuggcacugucuuauagagggcaauuuggcauucucuuccaaauuacaaaugcauauacccucagaccaaguaauccacuuuuaggaguuccucugacacauauauccacauauguggaaaugaucaggaacaaguuuauuuauuauagcauuauaugugaugaugacacguuuucuugaauuuuuuuucagcacaagagucugauaauauguucuuuuuccuuuaaaaaaauuccacagcuauauucuuugucuuuuauaucuuagaacaguacagacugugaccaguggcugaacucuaguccauggcuuguuuuuguaugacacuugaacuaagaaugauuuuuacaguuuuaaaggguugugaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauuuggcugugaauccaucugguccuggacucuuuuugguugguaaacuauugauuauugccacaauuucagagccuguuauuggucuauucagagauucaacuucuuccugguuuagucuugggagaauguaugugucgaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucuacucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguggugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuuuugauuugggguggagaguucuguagaugucuauuagguccgcuuggugcagagcugaguucaauuccugaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggccaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacuguggugaggucgggggaggggggagggauagcauugggagacauaccuaaugcuagaugacacguuagugggugcagcacaccagcauggcacauguauacauauguaacuaaccugcacaaugugcacauguacccuaaaacuuagaguauaauaaaaaaaaacauuaaaaauaaaaaauaaaaaauaaaaacaaaaagaaaacagcagguugaguugcauaggaaguuuuuguuuggguuucacuaagaaaaauucucaguuugaagacaugauaucugaagcuauuguguuaugugcauaaagguucuugaacuugguguuauaguuucucaguguaugauguuuuaaaaacuaaauaugagauuaagcucaccuuuuccucuuuuaacauuuuuugacuugcguuucaucuuguuucauauuaagguugccauauuugcuucuuuuuugauauaauuuuuucauuuuucaacuuuggguguuuguuuuuauuuugcucaggaugcaugugugugugcauaucuauuguuuauuuuuuguaaauggcaaauaaauauuucuaaccucaaaaaaaaaaaaaaaaaaaauaaaggguugugaaacaaaccccagaauaaugaagaagaauaugauacagagaucauauauggcuuggaaagcuucaaauauuuaucugguccuucacauaaaguuugcugacccuacuguaaaagcucuucacaaccgcuuauuauuuugcucuucuuauuuacgcucucugccuggugagacacaggcugaaaagauucuucuuguaucuccuuaccuucuuaaccucacugcuuguggccaguggaaugugucugugaucuuaggaaguuugagggagcuggggcugagaguaauccuuguguguguguuggggagucucuccucuaugugauggaugcuauaguuuuguuguuguaaacugugcaacagagugagacagagucucacucuguugcccaggcuggagugcaguggcgccaucuccgcucacugcaagcucugccuccuggguucacgccguucuccugccucagccaccugaggagcugggacuacaggugcccaccaccacacccggcuaauuuuuuguauuuuuaguagagaugggguuucacaguguuagccaggauggucuugaucuucugaccucaugaucugccugccucggccucccaaagugcugggauuacaggcgugagccacugcucccggccuguaugcuguauuuuuaggaaagauaguagguuuuugacuauauaucuuuguuuuauuaacccuauauugucucuuccacauuguuuuuugugccugcugccuaauuuuugugacagcugcuuccauaagggcauccuugcugcuuugagaacgaaccacccauggacuucaugguuucuggguaguuucauaugaggcuguugcacucuuucugggaggugcuuuccuaaucauucugaucuuuuccuacuagaaauuucuggauaauuuccaguuuucaguaguccuuucauuuauccugauuuaauauuuuucuagguuauuucuuuuggcauuuggaguagggaagucugaugaaguccucagcucuuuuuccuuagaagucuuauauauuuccuauuuccaaauucuuaaggauuucuuauuuauauucuuuuuuugcacccucuggagaaucaaccuuauauugacaaaauauauuuuuacauuuuugggugacauuugcaaguccuuaauuaauuaauuaauuaauuuuuugagacagagucucgcucauucgcccaggcuguagugcgguggcgugauccuggcucacugcaagcuccaccucccggauucaugccauucuccugccuuagccuccugaguagcugggacuacaggcgccugccaugacgccuggcuaauuuuuuguauuuucaguagagacgggguuucaccguguuaguuaggauggucucgaucgccugaccuugugauccgcccgccucggccucccaaaguguuaggauuacaggcgugagccaccgcacccggcccaaguccuuaauuuguaagucuugaguauuuugguuagcaauaauuaagacauguacuaaacauauacuaacuuguagugcauuugaaauaacauugcauuuggcuaccaagauuuuauaccccucaaauaaucuuagcauuggaaauaaaguaguaauaauaauaauuacuuguuucaguuacuguacuaggugucuuuauguauauuauuuuuaauccucacccaauuuuauaaaaaguauuauuucucauguuuuuuucaguggaggaaaccaggacucagcaaaguuauauuaacuaguacgucaacucuguggguucaggagcaucucuguauaguguugccaucuagucuugucuccucauuuuccaugaaauaaggagacuaaggccaggcgugguggcucaugcguauaaucccagcacuuugggaggccaaggugggcggaacacgaggucaggaguuugagaccagccugaccaacauggcgaaaccccgucucuacuaaaaauacaaaaauuagcccagcaugguggcacgcaccuguaaucccagcuacuuaggaggcugaagcaggagaauugcuggaacccaggagguggugguugcagugagcugagaucgugccacugcacuccagucugggugacagagugagauucuguaucgaaaaaaaaaaaaagacugagucuagugaagccaguagacuugcucaucaucacgcagcuaguuagcagcagaaugaggacuuggaucccugaacuccugacucacauuccagugcacuuuucacuacagcaggacaccuuggcuccugagccccaagugacagccccaaacagcuguguuuaucugucuugcaugucccagcuuguuuugcuagcugagcaaaaacuacuuaaaaggauccucaaucuucaccuucccauucccuuccacuucuacucauauacuccacuugccccaugaauaacuucacagaaacaauugugcaaugucacuaagccuuccucuggugucaagaguuacuccgugagagagcauucacuuccucaugacuccgguuuacugguuagauuggcuuucucucucuucucuuugaucggaaucuucguuguuuaggcaggaauuugaggagcagauguuaugccccuugaacagccccuuuaauucuccuuaguacugugucuaaugacucuuaauccuguccuuuuaacucuguggcuagcagacuuaagagugaagugagacaggaaugaugagcuugaugcugaacauuucauuuuaauguuggcaaaguagucuacagagaguacaugacaaacagugagacagagggaaaauguuaaaaguguuccuauauagcagaaaaacaaugugaauauuagugugggaucacugaaauuuuggguuucccaccaaauguagauagaacaguuugguuauuaguuugccagagaaauggagccauugacuguuucuacuuugucuucuuaaacuuuuauauuuuuuagauuuucauuucuguuuuaaaauaaaaauaaaucaucagaagaaacaaagugaucucuuauuuuucaugguuacuggagaaaauuacacuucccccaaaugggaguagcauuaacaagcauauauccugugaacugauucauuccauucuuucuuuagagacuuugguuuagcgcucugaacuuucugauuaucagaucuuauguguuugcuaauauauaaaauaacaaauuagacauaaugcccuauaauuuucucaguuugauuaauugccugaaauuugaucuaucagucaguguuugauuagaauagagaaaucacauguaauuugaacaaggaaagaucaguacgaagaauugcuagcuauaauaggguuuuggagcaaugaggauuggcuaguaaaaaguaaagagaacucuaaggaauauaagaauaacagauaaaaggagcaucaaccccugggguugagauacaacauccagggccucugagauuaagauccagacccuguuugagggggcauggcuguggcucauugaaugaagagaaguugcugugguagaaaucugucucaucagaaucacucugcuauaauacugccuuguggagguacugauggaagauacugggugcugcugacugcugugcacuucaggagccugacaguggagcaaacugcacgggugcuggaucuggacacuggagaagcuguguugcaguacagaagccugccaagaggagcacacaagacucuuggaaagaagaggaaaaucuccucuuacaaugucgaucuaacaucaugccagcuagcaaaggaaaaauguuuaaaggguccaaguucauuucugcagaguagacaggaaaggaugaauucggagcugagagacaguaaguggacaacuggcacauuuggucaaacuuguaauuuuauaucuuagauggacaaauuuaaacacaaguccauagguguuuuccuuacaagcuuacauuuaaauuugggauccuggucagaauuuugcuaaggacuucauucuuucccaguguuucaggaaggauaccauggggccagagccacuuuucuuuauuguaagguccugggcuguggccccuuuugcuuuucugggcuccuuucucaugggcaucuguuuugggaguuucauuuccucaucugcuuugacacuuuaaucuuggacauuguagugaaaugcuucacauugucacacauucuaaucucagagaccacuccaaaucuuuuugaauuuucuuggccauugaaauuaguacucuggaaucaguacauuaagaaugguuuuuuaaaaacuaucagcuagaauuucaacauuuuagaagaaaugggucaguauaaauuuggaggagcaguuucuagcuaguaguagcugugcagaaaaacaguuuuauugauaaguaucugauuuggauuuaggaaccagcuaggacgaaaaauucuauugaggucuggccagauagacauagauuuuauuuuuccuuuauauucuguguccaaaagacaaauugucaugaguuuuuuuuuuuuuuuuuuucugaaguauccauuuguuucucagcuuuggaauuagagguguagaaaauaaaugggacucaacagccuaagauuuuguuuaaaaagauguucuuauuuauuuauauuaaaaaaauuucuaaacuuuuuuuuuuuuugcaagaaacuguaugucagcauuuucauuuuugauagauaaauuuuauauuugggauuuugauuauuaaguuguuucuccaccagaauuccuuauggauuuuuguaauaaucucuauuuaauguguuuaauuauuugcuuuccauuuauauuuauuuugggauuucuuuuuuaagagaauggcaccugugacagcauacuguuaauauuacccuuguaucguacuuuaccaugccaucucugaagaauauuacagaccauuuuggagcauggugaauaacgaauuuuuaccuuaggaguucacuugaguagucauuuuuauauuugugacugcaagucacuuuuaggggcuguacuuccuuaguacugguagcauuauuauccaauggacuuuuauagcuuucauuagguuuucuuuuguuucuguucuuuaaagaacauuuuacuuaacuuaguauuucauuuuucaucuauauuaugaggcaguaagagucuucuguuuuuccaaaguugagacugcuuuauauuuauuucauauugucuacagcuguaguguucaauacauuagccacuagccacaugugguuauuuaaauaagauaaaauaaaaauuggcugggcgugguggcucacaccuguaaucccagcacuuugggaggccgaggcgggcagaucaugaggucaggagaucgagaccauccuuacuaagauggugaaaccccaucucuauuaaaaauacaaaaaauuagccgggcaugguggcgggcgccuguagucccagcuacucaggaggcugaggcaggagaauggcgugaaccugggaggcagaguuugcaguaagccgagauggcgccacugcacuccagccugggcgacagagcgagacuccaucucaaaaaaaaaaaaaaaaaaaaaaaaaaaaaaauuuaaguucuuuaguugcacuagccguauuucaaauacuugauggauacauguggcuaguggcuaacauaauggauagcacagauauaaaacauuuccucgucauguaaaguucuguuggauagugcugaucuguagcuuauaggaugguaucuuagucugcuucagcugcuaaaacagaauaccauaaauuggguagcuuaaacaguagauauuuugaccaggcgugguggcuugugccuguauuccuaacacuuugggaggccgaggcaaguggaucacuugagcucaggaguuugaaacuagccugggcagcauggcaaaaccuugucucuacaaaaauuagcugggcaugguggugcacgccuguagucugagcuacuugggagguugaggugggagaauugcuugaaccugggaggcggagguugcagugagccaugaucgcaccacuguacuccagccuggacgacagaaugagacucugucucaaaaaaaaaaaaacaaaaaaagaaaaaacaagagauauuucucacaguucuggaggcuggaagugcaagaucaaaguguuggcaaauuauguuucuuaaagagggccugcuuccuagauuggaaauggccaucuucucucaguauccucacaugguagggagaaaagcagcucuagugucucuucuuauaaaggaaguaaugccaccauaggggcucuauucucaugaccucaucuaaaccuaauucucuccuaaaggccacaccucccaauauccucacuuuggggguuagggcuuuaucauaugaauuuuuuuuuuuuuuuuuuuugagacagagucuugcucugucacccaggcuggagugcaguggcacaaucuuggcucacuacaagcucugccuccuggguucacaccauucuccugcgucagccuccucaguagcugggacuaaggugcccgccacugcgcccggcuaauuuuuuauuuuauuuuauuuuauuuuauuuuuuuuagagauggagucucuuucucccaggccggacugcaguggcgcuaucucggcucacugcaagcuccgccucccggguuuacgucauuccugccucagccucccgaguagcugggauuacaggcgcccgccaccgcgcccagcuaauuuuuuguauuuuuaguagagaugggguuucaccguguuagccaagauggucucgaucuccugaccucgugaucugcccgccucggccucccaaagugcugggauuacaggagugagccaccgcgccuggccuaauuuuuuguauuuuuaguagagacgggguuuuaccauguuaaccaggauggugucgaucuccugaccuugugauucacccgccucggccucccaaagugguaggauuacaggcaugagccacugcgcccggccuaucauaugaauuuugagggaacacaaacaugcagucuguagcagaugguaauaggcugauauauugcacuuguugauguaaaucugauagguuucuuucucuccaaggacagauuuuuaaauauuuaacaauaccaauaauguuucagguucugugagaauuuuauaauuuauaauuuccaaacuuaaaauaaucuauaaucuauuuuguccuaacaauuacaaauauauuuuuuauuucagauuauauauauuccuaccacauggagauaauuacagcuuuaaaaaauuuuauuuauuuuuucauuuuauuucacauauugacauuaaauuuuuauugacacauaauaauuguacauauauaugggguacaaugugauguuuuaauacauguacucaauguguaaugaucaaaucaggauaauuugcauaauuuuuuuuuguagggaaaaauucaaaaucuacucuucuggcuauuuucaaauauauaauacauuauuguuaacuauauucauccuacuaugcaauaggacaccagaacuuauuccuggguucuacaucuguuuauuaagccauccaaggauuggaaauauuggaaaaaaaauugcaucuguacugaacauguacacuuuuuucuuguccuuauuccuuacacaauauaguacaauaacuaucugcaugacauuuacauuggauauugagugaucuagaguugauaugaaguauaugggaggaugugcaaaggugaugugcaaauacugugucauuuuauaucagggacuugaguauccuuuguuauccucaggagauccuggaacuagucccccauggauacugagggcugacuguauaguccuauccucacagaacuuugauucuaaugagggaagacugacuauaaacaaaauauauauaauagguggugguaaguaccguggagaaguaacaaauggggcaaagugaguuauacagcuccauucuuagaaaccuuggaguaauuuucuuaguuuauacucguggugguuuccuuuugucuccuuuauuacaugggacucugacaugugcccauagcuaggguggcaguaggaucuacccgauaguaggguggcaguaggaucuacccgaaaagcauccugcugauacaggaccaaaggauccucuuguucucgagccuauaaaaagagcuaauggucuugcuucucuuaacuguggccuccuacacuguguuuuggacgauuggugaugucuuggauauucuguuucuuuggaacuuugaauauacaacacuuuacuagggaauuagcaauggaagcagagcaaaaauguacagaggaaacagaaugcauaacucugauggaauugaagucaugaggcagcagaaagcuuaaacaggcagagugggaggguuagagggaauuuaauugggaguaacagaaguaauaguuaauggagccagaaugcuugagucauguaauugcaaagcagaguugggagcagcagaugcuaaagaguaguugcuguaguuacucuuugcguuguaggagcaguugucauauuacuauauagcuacugaaugaagaagaguucuuagugaggccugggugaacagcucuucuuaguauucugugugaccccauuugaccuuuuaacaaaucucuaaguaaauaaauagccccuaagguaaacuaaguuuuucucugcuauuuuuuugcuugagagagcuauaacuguaauagacuuauauuucugaacauuuuagugcuugccaauauuugguaauauuuauguuuccuauauuuguaacgaacauucuucuuccuuuacauuuuuuguuaaauuauuguuucauacauaaaaguucaccuuuuauuguauaaaauugccucagauuaauuuauacacauuggcaauggguaaauagaauuuuucacauuauuaaaaacugaaggaugcccauguaagcaaaaaacaaaaacaaaaacaaaaacaaaaaaaaacgcacaaaaauaaacccaaaccccucaaacaauuucaaccacaaaacauuuuacauauacuuacuaguuuauucugagaauuuucuagccuucaaggauuaaauuacacuguaaagugugguaguguacccauuugaugucuuuacuggugaauuaagggccuuaauauaaaauugcuucagaugucucuaauuuuuauaauguuuaaauuaaaauauaauauuuagaaaauuacaauacuacuaaggcuguagcuugaggacuaaucauaaaaugaauacaucccuguaauuacuacccagauagaagaaguagaguguuaccagcaccagaaacuuguuuaccagauauuacccacaaccuucucauccugacuacuugcaccauagauuacuuuugccuauauuugaauauuacuuaaauggguaaauacagcauauauuguuuuugucuggcuucuuucacuugauuauauuuauaaaauauauccauaugguuuauagcagaaauuuguacauuucaauugcuguacagugugcuacuguaugaauauauaucuacuuagcuauuuucugccuguggacauuugacuuauuucugguuuggggcuauuaugaguaguuuuucugugaacauucuuguagaugucauuuggaacauauauuugcuuuucuguuggguauauacuugguaguggaauugcuaggucauugauuaugcauacauucugcauuagcaaguacuucuuuuuuuuuuuuuugagaccgagucucacucuguugcccaggcuggagugcaguggcacaaucucagcucacuucaaccucugucuccuggguucaauucuuuugccucagccuucugaguagcugggacuacaggcaugagccaccacgcauggcuaauuuuugcauuuuuagguuuuaggguuuugccauguuggccaggauagucucaaacgcgugaacucaagugauucacccgccuuggccucccaaagugcugggauuacaggugugagccacugcaccagcccauuagcagguauuucuaauagauuuugaaaaucauuguaccaaucuacccuccuacccauaguccacaaaaguuaccuuacaucuuugccaacacuuuguguugucaaccuuuuaaauuuuagucauuuugguggauauauaguaguauuucauuguggcuuuauuuugaauuuuugugaugcaugaugagauuagacaacuucucauaacauuauuggauauuuggauauccuuucucaaaugguuaaaucuuuuggccauuuuuccggugguugccuuuuuuuuuuaaauaccauuuaauagauuuuaaaaauaugguggaucuagggacuuucguugguuaaauaggaggcacauauucacucgcaauuuuuggcuuguuuugucacuguuugugaugucuuuuggugaauagaaguuacuaauuuugaugaagguaacauuugcauucuuuuuuuuaugguuagaauuuuuuuguuuucuguuuaagaaaauuuuucuuuaaccccguguugucaauuuuaucuuccagaaguuuagauauauuacuuuuaaaaguuaauaauuaaugccuacacuguaccuggaauugauuuuuauguguguuguaaaauaaggacaaagauuuauuauuuacaaugucaaauugacuccgcaucauucauugaaaagacugcuuucaucacuuuugucauaaaucagguggucuuuuucuugucauauugcauggucaaggaccucuaucguauguugaauagaaguguugaaaauaggcuuucuuuucuugcuccuaaugucagagggaagguuuuuaacaugucagcauuaaggaagauauuuguuauaguuuuuuuuuaaugauacccuuuaucaaauuaagaacuuucccuuuacuuccuaauuugccaggagguuuuaugaaauuauuagugaauaucccaaguuuaaauacaaauuuuguuaaaguacaauuuguaugcaagauuuugccauucuuaaagccuugacuugaaugcuuugauauuugcauacacuugcauaaguaucacugaaaacaaauauacccaucuccucagaaaguucucuugauucuuuuucauucuaugucccuccuucccauagaggcaaguacuuuuaaauuuuuauugccauaauauuuuccuauuuuuuugacuuuauguaauugggauuauauaauauauaguauguuucuuuuuuguuuuacucaauaaaauguuuaugacauuuauccauguauuucauugcaugaauauaccaaauguacaaauuauauauacaacguguaaaguguacaauugauugauuacuugagauggagucuuguucuguugcccaggcuggagugcaguggcacgaucuuggcucacugcaaccucugccucccggguucaagaaauucucuugccucagccucccuaguagcugggauuuaacagacacccgccuccaugcccuguuaauuuuuuuguacuuuuaguagagaugggguuuugccauuuuggccagguugaucucaaacuccuggccucaagugaucugcccaccucggccucccacagugcugggauuacaggcaugagccacugugccuggccaaguguacaauuuagauuauuguuuucagcuuuuggacguaaugaauaaagcugcuuugaacguuuuuguaugagccuuuuugugugcuaugaacauaccuaagaauagaacugcugagucguaggauagguacauguuuaccuuuauaugaaacugccaaacaguucuccaacauauuuuuuuaucuuacacuuuaccaguuguguaugagaauucuaauugcuccacauucuugaccauauuugauauggucaguaucuuugauuuaaccauuuuaguggguggguauaaaaugauaccuuguguuuuuuuguuuuugcauuucauaaaugauuaaugaugugaagcaccuuuuaauguuuuuauagagcacuugaauauauuuuguuaaguaucuaucuuuuuacuuuuaguggguuguuggucuuuuuauucuuuuuuuuuuuaaaucaguguauuuuaggagauacacguacacacacagcaauaauccuuugcauuacaaauauuuucuccuacucuguagcuugguguauucauauucuuuuuuuuuuuuuuuuugagacugaguuucgcucuuguugcccaagcuggagugcaauggcaugaucucggcucacuguaaccucugccuccuggguucaagcgauucuccugccucagccuccugaguagcuggauuacaggugugugccaucacgcucagcuaauuucuuguauuuuuaguagaaacaggguuucaccauguuagccaggcuggucucgagcuccugagcucaggugaucugcccgccucugccucccaacgugcugggauuacaggcuugagccaccgcgccuggccuuacauucuuaauguugucuuuugauauguuuuaucagauaccugaauuacuuuucuuccuuuaugcuggauuuuuagaaagucacaugaauugacuugaauauuaaaccugucuugccuuccuggaguacauuuuacaugauugugauaucuuuuccuuuuauauauauauugcuggauuccaucugcuauauuuuguuuggaacauuuuguaucuguguucaugagagauagauauaguuugcuguuuccagcuuuuggaaacauauguuuagaucauugauuaaaacaguuuuuuuguaauauaugcauuuaacuccauaaauuuucuacuaaauacuaaauuuucuacuuuagcuauaugucacaaguucuaauucauuauauuuucauuaucauucaguuaacauuuucuaauuuguauuguguuuuuuucuuugaucuaaggauuacuuauagguaucuugcuuuauuuucaaacauucagugguuuucagauuauuuuugagaauuuauuuguaacaguuccacuaggauuagagaacauaugcuauaugauuuuagguuuuugacauuuauugagacuugauuuacagauuugcauaugucaauuuuuuaaacauuauuuguauacuugacugcauuuuuuguuguggauccaacauagguaaauuaguuuauuaauuuugugguucuaaucuucucuauccuuauugcucuucaaaaauuggcugguaggaucaguuacuggaaaagagauguugaaaucuccgagugugauuguagauuugccuguuucuccuuuuaguuuuguaauuuuuugcuuuauguauuuggaggaaugucacuaggcaugagcacacuuagaauuauuguaucugccugguagauuuccccauuuguuauuauucuuuuuuuuaaucuucagcuuuuauuuuaaguuccagggcuacaugugcaggaugugcagguuuguuacauagguaaacgugugccauagugguuugcugcaccgauuaacccaucaccuagguauuaagcccagcauccauuagcuauucuuccacaugcucucccccugccacccaggccccaauguguguuguuccccuagguguguuguucccccacauguguccauguguucccaucauucagcucccacuuauaagugagaacaugcagcauuugguuuucuguuucugcauuaguuugcugaggauaauggugaaauuuccuuuuuaucuccaguaauguuccuuuauuuuauuauuuuuauuauuuuuauuuuuugggacagagucuugcucuauugcccaggcuggagugcaguggcaugaucucagcucaccgcaaucugcaccucucagauuccagugauuuucacgccugagccucccgaguagcugggauuacaagcgugcgcuaccacgccuggcuaauuuuuuguauuuuuaguagagaugggguuucgcuauauuggccaggcuggucuugaacuccuggccucaagugauccaccugccuuggccucccaaaaugcugggauuauaggugugagccacgguacccauccuuguuccuugauuuuuuguuuuguuuuguuuuuuaaauggaguuucgcuuuuguugcccaggcuggagugcaauggcgcaaucuggcucaccacaaccuccaccucccagguucaagcaauucuccugccucagccucccaaguagcugggauuacaggcaugcaccaccaugcccagcuaauuuuuuuuguauuuuuaguagagacgggguuucuccauguuggucaggcuggucuugaacucccuaucucaggugauccagcugccuuggccucccaaagugcuggaauuaugggcgugagccaccacgccuggcccucauuccuugauuuucaaggccacucugccugauauucguaagauauaccagcuuuauuuuaguaagucuuugugaaauauguuuuuacauucuuuuaauucacacucuccauauaaauaaauugucuuuuuuaugcagaaguuuucuauccauccugucaaacuuugucuuuuaauuauaaccuuuaaguuaguuauauuuaauuacuuauaaauuuggauguaaaccauccaucuuauucacuguuuuuauuuguccauucuguuuuauuuccucuuuacugucuugucuuuugcauuacauauuuuuuuuuuuuuuuuuuggagauggcauuuugcucuuguugcccaggcuggagugcaauggcgugaucucggcucacugcaaccuccaccucccggguucaagcaauucuccugccucagccuccugaguagcuggaauuaaaggcaugcaccaccaugcccagcuauguuuuuuuuugcauuuuuaguauagauggggugucugcauguuugucaggcuggucucaaauucccaaucucaggugauccacccaccucagccucccaaagugcugggauuauagcaugagccaccgugccugaucugcauuaauuuuuaauacuauguuuucucuucucuguuagcuuuuuaguuuauugucuuuuacuauucuuuuagucguuagucuaaagauuacaacuuaacaaagucuauuauaaauuaguacuuuuacuacuucccagucaauacaaagacuuuggaucauuaacuacauguaacugcauuuacucccuccugccauuuugcagcuguuuucacguauaguuguccccuuguuauaggcaagaaucccugucuauauucaaauuugugcauacucaaguccugcaguugguccugagaaauccaccuaugggaaaagccagccuuuuguguaugcaaguuuugcauccugugaauacuauugugaauacuaucuacaauguuuuauuguuucuuuuuucuucuucuuuuuuuuuuucugagacggagucucgcucugucaccuaggcuggagugcaguggagcaaucuugacucacugcaacuuccgccuccugagaucaagcaguucuccugccucagccucccaaguagcugggacuacaggugcaugucaccacaccuggcuaauuuuuuguauuuuuaguagagacgggguuucaccauguuagccaggauggucucgaucucaaccucgugauccaccugccuuggccucccaaacuguggcgugagccacugugccuggccuuuucuucuuuuuuuaagagauugggucuugcucugucacauaggcuggaguguagugacgcgaucauagcucauugcauagcugggauuaugaguacgagccacugucccuggcagaauacuguauuuuuuaucugcaugugguugagaaaaaucaguguaaaaguggacccgugcaguucaaaccuuuguuguucaaguguccucuguacuuuuacauauugguauaugcauuuuaaaccauucaggugguauuguuauuuuaugcagucaguauucauaacuuauucauucauuuacuuguauauucucccuuucuguuauucuucaugccauacucugugcuuuuauuagggaucauuuucuuucuaccuggagaauucuguguaguaucucuuuuaaagcaagucaacuguugacaaauucuguuaguuuuaguuuuucugaaaacaucuuuauuuugccuuuaagugauucuguaauucuagcuacucacuuauuucuugaccucucuauuuaaaauauuuaucccuguccuguuaccuuccuagcuuuauuucccccacauacuuauuaccguuuuuucauauaauauauuuuacuuauuuauuagcuuaguauugauuuugggaggaagggcucaccauaguuggcagguuggaucuucagcagcaacaacaguuaggucaaguuaagaguugcuguugggcucaucuacaacuucuauucaugccaccaugacuauuucauuuacaagccuauuguguuaacagucacagccaaacuggccaagucacuuugcaugguuauucauugccucuuuugagguugaugcuuucugggauuaacuugugacacaaaaagcuucauacuuguccccuuucauaugucuaucuacaugagacaaggagauauucuccucaucuccuugucucaaucuccuguucuuuuauaggguuucucucuuauuuucuggaaagguuguaucuuaccaguguaugugcuacuucuugcucaccugauugaguuaaugugauauuuagaccagggaucaacaugaauuucuuuggauugcccauauccccugggacucuaaaggcuggaaaauuaauaauagccuugauucaggcauuuaaauguaugcuauuguuaguuggaugugacugucagcugcuuucaguccuccuuaauaggggcagaaaaacaugcuucaugagaucaaugacugcauaccacuuaucugaucaagaccaauaacccagucuuuauaugcugccaaagagacuaucuggcuuucacgcuauagucuuuaauuggugauuugucacucucagccuuuuguuguuuuucuccguugcaucgacugcucuuagcaacagcuaucgaauuccuaguccuuuuaauuacuucucuguacuucacaaaugccugaaauauugcaccugccauggcuucucuuucaccaacaaaaguuucagcaauugugguugcccuacuguggcauguuagggacugugugccaccaguaauggguuucucauugcuagccaguuugugguugauacagcaucagauucucauuugaagucaaaacuucauaggaccacuuuugguaucaacucucccaggucagguuucccaaaaacacacuuugaaaugucuguauuugcaugucagaaguuuauauuggggaguguuuuggggucaaucccugugagagaggguacaagggaaacagcauugugaagauggggaaauugaauugccauguaguugccauagcagcaacaacuguuccacagggagaucugaagcuaaaauaaccccucugagauauuucaggaauggacuauuuuacugcauauugaccagucauugaaugugggcuguuuuggggugguauaauagcauaaccuuuggugagggaguugcaacucagggaaauuccugaggguucaguuauuagccaucaguaggcaaaaucccagaagcugggagaaugagcacuucacuuuugaagggggaguucuggguagcacaccacuguauucacuacagccacaauggcaagaucaagaucaguuuuaguggaauggugaggguggaaagguauuguagugcuaaagaacuaaaggaggagaugaggaggcuugaaaacuuguucaaacagcuuagcugugaaggggaugagagagagaagauaguagaaguuccugaggagacugggagagaugagauccaggauauaaguaugauuuuccauggacuggaagagguucauuucuaccauuguaaugaaagaggaggaggaagaaaguucagguaaagauaaguuuauaacaauaaugagaggaaguugaggcaguucuuguuuucugagaaagagccagaagauuuaacagcugaaagagggagaguugguuggguuggagauauaagguaauuagagagaguuuuaauagauugcaguggagagugggaagagagagcuaccagaauagccagugguugguugguugguggugguuguuuuuuuuuuuuuuuuucuggugacagaguuuugcucuuguugcccaggcuggagugcaaugacgugaucuuggcucacugcaacuucugccucccagguucaagcaauucuccugccucagccucccaaguagcugagauuacaggugcccaucaccaugccuggcuaaguuuuuguauuuuuauuagagaugggguuucaccauguugguccggcugauuuugaacuccugaccucaggugauccaucugccuuggccucccaaaguauugggauuauaggcaugagcuaccuugcccagccgcuaguggguauuuagaacccauuugagguugauguuccugauuuuguggaauuaucaauuuguccauuuguguaacauuuuuuuuucuggcaauacuuaauguaguaaaauuauaaacauugugcuuaguaucuuaccaacuuuccuuuucuuuucguacagccaucagaucaagucauuacaguauaguaacacaggagacaugauucuuguuguaucuggaagcucucaggccaaggugauugacagagaugguuuugaaguaauggaauguauaaaaggagaccaguauauuguggacauggccaacaccaagguaagcauuaaacagaauauuuuaaugaauuaauucagcacacauuuauuaacaacuauuugaguuaucauguaauaauuuuccccaaaaguuagugucauaaaacaauagcaauuuauuuguucucacaaucauguggauugauugggugguucugcuucauacaguaucagcuggagcacuaggaucgcuguaagauacaaaaggggcccagaugguuugcagucaguguccugcuccauggcaucucucugugucuuugccucuuccuuacuucuaccccaccccuucccuucuugcuggcucucugucucucugucuuuuucucuugccacaugucuaguuugggucuuuucacagugugguagucuuagguguauuagucuguucucaugcugcuaauaaugaccuauuugagacuggauaauuuauaaaggaaagagguuaauuguuucacaguucugcauggcuggagaggccucacaaucaugguggaaggcaaggaggugcaaagucgugucuuacauggcggcaggcaggagagagcaugugcaggggaacucccauuuauaaaaccaucagaucucaugagacuuauucacuaccaugagaacagcaugggggaaacugccuccaugauucaauuaucuccaccuggccccgcccuugacacaugggaauuguuacaauucaagaugagauuuggguggggacacagccaaaccauuuaauucugccucggccccuccgaaaucucauguccucacauuucaaaaccaaucaugccuuccccaaagucccccaaacucuuauuucagcauuaacucaaaauuccauaguccaaagucucaucugagacaaggcaagucccuuccaccuaugagccuguaaaaucaaaagcaaguuaguuacuuucuagauaaacagggauacaggcuuuggguaaauacacuuuuuucaaaugagagaaauuggccaaagcgaaagagcuacaggccccaugcaaguccaaaacccagcaggcaaaucuuaaagcuccaaaaugaccuccuuugacuccaugugucacauccaggugaugcaagaaguggguucccagggucuugggcagccccgccccuguggcuuugcaggguacagccccccuucuggcugcauugaguguuggcagcuuuuccaggcacacagugcaagcagucaguggaucuaccauucuggggucuggaggaugguggccguuuucucacagcucugcuuggcaguaccccaguggggacucugugugggggcuccaaccccauauuucccuuugacacugcccuaccagagguuauccaugagggccccccccgcucccugcagcaaacuuuugccuggauuuucaggcauuuucauacaucuucugaaaucuaggcggagguucacgaaccuuaauucuugacuucugugcaucugcaggcuuaacaccaccuagaaccugaaagguuugggacuugcacccucugaagccauggccugagguguaucuuggccccuuuuaccuauggcgggagcagcugggauguagggcaccaaguuacuaggcugcacacagcaggggguucuggacccacaaaaccauuuuuuccuucuaagccuccaggccugugaugggagggucugcugugagggucucuaacaugcccuggagacauuugccccauugucuuggugauuaacauuuggcuccucauuacuuaugcaaauuucuacaacccaguuuccucagaaaauagauuuuucuuuucuguugcaucaucaggcuacagauuuucugaacuuuuaugcucugcuucuucucgaaugcuuugcugcuuagaaaugucuucuggcagauaccuuaaaucgucucugucaaguucaaaguuccacagaucucuagggaacucuagaaaaaaauucuuauuucacucuuucccgccuaucuuaugcccuuuucuaauacaggggcacaaugccuccagugucuuugcauaguaagagugacuuuacuccauuucccaacaaauuccucaucuccaucugagaccaccucugccuggaccuuauuguccauaucacuauuaacauuuuggucaaagccauucaacaagucucuaggaaguuccaaacuuucccacauuuuccuauccucuucugagccuuccaaacuguuccagccucucccuguuacccaguuccaaaguugcuuccacauuuucggguaucuuuacagcagcaccccacucuacugguaucaacuuauuguauuagucuguucucacacugcaaauaaagacauaccugagacuggguaauuuauaaaggaaagagguugaauugacucacaguucugcauggcuggggaggccucacaaucaugguggaaggcaaggagauggaaaagcaugucucacauagcagcaggcaggagagagcaugugcaggggaacucccauuuauaaaaccaucagaucucaugagacuuauucaguaccaugagaacaguauggggggaaccguccccaugauucaguuaucugcaccuggccccacccuugacaugugggaauuauuacaaugcaaggugagauuuggguggggacacauccaaacuauaucaguagguuuugacuucuugcuugauugcuagguugcauggaggacaaacauggaaauuaauuaaguaccuuaauaucuggcuucagaucuuagacaggaucagagggccagcucaaauuugcaaggaggggagguagaucccaccauuauaugggugaauggcaaaaucaaacagaaauuaugugggaugggagauacugaugcaggcaucuuuggaaacauucuacuuagcuaauuuuaugcuaggcuuuaggucaagaaggagagagagagcugacaugcugugguacacacuuacagucccagcuacuuggaaggcugaggcaggaggauugcuugaucccaggaguuugagguagugugcgaugaucaugcuugugaauagccacuagccacugaacuccagcuugggcaacauugagacacccugucucuuaauuuaaaaaaaaaaaaaaggaaagaaaguggucucaguuuuuuuuuuuuuuuuuuuaauugaucauucuuggguguuucucgcagagggggauuuggcagggucacaggacaauaguggagggaagaucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucauagaucaauagcaucccaaagcagaagaauuuuucuuaguacagaacaaaaugaagucucccaugucuacuucuuucuacacagacacggcaaccaucugauuucucuaucuuucccccaccuuucccccuuuucuauuccacaaaaccgccaucgucaucauagcccguucucaaugagcuguuggguacaccucccagacagggugguggccgggcagaggggcuccucacuucccagaaggggcggccaggcagaggcgccccccaccucccagacggggcgguggccuggaggaggugccccccaccucccucccggacggggcggcuggccgggcgggggcugaccccccaccucccucccggacggggcggcuggccgggcagaggggcuccucacuucucagacggggcggcugccggguggaggggcuccucacuucucagacggggcagcugggcagagaugcuccucaccucacagacggggucgcggccgggcagaggcgcuccucacaucccagacggggcggcggggcagaggcgcuccccacaucucagacgaugggcggccgggcagagacgcuccucacuuccuagacgggauggcggccgggaagaggcgcuccucacuucccagacugggcagcugggcagaggggcuccucacaucccagacgaugggcggccaggcagagacgcuccuuacuucccagacgggguggcagccgggcagaggcuguaaucucggcacuuugggaggccaaggcaggcggcugggagguggcgguuguagcuagccgagaucacgccacugcacuccagccugggcaacauugagcacugagugaacgagacucugucugcaaucccggcaccucgggaggcugaggcuggcagaucacuugcgguuaggagcuggagaccagccuggccaacacagcgaaacccugucuccaccaaaaaaauaugaaaaccagucaggcguggcggcgcgcgccugcaaucgcaggcacucggcaggcugaggcaggagaaucaggcagggagguugcauugagccgagauggcagcaguacaguccagcuucggcuuggcaucagagggagaccguggaaagagagggagagggagaccguggggagagggagagggagagggagaggucucaguuuuuaauguaaauauuuuuaaugggauaaugauauuuuaagauuaaaguauauuauauaucaguuaacuacaggucaauaauuauauaaaacuuaagguaugaaaaacauuuauuuuugcuaacauaucugugaguugacuguucuuggcuuggugaggcugcaagcugcagauagagucuagguauguuuucuguguguuuguucccccuuggaucaguggacuaccugaggauguguuuuugucacagugauagaaucacaaggaaacuccaguucuggaaguacauuuuaagccauugcuucuaucauguccacuaacauucagucagccaaagcacauaccuuguccauggcuaacauugauaguauagauaaacauaccugaucucuagcaggaggaacugcauugucuuggggaaagguuguagauauagggaggggugaugaguugggaacaauaaugucgucugccacaaacauauuaaaguguaacuggauaugguugaugcagaauuuugaaccuuuguuuuaauucugauuuuuacucuuuucccccaucuagugcccuuuuguaauacaguaauucucaugauuuuugucugaauugaaaucuucuaugagauuagauugucuacgaaaauacagucgauccuccuuguuuucagcuuuuguauuugugaacucaccuacuauuuuuuguaaccccaaaaucaguacucacagcacuuucauagucauguguuugcauagagugucaaagaauuucaguuugaacaaagugauauucugccuucuuuuucagcucucauacaauagucagguauccuuuuuguggucuauuuaaugccaugcuuuuccuauuuuuguacuguuuguugguuguuuugccacuuaaauuaacccccaagcauagugcugaagugcugcuuagcauucacaaguccaagaagucugugaugugccuuacagagaaaauagaugcauuaaauaaacuucauucaggcgugagugcuguagugccauuggcugugaguucaauguuaaugaaugaacaauauauauuauuuauuuauucauucauuuaauuauuauuauuauuauuuuugagauagaaucucacucuguugcucaggcuggagugcaguggugcagucuuggcucacugcaaccucugccucuuggguucaagcgauuccccugccuuagccucccgaguagcuaagacuacaggcaugcgccaccaugccuggcuaauuuuuuuuuuuuuuuuuuuuuuuuuuuuguauuuuuaguagagacgggguuucaccacguuggccaggcuggucucgaacuccagaccucaagugauccgccugccuuggcuucccaaagugcugggauuacaggcguuagccacugugccuggccaacaauauauauuaaauaagcacacauacaacaaaaguagguguugguaaguuuacaaaaaugugaccaguagcuugcugaaaccuaacuuuuuauuuguucauggaacuuucuagaccguaacuacacugaauaaugagaaucugcuguaaucuuuuuaggugcuguagaugagccauuggauuaaauuauuacaguauguuucagacugcucuauguuaaacccuagugaagugccucucaaacccucauaaggaucacaaucucauguccuuucuuuuguuauugaaugcccaguauguguuagcgauuuaaacaaaauucaaauauaauuuuuuuuuuuuugagacagagucucgcucugucaccuaagcuggagagugcaguggcaugaucucggcucacuacaaccucugucucccggguucaagcgauucuccugccucagcauccugaguagccgggauuacaggcgcccgacacccacgcugggcuaauuuuuguauuuuuaguagacacgggguuucgccagguuguccaggcuggucucgaacuccugaccucaugugauccgccugccuuggccuccuaaagugcugggauuauaggcgugagccaccaugcccggccuugacuuuuuaauaauaaccauucugacuggugugagaugguaugccauugugguuuugauuugcauuucucuaaugaucagugauauugagcuuuuuuucauaugcuuguuggccgcaugugucuucuuuugaagugucuguuuauguucuuugcccacuuucuaaugagauuuuuuuucuuguaaauuuguuuaaguuccuuaucaguguuggacauuagaucuuugucacaugcauuguugcaaaaauuucucccauucuguagguugucuguucacucuguugagaguuucuuuugcugugcagaagcuucaagaagaaaggaauccgauugguucugugucugucucuuuugguauucucaggcuuauguagucauccauauagaaagaugauuaggaaaguaggacaagaauagcagaaaucuacauaaaaguguaggaaauuaaaauuaguuaccagcauacaaaaaacuacuauauguuauaauuacauacuauaacucaccccuccuugccaaauauucucucucuuuugacuucaaaaucauggcuuauauguacuuucuccauuucccagaugcaaauauaauuaauugacuuuauuuaucuaggaaauguuacugauaucuuaauuguagucauuggcuugagugauggguuuugguaauucaacuacuauuacuugaaaguaguagauuucauaggauacuguuauaaaauguuuuuaaccucuuuucugauuucaggaguaauuaguaauugugguuuacuggaaaauucaaugaauaggguguuaaaggaagcaauuuauuaauaauauaucuaaucuaucaugauaaaauauuauauacuucauauguaagcaggcccuccuaauuauauuaaguuguuauauuauuaaauuuguaucuauauucuuuauaucauuuuauauauggguauguauauauaaauauauauauauauauauauauauguauuuuuuuuuuuuuuuuugagagggugucugguucugucaccaggcuagagugcaguggugcgaucucagcucacugcaaucuccuccucccggguacaagugauuccccugccucagccucccgaguagcugggacuacagguacguaccaccacacccggcuaauuuuuguauuuuuaguagagucgggauuucaccauguuggccagucuggucuugagcuccugaccucgugaucugccugccuaggccucccaaagugcugggauuacaggcaugagccaccgcauccagcccauaguuguuacucuuuugccuccagguauaggacuccuuuaaacauuucuuguaggccuggccuaguggugaugaauuuccugcuuuuguuugccugagaaagacuuuauuucuccuucauuauaacugcugaguguacuagucuuggguggcuuuuuuuuuuuuuuuuuuccuuucagcacuuugacaauaucauuucauucucuucuggccuauaagguuugugcugaggaauccacuguuaagucugauggguguggucuuauaugugacuagacuuuuuuuuuuuugcuguuauuagaauuuccucuuugucuuugacuuuugacaaucugacuauaaugugccacuaaaaagaccuuuuuggguuguaucuauaugggaaucugcuaucuucuuguaucuguaugucuaagucuccuguuagacuugaaaaguuuucaacgauuauuuuauuaaauagguuuucuaugccauugaucucuucaccuccuggaacacccacaauucagauauuugguugcuuuauggugucccauacauuauguaggcuuucuuuauucuuuuuuguucuuuacuuuuuuuuuuuuuugucuaacuggacuguuuggaaagaccugucuucaaguucugaaauucuuucuugugcuugaucuagucucuuguugaagcuuucaguuguauuuuuuauuucguuuauugaauuauucuaagauuuuguuuuuguaauuuauuuaucuuuggugaauucucauucauaucccaaauuguuuuucugguuccuuuguauuguuuaucuguguucucuuguauaucacugagcuucuuuuagacuacgauuucgaauuuuuuucagacauuucauauuuucuuuucgcuggaaucuguugguggagaauuauuguguucccuuggaggugucacuuuuccuugcuuuuuuguguuucuuguguucuuacauuguuaucugugcaacucuuguaacaguuacuucuuccaguuuuuuggauuggcuuucauagaggaauauuuuuuccuguagauguaucuaugguguugguuagguagggcgcuucagcauugauucuggauuuguguaguaguguagucuccauaugacuucuuuggcuuuaaacccugucaguggugucuguguuuuccucagaggcuuaggugaauuuguuaguggaggcuguggugagguuuaauuagguguggcaaugccaggugggccagucuucuggccccagugguggcaauguugggcugaaugucccuguucuugggcccuugcgcacaguauaugagcacugguguuaguagguucagacaggcugauauuugagccuccagguggcuuuuugaggugccaguaguggcaguggugaguugaguggguggguugggccccugagcauugugcaugguguuggugauggcaguauaguggcagggcaacaccugggcuuccagguagcacacacuguuguuagugguggcugugacagacugggcagccuggucuucagacccccaggugguacacauagcugggugccagguuugguggugguggcaggcugagcaaccuuguccuccagccccuaggggguguagauagauauaagcagugguagacugggcagggugaacccccaggccuuuagauggcaugcuuaggcacuggcaguagguuuucuggccuguuauuaugccaucugguaguacacacuccugcuuggagugaccaguggggcacagcaauccuaggcuauaugguaggguggugugguagggcacuugguuggggugacauugucaggucuaggguggugugguagggcacucagggggugacagugucaggcauuuuuuuuuuuauuauuauacuuuaaguuuuaggguacaugugcacaaugugcagguuaguuacauauguauacaugugccaugcuggugcgcugcacccacuaacucgucaucuagcauuagguauaucucccaaugcuaucccucccccuuccccccagugucaggcauuuuggggcugucaucaggucccccugaugguccaaauggguauaggcugugguaggugggacgggggcaauuccuaggccuucagauggcgugcuauggugcggcaggcauucuggggcuguuuggucuccuuaugugcaugugccugaggugacugauggugcaggggaauccauaggccccugggcagugugauagagagcacugggguugcuggugccagaccuugugagcuuguccuuaaggccucugauguugugcacaaaugcaggcuguguugggcagggcagggugaucaacauguccuggauaguguccuuggguggugguugcagcagcaguaguaggcagggagagucuauccucagggcauguggaaaugaacagcucugcuaaggggaaggcucaaugacagagguggugggggugguggugagggagauugaugccagugguagccaucccaggcagauacaucucagucucuggagagcacaugcuuugucuccacuuccccuauucccuguggcauuggcugcauuggcuagggugagccuguccucaaggcacauguaccacaguccugcuguuguggguagcaggguugcugucugugguaccugccccaggcaggugauucuuaggcucuggucccuggcugcagcagcaggcagggagagccugcccuuagagcaugugcgggugugcuggggcuuuguugccggggguaggugggcaagguuacucucaguggcagugaccugaggcaggugggucugggcuuuggcucccuuuguccuagaggcagcauccacagggcucuggauuguccuuucuucaguguacuggaugcugugugauccagagugcuggggauauuucugcugugcuggguccaacuggugucaugugcuacaacccucucaguggguaugaggggaugucauggggccuccagggauguggagaugcagguacuguuuggccccagaaagaaaacagacugguggggucugggcucucaaauucgugccaugcugcaggugcuuggguuuccaggugugcguggaaccuauugugagcuuccucuuuagaagcuuguuuauaccagucucagcuugucaggguuaagggacugugcuauggcuaggauugcagguaucuacagggagaauguggaugcugggaaucuuuuacucaccuuuuccccacacugaggagccucuuagggcucccagcugguccuggcugggcucugugccuugcuuucuucagugccugucacuucucugcugaauuccaacauucucucuuugaugcuguauuugaagugugauuaucuacucauuaagcuuuucuuuguagaggaggugagugucuggugcuucuaguuagccaucuugaagucccccauaagcuuucuuuuaucaguucaucuagagcugauauuguucagugccuuucuccaggauugucuucaacucuuuuucuuuucaacaugaaagcaauucucugccauuuauuuuuaaauuacaugacuaagguggagaaagcagguucaggauaccucagaaugcuuggacauuuuagugggagauaucuccauuagcggaucuuagucauggaaguuagaagaguuuucagauguuuuauuuauuuuugaauaguacguguagucauucugauacccagcuauuccaaaaaaauggcacuuauuauuuggagaugaaauauauuagucaugucuuuuuacuggugaauacuuucucuuaagaacuuaaaauauuuaauuuuuauuaaaauaacuguucuggguuuauuuuuguuuucuugagcaaaagaaaacuguuaacuuaagguauuaauaauagauauaacuaaaaaauugaaugauuugaaguacauuuuauuucuuuccauuuucuaaauauuuacagaaacuuuaauagaaacuucuuaacauugguuucugcgcuuuugacauguccccaucauuuuuggaguacuuucuuacauuuuggcacaacaagauguuccagggucaucuuauacuuucccuaauuugauccuaccuacuuuucuagugauccauggcuucauucaacagggaagucaauuuagaaauuaagauuugguacucugguuauauucauugcuguugggugucauugcuucuagccucaaaagacaaagcuaggagggagauaaaccaauccaaaaauuaaaauaaguaaaaaauuaugaguucauuuggauacaucuaauucuaauccaacuuucuagccuuuucccguuccauauucguaauucacuucuccaacagugaagaacauggcuuuuaacauuauaauuauauuuacucauuuguucaguguuacaguacauggaaaguaguuucagaauugcuacacccaaagcucuuguuguagggugaauucuaagauggcuccuaagagucccugcacuucuccuugaauguaguuuugaacuauaaguauaaugggcuagucacuccuaugauuacauugugugacacaauggacuuuaagaaagaaaauugucuucaguggauccagccucaucaggugagcacuuaaaagcaguugggcucuuccuggcaaaagguauucuaaguguaggagggacuugaugucagggagauucucugcugcugguuuugaagaugaaaccagaacuugugaaugaugaauuugaauauauaggcaaggagauuucuaagcaaaauguugaaggugcugccugguuucuucuugcuccguauaguaaaauaugagaaaaccaagggaaguuuuguuaaaagggaaccaagacuagaugauuuaguuaauuuuuagccuaucaagaugacaaaggaugcuaacauauagcaauaacuucugaaagcaugguauggagaaagccagggauguggcuguauaauaacuucagaaagaucaaaagaugagaguauucagucacacuggacucuuccaagaaauuaagggcgugccucacagaucuucuuaaccaaaccaggugaucucuaggaaacuuaagaguauugcuccuuaacaaguuaaacaacagcuauagauaaagaacagguuguuuugcaaagauuuguggguuuggcuuucaucauuacuuaauauguuuguuuuuuacagaacugcauuaauuuucuauugcucuguaacaaauuaccaaaaaccagggacuuaggacacccccaguuuauuaccuaacagcuguuuaggucagaagucugucacaauguggcuacauuucucugcugagggucuuacagacugaaaucagggugucaguaagacugcacgcuacuaggucagcauuccuaaugcauuccuugccacauaguucccuccaucuucagggucagcaaaggagaaucuuucucauguugcaucuaauggagauugcacauagggucuagaaagcuaagaguagccccagcugacaggcagcaagcaaauagggaucacaguucuacaaccacaaggaacuuguauugugccagcaaccagaauaaacuuagaagcagauuauuucccagaaccucuagaaaauaguacaguucuacuaacauccugauuucagucugugagauccugagcagagaaucuagcuacguugugccagacuucugaccuacgcagcuguuagguaauaaaucggggguguacuaagucccuagguuuuugguaauuuguuacagagcaauagaaaacuaaugcaguucuguaaaaaccaaacauauuaaguaaugaugaaaguccuugaggaguuguuagggauugugaucaaacaaagagcaggaguuagcuuuuggguaggaggaaggaauacuuuuuuuuuuuuuuuuugagauggagucucacucugucgcgcaguggcgugaucucugcucacugcaaccucugucuccucgguucuagcaauucuccugccucagccuuccaaguagcugggauuacaggugcccaccaccaugccuggcugauuuuuguauuuuuauuagagaugagguuucaucauguuggccaggcuggucucaaacuccugaccucaaaugauccacccaccuuggccucccaaagugcugggauuacaggugugagccaccacgucuggcuggaguacuuuugcacugggaauggaagggauaagaaugagcucauaugcagcuguauuuacaagugguagcuuuagauaggaaaugaauaaugccuccaucuauuagcagagacauuuccuaguuuuguauugggagauauugggauagggccuucaguagaauuguaaagacauagaacagcuguugaugguugugagagaaacauuacuggaagaauuauggaaguauuacgggcuacaaaauguaaauuuguagaaacaaucauucugcguguucauauccuauuauugagucuuauucaggagccuagguauuuggauggacuacggugacugugggggagaacgggggagguuauuuuggaauaaaagcacuucauuguagauucaacaaaaggacacucaggauuaugcugagagagugguucaaguuuaggauauugaaaauuuaagaauucaaaaaacugcaagauaggagguuguguggccaguaagugugauaucuagagccuaaaacauauuuggugauaaauauuugugaaaucaguaaauauugagaguucaggauuuuagaagcauauuaugaccauucaugguaguggcagaauuagccauaguuggcacugcugaaauaucuuguaacaagucaucagaauugaguaggccaaggaagauugaauuuguuuuugagguauucaaauggauauuaaaauuacucaggaauuagacuuggacuuuagaauccuugauuuaugcaagcaaaugacuaagaguguguuaggguuggcaaaccauggccuuggggcaaauccagccaccacccuguuuuuguaaauaaaaguuuuauuggaacauagacacauccauuaauuuacuauucccugugacucccuuugaauugcagugguagaguugagcaguuauagcagagagcauguggcccacaaagccuaaaaugugaucugacccuuuagaaaaaaugugugcagauuccugaauuuaagcugugaguauucuccccagcaaaauguauucacacaaaauuuuguugaccauuucaggagauuugauaauuccugaaagguggugaauggacucuaguuaagaagaacuuuuggaucugaguucccaguauauucccuacuauuuucugcugcauuucgucucuucuuggggguaggcuuuguuagcucaacaugccaaagacauggguacuaucauucaguaacuacagauggcacuguuacaaagggagcuguuuuuauaacuugucauugggguagccacaagaguacagacagauuacagacagauuaucagcaaucucucucucucucucucucucuuucucucucucugugugugugcguguguguguguguguuuugaggaaaccaguguuggucauggauaauuaauguccucucucaaaguauagcauauuaugagaaauaaauaguugcuuaauucuuucuucuaggcuauuuccaguuaaggcuguuaaauaaaggaagagauauuuuucaggagugccuauguuuagauaagagaagaagagagaaaaaguaguuuauuuggugaaaaaguguuuagucacuaacuguucuuuaauaggugucucuuuaaaaauuguuccacuaauguuagccaugguacugaaucuguuuagacccauuuaagaauccuuaguugaacuucauuuuguuaugacuaauuuuggucacuguuuuaacacaagggcacuuaacauucccauugccuuugucaugcuccugucuuuacaaauaagaaacaacauucacagucuuguagguuuuuucuguuuaaccuacuaucuguguucuuauucuggguacuuaacaguaaaggugaccacauguccuuuuauccuaaugagaggugaagccagcuggacuuucugggucggguggggacuuggagaacuuuucugucuagcuaaaggauuguaaacaccaaucagcacucugugucuaacuaaagguuuuuaaaugcaccaaucagcacucuguaaaaauggaccaaucagugcucuguaaaauggaccaaucagcaggaugugggcagggccaaauaagggaauaaagcuggccaccccagccagcugccgccaccugcuaggguccccuuccaccuuguggaagcuuuguuguuucacucuucacaauaaaucuugcugcugcucacucuggguccgcacuaccuuuaugagcuguaaacacucacugugaaggucuguggcuucacuccugaagucagccagaccacgaacccacuggaaggaagaaacuccagacacgucugaacaucugaaggaacaaacuccggacacaccaucuuuaagaacuguaacacucaccgcgaggguccauggcuucauguuugaggucagugagaccaagaacccaccagaaggaaccaauuccggacucacuaaugucuucugcaauagggguaguuuucuuuuauuaaaaaguauccuuucuauuucaagaugacauuucaacucuaaucaauaaauaucaguaaaagaucugcuuucuggggucugccuuuaagaccugcauggguugagugaguuguuggguugcuguuuagacaaaguacaagaaguaugguucuaaggauggaauugaguagcagccaucuguagaauuccugagucugggaaugaggagaggaagcugguaaacuaggaacugacugggagauaagcaggcuaugcauuggauuaagagacuaggcagagaugucaguggagauggagcuuaguuaagcagaggaggagacugagagugugguguaguguacaggauuggggaagacaagguaguuuaggaucuaaguccucaaaggcugggcaugucuuggauuauuggaauguuucuuuuauugcaaaucaugaacuguuuuccuugcucagaggcagauaucuaauggggcaaaaaucagaccagaucccuguuaacugcuagucacuauaaauuauuuucuuucuuuucuuucacuccccuuccuucacucccucccuccuucccucccuuccccccucacucccugccuccguccucccuccauccuccuccguccucccucccuccucccucccuuuucccuuccucccuuccucccucccuuuucccucccuuuucccuucccuucucccuucccuucccuuuccuucccuucccuuccuuucccuucccucuucccuucucuucccuucccucuucccuucucuucccuccccuucccucccuuuccuuccccuccccuccccuucccuucccucuucccuucccuuccgucuucccuuuccuuccgucuucccuuuccuucccucuucccuucccuucccucuucccgucucuucccucuucccuucccuucccucuucccuuuccuuuccuuccacaugcaaucuggccuucagcccaaauuuaucuauacugagaacuuggagggaguacaaugagcuauuucuuugcccugaaguuguuugcccucgauaauagguauuuucuuuuucucuuuuuuuaauuaauuauuuuuuuucuuaagcauaggcugacaaauuucuacuuucaaaagagauuaaugggacccuuagaaauccuuuggauuuaaaucauuuuauuuuucaguacuuugguugcacagauuuuuuuuuguuuuguuuuuuguuuuguuuuuguuuuuuuuaagacagagucucacucugucacccaggcuagagugcaguggugcaaucuuggcucacugcaaucucugcuucuuggguucaagugauucucaugcuucggccucccgaguagcugggauuauaagcgugcuccacuaaaccuaucuaauuuuuguauuuuuaguagaagugggauuucgccauguuguccaggcuggucuugaacucguggucuccagugaucugccagucucagccucccaaaguccugggauuacaggcgugagccacugcacccggcugguugcacaaaauugagaugaauuuuacuucucuauucauggcacucuauucauuugcuuaugaaaauaauuucauggcacuuugauggucaguucucagcucugguaauacuguaacucucaguagcaguugacacagcugauuacagucacuuccuugaaacagcuucuuuacuugacuuugaauuuacggugcucucuugguuuucuucuuaccucacuguauguuccuuuucacucuuguuuuuucacuccuccuuuucuauucaacuucuaaauauuggaauaucccagggcucaguguugagcccucuuuuguauuaugcuucugccucuggauacaugaguuuaaauaucauguauagacacuaauuacauacaaauuuacagauuuuacucuauuuucucaccugcccaguauuaccaacuaccuacuugacaaauuuagauguaucucaccuuaacaugucaaaaaaggaaauugugacuuuucuuccuagaccuauuccuucugcaguugguugucuuuauuucucaguaaauggcauugccauucaccaguugaggaagucaaaaaccuguaaguuaaacuugacuucucccuuuucccucacaccccacaucuguaccauuggcaaaauaugucuuaccaacaaaacuuuaugaagaaaguuguuacaaacauuuguguguagguuucgugugaacauguuuucaaaucaguaauaccuaggggugugauugcugaucgugugguuagacuguauuuagcuuuauaagacacugugaaacugucuuccaaaguggcuagaccauuuuacauucccaccagaaaugaaugagaguuuccguugcucuguagccucacuagcaauugguauuguuaguuuuugguaguuuagccauucaaauagguguuuagugggaucccauuguuguuuuaauuugcauucccccaugaugaaugauguugagcaucuuuucauguuugucauucuuuuuuuuuuuuugagaugaagucuugcugucucacccaggcuggaguacaguggugcagucucggcucacugcaaccuccacuccccagguucaagugauucuccugccucagccucccagguagcugggauuacagguguccaccaccaugccugccuaauuuuuguauuuuuaguagagaugggguuucaccauguuggccaggcuggucucgaacuccugaccucaagugaucugcccaccuuugccucccaaagugcugggauuacagguaugggccaccacacccggccuguguuugucuuucucauaucuuuuuuuaaugaagugucuauauucaauuuuuuucugcucagauuggggaagagagaaguguucauuuuguuaauguuuguuuuucaguuuuuuuuuaaaaauauauauauucucaacuuaaguccuuuuuuaaauaugugauuuggaaauauucucucucucucucucucucucucucucucucucucucucucgucucgguucacugcagccucgccagccugggcucaaacgauccucccaccucagcugggauuauaggugcacaccaccgcuccuggcuaauguuuuguauuuuuuauagauacggguuuggcauuuugcucaggcuggucuugaacuccugggcucaagcgauccaccugucuuggccucccagagugcugggauuacaggcgugagucagucuguggcuuuucuguucauucaccuuguaaagcagaaguuuuaaaaauucuaacaaauucuaauuuaucaauuuuuuucuuuauagauuguguuuuuaaaaauauuuuuaaaaauuucaauagcuuuugggguacaaaugguuuuuauuuacaugaaugaauuguacaguggugaagugugagauuuuagugcacccauaaucugaguaguguacauuguguucaauauguaguuuuuuuaucccucauuccucuccuuaggcccuucugaguuuccaguguaccacuguauauaccuuuguguacccauagcuuagcucccacuuacaggugaggauauacaguauuuaguuuuccauuccugaguuaccucacuuagaauaauggucuccagcuccauccaaguugaugcaaaagacauuauuucguucuuuuuuauggcuggguauuuuuucaugguguauacauaccauauauucuuuauuuacucaucaauugaugggcauuuugguugguuacauaccuuugcaauugugaacugugcugcaauaaacauaagugugcacguguuuuuuugauauaaugacuucuuuuccuuuggguagauacgcaguagugggauuguuggaucgaacgguagauuuacuucuuugagaaaucuccauauuguuuuccauagagguuguacuaguuuacauuuccacuagcaguguauaaguguucccuuuucaccacaugcacaccaacauuuauuguuuuuucacuuuuuaauaauggccauucuggcuggacuaagguggcaucucauuuugguuuuaaugugcauucccccagugauuagugauguugagcauuuuaucauauauuuguuggcuuuuuuuuuuuuuuuuuuuuuuuuuugagacagaguuucacccuuguugcccaggcuggagugcaauggcgcgaucucagcucaccgcagccucugccucccggguucaagcuauucuccugccucagccucccgaguagcugggauaguagcugggauuacaggugugcgccaccacaccuggcuaauuuuuuguacuuuuaguagagacaagguuuaacuauguuggccaggcuggucuugaacuccugaccucaggugaucagcccgccuuggccucccaaagugcugggauuacaggcgugagccaccauaccuggccuaggccauuuuuauaucuucuuuugagaagugucuucaugucauuuguccacuuuuugaugggauuuuuuuuuucuugcugauuuguuugaguuccucguagauucuggauauuagugcuuucuuuguugggcgcauaguuugcaaauauuuuuucccauucuguggguugucucuuuacucugaugauuauuucuuuuguugugcagaagcuuuuaaguuuaauuaguucccauuuauuuauuuuuguuuuauuugcuuuuggagucuuagucauaaauucuuggccaguuuccagaaaaguuuuuccuaggauuucuuguagaauuuuuauggguucaggucucagauuuaccucuuuaauacagggauguccagucuuuuggcuuccuugggccacauuggaaaaaaaagaauugucuugggacacacauaaaauauauuaacaugguagcugaugagcuuaaaaaaaauugcaaaaagaucuuguaguauuuuaagaaaguuuacacauuuguguugggccacauucaaagccauuccgggccaugguuuggacaaguuugcuuuaauccauguugaguucauuuuuguaggcauacaguuuuauucuucugcuuguggcuguccaguuuucccagcaccauuuauugaauaggguguucuuucuccaauuuauguuuuggugugcuuugucaaagaucaguugguuguaaguauuuggcuuuauuccuggguucucuauucuguucuguuggucugcauaucuacuuuuauaccaguacuaugcuguuuugguugcuguagccuugucaauauaauuuggaguuagguaauguuauaccucuugauuuguucuuuuucuuagaauugcuuuggcuauucaggcucuuuuuuaguuccauaugaauuuuaggauugauucugugaaaaaugauguugguauuuugauaggaauugccuugaaucuguagauugcuuugggcaguaugaucauuuucaugauauugguucuugcaauugaugagcaugggacauauuuacauuuguuugugucauuugugauuucuuucaguaguguuuuguaguucuccuuguagagaucuuuuaccuccuugguuaaguauacugcuagguuuccuuuuuuuuuauuuuuugcggcuauuguaaaagggauugauuugagaaucagaucuuaauuugauuuuccaguuugguugcccuuuauuuuuuuucucuugccugauugcucuagcuaggacucccaguauuaugaugaauagaagugugguaaaagugggcaacuuggucuuguuccaauucuugggagagguggggauucuuuucaacuuuuccccauuuaguaugauguuggcuguggauuugucguauauggcuuuuauuauuuugaaguauauuccuucugugccuaguuuguugcuuguuuuuaucauaaagggaugcuguggggcauuuuaucggauguuuuuuaugcauccauugagguaaucauaugguuuuuguuuuaaauucuguuuauguggugaauuugcauuuauugacuugcauauuaggccacucuugcauugccgaaaagaaauaccugagacuggguaguuuauaagaaaagaaguuuaacuggcuuaugguucugcaugcuguacaggaagcauggcaccagcaucugcuuuuggggaggccuggggaagcuuuuacucguggcagaagaugaagcaggagcagauacuucacaugguggaagcagaagcgagagagagagugagcggggacuuguuacacacuuuuaaaugaccagaucuugugagaacucacuaucacaaagacagcacuaauccaugaaggauucacccccaugauccaaacaccucucacuaggccccaccaucagcacugaggauuacaauucaacaggagauuuggcuggggacaaauacacaaacuauaucacauauauugaaccauuccuucaucccuuggaugaaacccacuuuaucauggucaguuaucuuuuugaugggcugcuggauuacguuuguuaguguuuuguugauuuuugcguguguguucaucagggauauuggucuguaguuuucuuuuuuugguuacauuuuuuccuaaguuugguaucaggaugauaauacaggcuucauagaaugaguuagagaggauucccuccuuuuucucaaucuuuucuuaucuuuuuuuuuuuaaacuguaaguucagggguacauguacaggaugugcagguuuguuacauagguaaacguguguuauggggauugguuguacaaauuauuucaucacucagguaguaagccuaguacccacuaguuguauuuacugcuuuuuucccuucucccacccuccacccucugauaggccccaguuuguguucuuccccucuaugucucuguguguucucaucauuuagcuccugcuuuuaagugagaacaggcgguauuuggucuuuuguuucuguguuaguuuucuaaggauaauggccuccagcuccauccacaucccugcaaaggacauaaucucauucuuucuuguggcugcauaauauuccaugguguagauguaccacauucucuuucucaaucuuuuggaauaguuucaguaggauuggcaccacuucuucuuagaaggugugguagaauucugcuaugaauccaccugguccugaguuuuguuuuuuuuuucuugguuggcuauuuuuuaaauuacugaugcguucucacugcuugcuauugguuuguucaggauuuccauuccugaugcaagcucuggggguuguaugcuccuaggaauucaaccauuuccucuagauuuucuaguuugugugcauagagguguucauaguaaucucaaaugaucuuuuguauuucuuuggugucaguuguaaugucuucuggauucuguuuucaguguuguacaugagagcuuuuuaccaaacacagauuuucucuaguuuuucuuagaguuuuacuguuuuggauucuggauucagggcugucauccauuuugcauuaacuuuuguauacaguaugaauaauagguugagauuaucuuuuuuugucauaugauugauuaguuauuucagccuuauuaguuggaaaaacugaccuuucuuuauuaaauuuccuuugcaucuuugucaaauauuaaauaucaauaguugaugauauuugagugaguuuauuuuggggcuuucccuuguguuuuauggguauguguuuaucuuuuucugauacaguaccauucugucuugauuacuguagcuuuuuuucccuuuucaacgcuuuauaucauuuauuaaugcaguauauauuagaucuaaaaucugcaguuucuaagcacaccauguuuagcuuuuacagauccuucugcaguuuuagguuauuucuacagagguaccuucaagugaaugaauaacauauucucuaauuccugaaaauauaguacagaaugaaaugauuuaaauauaauuuagagacauacugauuauggaaauagauuaucucucaauacaauacuuucugucuugguaaaaguaauaaagcaaagaaaauaauucauuucugaaguugcucuccuucacuuguaaaguucugaucucuucccacuaugcauauuuacccuuuacuguuaaggaaagcuuugcauauguagauauagaagaauaagcacgaaaauacuaaagauaugucauucuccuaaaggagacaaaagugguuuucagugauuccuugccucauguugaugagucuguagaauucagaacccauuuggacacagcuaguaucccugcucuugggguagauauaaggacaccaggucauugguaggcagguacaggcccuuccucugcugcugcagagagauaaugacucaagaaaauugggcugaaauuuguuuuaaaaaaacccaaaaaauauaaguaaaagaaucacaggugcugacugauugguauuacauuuuagaucagccaaaugccuuuauuuuuacuuuauauauauuuacugguggcuguaaucaaaugucugucuaaaauuccucauuacccacuguaggguucuagcuucaauauauuacauugucuuuuaucaggcaacucugccauauucacucauauuguauaagcuuugauugcaguagaucuggauuuaauaucgauuucuaagcuggccuuauguaaauuauuugguauuugaauuaaaugaauauuaaugauguaccuugguuuuuugguuuugaaguaucuuccuaugcuugugccgaucguaugggaaaacuaggcuaauaguguaaauagauagaauugcuuggucugguauugaguggaacuugccucugguauugaguggaaccccccuaccccauucaaaaagcagcaauaucuaguuuccguauaccuauuaaugagugcuuuucuguuaaaaaucagaauauggaaaaaaagucaauuuuuucccuuaugcaccgcugagagcaagcauaauucucucaauguuuuuuaaaaauuuccuuacaguguuacuucuucuagacaacugaguggguggagaaagaaaagugauaaggaaaauguuuucaucuuguacaucuuccucuagccccuaaaauucucaucugacauuuugcgacauguauaguggugucagcaucucuucaaauauagcucccuacacguuggacccucucaaguuggcuucuugaagaucacacccagacagaucacaguucucuaaauugguuccugccagaguugcuccucugagguuacaauucuucaacuuugcauuuuuuaagguagccacucucaaguuaauuccugucaucugacuuccuuccauauccacaccuuucagauuagcaccuucuaaauuggcuuuaagaccagaaagauccucaaaauuacacaguuucagggaugcuccuucugcauuagaacagagcaucuugacucccuggagauuugcacagucaagcacugauccagagagaucaccucauucaagauuugcacaguaaagauuugcaugugcaagauugcagcggcuuaaauuggccauuuugaaguuaauguaucgaagguccuaacgagaaacaucagcaccacugaaguucaaacucugguaucacaguucugacuugguuggaguugcuaucaaaaaucggacaaauuccuuucgagauauuggugaaugauccucuggugauugagaauucuuuauugccacuucuagguguucaaucagugagucaauaccaaaaaaucuugcuucuucuaacacacccaauaaauuaaugccaucauuuacaaugagcuguccaugacacaaguaguucaaaguggguucaaaguacucaggacuuuggucaauuaagaaggcuccucuaugaucuugcuuauuuccccagacaccucuguucuuaagcaugugggccagcauacugucagguucuuuauucgcuaaagugcuccguguaguuguaaaguaccucccuccaacauuuaauguuagccacucuguguggaauccuaacaauccuucaggaggcuuagaaucugucugaagaucaauaaauggcucucccucacacacaaauaaaacaucaucaucccugaucaaagcaauaucaucagucaguccaccuuucucauuauacacacugguggcuuuuaugcugaguuuacugcuggccacagaaagcaaaucagauaaaguuccauauacagcaaccaccuuuccguucuugggggcugcuguucaggaacagggucacccgccucauugcgcugcccccgguggguccugagugagccaccacccucccacuugguccuccucccaccuuuuucucuucccaccuuucccuucccuccacccacuuggauucaccucccuuugccaccuuccugcccuuggggacacacacacacaggcacucugucccacacccagggcucggccagucuuccuacuacuacagcuuuuaaauauuucuuacauauuaacaaacuuaaacuuaaauuugguaggaugcuuuccaacuuuuuuuuuucuuuuuaaaaauggcuuugacuauucuaauuucuuuacuuuuucauguaaauuuuagaagcacccugucuauaucuacaaauaaucuuguuagaauuauuuuguggauacauucuuuuuguacauauuuaugggguacaugugauauuuuguuguauacagagaauauguaaucaaguucagguauuugagguauccaucaccuugaacauuuauuguuucuaugugcugggaagauuucuaguucucccuucuagcuauuuuagaauaugugagacauuguuauuaauuguagucacccuacugugcugucaaacaugagaacuuauuccuucuaauuguauguuugaaccuaucaacugauuucucuuuaucuuccccccuccccugcacuucuuagacacugguaacuaucauucuaagucucuacuuccacaagaucacccuguugggauuuucuuuggaauuauacugagucugaagaucaauuuggagaauugauguuuucaguauauugagguuucugauucaucagcacaguauaucuccccacuuauuuaggccuucuguuucuuucguguacauuuuauaguauaucaacauagggauccugauuauauuagauuuguaccuaagcauuuuguuuuuuugaguuauuacaaauaggacuuuaaaauauuuuuugguuucuaacugucauugguagugcauagaaauuuuauugauuuuuuugaauguuguuuuuuuauagaguccuugggauuuucuacauaaauggucauugugucuuggaaugaauguuuuauuucuccuuuuacaauccgaaugccuuuuauuuuuuuucuugccuuauuguacuuaacuagggcuuccagauugacauugaaugugaaugugguggggucagguaucuuugcuuaaaaccugacauuuagagaaaauauuuggucuuuuaccauuaaauagguaguuaacuguagguuuuuuguacguaccuauuauggacugaauguuugugucccccccaaauauauauauugaagccaucaccuccaauguuauaguauuaggaggugggggccuuugggagguaauuagguuuaggugaggucaugaggguggauucucuaugaugcgauuagugcccuucugaaaaaaaggaauagauaccagagcuuucugucuccugaccauaugaagauacaggagaagauggcccaucugcaagccaggaagggaucccucaccaacuuccagaauuaugagaaauaaauguauggugguuaagccacccagucuauggucuuuuguuauagcagcccuagcugacugagacaauaugcuuuuaucaaguugaguaaguuguuuucugucacugauuggcugagaguuuuuuaucaugaauggcuauugaguuuugucaaaugccuuuucugaauuuuuuaucuuauuauguuaaugugguuaauuacauugauuuuugauuguuaaaccagacuuguauucuuggaacaaagccuucuugguugcaauguacuauuccuuuuagauacuaguuuaauauuuuuucaaagaucuuagcuuuuauguugaugagggauguuguuuuguagcuuucuuaugucauaugguacuugauuuugguaucagggugaugguagcuucauaaaaugaauuuggaaguguacuauccaauucuguuuuggggaaacuguugugaaaaaguaauguuacgucuuccucaaauguuugguagaguuugccaguauagccaacugggcugggguuuucuuuucuguuuuugaaagcuuuuaacuaugaauucaguauauuuaguggauauaggacuauucgaguucuuccuuccuuuaaguuaccaaauuuaugugcauaagauuauuauaauaguaauauuucuuugggaucaguacugauauaucuccuaauuuucccugaauuggugguaauuugugucuucucucucuuucucuccuuuucuuguucuggcuaaaaguuuaucaacuuuauugauuuauuuucuccuacuugccuucuuuuucuaauauuuuaagauggaugcuuuaauuauuaauuugagacuuuucuuauuuucuaauagaaaugcucuaagcauuucuuuaacugugucccacaacuuucagauguuauauuuucauuuuuauucaguucacuugggauuaccuuuuugacccauggguuauuagugugguguuuaaauauacaaguauuugagacuuuuuucuuacuggcuucuaauuuaauucucuuaugaucuagaaacauacuuuaaaaaaaaaaaaauucuggccucaagugauccucccaccucagccucccaaaguacugggacuguaggcaugagccaucacacccagcccuuggaaacauacuuugaauaauuuuaauuuuuaaaauaucugaugaaguguguuuuguuacuuagaauaugauuuuagugaauuuucugugugcacuuguaaggaauguguacucacuugucaacacuuagugcugcucucuagucaaagccacugucgaucuucgcaugacucacauuaacaucuucccaguuggaccuauaaauucuuuuuuuuucucguuuuucaacaggcuuuucuucacugagcagcccuauagauucuuuuuuuuuuuuuuuuuuuaacagacuuuccuucacugggcaaccagaauauuuuuuaaaaaguauuuaguuucuagccugugcaguauagcagaaaccacaucucuauaauaaauaaaaaaucagcuggguguagcggugcuugccuuguagucccaacuacuugggagggugaggugggaggaucucuugaauucaggagguugaggcugcagugagcugugguggucgcaccauugcacuugagccucagcaacagagugagacccucaucuguaaacaaacacucccccccccaaaaaaaaacuuaauaaaauuauuuauuuugguauaauuuuaaacuuaaagaauagcuguaaauuaaaagggguguaaagcuucuuuauacuucuuuuucagauuuaccaauugcuaacauuuugucucauugcuuuauuuucaccuuaccccuuccuuccuuuucccuccuccauuccucccucaacuaacacaaacuaacccaccuuccuaucccaccuguauauacacacucauauauauaugcauaugcauauaaauuacauauauguguguuuaguuuucagcuuuugaaaguaaguuguaaacgucaugcucuuuuacuccuaaauucuucagugagguguuccuaauaacaaugcauuuucauacauaaucauaauuuucuuuuuuaagagacagggucuugcuuugaugcccaggcuggauuagaaucccugggcucaagcaauccuucugccucagucucccuaguagcugggacuaccaggcacaaguuaccaugccugguggauagccaugaauuuaacauugauaacguauuauuaucuaaaucacauuucacauucauguuucacugauuaucucaacaaucuguauaaugauuuuuucaccaguuccaggcucugaucaagaucacacauuguauauagucaucauaucuguugucuccuuuaauugggaauggcuucucugcauuauuucgucuuuauuuuuccuugacauuuuuugaggacugcaggucagugauuugauaaaauauagaauuugauuuuaccucauaguuugaauuagguuaugcauuuuuagaaggacuaugacagaaaugauaugguguccuccuuucuucaucauaccaggaaguaugugaugucagcuucaguuuguccuugcauuggugauguuaaccuagaucacuuguuuaagguggugucuaccagguuuuuccacuauaaaguuacugucuucucauugcaauuacuaaguaauuugcagggagauuuugaggcuuuguaaauauucauuuucaaacuuuucuccacaauuuuagcaucuauugaugauucuuuccugaaucaguuauuacugugaugauugcaaaaugaugaucuuuuaacuccaucauuuauuuuauguuuaucaguagcauucuacuaaaaggaagagcuuuguuuguuuguauauuuauuauauuaguauacacucaaugguccuuguuuuagugaaugguuuauaauucguuacuaucauuauuuauugugaugcccuaacuauuccagauuuagccagcagaaggcucuucaacgugugcuuuauccuuuuaacaugucuccaucaucuuuguaguacuuucuuuuuuuuuuuaauacaacaaaauguuccacguucaucuugcucguuuccuaccccaucucuguaaucaauaauuuuugcaagaagcccugguuccuuuuaaggagaggugauuguuagagaccaggaucucuguguuaguuuugcuggaauauauuacuucuagacauucuuaacauacagaauuagagaauaacuaacacauauauacauauacaacaauuuuaucuaccuauuaaaaaucaugaguucacauugauacccuuaauuucuauuuaacaucagagaguucauucuagucuuccgccuuuucacuuuuguaacuaucuucuccaacagggcuaaaccuuacuccaguuguccccagcacauuuccuccuuggcuuaguucuucauuauauugaaggcaguuucagaauugcuaaugcauaccacugcaaaaaagaaacaaauguauuaauuagaauucaauauuuauuuacaguucuuuuggucuuagacugagaauauguacuagguuccugggcuguuuuaacuaauuacuacaaacuugguggcugaaaacaacagaaauuuauucuuuuacuauuacagaggccagaaggcugaaaucaagguguuggcaagaauguuggcucuaggcaagaaugcccuuucuugccuuuuucagcuucuggugacucgggguauuccuuggcuuguggcuauauaacuccauucucugccucugucuuuacauagccuucucuuuuugucuuuuucucuucucuuuucuucuuuaaaaaaaauuuuuuuuuucuugaaacagggucucauaauguugcccaggcuggaguguaguggugugaucucaguucacugcagucuccaucuccugggcucaagccauccuccaccucagccucccaaauaacugggacuacaggcaccugccaccacacguggcuaauuuuuguauuuuuuguagagaugggguuuagccaucuugccuaggcuggucucuaacugagcucaagugaucugccugccuuggccucccaaaguguugagauuacaggugugagccaccacgcccagcccucuucuaucucuuauaaggacauuugcuauuggauuuagagccugcacagaauugcaucuagaauuuuuuuuuuuuuuuugagacagggucuugcucucuugcccaugcugaagugcagugguguaauaauggcucacugcagccucgaccucuugggcccaagagaaccuuccaucucagccuuccgaguagcugugacuaccguugugugccaccaugccuggauaauuuuuuuucuuuuuuuuguagagaugggguuuugccauguugcccaggcuggucucaaacuccugagcucaagcaauccgccugucuuggccucccaaagagcugggauuacuggcauguggcaccgcacccagccgagauucuuaauuauaucugcaaauaaccuuucccaaaauaaggucauguuuacauguucuugggauuagaauauggacauaucuuuuugggggccaucaacccacuuacaggguagauaguuaucugggguauucccuucuguuuauucuuucaguauauguguuacuaauuugaaauguaagguugauuuguuccuguuuauauucaauuuuugguugucccauccuuauuuuuuugugugaauauguaaaauguuaacacuguuccaaaagucaaaaaaugaauaaagaaucacaaacuaugauggcuauuauuaaggaaaugcacagguacuaagguaaagaacaauguggugggccauguuuucuuacauagaggaccagggaauacuuauuugagcaaguggcauguaaacugagagugaaauaaugagaaggagccagucaugagaaaguggaaaaaagagcuuuccagcguagggaaagcauauaagaaggcccugauauggagcagagcugaacauauuggaggaacugaaaggaaggaaguggcugguaugugcugggcaugagggaacacaaaauaagugaagauggaaggaacauggagccagaaaauaaaauucguuguggacuguguauauuaggguucccuagagggacagaacuaauggaauauacauacaggggaguugaucaaguauuaacucacaugaucacaaggucccacaauaggcuguaugcaagcugaggagcaaggaagguagucugcaccaaaacugaagaacuuggaguccgauguuugagggcaggaaacauccagcaugggagaaagacguaggcugggaggcuaggccagucucucauuucacauuuuucugccugcuuauauucuagccgagcuggcagcugaucagauugugcccacccagaguaagggugggucugccuuucccagcccacugacucaaauguuaaucuccuuuggcaacacccccacagacacacccaggaucaauacuuuguauccuucaauccaaucaaguugacacucauuauuaaccaucacacuguauaagagguuauaaagccaguaaaagguuaaguggcauuuuaauuuaauuaaauugaucaguuuauuuauuuugagauggugucugacccugucaccuaggcuggaguauacugguacaguuguagcucacuguaaccuccaacuccuggguucaagggauccucccacuuuagucuucuaaguagcuggaacuauagaugucuaucccauacucagcuaaguuuuuauuuuuaguuuuuguagagacaggaucucacucuguugcccaggcugaucucaaacugcggaccuuaagugauuguucugccucagccucccagaagugcugggauuauaguugugagccacugugccgacauuauggcauauuuagaacuacauauauauauauauauauauguauguauguauguuuauguauuuuuuuuuccauuaacuuuuaaguucuagggugcaugugcaggauauacagguuuguuauauagguaaaugugugucauggugauuugcugcacagaucaacccgucaccuagguauuaaccccagcauccauuagcuauucuuccugauguucuccuuccuuccacccugcacccccgaggggccccaguucgugcuguucccccgacaguguguccauguguucuuaucguucagcucccacuuauaagugagaacaugcaguguuugguuuucuguuccuacguuagaacuauauuuuuaagggauuauacugauugcuauguagagcacaugagguaaaaugaaagcagaggugggcgcaguggcucacuccuguaaucccagcacuuugggaggcgaggcaagcggaucacuugaucccaggaguucaaaaccagccugggcaacauggugagaccccgucucuacgaaaaauacaaaaauuagccaggcaugguggcucaugccuguaaucccagucacuugggaggcugaggcaggaggaucacuugagccugggaggccaaggcuacaguaagcugugaacaugccacuguaccccagccuaggugacugagugagaccccugucucaagaaaaaaaaaaaaaaaagaaaaagcagagagacuaauaacaaaccuguuacaguacauauuaacugauauagaagcaugagagaauguugugagagaauaagugauagugaugaaaaagagaaaagugaauagauuuuagaaagugaauagaaauagaauguauuuuggauagaauugucaagaauagcugguggauugaaucuguguagauagaagguuuuaggaccaugguuaugggaauauuuaagaacaacucucacguuuuuagcuugagcuacuaggaaagaaacugauugaaaauaaagugggcagaaagaaucaagauuuucccuguaccuguuguguucgagaugccuaugauaugcagauagaaaugucaaguagauaguuggaugugcaagccuugaguucagggguggaaaaugagaucucagacuugccgucuaguccuuccagguauugguucaauucaugccucccacauggcuaagagucuccaccuccccucauuuguauuccguaaacaugaacagaaugucaggccuuggccagauacuauuugaggcauuguagacaacuuuggcugaagaugaucuccaggccuauguaucuuuucagagaguuacuguuauuuuucuuguaagucacuuaaauauguacauuuuacuucuuuaaucauaguuuuauuuugaacugugucagaguaagagauacugcaguuauuauacuaaaaaagaccaggcucuuuucuaucccacguaaaucugacuugcuguaugagaccacucuagcugacuuuacugccuaagagggaauuaugcauuuguauauauguguguguuuauguuugcuauguacucuaguugauuugguguauaugucaguuuacguauaucagcaucacauuguuuuaauuauaguguuuuuauauucucuauacuuaauggagcuaauuuuccucaaucauuuaaaauauauucuuccuuuucucacauacuuauuuuuacagaggcauuguagaaucaagguuguugacacauuuuuaggaaauauggauuucccuuccaaucucuugccuucaccuugcuuauuuguaaaugcuuucuauucuugauucucuuccauugaagaaaggaguuaugaucuuugaagaaggaccugucuuucuuauuuuggcuuuaccuuucuuuuuuucuucuaaagaaaggaugucauuuuccucuccauuucccaccuuacuaagcaccuguuacauacaagcacugaguuaauuccugaggugggcacagggugguacacaaagaguuaaagcgaaauaaaugaaacauguuaugagagaaaauugggauaaaauaauauagguuuauaauuaaaauggugcccuuuugggggaacuaaacauuuuuacauuuaaaaaugacaugucaguuucuagucaguuuauuuuuuaccuuuuuaaaacaucuuuuuuuccccuuugucuuuauuuuuaagggucauacagcaaugcuucauacuggcucauggcaucccaaaauaaagggagaauuuaugacuugcucaaaugaugcgugaguauuguugauaauucaucuaauacauucauaucuuuagguauuuuauuuaacguuuggauuguuacaaucuuggcaguaauguaguaaguggaauauuaggaauucuuauuauauacauauauauauauauuuuuuuuuuuuuuaagggggagucuugcucuguugcccaggcuggagugcagugguacgaucuuggcucacugcaaccuccagcuccuggguucaagugauucuccugccucagccucccagguagcugagauuacagaugccccaccaccacacccggcuaauuuuuguauuuuaguagagacgggguuucaucauguuggucagguuggucucaaacuccugaccucaaaugaucugccugccucagccucccaaagugcugagacuacaggugugaaccacugugcccggccuauauauucuuguucuuuacuuugauuuuaucugauaguguaguauuugauuaaacaaaaauagacacuaugaaaacgagagugguauaaauuccuguagaguuuauuaagguuggaucagauugaugcuauuaaguggacucaaaggacuuugaaguugugacuaauuauuacuuuguauaauaaaggcuuauuuccaucugagucuaauagcuaacauaagcuuauuggcuaagauugauuuugaaaggaauaacugaggaaauugauuaaauuugguguguaugucaguucauacauaccagcaucacuuugaagcaaauuaauuaaauuuccuugguuauuaaauuuuuuuuuuuuuuugagauggaguuucgcucuuguugccuaggcuggagugcaauggcacgaucucagcucacugcagccuccaccuccuagguucaaaugauucuccuacuucagccucccaaguagcuggaauuacaggcaugcaucaccacaccaggcuaauuuuguauuuuuaguagagaugggguuucaccauguuggccaggcuggucucgaacuccugaccucaggugauccaccugccucggccucccaaagugcugggauuauaggcaugagcuauggcaccagacccuaaaauuuuuuuauuuuaauuuuugugaguauacaguagguauauauauuuaugggguaugugagauauuuugauagccaugcaaugcauaauaaucacaucauguaaaauggguauccaucuccucccuucguguuacaaacaauccaguuaaacucuuuuaguuauuuuauuuuuauuauauuauuuuuuauuauauuauuauauuauauauuauuuauuuauuauauuauuuauuuuauuuauuauauuauuuauuuuuuugagauggaguuccacucuugucacccuggcuggagugcagugucacgaucucggcucacugcaccuuccaacucccagguucaagugauucuccugccuuggcuucccaaagagcugggauuacaggugcuugccaccaugcccagcuaauuuuuauauuuuuaguagagaugggguuuuaucauguugcauaggcuggucacgaacuccugaacucaggugauccacccacuuuggccucccaaagugcugggauuauagacaugagccacugcgcccagccucuuuuaguuauuuuaaaauguacaguuauauuauuauugacuauagucacucuguuaugcuaucaaauauuaggccuuauucauucuuucuauuuuuuuuuuuaacccauuaaccauccuuaacucauucccauacuccgcuacccucuucagcgucugguaaccaucguucuucucucuguguucaugaguuccauuguuuugauuuuuggaucucacaaauaagugagaacaugcaaugguugucugcgugucuggcuuauuucauuuaauguaaugaucuccagcuccauuaauguuguuauaaguuacuggaucucauucuuuuuucauggcugaauaguacuccauuguauauauguaccacauuuucuuuauccauuuaucuguugauggaugcuuaguuugcuucugaauuuuggcuauugcaaacagugcugcaaccaacgugggagcacagauaucuuuuuuuuuuuuuuuuuuuaguauuuauugaucauucuuggguguuucucggagagggggauguggcagggucauaggauaauaguggagagaaggucagcagauaaacacgugaacaaaguucucugguuuuccuaggcagaggucccugcagccuucccacgguguuugugucccuggguacuugagauuagggaguggugaugacucuuaacgagcaugcugccuucaagcaucuguuuaacaaagcauaucuugcaccacccuuaauccauuuaacccugaguugacacagcacauguuucagagagcacgggguuggggguaagguuauagauuaacagcaucccaaggcagaagaauuuuucuuaguacagaacaaaauggagucuccuaugucuacuucuuucuacauagacacaguaacaaucugaucucucuuucuuuuccccacauuucccccuuuucuuuucgacaaaacugccaucgucaucauggcccauucucgaugaucgcugucucuucggagcuguuggguacaccucccagauggggcaccgggcagaggcgcuccccacuucccagacgggguggcugggcagaggcacuccucacaucccagaagaugggcggcugggcagaggcgcuccucacuucccagacgaugggcgggugggcagagacgcuccucacuucccagauggggcagccgggcggaggcgcuccucacuucccagacggggcggccgggcggaggcgcuccccacuucccagaugaugggcugccgggcggaggcgcuccuacaucccagacugggcggccgggcggaggcgcuccucaccucccagacggggcggcggggcggaggcgcuccucaccucccagacgaugggcggcggggcagaggcgcuccucaccucccagacggcguggccgggcggaggcgcuccucaccucccagacggggcggccgggcggaggcgcuccucacuucccagacgaugggcggccgggcagaggcgcuccucaccucccagauggggcggcugggcagagagagcacagauaucuuuucgauuuacugauuuccuuuguuuuggauauauacccagcagugaguucgcuaaaucauaugguagcucuauuuuuagguuuuugaggacccuccaaacuguucuucauaaugguuuuacuaauuuacauuuucaccaacagcauaugagggucccuuuuucuccacauccuugccagugauuaaaugguuaagauucuuuugcauuuguaucugcucauccaugacucaagaauauuauagaauauuugagcagcuuuucccucuauuguuauauuauaugauucauuuuaguauuaaaaguaguucacaggaaugcacuucguaugauuacauagaaaauuacaauaaaaaaucuugaaaguuaaaaaaauaggugguauuauuuaggugaaucauuaguuaaauaagaacuuuuuuauucuuagguuauuuugucuuucaucuuucaacuuucugauacuuaaauuugccuuguuaacauucacaguugcuguucauauucuuagauacuuuauguuuucugaaauauaucuuuagaagacaaaugacauaauuucacuuucauagaggaauuuaaaaaauuaauuugaucuaaaagaaacugaaguuugucaaucuauacaaguaagaaugugacuaaaauaaaauaaauauauuuuaguaaaauuucugguaaaucagauuauguaguguuaauuucuuuuccuaucuuagucuuugcagcugcauaauuacuuuuccaaauaguuaagguauguuuguuuaaaguuauguuucuuauuucagcauuagggaaugaacuuuaucagcaaucuaaauuaauaauauagcaugacuagguaagguuuauucuaggauguaaggauauuuuaccaccaggauauuucaguauacuucauugcugaaugaaugaaagguuaaaaucaugugauuuuauuauaugauaaaguggacauuugauagaauuuagucuuucccaguaaaaguucuaaguaaaauacagauaggaagaaauuacuuaaaucugauaaaaauuaguuacuaaaauuuaaaguaaauauugcauuaaauauuggaguacugaagcuacuugcguuuaaauaggaaacaagacagucccauaacuacuuugagacuuaugcaggagagacuuugugcagugucuuaagaaaaugaauaauugauacuaauguuagaagaaaacaaauacacuauuggaccacagaggacuugggcuauucugguuaaaacuuaaccacagaggaccugggcuauucugguuaaaacuuaaccacagaggaccugggcuauucugguuaaaacuuaaguugaauagagcaguugggaaaaaaacuuuguucucaaaacuguuggaucagugugaauggugggcucucauaguugauaauguuuuaacuuuuaugagcacuacagcagccuuucccaaauagauuuccaggcuguguaaauuagaaguuugacaaaaggcauucuguggucaaauaaauuugagaagcuuugaauguuauauuccaagaccagugauacacaaacauuuaaaaguuuuuaaaaauaauuuuuaacaacuuuuuuauuucaguagguuuuugggggacaagugguauuugauuacaugaauaaguucugcagugaugauuucuaagauuuuggugcacccauuaucugaccagauuacacuguacccaauggguagucuuuuaucucucaccacucgccaccguuucccccaaguccccaaaguccaauguaucauucuuaugccuuuguguucucauugcuuagcucccacaugugagugagaagaugcgauguuugguuuuccauuccugaguuacuucacuuagaauaauagucuucaauuccauccaggcugcuaugaaugcaauuauuuuguuccuuuuuguggcugaguaguaguccaaguauacacacacacacacacacacacacacacacacacacacccacauguucuuuaucaacuuguugauugaugggcauuugggcugguuccauguuuuugcaauugcaaauugugacccuauaaacauguguguucaaguaucuuuuuugcauaaugacuucuuuuccucuggauagacaccuguagauccagugggauugcuggaucaaaugguacaucuacuuuuaguucuuuaaguaaucuucauacuuugguugugguaguuuacauucccgcaaacagugugaagauuguaaguguugcauuuucacugcauccccaccaacaucuauuauuuuuugauuuuuuuauuauggccauuauuacaggagugaaggugguaucgcauugugguuuuuauuugcauuucccugaucauuagugauggugagcauuuuuccauaugcuuuuuggccauuuauauaucuucuuuuaagaauugucuauuuuggcugggcaugguggcucauggcuguaaucccagcauuuugggaggcugaggcgggcggaucaugaggucaggaaaugagaccauccuaguuaacacagugaaacccugucucuaugaaaaacacaaaaaauuagcugggcaugguggcaugcgccuauagucccagcuaccugugaggcugaggcagaagaaucacuugaacccaggagguggagguuacagugagcuaagaucgcgccacugcauuccagccugggugauggagugagacucugucucaaaaaaaaaaaaaaaaaaaaaaaagguggcaguuccaagauggcccaauaggaacagcuccaguuuacagcucccagugugagugacacagaagaugggugauuucugcauuuccaacugagguaccagguucaucucacuggggcuuguuggacagugggugcaggacagugggugcagcccacugaacgugagccaaagcagggcgaggcaucaccucaccugggaagcacaaggggucagggaauucccuuuccuauccaagggaagcugugacagauggcaccuggaaaaucaggucacucccacccuaauacugugcuuuuccaacggucuuagcaaacggcacaccaggagauuauauucugugccuggcucagaggguccugugcccacggagccucgcucauugcuagcacagcagucugagaucgaacugcaagguggcagcgaggcuggggaaggggcacccaccaaugcugaggcuugaguagguaaacaaagcagccgagaagcuuaaacuggguggagcccaccgcagcucaaggaggccugccugccucuguagacuccaccucugggggcagggcauaccugaacaaaaggcagcagaaaccucugcaggcuuaaaugucccugucugacagcuuugaagagaguagugguucuccuagcauggaguuugagaucugagaaugaacagacugccuccucaagaggucccugaccccugaguagccuaacugggaugcauccccccaauaggggcagacugacaacccacacagcuggguaccgcucugagacgaagcuuccagaggaacgaucaggcagcaacauuugcuguucagcaauauucgcuguucugcagccuccgcugcugauacccaggcaaacagggccuggaguggaccuccaguaaacuccaauagaccugcagcugaggguccugacuguuagagggaaaacuaacaaacagaaaggacauccacaccaaaaccccaucuguaugucaccaucaucaaagaccaaagguagauaaaaccacaaagauggggaaaaaauagagcagaaaagcugaaaauucuaaaaaucagagcgccucucccccuccaaaggaaugcagcucuucaccagcaauggaacaaagguggauggagaaugacuuagacgaguugagauaagaaggcuucagacgaucaaacuucuccgaguuaaaggaggaaguucgaacucaccgcaaagaagcuaaaaaccuugaaaaaagauuagacgaauggcuaacuagaauaaccaguguagagaaguccuuaaaugaccugauggagcugaaaaccauggcaggagaacuaugcgacgcaugcacaagcuucaauagcugauucaaucaacuggaauaaaggguaucagugauugaagaucaaaugaaugaaaugaagcgagaagagacguuuagagaaaaaagaguaaaaagaaaugaacaaagccgcuaagaaauaugggacuaugugaaaagaccaaaucuacgucugauugguguaccugaaagugacggggagaauggaaccaaguuggaaaacacucugcaggauauuauccaggagaacuuccccaaccuagcaaggcaggccaacauucaaauucaggaacuacagagaacaccacaaagauacuccucgagaagagcaacuccaagacacauaauugucagauucaccaaaguugaaaugaaggaaaaaauauuaagggcagccagagagaaaggucggguuacucacaaagggaagcccaucagaauaacagcugauuucucggcagaagcucuacaagccagaagagagugggggucaauauucaacauucuuaaagaaaagaauuuucaacccagaauuucauauccagccaaacuaagcuucauaagugaaggagaaauaaaauccuuuacagacaagcaaaugcugagagauuuugucaccaccaggccugcccuacaagagcuccugaaggaagcacuaaacauggaaauaaacaaccgcuaccagccacugcaaaaaaaaugccaaauuguaaagaccaucgaggcuaggaagaaacugcaucaacuaacgagcaaaauaaccagcuaacaucauaaugacaggaucaaauucacacauagcaauauuaaccuuaaauguaaaugggcuaaaugcuccaauuaaaagacacagacuggcaaauuggauaaagagucaaggcccaucagugugcuguauucaggaaacccaucucacgugcagagacacacauaggcucaaaauaaaaggauggaggaagaucuaccaaguaaauggaaaacaaaaagguagggguuggaauccuagucucugauaaaacagacauuaaaccaacaaagaucaaaagagaaaagaaggccauuacauaaugguaaagggaucaauucaacaaggagagcuaacuauccuaaauauauaugcacccaauacaggagcacccagauucacaaagcaaguccuuagagaccuacaaagagacuuagacuccugcacaauaauaaugggagacuuuaacaccccacugucaauauuagauagaucaacgagacagcaaguuaaaaaggauauccaggaauagaacucagcucugcaccaaguggaccuuauagacaucuacagaacucuccaccccaaaucaaaagaauauacauucuucucagcaccacauugcacuuauuccaaaagugaccacauaguuggaaguaaagcaguccucagcaaauguaaaagaacagaaauuauaaaaaaccgucucucagaccacagugcaaucaaacuagaacucaggauuaagaaacucacucaaaaccgcucaacuaccuggaaacugaacaaccugcuccugaaugacuucuggguacauaacgaaaugaaggcagaaauaaagauguucuuugaaaccagugagaacaaagacacaacauaccagaaucucugggacacauuuaaagcaguguauagagggaaauuuauagcacuacaugcccacaagagaaagcaggaaauaucguaaaauugacacccuaacauuacaauuaaaagagcuagagaagcaagagcaaacacauucaaaagcuagcagaaggcaagaaauaacuaagaucagagcagaacugaaggaaauagagacacaaaaaacccuucaaaaaaucagugaauccaggagcugguuuuuugaaaagaucaauaaaauugauagacugcaagcaagacuaauaaaagaagaaaagagagaagaaucaaauagaugcaauacaaaaaugauaaaggggauaucaccaccgaucucacagaaauacaaacuaccaucagagaauacuauaaacaccucuaggcaaauaaacuagaaaaucuagaagaaauggauaaauuccuggacacauacacccucccaagacuaaaccaggaagaauuugaauccacgaauagagcaauaacaguuucugaaauugaggaaauaauuaguagccuaccaaccaaaagaaguccaggaccagauggauuuacagccgaauucuacuagagguacaaggaggagcugguaccauuccuucugaaaccguucgaaucaauggaaaaagagggaauccucccuaacucauuuuaugaggccagcaucaucuugauagcaaagccuggcagagacacaacaaaaaaagagaauuuuagaccaauaucccugaugaacaucaaugcaaaaauccucaauaaaauacugacaaaccgaauccagcagcccaucaaaaagcuuauccaccaugaucaaguggguuucaucccagggaugcaaggcugguucaacauacgcacaucaauaaacguaauccaucauauaaacagaaccaaagaaaaaaccacaugauuaucucaauagaugcagaaaaggccuuugacaaaauucaauagcccuucaugcuaaaaacucucaauaaauuagguauugaugggacauaucucuaaauaauaagagcuauuuaugacaaagccacagccaauaucauacugaaugggcaaaaacugaaagcauucccuuugaaaacugccacaagacagggaugcccucucucaccacuccuauucaacauaguguuggaaguucuggccagggcaaugaggcaggagaaagaaauacaggguauucaauuagaaaaagaggaagucaaauuggcccuguuugcagaugacaugauuguguauuuagaaaaccccaucgucucagccccaaaucuccuuaagcugauaagcaacuucagcaaagucucaggauccaaaaaucaacgugcaaaaaucacaagcauucuuauacagcaauaacagacagagagccaaaucaugagugaacucccauucacaauugcuucaaagagaauaaaauaccuaggaaugcaacuuacaagggacgugaaggaccucuucaaggagaacuacaaaccacugcucaaugaaaugaaagaggacacaaagaaauggaagaacauuccaugcucauggguaggaagaaucaauaucaugaaaauggccauacugcccaagguaauuuauagauucaaugccauccccaucaagcuaccaaugacuuucuucacagaauuggaaaaaaacuacuuuuaaaguuuauauggaaccaaaaaagagcccacauucccaagauaauccuaagccaaaaguacaaagcuggaggcaucacguuaccugacuucaaacuauacuacaaggccacaguaaucaaaucagcaugguacucguaccaaaacagagauauagaccaauggaacaaaucagagcccucagaaagaauaccacacaucuacaaccaucugaucuuugacaaaccugacaaaaacaagaaauggggaaaggauucccuauuuaauaaaugaugcugugaaaacuggcuagccauauguagaaagcugaaacuggaucccuuccuuauaccuuauacaaaaauuaauucaagauggauuaaagacuuaaauguuagaccuaaaacuauauaaacccuagaagaaaaccuaggcaauacaauucaggacauaggcaugggcaaggacuuaugucuaaaacaacaaaagcaauggcaaugaaagccaaaauuaacaaauggggucuaaauaaacuaaagagcuucugcacagcaaaagaaacuaccaucagagugaacaggcaaccuacaaaaugggagaaaauuuuugcaaucuacucaucugacaaagggcuaauauccagaaucuagaaagaacucaaagaaacuuacaagaaaaaaacaaccccaucaaaaagugggcaaaggauaugaacagacacuucucaaaagaagucauuuaugcagccaacagacacaugaagaaaugcucuucaucacuggccaucagagaaauucaaaucaaaaccacaaugagauaccaucucucaccaguuagaaugccgaucauuaaaaacucaggaaacaaugggugcuggagaggauguggagaaauaggaacacuuuuacacuguuggugggacuguaaacuaggucaaccauuuuggaaaacaguguggugauuccucgaggaucuauaacuagaaacagcauuugacccagccaucccauuacuggguauauacccaaaggauuauaaaucaugcugcuguaaagacacaugcacauguauguuuauugcggcacuauucacaauagcaaagacuuggaaccaacccaaauguccaucaaugauagacuggauuaagaaaauguggcacauauacaccauggaauacuaugcagccauaaaaaaugaugaguucauguccguuguauggacauggaugaagcuggaaaccauuauugucagcaaacuaucacaaggacaaaaaacuaaacaccccauguucuuacucauagguggcaacugaacaaugagaacccuuggacacaggaaggggaacaucacacaccggggccuguuguggguuagggggaggggugagggagagcauuaggagauauaccuaauguaaaugaugaguuaauggguggagcacaccaacauggcacauguaaacauauguaacaaaccugcacguuguacacauguacccuagaacuuaaaguauaauaaaaaaaaacuauuaauguuuuuagccuacuuuuugauggaauuuuguuuuucuuauuugauuuccuuguagauucuagguauuaguccuuuaucggaugcagagauuauaaagauuucucccacucuguggguugucuguuaacucugcugauuauuucuuuugcugugcagaagguuuuuaguuuaauugagucccauuuauuuaucuuuguguucguugcauuuccuuuuggguucuuggucaugaagucuuugccuaagccaaugucuagaggggguuuuuuuuuuuuuuugauguuaucuuguagaaucuuuaugguuucaggucuuagauuuaaauauuugaucauuuugaguugauuuuuguauaagaugagagaugaggauccaguuucauucuucuauauguggcuugccaauuauccaagcaccauuuauugaauagagugucuuuuccccacucuauguuuuuguuugcuuugucaaagaucaguuggcuguaaguuuuugauuuuauuucuggguucuguauucuguuccacggucuuugugccuauuuuuauaccaauaucacacuguuuuggugacuauggccuuauaguauaguuugaagucagauaaugugaugccuccagauuuguuguuuuugcuuagucuugcuuuggcuaugugggcucuuuuuugguucccuaugaauuuugagguuguuuuuucuaguucugugcagaaucauguugguauuuugauggaaauugcauucaauuuauagauugcuuuuggcaguauggucauuuucacaauauugauucuacucauccaugagcauggggaguguuucaauuuguuugugucaucuaagauuuuuucaguaguguuuuguaauuuuccuuguagaggucuuucauguccuugguuagguaaauuccuaaguauuuauuuauuuuuuuuugcagcuauugugaaagugguugaguucuugauuugauucugagugugguugcuauugguauauagcagagcuacugauuuguguacauuaauuuuguauccugaaaccuuacugaauuuauuuaccaguucuaggagcuuuuuggaugagucuuuaggguuuucuauuaugugaugauaucaucagcaaacaguggucauuugacuuccucuuuaucaauuuggaugccuugauuucuuucucuugucugauugcacugguuaggacuuccaguacuauguugaguagaaguggggaaagugggcauccuugucuuguuucaguucuugcaggaaugcuuucaaauuuuccccauucaguauacuguuggcugugggauugucauagauggcuuuuauuauguuaagguaugucccuucuaugucaauuuugcugaggguuuuaaucauaaaacgauguuggauuuugucaaaugcuuuuucugcaucucuucagacgaucaugugauuuuuguuuuuaauucuguuuaugugauguaucacauuuauugacuugcggauguuaaaccaucccugguaugaaacccacuugaucauggcggauuauauuuuugauaugcuguugaauuugguucacuaguauuuuguuuaggguuuuuacaucucagggauauuggucugcaguuuucuuuuuuuguuauguccuucccuauuuuggguauuagagugauaccugcuucauagagugauuuagggaagauucccucuuucucuauccuguggaacagugucaauaguauugcuaccaguucuuugaaugucugauagaauuuagcugugaauucuucuguccuagauuuuuuuucguuggcaauuuuuuuuauuaccacuucagucucgcugcuuauuauuggucuguucagaauuucuuuaucuuucugcuuuaaucugggaggguuauauauuuggaggaauuuauccaucgccucuaguuuuucuaguuuaugugcauaaagguguucauaguagccuugaaugaucuuuuguauuuuuguggugucaguaguaauaucucccauuuuuuuucuaauugugcuuauuuggauuuucugucuuccuugguuaaucuugcuaauggucugucaauuuuauuuaucuuuucaauaaacuagcuuuuuguuucauuuaucuuuuguuuuuuuuuuuuucauuucaguuucauugaguuaugcucugaucuucauuauuucuuuucuucugcuggguuuggauuguucuuauuucuccaguuccaugaggcgugaccuuagauugucuauuugugcucuuucagacuuucugauguaggcauuuaaugcuaugaacuuuccucuuagcaccacuguugcuguaucccagagguuuugauagguugugucacugucauucaguucaaagaauuuuugaauuuccaucuugauuucauuguugacccagagaucauucaggaguagauuauuaauuuucauguauuugcaugguuuugagguuccuuuuggaauugauuuccaauuuuauuccacugugguaugagagaguacucgauauaauuuugauuuucuugaauuuacugagacuuguuuuguggcauaucauauggucugucuuggagaauguuccauguacugaugaauagaauauauucugcaguuguuggguagaauguucuguaaauaucuaaauccauuuguuguauaguuuaaguccauuauuucuuuguugccuuucugccuugaugacuagugucaguggaguauugaagucccccucuauuauuguguugccaucuaucucauuucuuaggccuaguagaauuguuuuauaaauucgggagcuccaguguuagauauaugcauacauacauauauauuuauuuagaauugugguauuucucuguuggauuaguccuuuuuaucauuauaugauaucauucuuuguauuuuuaagcugcuguugcuuuaaaguuuuucuuuuuuuuuuuuuuuuuuuugucugauauaagacuagcuacucuugcuugcuuuuggcguccauuuccguggaauggcuuuucagaagacagcagaaacuugauuguugaauucuuauccauucugccauucuguaucuuuaaguggagcaguuaggccauuuacguucaauguuauuauugagaugugagguacuauucuauucauugugcuauuuguugccugaauaccuuuuuuuuuucauugugcuauuguuauacagguccugugagauuuaugcuuuaaggaggcucuauuuuguuguauucugaggauucguuucaaaauuuagagcuccuuuuagcaguucuuguaguguuggccugguaguggcgaauucucucagcauuuuuuuaucuagaaaagacuguaccuuuccuucauuuaugaagcuuaguuucacuggauacaaaauucuuagcugaaaauuguuuuguuuaaggaggcuaaaaacaggacccuagucucuccuagcuugagggauuucugcugagaaaucugcuguuaauccaacagguuuuccuuuauagguuaccuggugcuuuugucucacagcucugaagauucuuuuuauugucuugacuuuugauaaccugaugacugugugccuaggcaaugaucuuuuugugaugaguuucccagguguucuuugagcuucuuguauuuggauaucuagaucucuagcaaggccagggaaguucuccuuaauuauucccucaaauauguuuuccaaaguuuuagauuucucuucuuccuuaggaacaccaauuauuuuuagguuuguuuguuuaacauaaucccagaguucuuggggcuuuguucauuuuuaaaaauucuuucuucuuuguccuugauggauuggguuaauucaaaagccuugucuucgagcccugaaguucuuucuucugcuuguucaguucuauugcugagacuuuccaguguauuuugcauuucucugaguguguccuugacuuccagaaguugugauuguuuuuugcuuaugcuaucuauuucacugaagaauuuuccuuuccuauccuguaucauguuuuugauuucuuuaaguugaaauucaccuuucucuguugacuccgugauucgcuuaauaaucgaccuucuaaauucuuuuucuggcaauugagauauuucauuuucauuuagauccauugcuggugagcuaguaugaucuuuuggggguguuaaagacccuugcuuugucauauugccagaguuguuuuucugguuccuucucauuuggguaaauuaugucagagggaagaucugggauucaagguggcuguucagauucuucugucccauggggugcucccuugauguguuguucuccccuuucuccuaggaaugaggcucccugagagccgaacuggagugauuguuuuuguucuucugagucuagccguccaguggagcuacugagcuucaggcugguacugggguguguccgcaaagaguccugugauaugauucaucuucaggucuugcagcccuggauagcagcacccgaaccaguagagguagcaggggagugaaguggacucugugagcauccuugguuguguuuuuguuuggugcgucauuuuguguugguuggccuccagccaggagguggugcuuucaagagugcaucagcugugguccuauagcgaggauguggacuugcccuacgggcugggcacagugucuuauuccuguaaucccagcacuuuggccgagaugggcguaucacuugaggucaggaguucgacacuauccugaccaacauggugaaucccugucucuacuuaaaacaacaacaaaacaacaaaacaaucaccaccaccaccaccaccaccaccaccaccaccaccaccaccacguucuaggaauaccugguuaaguauucagguuuuucaggcagugggcggggccauagagcuuucaagagauuuugaccuuugucuuugguuaccugggcaaguagagaaaaaccaccagcuuggggaagggauaggugugucugugcucauucccuccuugggcauggggcucgcuuuggcugcugugggggaugggggugugguuccuaguccaauggaguuauauucccagggagauuauggcugccucugcugaguuacacagguuaccagggaagugggggaaagccugcagucacagaccugucuccacucccaugcaguccccaguccuaaaggccagucucauuccugccgugcccccucaccugcaucgagucuauuuccaggcagcuggugaccagggcugagaacuugccccagaccgugaaccucccuguugagaaagcaagcagacuuacaguuuuucggugacucagggagccugcaguggugauccaguuaccucaaagggucuauggauucucucagcuuuccugguauguuccuguggaaauucuuggugcugcuauccagggcugcaagaccugaagaugaaucauaucacaggacucuuugcagacacacccuaguaccagccugaaguucugcucaauacuguucaugaacacuguucaugaugugagucucuacacacugcucugccugucugagcgggagcugcaagcuaguccugccuccuauucgccaucuuaaaguccauuuaaaagguuuugaaugggguauaaggaaaucuauuuaacuguauuaauucucuaaacaacaguuuagauaaaguuccacaggugugacaucuuuuacuggguauaaaauguaguuuaucccauuccuuuaaaagauaauucuuuaguucccuguccaaaucauugauuucauaguauauuguaccuuugaaaaugcauaucaguuuuuccccccauacuguacaaaucaggcuuuuuuuuuuuuuuugugacaaaagucuugcucugucgcccaggcuggagugcagaggcacaauuugggcucacugcaaccuccgcccccuggguucaagcgauuauccugccucagccuccugaguagcugggauuacaggcucccaccaccacaccuggcuaauuuuuguauuuuuaguagagucuaggcuggucucgaacuccugaccucaggugauccgcccgccucagccucccaaaguucugggauuacaggcaugagccaucgcaccuggccacaagucaggcuuucuucagccauaguucugugugaggaucaggaaucuuuaauuguagacucccauuauauauauucuuuacaaccuuuuagagaaaucugccaguaauaaauucagaugguuugcuguuugguugauuuuuuuuuuucucaccucagaguguaguaauuaguuauaaguuaagcuguggaauaucaacccaguugccuguuucacucagcaaauauuguuugcucacuaugugaucuaaguuucugccuucauagggcuuauauucuaguguagaugagugcugggagacagauaagguacagcuaguaauaaauaaauaaaauaguuucucuaguaguaaguguuaagaguaaaguuaaagcaaaacgauaaagaguaggagagaggggucuacugcacguagaguagucagagaaagccuuggaauugacuuuuuuuuuuuuaaguugaggcuuaaauuaugcaaaggaggcagccacagggaaagaacuuuuccuggacaaaauccuauuauauuuaauggccuugaaaugugaaugcaauauggcauauuugagggaaagaaaagacuaguaguugacauuucauagauugguaggaaaagugagagugauaggaaaugaguuuggaaaagaggacagggccacugaaauaagguguugugggcuaaaauauaaagugcuaaaauuuuaaaguaaugacaagccaagccauugaagaguacuaaaucuguacuguauuuuuaaaauuaaauuaaaauuuaaaaaauugacucuugcuccucucuggaaguaccauaauauuauuggaaagucaaagucaauagaaauggucucuucacagguuguuaacauuuuccagugagguaacauugggauacuagcucauaauaguuaacauuuauugagaacuuaauauauaccagcacugggcaauacauauuauaugucugaagcacuuuauauuauguuuucuucacagcagucggauaggugguaauguuauuacauauucuaaaugaagaaacugauuauauuuuucccaaggacacauaauuccaaguguugcuuggauaacaugagccagaaugugaacccacugagugguuuguacacuuuaugaaugguugucacaaacgugaugaugauugauuuacagauauaggcagaagaugcaaaucucuuuuauauaaguaauggauacaagaacuuacuuuuuagaaacauguugcaguauucuccccuuuggaaggacaaauuuccuuugcauugaauuucucuuguagggcacuacagugguggugcuaccacauugucugacugugaugaggauuaucuuacucaucuccaagaucucaucaguauaaguagacuggguuucauuguauucccaugguuucuuagcaaucuguuauuucuuuuagauaagauauauguauauuccuucuugcugaagacagcagauaaaauugaaaauagccaucaaauaaaagcaguuucauuacuucucuucaaauccuaauauauggcuuuuguuuuaaaauauuuuuuucuuaaaguauguuggauuuggcacauaacauuauuaaaauaaagaaauuuuauucuacagguugaguaaauguuaccugaaaugcuggggaccagaaguauuuuggauuucagauuuuuuuuagauuuuggaauauuuguauuacugguugaguaucccuaaacugaaaaucugcaauaaauaaugccucaaaaagcacucagaaaguuacagauuuuggaggauuuuggauuuuuggauuagggauacucaaaccuguauuucuaauuuuaucauagguguugaacuucaucaaaugguuuuuccuaauauuugauguaaucuugcuguuguuuuucuuuuggucuuuuauugugcagaaguuuauuaauauauuuucugauguuaaacuagucuuacauuccuguaguaaaccauaguuuuucacugaaaaaaaauucugcucuauuuaggaauuuuguauuuuauuuacaauuucaauuuuauguugacaagaaaauuuuuuuuuccucucuagaggacuuuuaaauucuuuuuguaauaccuuuauuggacuuuggaacagagauacuggccucuuaaaaugaagaauauuucccucauuuucuauuaucuggccccauguccaaguuccccauuucuccagaagguggauuuuauaaccauagccauaaauaaaaaccuuauggaaccucuaaggucaucuaacaauuugaauuaaaauccaaaccccgggaauacagaauuguuuuucaaaguuugcuuuguuuuuaaguuuaguuucucagauauuuuuuggaaaagguauguuuaauaaaucuagaagaaauuuuagcaguaagcggaagcaguugggaagaaaauacuguauaugacaaaaauuuugggaaaauauccaugauauaagaaaguguacucauauugcaucuggguugaaugcucccauaaaggaaaggugaguggaccuggacauguaaacauaggaagugggaaggagaggcaaaggagcacaggaaugggaucugugggcuuguaaauauaaucugaugaauaguaguuugauuaaaauguacuugcaagucuuucucaguccaagagagaauaugacuugaauugagcuaucaauauuuaaaaauaaugaccgcuacuacuccacaagguuaggaggaguacauauauuauccuuggagaucaaaagcuuccauuguuuaaaaugggcaauuagcacccagaaucaugguucuguuuuuuuauccuaagacauuaggguaaaaagcuuuuaauuuuauuauugguuuuauuaaauggcuuaauuuuauuguugagcaaacucuggauuaacaggauaaacaaaguaaaauugcuaauacuucugauuauacuucauugugauugucaaaugaauauuuuaccacaugacacuauaaaauauccuagauauuuuucagaaagaaauaagaauaaccaugguauauuuguuacuuuccuucauacuggaaaacugcauggauugucgagaacaacuagcaucugaucaggcaucaucagaauucguaggucuaauacuguaaaguuuuggauuaagaaauacucuuuugguucaggaauuaguucagugagggccuuugggcaaaauucacucuauauuucuuagagaaucuuauauaucagagugccacucugcuuuucauugcuuuaucuuauucucuucuacguugguuagcauggcagagagaaacaucaacugcacguuuuauaaacuccucacucccuuggaagacuuuauugagggcuauuuagguuuuaaauuaggaucauuuuagcaggcucuguuguauucauaaugguaguaucuucuucuuuuucgcauucuugcuuucuaucucuccucuccugccucucauuuugggcaacuggaagcuacauauuuugaauacuaugaccaugguguagauagccucuggauaaaaguuuauucaucucaacaccucuuguauuaucacagcguuaugcacuuacugcuuaauacacacgaugaauguuuucacgguuauagcuguugcuaguauuguaguggcuggagagcucugacuaggucaaugugagacauucauguaaacagcacauaagaauugguuuagaugcaguuggggggaggauucagauggcaauugugagaaacuauuccagugaaggccaagcuagcacucauuguuuuguucuggccucauguauacuaaguuaaauuguggacaucuuuucugagugugaguuggagaugcuagugccuuaacuuuuuaauuccaggaguuucaguauaaaacauaaaccugagaugaggccaauguaggaaugaaaugaagaggaagagggcaagauggcagucuuuuugguucucuuaaguuuaccagaaugaaaauuaaugaugaaguauuaauagaacuuacuacauuuuacuuggaaguaaauguuaaugaaaaccagaugauaaugaagauuaaaaaaugcuuacuuauccaaaggaaguaauuucuacuugugaauuucuaugaucuaaugaggaacuauuuucuaauuugaauuguaauaguguaccaagugagaacauaaaugacacuaguauaaucugaguccacaguauagaauuuuuacuaagccaguuccaacucagcacagagcucagcccauugguacugaugagugaaucagaugcuuucauuauuugaaggguuuuucuauuacauacucaggaauuuuuaucuccagguugguucagaucuguuacaacugcuuucgccuccauauccagcuaauugucauauuuacaucuuugauguaauaagauuuuugauacuucugccacuucuaauuuucccacuacuauucuuguuauacacugugauuuuuaugaguuguugccauaacauuuuggggaggagaggguguuaugggcugaauuggcuguauuuaggguuaaggucuuuaaagaguaugaggcuaugaaugugggcccuaauccaauaugacugguauccuuauaagaagacaaagacaccagggaugcacagccacacagaaaagaccaugugaggacauagugagaaagugcccaucuaucagcaaaacaaggaaaaaggcuucagaaaucaaaccugcugacaucuugaacuuggacuucuaguccccaaaacugugagacaauaaaauuucuguuguuuaagcuacccagucuguggcacuuuguuguggcagcccuagcaaacuaacagagagggggaaguguuagaggaacuuaagacuugcacacauguacaaaccugugcacaggaaugugcccaauaauggaauguucagggucccuuguuguuugaggcgucuuaccauucuacuuuguaugccuuuggcgagucugccuacugcugagagacauuaguacaucacuaaacuuguccauuuuuuccccaauaaggauaaauauuacagcacaggaauaauaggcaucuagaauuacgccccuucaccagauuauguuuguccugaagucccaaaauucugucuuuuagcgaucacauuaaauggaaggcagauucaccuacacauuucuguggcauucuuggagauuucaguugaaaaaaguuugugacuuuugaucuacucaguguuugauuaugaaaaaugaacaguaguaacaauugacugcuuuauauuaaguuguuaucagaauuuagaaugauucuuauuuucuuuuugccauuuaaaauuuaagccuacauggaguauuguugagauuuauaauugacaaauaacugacaguugauuauaaucuacagccucgggauaaaauacaguaaaauauuuuaaacacucaggacccagaacaaauacguuugcugaaugauuguaagaaugcuugauguuuggcugcaaagcuaugaauuuccuugccuuuccacaauuuaaaauaucuaccuucucacaaaucuuaaaaguuagaccuauccugcuguuauauauaauucauuuucuacuaacauuguucuuuuuuuguuuguuuuuugagauggagucucacucuguuugccaggcuggagugcaguggcacaaucucggcucacugcaaucuccgccucccagguucaagccauucuccugccucagccuccugaguagcugggauuacaggcgcacacuaccaugcccagcuaauuuuuguauuuuugguagagaugggauuucaccauguuggccagcauggucuugaucucuugaccucgugauccacccgccucggccucccaaagugcugggauaacaggcgugagccauugccccuggccuaacguccuucuuuuauaacaucuaaaguaguuagaauugacuuauuucccauaauuuuaaaauguauucuuuuacaugauuuuaaguugcauuuucaaaaacaguuucugcagucuagaacuugcaguagaaauguguuucaugaugccuuuugucaugauuuucucacucuuugugaaucuacuuguuguauguuuugauauuuuauuuuuuuaaaaucuacuuaauacuuuauuaagaauuuauuagagaccaaauguugaauagggguuauaaaacucagcauucaaaugcuuuccccaucuauugguguaguaauauaaucuuuaauucagcagauuauuaucaaacaccuucuauguguaaguaagaaacacagaaauuuuaaaaaagagucuuaacuaccacagaguuaauugccucacuuuucaaaaagggaaacugaagugcuuguuuguccaccuucuuuguggcagaauagucccuucacugugagugacuuaacccauuuucacugugccuuccacuuuguguaguccuaauggaagaauugauuacuuuugaaaugaaaggaaaaguaaaccaguaaaguuaaggacuuaaugaaugauuuuuuuuuucuauuaacugaugaauaaucacuaaaacuuucagcuguggggaauuguguuuuuggcagagacagggaggcacucugaagaaaacuuucaacgauuugcauuuuagaaaauguuuugaauaacuugcuaauacuuaaaaaaguacuucugugaaguuuuaccuccucaguguuuguuauuuuuaucuaauccuauuuuucauaguaacucauugugaaauguuuaucugugcauuuaauagguuaacaaggaggaaaaagcagaaaaauaauguuuuuuuuccauagucagaagagagaagaaauauggaagaauagugaggcaguggcaggcccauucuaauucuuuuuuaaaaaggugggcauggagaaaguggaucaagggugaaauaaaagaagaggaacuggcagaugucacacaauagccguaggauccauuugcaagcauuuguaaaaaaugacccccaaguacugaauaauucuuugaggguuagaauucccaauaguugguagaaguaagaaccagagacuuuaaaaaaaaucaaauugaauauaacuuuuacuccaggaugcaauggugaggaaaguuaggcugaacaugccguauuaaaaacuuucacuggcaauggcaacacauagauacugggagcauagaggaaggguugcuaacauuacugcuugggagaauuagggaaagugucacaugggcauuugaaauauguguauugguguaaauucuuuuuaugaaaaaguagggaauuagagaggagauggacuuacugaagaauauagagaaauacuaauuuaggcucucagugauauaccaucuagagcaugaaaaaauacauagucaaccaugauuagaugauuuuaccuauaaguaaaagacauaauuucauauuuagacuuguuuuauauacugugaaaugaauauuuacagacauuaaaucuagucgcuuuaguuuuuucuucuucuucuucuuuuuuuuuuuuuuugggacaaagaguccugcucugucacccaggcuggagugcaguggcgugaucucggcucacugcaaccuccaccucccggguucaagcaguucuccugccucagccuccugaguagcugggauuacaggcaugcaccaccaugcccggcuaauuuuuuguauuuuuaguagagacgggguuuuaccacauguuggucaggcuggccucugacuccugaccucgugauccgcccaccucagccucucaaagugcugggauuccaggugugagccaaugugccccggcccacuuuaguuucuuuugagcaacugagugucaugaaaugucaauaucaugaaagaaagagagguaaggaacugcuuaaggaaucauggcaggcauuacacaaaucauguaauuugugaaccuugaucucaucuuauuuucucccaagaaaagaaggaaagaaaggaagaaaagaccagaacacagcaauaaagauacauuuuugggacaguuggggaaauuuuuauuauuaggugauaugacucauuaauugcaaauaugaccacaauucuucaucuuugcuuauauccaugcccuuugcaaugugacuuugcagcuacucccauuaaggggccaucucuguuuauucaccccacgaaucugagcuugucaacaaaaaguggcagaaguuaugguguguccguuuggagcacaggcacaaguucuugcaugcuuauauucccuugggaacuaugacauuugcuguccgaucuagcccuggcuauccuggagggugaaagaguugguagaagaaaggucaguugucucagcucaggccauccuagaccaucuuauaucccgccaacccccaaacuugucagagagcuuagccuagaucagcaaaauucaccacagacauaugaguuaacccagcuaggacagaacuaccuagcuggcugguugauguguaagcaaugauauaugaugguuauguuaagcuauugaauuuugggaaugauugguuauguaucauuuguaaacugauacagugauauuacugaaucauguuauguagaaaccuguuuaugaagaaaaauguuuuuuuguucuuagaagauaccagcugaugaauaggugugaaauauuacgaaauaugcacuuucuuuuaaaugguauagcaaaaauaaaguguguguggucuugugugugugcauguauauauauauggagagaaagagagagagagagauugagaauacagauaugaugaacuguuauauuguguuuguugaaaaggacauauuuauuguacuauuuaaacuuuuuuguagcuuugaaucuuuucaaaauaaaauguuuggagcauuucuuaauauuggcuuacuuggacaucaucuccccaaccucaccuuuuuuuuccuuuaaaagcugaauuugagauagagaaaaaaagggucauaaagauuauaguuuguugcacucuauguaaucaaguuuguuuauuuggagauggagucucgcucugucgcccaggcuggagugcaguggcaugaucucagcucacuacaaccuccgccuccuggguucaggcgauucugccaccucagccuccugaguagcugggauuacaggugcccacugccacaccuggcuaaucuuuuuuguauuuuuaauggagacgggguuucaccauguuggccagucuggucucgaacuccugacgucaagggauccaccugccucagccucccaaaagugcugggauuacaggagugagccaccacaccuggucuuaaucagguuuuuggaggauaucuuuucaguguauuuuaaguuucugccuauuagugcugguuuagauuaugagagcccaguggucagggauugucugcauuggauuauacauaacaggauuuccuaaguccaugccucagacugcuuguaacuauagaauauccauggagaaagaguucuuuagucuuccacuuggagaggcacagugccaaagaguaaguacauuaaacauccugagagcuauauuaacaaaagaaaccagcauuuuccagacauauugauacaaauuauccucucuccccacagucaauaacauauguuauacuugggguauaguguucuuaggaauacacuuggagaaaugaagauugucacuaguaaaugcuuuugaugauaggcuucaguaaauuauaaauauuuuaaaauuugguuauagcuucuaaagaugaauuauaaaauuaaaguuuuugauaaauuauggcauggcauaauggaaagaguguguacuuuguagugagaaccagaggaacuugggugcuccaccaguagcuuuuugacuaaggaauucacuacuaaguuuuagauuccuauaaaaugggauaauacuugauucccaagauucuaaccugaauuaaauguguaaagccuugaguauaguuggcguucauauuuaaaacuagccuuggauucauuuggaugugaggguuucucuuauaucuugaugagcaucuguuauauagagcagaugugggucauguuggaucucauaagcuuuugcuggaaggcugcuaggcagauaucauuugauuuuuauaaugucaauauaauuauaaaauucuauaaggaacaaugauucacauaagugaaucucagaaaaguaaacuuuucuguaacugaaaguuucuucuucuguauuuuaaguauuuuggggggaaacaaaguauacaguuuccuacauuauucaugaguguuuugaauauaauuuaacaucucuguaauuuauaauuuauuucauugugauauaauaugucuugacaauguagaccuauuuauagcuuuugaguuauugaccgcuauuuuuauuuuuuggauuucugucuuuuaaauuguuacaucuuagcagcuguugguaugacaauucuguagaaauaccucagucuuuccuucaguuuucugcuucuaauacaguggagauaggguaguguugguccuagcuuuuuagaauuggugcagaagaaggcauaagcaauuggcauagugugugauuuuuugauacccucauagaaauggaaaauauacuguuuacauuacguuccugcaaugucugauauagcuuguaacuaauuuaauuauuugauuuuuuuaauuuaaguuauucuuuaacauaaucucauaauuuuucauuuugaagccauaagugugcuuuuuauuuuuauuuauuuaauuuuguuuuuguuuuuguuuuuguuuuuuuuuugagauagagucucacucugucacccaggcuggagcgcaguggcugaucucagcucccugcaaccuccgccucccggcuucaagcaauuuucuccugaguagcugggauuacagguaugcaccaccaugcccagcuaauuuuuuuguauuuuuaguagagacaggguuucaccauguuggccaggcuguucuagaacuccugaccucaggugauccaccugccuuggccucgcaaagugcuggcauuacagcugugagccacgacgcccagccaagggugcuuuuuaguaauuaucuguuuaaguaguuaccaacacuuaaaaaguuaauagcuuugacuuuauuuucauuauuguguuuacuggugacauaauuaagcucacuaaaaagccugauuuauaauaucucaaaaaaguauaaugugauuuuucagcauuauuaauaaaauagaugcagaauuauuacugugauuuuuauuuuauauccaauauaagauaauaaaauauuacuggaggaguuaaauguauugaucagggaagaguuauuuauaauuaagccuuuaaauuuuauguacguguuugcuccuguuauguuuggauggccuuuguuuaauuuacauuuuucuaguacuuucagcuuacuuagacauauuuuuaucauacguuuaauauauaaaacuugaccucauaugucuaggaaugaaaaaacauuuaaugucacauuaaccuugcuguaaguuuuauguaauuuuuacgcagaauguugcucacguguucuguauugccauauguaacggguaagaugucuacaccuucaaaaauguuggaggaaaguuugauaaaguucaaguuuguuauguuuuacuauauuauacacuuuucaccacuuuuagucaguaauuuauuuuggcuacaugaacauaaaugcugaacaauaauuccuauauagggauuauauacuguagaagaugcaaaucaguauuuucuuuuuuauccugaaaucaauaugaaaaauaguuaauauuaucauuaguacaucuugaaguguuaagucaauuugauuuuaaaauauuuauuuaugaauuuagaccagaugcgguggcucacgccuguaaucccaggacuuugggaggcugaggcgggcggagcaccucgggucaggaguucaagaccagccuggccaacauagugaaaccccgucucuacuaaaaauacaaaaauuagccaggcgugguggcacacucuguagucucaguuccucaggaggcugaggcaggagaauugccugaaccugggaggcagaguugcagugagcugagaccaugccacugcacuccagccugggcaacagagugagacucugucucaaaaaaaaaaaaaauuauguauguguuuauuuuuaaagaagaauguagaagucuccaaagaguuggagaguauacuuguuuacagguuucccuauauuaacagaggauuugauagagguuggguugaauuucuucuagggauuucuaggucaggcaagguagcaucaaggacagccaauccacugcauguuuaaauucacacaugauuaaauaaaucuguucauguaugaugcaccaguauucuuguguguggugacccuguuggccauuuaucaaauaguaguauaugaaggagaaugcuguuccuaugaaaauucaugaauugaauuuaguugcagggauggaaauaaagguauuuccauauuguggacuuugcaguucuugaaguucauaaaguuaaaauaucucuuuguuuugacuuugacuuuucugcaaagacuugcauauuauaauaaguggguuuucuuuuuaaaacuguccuuuaaauuucuaaguuucugugacuuacuacauggcaaauuuauuuguauacuauuucuaaaucccuucuuuucuguuauguuuuuauuuuuaaaguuuauuuuauuuuuuguggguacauaguaaguguauauauuuaugggguacaugagauguuuugauacagauauacaaucuguaauaaucacaucauggaacauggaauaucugucaccucaagcauuuauccuuuguguuacaaacaauccaguuauacuuuuuuaguuuucuuaaauguacgauuaaaugauuauugacuauaguaacccuguugugcuaucaaaaauauuaggccuuauucauuuauucauucaauuuuuuugguacccauuaaucaucccuaccuccucccuaaucccccaacuacucuuccuaaccucuaguaacuauccuucuacucuaucuccaugggcucaauuauuuugauuuuuggaucucacaaauaagugagaacauguaaaauuugucuuucuuugccuggauuauuuaauuuaacauaauuaaccccaguuccauccauguuguuacaaaugacugaaucucauucuuucuuauggcugaauaguacuccauuguguaugaguaccauauuuucuuuauccauucaucuguugauggacacuuaguuuggguucaaauuuugguuauugugaacagagcugcaacaaacaugggagugcagaaagcucuuugauauucugauuuccuuucuuuuggguauguacccagcagugggauugcugaauuauaugguaucucuauuuuaagcuuucuggaggaaccuccaaacuguucuccauagugguuuuaugaauuuacauucccaacauuaguaugaggguuccuuuuucuccauauccuugcuagcauuuguuauugccuuuuggauaaaaaccauuuuaacuggggugagaugauaucucuuguuuuuauuuucauuugucuggugaucagugaugcugagcacauuuucauaugucuguuugcaauuuguauuucuucuuuugagaaaugucuacucagaucuuuugcccauuuuuaaaucagauuauuagagauuuuuuuccuauagaguuguuucagcuccuuauauauuuuuguuauuaaucccuugccagauggguaguuugcaaguauuuucuuccauucuguggguugucucuucacuuuguugauuguuuccuuugcugugcagaaacuuuuuaacuugauaugauuccauuucuucauuuuugauuugguugccugugcuugugggguauuacucaagaaaucuuugcccagaccgauguccuggagaguuucccuaauguuuucucguaguauuuucauaguuugagcuguuagauuuaauucuuuaauccauuuugauuugauucuuguauauggcaagagauaggggucuaguuuuguucuucugcauauggauauccaguuuucccaguccauuuauugaagagacugucuuuuccucaguguauguucuuggcaccuuuguaaaaaauuaguucacuacagguguguggauuuguuucuggauccccuauucuguuuuaucggucuguguaucuguuuuuaggccaguaccaugcuguucugguuacugucacucugguuauaauuugaagucagguaaugugauuccuccaguauucuucuuuuugcuuaggauagcuuugacuauucugagucuuuugugguuccauguaaauuuuaggauaguuuauuucugugaagaaugucauugguauuucgauagggauugcauugaaucuguagauugcucuggguaguauggacauuuuaacaauauugauucuucuaauccaugaacauagaauauuuuuccauuuuuugguguccucuucaauuucuuucaucaguuuuuuauagucuucauuguagagaucuuuuacuucuuugguuaaauuaauuccuagguauuuaauuuuauguguggcuacuguaaaugagauuuuuaaaaguuucuuuuucagauuggucauuguuggcauauagaaaugcuacugauuuuuuuauguugauuuuguauucuguaacuuuacugaaguuguuuaucaguucucauaguuuuuugguagagucuuuagacuuuugcaaacauaagauuauaucaccaucugcaaacaaggauaauuuuacuucuuuauuuacaauuuggaugccuuuuauagguuucuuuuaucugaucacuagcuaggacuuccagcacuguguugaauaacaguggugaaaguggacauccuuguuguguucuagauuuugaaggaaaaggcuuucagcuuucuccuauucaguaugauacuagcugugggucugucauacauggcuuuuauuauguugagguauguuccuucuauccuuaguuauuuuaggguuuuuaucaagaagggauguugaauuuuuuuuugcuuuuuuuuuuuugagacagagccucacccugucaugcagggagagugcaguggcaccaucuuggcucacugcaaccuccaccucccggguucaagugauucuggugucucaacuucccaaguagcuggauuuacaggcaugugucacaaugcccagcuaauauuugcauuuuuuuuaguggagauggaguuuugccauguugaacaggcuggucuugaacuccucgccucaaggcauccaucugccauggccucccagagcccugggauuacaggcgugaaccacugugccugggcagagauguugaauuuuagcaaauugaugguuuuucagcaccaauugaaaugaucauacgguuuuaguccuucauucuguugauauaauguaucaauuuccacguauuuguauaguuuccaaaauuauucuuguuauuaauuucuaguuuuacuucauugugggcagagaagauaguugguacuauuucaguuuuucugaauguuuuaagacuuguuuugugaccuaacauaugaucuguucuugagaaugaugcauaugcugaggaaaagaauguauauucuauagcuguuggauggaauguucuguaaaugucuauuagauccauuuggucugcagugcagauuaggucugauguuucuuugcugguuuucugucaacaaaguauagcuacuccugcucuuuuuugguuuccauuggcauggaauaucuuuuugcaccccuuuauuuucagucugugugucuuuauaggggagguguguuuccuguagucagcagaucagugagucuuguucuuuuaucuguugaaccacuccaugucuuuugauuggagaguguaguccacuuacauacaguguuauuauugauaaguaaggacuuguuccugccauuuuguuauuuguuuucugguuauuuuuuggucuucucuuccuuccuuucuuuccuuccugucuguuucuuagugaaggugauugauuuagcuuuuuauuuuuuguguaucuguuguauguuuuuuugguuugagguuacuaugaggcuugcagauacuaucuuguaacccauuauuuuaagaugauagcagcuuaacguuauuugcauaaacaaaucaacaaacaagcaaaagaaaacuagugaagacuggcugggugcaguggcucacgccuguaaucccagcacuuugggaggcgaggcagguggaucaccugaggucaggaguucaagaccagccugaccaacauggagaaaccccaucucuacuaaaaauacaaaaaauuagccaggcaugguggcacaugccuguagucccagcugcucaggaggccgaggcaggagaaucacuugaacccgggaggcagagguugcggugagcugagauuacaccauugcacuccagccugggcaacaggaguaaaacuuuguucccccccuccgcaaaaaaaaaauuacaacaacaaaaaaaacuagugaagacugugccuuaacauaguccccuagcuuuuuaacuuuuuguuauuacuauuuaugucuuauugugcugucugugucuugaaaaaguuauuauuuuagcugggcaugguggcucacaccucuaauccuggcacuuugggaggccgaggcagguggaucacgaggucaggaguucaagaccagccuugccaacauggugaaacccugucucuacuaaaaauacaaaaaauuagcugggugugguggcacaugccuuaguccuagcuacuugggaggcugaggcaggagaaucgcucgaacccaggagauggagguugcagugagcugagacugugccauugcacuccagccugggugagaaagugagacucuuucucaaaaaaaaaaaaaaauuauuuuuuauuguuucauuguuuaguuuuuuuuuuuuuuuuuuuuuugagacggagucucacucugucgcccaggcuacagugcaguggugcaaucucgcucacugcaaacucugccucccggguucaagugauucaccugccucagccucccgaguaguuggaauuacaggcgcccaccaccaugcccggcuaauuuuuguauuuucaguagagaugggguuucaccauguuggccaggcugguuucgaacuccugaccucaggcauuccagcugcuucgaccucccaaagugcugguauuacaggcaugagcuacugcacccagccgagcuccauauuuuuuuuuaugucaaccagauaauuuauaagauaaauauuuguacaacuuuguagguuuguugcaagcuuuaaaugugaugauguauagagggcacaguacuuagcacauaguagauacuuaauauauuuacuuccauucuguuuuuuguuuccuucaaccagaugcauuuuaaauacaaaaggccaaguuugcuauuacuaucgcgcaaagcuugaaacauaaauucaacaucuaucaucuacuccuugucuaagcuuaggcaacguauuuguccuuucugaaccagugucuuuaucuguaaaauaagacuuagacuacauuaauuuaauccugaccuuuaaagaaauaccaguuaucuauguuaagaagaauuuuuaaacuacaaagaagcaagccagugguaaacuuucauuaggaaggacuuugauuagcaagaggagugaaagcaguggauagcauaaaaguaguuaccaagaaugguuaccuuuuguuugagugcaggaauaagaggcaaaaaaggggucccacagaagugaaacagaugauaagaugauagauacagguuugcauuuagagugcccuuucuccauuugccagagcugaaaauuuuucuucaguuaaacuccacaaacauuuuuuaaaaauaucuacuauuuugggucguucgcuacauuuggcaccagccuugagcugaaugcacagagauaaaaacaacaugguccuuacucuccagggugcuuuccugucuccugugaucauugacacucauaaugcuaaguuacagcaauaggauggaaguggcucauucuggauuguuucuucagaguaacaagaagcccuaauugucaagagacacagauucuauaguccaagagcagaguuuuccuguagguacuuuucagccugcaaguuagcucagacucgccugagaaaguucucugcagauaagagggugcuugaaucuucaguaaguccuauugucaauuucuggaucuuuucuuacuucaaaauaaccucagccccugcuuuaauaaaaaggacuuuaagccaacagaguaaacuugauaguuggugugggggaagaaaauagcccuuucuuuaugaguguugugauccgggagcuuuauauacccuaacuuaaucuucaaggcauugguugaaagaaggaagugacuugcuauguuacacauuuauuuagggguggaguuagggauuggaacucacgucuggcuccguuauaccacauuccuucucuggccuucuuaucuuaagcccacaaccaucuguauccuguucagaauggauaguuguguacuaaaggcugauccugugguagugcggugcuuuuucaaacugaauguuaagauuuuuuuggcaucaugaccaacauuuucuacaaaauaaaauagaguagaaauugucagugugugucgcaagcaguacuguuuccugaaguuuuuguuucagguguguaugugucugugcgugcgcaugugugcuugugcaugugcugaggcuguguaaaauguaucuucuaugugcaaaucaccaccuuuauugagugugguacgcagucacaaguucauuauugugucuuuucuccagauuuugaaaacauucuauauuucuuuuagcugcaaggaaauauaauguaguaguucugaggacaggcucuggagccagaauaucuagguuugaauccaggcucugccauuuacuaagugugugacuuuuggcaaguuauuuaaugucuccaugccucuauuuugucuucuguaaaaugggauugugcgagcauuaauugaguucauguacuuaaagugcuaagaauagugucaucacaugguagcacuccauaaaaguuaguugcuauuauuauuguuaguauuauugaaagguuuauaaacaucugucuuagagggauuauggaauauuguuuuaacaacagccuuccacagagacaguugauccauuugguuaauuaauuuguugcaaacuuugccauugauuuagugcaauacuccuuuuuuuuuuuuuuuuuuaaguacgcucagguuguuuguacuuagccagcauuaccaaagacagcuacuaagucauguaucuguuaagagcuauuguggaaaauugugagccugucucugcuaggucuuggccuauaaagaacuggcuggcuuuauaggcugauguaaucuuggucauaggccagcauugcuggcucauaaaauauauguguaugugcuggccuacugucuuacagagggcuaaauaagcauuauacuuaggucugccugacucaaguucugugagauuuggaggaagauguugcuuggaugaucaggggaggcuucacaauggaaauaauguuuuagauugagguugaaagaugaauggaaguccaggaaaguagcuaaaugaaaauaauuccaggcaucaguaagauuucauacccagcuguaaaucccagaagccuuaaaguggucaaagcaaggcagaaauaagcagaagcagugaacagaauaaacuguaggcuguuaccuuuuaggcuaacagacacacacacacacauacucacacacgcaugcaccugcacgcacacacacacacacacacacacacacauuuuaaauagacaggguauugcuauguuacccaggcuggagcgcagugguuauucacagguguaaucauagugcacuacagccucaaacuccugggcuuacaugacccuccugccucagccucucgaguauugggacuacaguuaugugccucugugucuuaguuacagauuuuuacaggaacuuaauggaggaaauaaagguuaaauauaugguuuaaauauguauuagggaauuauuuacauuucuuuaaauuauguuucuuauguagccagccaucucuuagagugaauaguuagcuacauuuuauuaugauuauugauaacauguucuacuguuuauagaauuguguuguguaccuuaccucuuccuuuauuuaggccuuagcucccaugagaaggcaccaccuaauggcagcugcuagaauuguaggcaacaaaugcauuggaaaauucacagaaaaaauugacaggaaaagcccaaccaguucacagcauaauuaguauaacguagugauaugaggcagucuuuuuuccuagacucuuaaaacacuuauuaaugauguuuauuauuuaugauuuauaagcauuaaaugaauucuaucuuauccccacuuccaacacaacauucucauaaacauuaaaagagaugaaguucucaaaugcuuagauugaugaaugaauuucuuaagguuaugagguaauaagucuaugauuuuuuuucuggugcccuuuguauuuccuuauaucuaaaagcaguauaacaacauugcagaaaucuugggcaguuuagugaggcaagaucucaccccugauucccaugcucuaauaguucagaacuaguaauguuuugagaggaggaaauaucuuagaauguuuuuacauguacuugagcaugcuauaaguauaguuuaccuaaaacuucaccuuuucccgcuuaaccuuaugccagaagccccuuucccugcugugauauaguucuuacuugugguauaauguucaguuuuuuuuguuuuguuuuguuuuguuuuugagauggagucuugcucuguugcccaggcuguagugcaguagcgugaucuuggcucacugcaaccuccaccuccuggguucaagcaauucuccugccucagcgucccgaguagcugggacuacaggcauaugccaacacgccugacuaauuuuuauguuuuuaguagagauggaguuucacuauguuggccaggcuggucuccaacuccugacgucaggugauccaccagccucagcuucccaaagugcugggauuacaggugugagcuauugcacccagccaauguucaguuuuaaguacuauaauuaaccaagccauuguuacucacuuuucucuauuauaaauaguauuguuaaauaccuuacauaugcaacuaguuccauauuuuggauuuucuuccucuuuuuuuuuuuuuuucaaaaagcauaugauuaucgucuguguuuagaugcagagaaguauuugagaaaaaauagucccacuuuccaaagaauuuauuuuuguguacuaauucuugcuugacugaauuguaugauuugaccaauuccgugguagcuacuaucaucuaguuuuuaucuucuaauaucaagggauuggguagacuagcaagucccuuaacuuaccuguuuuagacaugaaauucuguuugaaaaagcuaauuuauugauuuugaaaaguuuuaaaauuacucgguuucucuucuagcucugauaauugaaauauuuaauuucuauaauaaacauauguuaucuucacucaagucauauuuucuuuuagaaguccuugaucuuaagcaaacuuacuaaugauguuugaaauaccaaaugcuuuauucaucuccacauuuuucaauagaguacuaucucuuuuuaaugauuuuuuaauucaucuuauaauuuuaugcagcuguuaacauuccuuuuaaccaggcagaugccuugggacugugggaaauugcaguagcaauuagaggaaaauagggaagggugggcuggucagucuuggagagcaggaacaaugcagaauuuaaacauaggaaugucaugugucaauuagggauacagcaaaacccuucuauaacacuauaaaaggagccccaaauauucaguuguguaaaauaugagaugacauuaaacauaggguuauguaauaaaauugauuaaauaacuagguugagccucuuguggagguugggagccaacugccaguccuguuucauccaaauuaguauuaaggaguaauauggagggguuucacugggcuuaauauuucguuuuccuuuuaaaaaugcaauuguauguuagagaugaaaucauugagauuuugauuuuagaccuguguaacugcuaaaaauaaaagaucaggugaauugaauuaacucuaucuggugguacuugaauauggaaugaaaucuauggccagccagcaugguuaccuguuguuucaaaacagcaaaguuagugcuugaaaucugugaaguucauuuaaaaaaaugaaaaaaaaaaaaaaagguuagcaaaaucacugauguuaaugaccagccaaguagcuauuguaauuaaugcugauggguucugaagaccauuggcaagacaggaacccugaauagaucaaccauaaguuugccaaauauggacuauuuauuuuuacuagagacuuuguggagaccaggacuugagacacuguuuuuguaugaggguaguagccaguguuaccaaccacuugcuaugugccaggugaacucuuauaagcacuuuguauuaacucauaugacucucucacaagaucagcaauugcaagagccuuccuuuuuucuucucuuccucacuugguuuuugugugggaaucucaaguaauuauuuugggacacacuuuuggcaaggggugggagguacuauagacuuagugguaagaggaguuaaacauuguagcagagucagugcugaguuuuugguaacuaguuucaaguguuagguaucuucuaauaaggacauuuaacucugguucaugguaauucuaaauaucuuauuaaaucaacauauauuucauggcuaauccauacaucagguaaucuaccuugccagaguugacuauauaauaaaaaauaaauuauuuauauuuuguauuguaugagcaucuaauuuaguuuuccucuucagauuuauacucuuuugaaaacucuucaaaagaguacucuuuugaauacucuucaaaagaguauuauguauauuuauuauguaugaugaaagguauaugaaaggaauguauugugaaacuaauaucgguuuauuacacuuccuguaagaacuagcaugaccacucuuuuacucuaaauaugccaaccgccuuggcuauucagguuucaguaguaguuaaaauucuauaagaauuucauuuguuuuuagaugcaaggaaagcccuucugaauguaccuucaacagaaauaucagccauuuguuuaggaauacugauaugauguaaucugucuagauuuucugacauaguuugauauuuauguuuugaagauccugaauugcauguaguuuguccuaaauguuuuguuuugaacacaauguauuuagcuuugauuuuuuuuuugagacagaauuuugcucugguugcccagucuggaaugcaguggcagaauuacaguucacugcagccucgacaucccaagcucaagugauucucccacuugggccucucagguagcugggacuauaggugcacaccaccuuccugguuaauuaaaaaaaaauuuuuuuuuuuuuagagauaggguuuugccauguugcccacgcuggucuugaacuccucggcucaaacaauccacccgccucagccuccuaaagugcugagauuagaggcaugagccacugcacccagcccacguugauucuuuaaaacaauuuuuuuucuuugauuccuaaauacccacuucuugacaaaaguuuauuucucuguucugcguuaucugucagccaucuguauuauuuauauagauacauuuuaauuccucuauagggaaagcagguuggguggcuccacagcgauaucauuuucaaguuaguaagccuaguuuuguuguccuuuucuuacuuauucccauccuuaccucuuucccauagcuggauuauuaauuuuucuuacccugauacuuacugucauaauuugguguauucuuuuuuuuuuuuucuucuuuuucuguuuuugagauggaaucuagcuccgucgccugggcuggagagugugguggugugcucuuggcucacuguaaccucugccucucagguucaagcgauucuccugccucagccucccgaggagcugggauuaccggugcccgccaccaugcccaguuaauuuuuguauuuuuaauagagacaggguuucauuguguuggccaggcuggucucgaacuccugaccuuguaaccuacccuccuuggccucccuaaguacugggauuacaggcgugagccaccaugccaggccaauucuguguauucuuaugcuacacuauccucaucacuaagcaagauguauugaacuuuucuuauaauuuggccuggcauaauuuaucauaucgaauuuauucuuagcccuucucuacucuuccacucucucucuucuaccuccuuucugucuuccucccccacuuuuccucucucaugcuuuuuccuuuacccauucuccuccuccuucaucucacuuaacacaaauauuaauccagagcauauuccuguaaaguuuuauagaaauauugauuuauuuggguguugauugccagaaauguguuagucaguaggaguauaaagcuuuuugaggccgggcgcaguggcucacgccuguaauccuagcacuucgggaggacgaggcggguggaucaccugaggucagggguucaagaccagccuggccaacauggugaagccccgucucuacuaaaaauacaaaaauuagcugggggugguggcacacaccuguaaucccagcuacuugggaggcugaggaaagagaaucacuugaacccaggaggcagagguuguggugagcugagaucacgccguugcacuccagccugggcaacaagagcaaaauucaguauaaaaaaaaaaaaaaaacuuuuugaaagccuuaggaaauuaugaauugacucuuacugucccuuaauaacauaaacuaauuguuuuucuuauauuuaaaaaugucaccuguuuuaguuucuuguuuugacucaugagcuuuguguuauuguauuuauugauuaugcuaauaacuuucagauuuuuaauguuuuuuagaauaauuucuuuuugauagcagaauaaaauuuugauauuuuaguuagccaacuuaagcaaacuagugagagaguacuuaaaaccaagaaaagcgaauaauuguuuccauuuagccugaauuaugaguuucuauaauucaagagagagagauagacacuacuuuuuuuaauguaaauauuauaaauugcuaauguuguauuguuuggagaagcagaucagggccagauauuuuucaaaaucauuacagauuuugcacuuucaaugaauuguuuuuuuuacuuuauuuaaaguuauuucucugaccuguugguccauauguuuucucuucaucuaguucagcuccuucuguuaggauguaucuuaugagcuacagggcacaccucuccagaacucucaguuuaaagucaaauaugagagucuaccugguaagcuguaugucuauaguugacacuuuuccuucuuauuuuucugcuguuucaaauauuuaaauuauauacacuuugcugaccaaacauaaauuaaacuuuauuaguuauugcuaauuccuaccauaauuucuucaaguuaugcaacugcauauuccaaauuauaaaugagccuaucuaauaugcuucaauaguucuuuauaaaaaagagacuaggccucuuuguuagcagcuagaagcuuugugacauuuggaaucacugggccuucacugggccuucccuggacauccuauuagcuauucgucauuuauuuuauuacaugaacagggcuugcagaagcagauuuuuuuuuuuuuuuuuuuaagagacagagucuugcucugucacccagacagauugcacuagugcaauaauagcccacugcagccuugaacuccuggguucaagcuguccuccuucuccagccucuugagaagcuaggacuauaggugcagaccaccaagaagccaaucuugaagaaaaaaauacaagucaaagcuuggcugagccggccaugugguacaccuaugacuggcagguucauguauaugucauuauuacugagucaacugcauucuuuucuuaauuccaugaaaagcagucuacuauacauacugucaggggaaaucuacuaagaagaugacugugauuggcuauuacagacuugccaugucucguuucacugguauuacaggaaaaaagaaauuucuuuaaauaauacuuuaagugccacgaagacgggacaauuuguacuucuugguauccucuauccucucucucaaagugcuagaaaaauggaccgaucuaacuaauauagaaaaccgagggauaagauuauuuuggucagucuauaaauccauauuuuugaauucuuuuagaaauaaagucuuccucaucgauaucacagagaugguauacacuaugcuaaaacagcuguuuaauuuaaauugcauaaaauauuuaguuaagcuauauagccaaaacacaugcuaacaacaaauaagguuagccaccuugguggggaaauggagugauaguucucuagaaucaggaagaauucauuuguggcagcugcuuuguuggcauggugcuaaagcuuguuuuauccccaacaaggacaggaucugguguaggagggucucagcaacaggccaugucguuaugaggguuauuuuuauaaaauaggucucauuguauuggcaaagcuuaauccucugguggguagaaucccuuuuauuauaguucauauugugacuuacugcuuuuuaguaguaaauuagaaagguucucuguugauuuaacauaaagauagcaucugaaauuguaagcaguuuugcuauuuauguaaauauuguuucauguguuauuguggaaaaggaagaaagaacuuguggauuuagagaauuaagguugaaggaaauaguggcaaggaaaaaagaggcauuugagguauuccaugaugcugucucaugguccuggggucuacauaugaggaggugacaccaaaugcauguuaaaauuuuaugucauuaagugaaaauuuuucuuuguuuuuuaaaaugacauacuaggcugggcgcgguggcucaugccuguuaucucagcacuuugggaggccaaggcagguggaucacuugaggccagguguucgagaccagccuggucaacauggugaaaccccgucucuauuaaaauauaaaaauuagcugggugugguggcacaugccuguaaucccagcuacuugggaggcuaaggcgcaaaaauugcuugaaccgggaggcagagguugcugugagccaagauaacaccauugugcuccagccuggcugacagagugagacugugugucucaaaagaaaaaaaaaaguaaaaugacauccuagaaaaaucagaaaacuuagauccugcaaguuaauuaauggcuuugaggcuuaauucucuuuuuuuuuuuuuuuaauugaucauucuuggguguuucucccagagggggauuuggcagggucacaggacaauaguggagggaaggucagcagauaagugaacaaaggucucugguuuuccuaggcagaggacccugcggccuuccggccuuccgcaguguuugugucccuggguacuugagauuagggaguggugaugacucuuaacgagcaugcugccuucaagcaucuguuuaacaaagcacaucuugcaccacccuuaauccauucaacccugaguggacaccgcacauguuucagagagcacaggguuggggguaaggucacagaucaacaggaucccaaggcagaagaauuuuucuuaguacagaacaaaaugaaaagucucccaugucuaccucuuucuacacagacauggcaaccauucgauuucucaaucuuuuccccaccuuuccccccuuucuauuccacaaaacugccguugucaucauggcccguucucaaugagcuguugaguacaccucccagacggggugguggccgggcagaggggcuccucacuucccaguaggggcggccgggcagaggcgccccucaccucccggacggggcggcuggccgggcggggggcugaccccccccgccucccucccggacggggcggcuggcugggcggggggcugaccucccggccucccucccggaugggggggcuggcugggcggggggcugacccccccaccucccuccuggacggggcggcuggccgggcagaggggcuccucacuucccaguaggggcggccaggcagaggcgccccucacuuuccggauggggcggcuggccgggcggggggcuggccccccaccucccuccuggacggggcggcuggccgugcagaggggcuccucucuucccaguaggggcggccgggcagaggcgccccucaccuccaggauugggcggcuggccgggcggggggcugacccccccacauccuucccggacggggcggcuggccgggcagaggggcuccucacuucccaguaggggcggccgggcagaggcgccccucaccucccggauggggcggcuggccgggcggggggcugacccccccccaccucccucccggacgggcggcuggccgggcggggggaugaccccccccaccuccccccggauggggcggcuggccgggcggggggcugacccccccccaccucccucccggacggggcggcuggccgggcggggggcugacccccaccucccucccagacgggguggcugccgggcggagaugcuccucacgucccagacggaguggcugccgggcggaggggcuccucacuucucagacgguguggcugccgggcggaggggcuccucacuucucagauggggcgguugccaggcagagggucuccucacuucucagacggggcggccgggcagagacgcuccucacaucccagacggggcggcagggcagaggcgcuccccacaucucagacgaugggcggccuggcagagacgcuccucacuuccuagaugggauggcggccgggcagagacgcuccucacuuuccagacugggcagccaggcagagaagcuccucacaucccagacgaugggcggccaggcagagacgcuccucacuucccagacgggguggcggcugggcagaggcugcaaucucggcacuuugcggggccaaggcaggcagcugggagguggagguuguagcgagccgagaucacgccacugcacuccagccugggcaccauugagcacugagugaacgcgacuccgucugccaucccggcaccucgggaggccgaggcuggcagaucacucgugguuaggagcuggagaccagcccggccaacacagcgaaaccccgucuccaccaaaaaaaauacgaaaaccagucagguguggcggcuugcgccugcaaucgcaggcacugggcaggcugaggcaggagaaucaggcagggagguugcagugagccgagauggcagcaguacaguccagcuuugggucggcaucagggggagaccguggaaagagagggagagggagacgguggggagagggagaccguggggagagggagagggagaggagggagagggagaggagggagagggagagcgaggcuuaauucucuuauccaucaaauguggacaaguuagaucuuuuuacaggaaaauuagcucuuaagacugcagauagaaaaaaauuuuuacuuccuuuccuaagaugaaauugugagacuccccuugguaugacaauuauauaggauccaauaaaauucaugauaucaaaaagaaugaaguuauccauuuauacuguuaguugcaguuuucacuuacagccuuuuuuuaagaaaccuuuuuucauuugaguacuucuggauuacaguuuuaaaaagaguuuuucuauuuauguuaauugauacuuuucuaguuauuuuauuucaaaggcaccuuaaguacagcucauauuuuuacgcauaaacauuuguaguuacuuacguagcuaagauucaaauacaaaauaaguuauuacagagccuuuuagaaauaccauuauaauaaacuuaaccacuuuacaugacauuuuauauaacaacaaaagaugaagaucuuacagaucuuguucuuucugaguguuucaauaguggcaaauucacuuuaguauuauaaggugggaauaagaaggaacuguuaauauuacuguaguuuuuguggguuugaaauacuguaagcucuguagagagcuuacaguuaaucaaaaauuuauuguguugucagcacaauucagagauauucuucuggauauguaaaauucuaaagucuaaauaaacguuacaaagcauuugacaaucuugacaaacuccuuuuaaggucuuuuaaaaaucccuuuuuucuucucuucuuuuuugcugcuuaauguaagacugcuuuugugucauuaguaacugagcuggugaaauaguuuagcugguagacauauuuugcugcaaaagucauucccuuuugaucuuaacaagaugagcuguagucauuuaucguuagagucuguuaucuugaugaaagaagaaccuugaguagauuuauuuuauuacacaucaacuugaugugugaaauuacuuauguugucuguauuuacaacuguuaauucccaggaaaacaggugucuuuauauuauguaguccacuggaauuuaaacauuuuuuuuaaauggguucaucaagaugucaaaaucuucaauuguuuagugucauuucuauguuuugaaaaguuguuagaagccuguggauauuuagauuauuagaguaacccuucaggggauaauauuuuagaaaauaauagggaaggcaguuuauaaauagaagauuugaauguguucagcauauuagauauggaaucaguacuuacuugcuuuuuaggaauucauguaauuaagaaaaauauuaguauuacuugcuuuuacaacaacuuuauugagauacaauucacauaccauaaaauuuacccuuucaaguauacaauucaguguuuuuuaguauacucacagaguugugcaaccaucaucuaguuuuuagaauaguuucaucucuccaaaaugaaacccuguauuccuuagcagucacacgccauuuucccuuuacuccagucuguagcaaccacuaauuuacucugaauuuuaaaaugaugcauuaaaggugaaacgaauaauaauuuaguacacugauucuuccuguuaacgaaauuauguaauuaaaugcuauaugcauuaaauacuuguuaguaguauguuacuaaaguuuuauuuuccuccugugauaauagcuuaucaucacuguguacuuuaauuagguaugauaguauaucauuaauuacccaguauuauuuaguaagagcuuguugaaucuaccucuuguuuuuguuuugaaaauuugagauaauuuuuuuuucuuuaacccccaaaucaggacaaauacaaugaacuuaaucguauuuuuucuuugcuuagaauacuuuuccuucaugguacaaacaacuauuuauauaguaauuauaauagaaauaauguuuacuuuuaaaauaaacuuugcaauuuuucucagucuuagaaacaccccauuuuugcacacaaguaauuggcauuuuacagaucaugcuuauuuauuuccuggaacaaacucucaagauccuugauagcugugcuacuugauuguuugaaugacuagugaauuagcaauuagaaagcugcaaggcuaauacauaaggccugguuuugccucguuuaauccaaggguugagaguaaggagguaaagggaauauuuuuugacauuugcacuuggaccaaagauucuguuagugaggagauaugcuguauaguucaccagggauuuaguucagaggagaacugucagaaucauccuaagaguguuauuagauuucugggagaaagacaugucuaaggaaaaucacuauaaggcuucucugacucauuuugggaagugaagucagaaccuggggucuccaaaauuaauaauaguaugguaguuguuacugugacuauuccuaauaagcuguuuucucaauuuucuccccagacauagaaaucaagauauuaguuuuuauuuguaaauaaaugagugcugaaacagugcccuugcuggauauugauaaaagauaccuggagucuggaucaacugggcucauggaaaaugaguaucaucacacacauagucaucacaccacaacuuuuauugugguacacaaaaauauaaccuaaauccauggucucaggagcaugcuuauauauagauacacaugcuagauuuuauaauagcucucagaggaagaauggguuucacuuuacaaaauuuuguucugcccacagaauuuuaagaauaaaucucuuguauaacuugaugcucuuauguaaaauuaaaagaaaugaaaaacuaaacgauuuaaaaauaacaaaauagcuucugauaagaagugcuaacaauauaaucugguuuugaguuuuuuguucuuauguuaacucuuuuuuuccaugcuagauaacuccaugagcaaccccccaaagaugcauuguauugcugugucucaugggcuuuuucacugaguuuggacaugaguuuugagcauggcuacagaagacuucuuuuacugcucccaguuaucaugccuggcuuguguaauuggguagucaucauaaaaaaaaggggaggggggagauuuuuuuaaccuuugaaagugauacccuuuucagccuuggcagaucgcaguguucuaucuuugucucuaaaauccacaucggaaaugcuaagaguucccaagcuggaguuaggagaggucguugucaggaggauccuguagcacuuuucagaaauuagagggucauccagcaaaacuaggccacauagucuaaggaucaagugcacccaguaauaucacuuggauuugaagaucugcaugcuuuuaagcuuaucuguuauuuggucugguuucuauuuaccuguucaaguccagcacaguuuuuguaguugcugaaaaauaccucacugauaucaguuugcauaaauaaaaguuuucaucuaauuuucuuuucaguagguugccagguuuauguguauuugccauaggaccuccucauuuagcccuacccacccauccacccaccuggcuccuucuugugguacagggguguagugagugauucugugaauuuuuuaggagaauuuuaucucuguagcaggugugugggaaguguuuggcaggugugguguuugggaaguggcagcuguugagaaggucuaugaccugguccuuaccuuaaguuuuauaaaugcagguuaaaaaauacauauuuaaaagaucuaacuuugguuuagccccuguuuauuuuaauugaauccuuucaccaguaauucaauggauugucuuauuaacuuucucaggucuuguugagagcacucacagugaauaaacaagaaugcacuauauuacaaucacuguucucugaaaucaguggggcaaggcaccacaauaaaguuauuuaucaaguguaaaucuuaaccuuuguucugaucauggcauguuuuuuacaauauucuucucucuuuauaauacacugaguguuacugaacuuucugcuguaugagaaucauaauugugaauaucuuauauggaauuguacugcucaagauagaugccuguguagggucagguagguacuaagcagugagugggauauugauuguaaaaaugacuuugauuauuucccuccuguaucugugccccuugcaauauaacucuguagagguagagucuguuuccuuacuucuugaaucuggacuggccuuauaacuugcuuuggcugauagaaguggcagaagugaugguaugucaauuaugaaacuaagcccaaagagcugugugcaucucugcucauggagcacccugccuaaccuacaugagaauagguugagcuagccugcuggauauguucucaccagucaccccauccaagagcuagccagccacaauauauacaugagggaggccauucuggauaagccagucuuagccaaucugucaggcuauuucagaauuaugacaaagcauaauuaggagaauuaugucaaccugucaggcuauugcagaauuaugagaaagcauagccaaaaugaaaguucuagcugacuuguagaguuaagagcaagaaauguuuauuguuuuaagcuacuagguuugggguaguuuauuaaugcaucagugucuaacuucuacauaaugauuggucuuagaauguguguccuuggaaggggugggaagucacuugcugcuuucucagaaaauuguccugaaugauauuuuugcaaaauuagugaaucaaacacaaaaauaauuuauuucuaugguuguuugcuacccucaaguguuuguugaauuaaauugcccucuugcaaauaaucguuuuuguuguuguuuuaauguccuuugauaauagcauuucauauauuauuuguucuauugaucuuauuaaaaggggaaaccacaggacgucccuugucaucuuguacuccuuuuucauucuugcgugcucaauguuuugaugaaguguguuaagacuuauuuccucauuuguuuagucauaccacaaauugcuuuugaccauucaaaauaugcauaggcaccuugccuagggcuuuugugagcuuacagucuaggaagauacuggcuacuaaacagcaagguaaaauacaguggaauagaaauucuaaugauaggaacacauaagaggaagcaauugagggaucaguguuccccugaagaagugauauauaauuuuaggccuaaaggauggauugggaauuguagaaaaggggcagaaauagcauuuuaugcaugaaaaauguauguagaaagaccuaaaggcaagauaacuguguaauuauggcuggaaauacagaagaaauagggacuaauaguaagagacgaguucagaguaugauuagaaaccagguuaugcaagaugcuauaagacauacuauuguggaggguagacugaaaggaagcaacacuagaggcagggaggccaauuaggagggcauugcaguaauuuauacuagaggcgaugggaccauagauuggggcacuagcaguugggguaaagagaaguaggugaauucuagugaaaggcaaaauugacaggacauagggucugacucaauggugaguauaauggagauagaggaaucaaggaugguguucagguuuuuggcuuggacagcuggcuagaugauucacugagguggagggguaucacagcaggagggggcuuuaggaggaagacaauguaauuuucaaagugucaaguuugaaguauaugagaaacuuuuaagaagugccagaagauagcuaguuuuuugccucugaaacucagaaaauaucuguucugauagcuuugagagucauaaguauuugauaauugaaaucaggggaaggggaugagaucaaccaggcagggagcuuuucacuuuugagaaaaggacccaagacugaauccugaggaaaugacgauauuuaagagacaaagaagaguccacagagugcuaagaucaaccaagaaauaggaggaaaacugagaguacugucacagaacuaagagaaugugucaaagaucugagaauaguuaucaagaucaauggcugcuaugaggccaaguaaaguguugucugaagaaaugucuuuugguuuuaguaacauguucguacccuuuguuucuaagcacaacuuguuccucccacuuagaauguucuuuacccauuuuuguacuggcugaacacccagucuuccuuccagauguuucucaaauagucccuccucuaugaagccuuccccagcaaaauuauuuucuugcccuaguuugauagcuauaguaacacauauaagguucucauagaugguuuuguguacaucucugugcucugacaagauauugaauuccugaguucaccaaguuuguaugauuuuuuuuuuaggacuggcaucuuguguuacucaucuuuuuauucuuaauguuccacacaguggcuggcaaguagguagugcuugaaaauguuuguggauuugaaagcuugauuuugaauauggccuuaggcaaaaagcagcguuucaaauugcauauuaaaagucacuucaaaaccgaaauuucuaaguagcgcugccuauuggaugaacuuuaucauauacucuuuucucuaacaacauucaaauacaaauugcaaucuauuccaaaagaugcauugcuauugaacauaggagaaggagguagauagguaauaaucuauaauuggccaagaauagacuagucuuguacucuuuaguaaguguuuggauccaaaaugaucuuucaggaaagugccacaauauuuaacagucagucaaagagucuguuguugccuagauguuggaauaaauuugauaacuucuggaggauuauuuuaaguccauguauucauuuguuuaaguuaaguauauuaagccacuuccuacugaauaauuaauuuaccccaaggguuuacauuggaagagaguuacucuuaaaauccacuggaguguauuagggauaaagguuaccuuugauuuagcaugcaacacuccuugauguugaaugaaaaaauagauagauagacagauagaugccuuauauuuuugguuguaacuuugaaaauuggcaacaucccuucucccauccucuugguaauuuaagugugcuuaauuuacucaaauucuuuucuacaccuguucugacauuuuauugcagggauuuuaggggcuugauuauuuguugugccucuauguaaaggauauuucuaauuacaggagcaaaaagaaugaugucuggagucaucuggaguccgaaaaacaaaaagcugagggguauuaagaucugguuuauggaggugaaugauugucuuagauaacaggagcaaggaccugcugcaauaaguaaggauuucuaauucccaugaaggccagaaggagaagccagugauaacagcuucagaaacugcccauaaauaaauugcugagcugaggaauuauguucuguuacugaaauguguaaaauuauauauaaagggaaagagagcagcauuaauacacauggccagauuccaacuucaguaggcaaucccuucccucaggcacaaaacgagguaguugaacauuguaggagaaauacacuguguaagccugugucgugcaauucauuugauguugugacuguuguggugggacugggaaagccuugguauaccaccaagaaaagaggcugcuggaucuauauggucuguggggccccugggaaguugguguacuucugcugacuauuauaaacaguucugcuuaguucauugagccagaguccuagaaguuauccuugauaacuccuucuuuuucuuuguauguauugaugggguacaagugcaauuuugcugcauugauguauuguauuauggugaagucagggccuucaguguauccgucagaggagaaacauacauuguacccaccaagcaaccuccugucauccaccccuucccacccuaaacuuccuuucuuuuaaccccacuugcaccaguucuguagauucuaccucuaaaaauacauauugaaucagugcaccuuacucacuauuaaauauuauuugaaugagggaauaaaugcauucaacugccugaguucaaaucaccaucaguucucaacagaucuuucacuuguuuuccucccacugcaaacauagugauauuuucuaaaaaucacaaaucaagucauguaacuccccaacuuaaaaccucuaggcuuugggcuaaaauccgaaauguuuauuacuucccacaucaucuugcauaaucuuguucuaacucuuuuuaauucaucacagcaacugauuuucuuguccuccaauaauuuaaacucuuuuccaucucuuagcuuuagcaccugcucuuucuucuuccuggaaugcucuuauuuucacucuucugacaaacuuuacucccucagggauccucagucuaagugaaguuucucuguuauacuuuuugaaauucuuguacuguucuuuaacagcacuuguuaaagcuggaaguuauguaagcuaaccuguggguuuuuuucuccuguaauuuuuuucuucugcuuugaaaguucagguuucccgucuugccuuaaaggcuuuacuccuacaguucucccuguuccccaaaucaucauucuucuuuacugggucauuucaaucaacuuauuaauauccgucaguagcucucauuaaacaguaagaauaacaaaaggccccuguucacccgaauucucccucaguuacugccucuuuuuuuuucuuaugauacuuuauguuuuaggguacaugugcacaacgugcaggauuguuacauauguauacaugugccauguuggugugcugcacccauuaagucaucauuuaacauuagguauaucuccuaaugcuaucccuccccccuccccccaccccacaacagcccccagugugugaugugccccuuccuguguccauguguucucauuguucaauucccaccuaugaaugagaacaugcgguguuugguuuuuuguccuugcgauagugccucuuuuuuguuguuguucucccacagcaaaaguuccaaaaugaguuaguugucuguagucucugucucauuucuugucugucauucaccucagagcccauuucaguuaagcuuugauccacaccguuccacugaaauuacccucuucaggguucucagugaccuucauuuuaccaaauccacugguuaguucucucuccuuuccuggcuucucagcaacccucagcacgcuggaucauuuccuccuuggaacauucuuuguucuuggcuuuugugacugauguggucucccaggcugcaagagcugagauggagguaggcuggcaagauuuuuauugaggggaggggauugaccgugaaagauacaagaggagcaaagcaagauuggucaagccuucagaccaagaucuaacaccuauggaaguugagagggguggaagcaggauuggguagggaagaccauaaugcagaucuaacaaaguauuugacaauccacugggaccucuggagcaaagguugcuuguuagaggaaacccauguuagguagacuuggccaggucauacuacccacagugugcucucuuauuggcuagggaaguauuuguccuuaacacaaaagcaaagcagauccuaagguguuaacaggugaagguugucaguuaacuguacucuuuacagcugaauggcaaguuguuucuugaaaggacauccuagcagcauaccccccuccauggcuugcuacagugaugcacauuucuuugucuuuuccuuaccuuagucaucacuucuucucaguuuccuuuguuuccuucuccucuuguugucaaccuuugaaaguuagcauaugucaggauuuguuucuggacucugcccuuguuuguaguuucuuccuaaguccugugguuuaaaucccauuucugugccucaauccuuuacaucucuaguucugcccacuccgcugaccuccagacuuacagaucuaauagccugcugguuaacuacucuuuggaugucuaaccagacacuuuaagcuauaugaucaaaauaaaacucuugguuuucuucuccaaaccgguagcucuccuauuuuuccuuauuucuauaaacaacacugcacccauccauguauuaauaauugacuagaccagagaugugagagucauucuugauuuuucuuuaccuuucauguuaaaucccuuagcaagucuaucuguuguacaucuaaaauauaacacuuacuuguccauuuuucuccuucuccacaaugacccauguuguccaguacauuagaaaccauuaugauccaucauguggacucugcagugguaucuuaacuggacuguuugcuuucuuuuugccuucccagaauccccuagaaugaaagcuccgugagggcaagggcuuuaacugucuuacucaucucuguguccacagcgcccagaacacuaucugguacagaguggauacucauuaaauauuugucauauguauaaagauugaaugaaucacuucuuuaguuggaauuuauaacauaaaucagauuaugcucuuucuugcugugacaucauaaaaaaauacguauuuggucucaguccccaguuucugacacugagcuccuaaaacccuuguaauuuuucugggugaugggaugauggcgcaccuucuacagagcuccuaaauccuuggaauuuucugggugauagaagcauguuuugugcuaaugaggugacucuugguugacuucuggauggcuucaacauggggcuggucaccagaaaaaccaagccaugauuagacauuuggaacuuuaagcucuacccccauccuccagggagaggagugaagauggaaauugaguuaauaauuuauuaugucugugugaugaagucuccauaaaaaaaucucaaaacuaugagagcuuccaguuugguaaauacaaccacaugccaggagccuacccaacuccguagagacagaagcucuugcacucaggaacuuccagaccuuacccuauauaccgcucuucaauccgaguguucaucuguauccuuuauaauaaacugguaaauguaagucaaggguuucccugaguucugugagcccuuauagcaaauuaccaaaccugagaaggggguuguagccaaguuaauuagaaauaccagcaaaccaaacuugcgauuggcaucugaaaugggggcugucuugugagacugaguccuaaacuugggucugacguuaacuccaguuagacagugucagaaugaaauugaauuguaggaugcccaguugguaucugcuggauaauuuauuguugguauggaaaaacacacacauuuugugucagaaguauuacgaguauaaaaagcagauuuccuuccuuccuuccuuccuuccuuccaacuuccuuccuuccuuccuaacuuccuuccuuccuucccucccuccccgccuccuucccucccucccuccgcccuccuuccccccucccucccucccuaaaauccagugguuuauccauuuagaauagaauccagauugcaagauucuccuccaucuggcuccuuccuaccucacugaccuuaucucauguuacacugugcuccagccacagcuuaccuccauuucucacacugagcucuuucccagauuaggagguuucacuuguuuguucuacuuccugguguguucuaaggcaagauaauagcuccuuaucauucaguucaaauuccagaaugucauggccucagagauacuuacuuuucuuguccauuguauguaauuugggaccuuuccucugauuuuguuauauacuuguauuuuauuuagcaauacaaaaaugaauaauuagaagaaccaguuaauuuuucaagcuauuuagucucuaaacuuuauuuucacuuaggacauuagaacaacuaggcucuuuuuaauuuuuaauuaauugauagcgcuuccuuccaguccuaucuaucaaagaacgcuuucuuacccuccaguguaucuaaaaugaagaacccaaaguagcuagaccagauccuagaaaauugagugauuuaugaucauuuuaggaagguccuuaggugcuguaccguaaauauuugguagucuuuuuuuuuuuuuuccugugguuuucuaaacccucagagacuuccucaggagagugacaucaucaaauuuauuuuuauuuuuuguaauaaaaagaucauuuuuaugacaggguaaagaagagcuaggcuaaagacagggaguucagcucagucacaagauuaguucuagagucuacacaacaggaauaaagguccaauccaggacacucguggcaaguugguggaaaagaagggacaaguguguggcaugcuucaaaaugggauucaucagaccuuaucaucugaucagauauucauucagucaugaguuauuggcacuuacucuguguuauauccugagcuagguucuaagggaugcuagugagcaggauagcucccaaucuagucagggagaaaaauacuaaugaaguauaguuauaguuuacaggcaguccuuugaagcugacagaauaaaacuuauaggaugaugaugauaaugauaaaauaauaauauugcuugaggccaggaguuugagagcagccuaggcaacagagugagacaccuucucuacaaaaaauaaaaaaggaauaaaccaggcaugguggcacaugccugcaguccuagcuacucaagaggcugaggugggaggauugcuugagccuaggaguucgagguuguagugagcugauuaaaugcacuccagcuugggugacaagugauaccuugccagccaaucaaucaaaaaaauaauuaaaucguacauauauacauauaaaauaauaauucgagagaagaggucagggaagacuuucccagggagauaauguuuuaguugagaauggaggaggagagagauacacgugugaggcaaaauuauauucuagacagaaggcuacaugugcauuguagggauggagaagaaggagucaaggaugaaugagaccacuuccuugaacaguuguguuaaugcugacucuccccaagugauacagggaagguaggaggagagccgguaugaggggaaagauauuacauucuauuuuuggcauguuaaguuuuagcugccugcaggaaaaccacaugucuggcugauaguuggaaauguagaauugcagcccaggugauggauagauacauggauaguaaaacuuagaccugagagacauuguauaggugguguugaagucagagggauugguacauuuaccucagaacacugaggaacacaaacuagcuuuuuaaagacaaaagucagauguagaagggacaggaaaacugagcaucagaggaggaaaaggcuucaaggaauagauggugaaggaugugcauaacuguuguauuuggcagccaggcagucauuguggucucucucagaauauaguuucaguaaaguggcagagacagaaaauaaggcugcauagaaaaugugaaagaaguuuugguagagaagggaagaaguguggagagguggaaauaauggcuguuucauuaaggauggugcaugaauauaggcagaguggagaggaagaaugaaguuaaugaguugaauaaccauaaauaggucaacauuuuuaggaauuuuucuuugccuuuuuuggacucuguacuagggcauugccauuuuauuuuauagcucuaaguguaauaaacccacuaguaguggaugucggaaaguugcagaguagcaguguaaucaacauguggacucugucuuuuuguucgguaguugaccauucagcuggaauugcucccuauuuaugaaauuuuaauaacacacuucacugauuucuuggcuguguaccuaguguuucucaguuuuauugaaaaucgaagcaaauuugugucauuuuucuuauuuaaugauuaaggcacaauauuuuggguaauuuucuuccuauaauuaaaugccaucaauucaauaaaauuauuugagcuuauuuguaaggcacaacuaauuagacucuguucucaaagaguucacaguguaaugugggagagaaaaauguacaguguaaaauauaaugugauaugacaaguuuuauagaaagggaguguaauacacucaaacauacagaaacacagaaaaguuauacauuuagccuagauacauuuccacaggugggcacugaccugaaccugacccauaucucuuccacauguuguguucucauuuaaauaacuuuuuugagauuuuaauuuuccuguguaauuuuaaucuuaauguugcuauucuguuucucuaauuccugugguaagugugucuucaaacugucuguuccuugaaggcacacaauuaagagaaauacuggaaugaaggagcaagcgaaugaaucaaggcauguaaccagacuaaucgcuucagaagguuguggauuuuugucuguuuuguuuagcaccuuaucuccagcacuuagagcaguucuugggauaccacuggguuuguaaauacuuuuugacugaauggaaggaagauguagggagagaaggaagaaaggaaauuuuuaauguauucacuucuggaagaguagugaaaaggaaaaagacacaaaauccaauucuggccgggugcgguggcucacgccuguaaucccagcacuuugagaggcugaggcggguggaucaugaggucaagagauugagaccaucccggccaacauggugaaaccccgucucuacuaaaaauacaaaaauuagcugggcgugguggugggugccuguagucccagcuacuugggaggcugaggcaggagaaucacuugaacucaggaggcggagguugcagugagccgagauugcaucauugcacuccagccuggcaaccgagugagacucugucucaaaaaaaaaaaaaaaaaaaaaaaauuccaauucugacaaugaacaauuagacauuuaaaauauagauuuaauuauuguuugaaaaaaaauuggaucucaguguauuuuuaaaaaucuguucuguuauugugaauaauccagcaugguauuuucuuucuuacaguuuucaguagacugggcacccacaauggaauuuuucugauaagcaacuuuuauaaacaagacauccccaaacauuuuauauuauguuuuucuuuagaucauuuccaccuucucuucaauuucuucucuuuuguauuuccuuaacacuccguuuuaauuuugcuguccuaggacuuuuagauuaauauacuuaaaaauuauuggguucuauucuaucuuauugauucauuagaggucauacgcuucuuggaaaaacauuugcuucucaaaaauuuauaucuuaucuguuguaugcccaagacaauauauaacuuaguauaaauauggaauuauacuguccauagaaacucaaauauuccugauaucaauauauguugcuuuauaauuuuaucuauuuaaugaauucacuuaauuuuuauucacuguucuguuuuuaauuuucuacucuuugcaugugaaucaaauuaagauaguuuauuuggaagccguauugccaagcagcuauggaaagcuuuggcuuacauuuugaaauuuuuuuccuuugucuuuggccaacagcucaaccccuuuggugucccaucugcuuaacacacgacagcuauggcauauuuccauuuaucugggucagaagauaaagagggcuucaaaucagccuggauauuaccuaccauugcucugggucugauacagugaaagauggaaacuuuguuuuucccaggaauagaugcaauuaaacccauuacugugaaaugccccuaauugaauucuagauguuacuuaacuuucagaacauauaagcacccaccucaaaggaauagcauguugcuauauucucucuuuacuucaucacucuucauguuaaguucucaugaucauaccagauuuguuuuguuuuuugacugaugucucuugacucggauuuccuuugagagacuaaacuggucuagggcagaucuuauuuuuagaagucccgagaguuaaguuuuuccccuguguagccaauacauccaugaauuaggaaaguaacuuuauuuuuuucaacacaaauuauuaucaguucaaaacagcacuauuuauuuuuucuuuugauuuguuaauuugauugcuuguuuucacacaccuuaccucauuccaaaaaugauuuugaagaaauguaaaacaauaaauguaauacaacauuauaugaaacauucagggccaugggaagguuagggugaaggaauaaaguuaguucacaaagaauuauuaagagaaggucuugcugcucgugagaaguuagguuauagauucaucuccaaacuguccagugacuaugacaaaauuggagacauauucaguuaagccucaggaucuccaagaggagaaaauagaccuuucuuuucaacagaguaagaaagaaacacuuuuccccagggaccuucauauagggaacacugguggauguagacaguauccuaaacaaaaaacacaaucaaucaaacuuuucccaggacccucauauagggaacacuggugaauguagacaguauccugaacaauaaacacaguugggcauuuacuaugggcaagagacuguauuaagugcuuuguguauauuucucauccaauucuuuaaaauaacuauaaaguauuucccauuaggaaacugaggcucugagaggucaagugacuuguucaauaucaccaguuaggagacaggaguuaaaaacaggcaaaaugacuucauuguccucacccucaaucauuuuucuauacuguuacucaugucguuauuuuuuguugcacucuuuaacacaaguccaagcagaaccuaaaaaugaagaaaagccauccuaagaggagaucaaagcaaugcagucuaaauauaaaaucagcucucuggguagggguaaaguuuagagccauguuuuaauguuuguuagauuucucugaugaucuaaggggaaacuguagaacuucucuguaaaaaguacacauauauacgauuuuagguaccucgcagacccuugucacccuaaccccuagugcacaaaacuauacacagaucuagagguggacagcagagaggcaaagcuaucagaauuucgucugauaaaucccaaguguuuuacauggagacagcuguguugcuuugacuggcugcugaauauuagggggcaugucccuucauaaggccuaaguuagaagagauuucacuaaauuccaaauccuagcucucauagugcuucagacauuuccugggauugagggaaauguuugaaaacuuaaaaaaaaaaaucuuuaguaguaccugucuuacuaggauguuugacauuugauggucucacuacuuaguuacaguuuuuauuuguuacaguauuaguuaguaacuaauaguuacuagguauaguaagggucauuuuaaguuauagaaugggucauuuuuagaaugggucauuuuuacuguugcauucugguccucauuucuggaguaaauuuaagaguugugcuguccauugcauuuagacuaguuaacuauagggauaggugaaaaccaaacuaugaaagcaagccuuuuaauauuucaggaaaacguguauugauuacagccucuggaaacuggacuaacaauacuguaggaauacuuuucgaagucccuguaucagauuucccuauaucagcaauauaacauaagaaugcucugcuugcuuagcagugucugacccaauuuuauauaaugauuauacaaccauagauucacacacaguuaucuuuuagauguuaaaguagaaggguaugcuuugcaaccagguugaccuggauuagaauccuaacucugcuacuacuaacugugucaccaugggcagauuauauaacuucucacaucaucucucaaauggggauaauaaaaguaaccaugguaaaaugcugagcuuagaugagauaacauguguaaagcccuuaacauagugcugauauaauacagaccuaacacauguuuagcuuugauucauauuauuguaccuaaugguggagcuguaagcaacgagcaucucugugauuguugguguaauccuaaaggucuuaaguaacuggaaaacauauggagaguaugccaaguuucaucuuguuucagcaugggcuguccuugugcguagcacuucuuuaggaugucgccaccaguacuuuuuaucaaauagccuguuucugaugguaaaaugcugcuuaggugguuccacuugcucuguugauccuaguaguucauagccucugugcaaaguuuuaaaagcuuuucuggaucuacuuuauuuucucauuugaacucugugccuuagcuguuggugauuuuuucuccuacaugcaguucuuccgcccguacacauagaaaauguaucccccuagaguuauuuaagagaauagaggcugggugugguggcucaugccuguaaucccggcacuuugggaggccaaagcagguggaucacgaggugaggagacugagaccaucccggcuaacaccgugaaaccccuucucuacuaaaaauacaaaaaguuagccaggcgugguggcgggcuagucccagcuacucuggaggcugagccaggagaauggcgugaacccaggaggcagagcuugcagugagccgagauggcgccacugcacuccagccugggugacagagcaagacucugucucaaaaaaaaaaaaaaaaagaauagagcagagcuuauugagggaaacaugccuggcuuaugaacaaaugugucacagauauggggggagaaagcauaagggaugauuggcuaugacaagcagucauaguaggugggaucccuuauacuuguguccuuugaaaggaugauugacuaugacacgcagucauaguaggugggaucccuuauacuuguguccuuugaaaggaugauugacuaugacacgcagucauaguaggagggaucccuuauacuuguguccuuugaaaguguuuucucauugauuauguuaauugggagaaaaguugauauucauuuuguuaaagagaaaggacuucauuucuuuaacauacaucacauuagcaagacuuucagaguaauuaucccuaaaagguacaaaauacaaauaauauuaacuuuauuuugaguuacuuuuauagauauggaaaauuugcaguauucuuccucaagugaaaguacugcuugaaccaacaauauugauagcauacaaauccaaaauuguuaggaccuuacuuguuuucauggauucauauagacaggacuaugaaaugugaaguagacaguaaugugccaugacagcacauuaggucuguuaguugauuauuucacuuaacugaauguuuacguuaauuauuacuuaauccuuuuauacuuuuugucucuacaaaauagaaauaauaguaguaccuucuucagagaguugugaggauuagaugguaaagugcuuuuagaauagugcauacuucauuauguguacuuaaauguuagcgaucaugauuaugagucuuacaggaaucuuauucagauucuuaguccgguauucugaauucauuaucaaacacauuuugacauuucacgauuucuucgaauaauucuccauguacaagaguucuguuguagauuaauuuguuagagauaucgaaaagguucauuuuuuuaguggaaacuucuaaaguaauauugacuucauuacuuaacucugugacuugauuaagcauuguuuaaauuuucagucaggaaaaaucaucaauucccuuucaaaagaugaauauuuaucuccuuuucaaauuugcacugaaucacucuuuggcauauaaaauuuuaucuuucaaaucuguuuugcagauguagagucuggugcuuuuaaacuugguuggucgagugaaaaauuaguauauguauuauacuucagaggcauuaaaaauaaagaauaauagccauaauuauguuaaacuuuagcaguuuguugagaaaccguaagcaccugcagauacccaagaagaaguuguuccagaagccauagugagcccuggcagcacucacaguaaagggguggauagaagcagauuucuguaagauuuguucuauccacuugguccuaugcugaccaccauaaucucuuuccucuguucccaaauaucccauauuccaccuccaccucugcuuugcuucugucagaagguaguaacguggcauuacuucuuaacauaaauaaaaaacagucaucuguaguuacagacauacuagaucuuuguccacuuuuuuuuuuggagauggaguuucacucuguugccuaggcuggaaugccauggcacgauaucggcucacugcaaccucugccucccagguucaagugauucuccugccucaaccuccuaaauagcugggauuacaggugcacaccaccacgccuggcuaauuuuuugcauuuuuaguagagacaggguuucauuauguuggccaggcuggucucaaacuccugaccucgugauccucccgccucagccucccaaagugcugggauuacaggugugagcuaccgcgcccagccuccuuguccauuuuuuaaggccaaauccacauacaauuuuuuaucuugauacauguuuugagaguaauuaguggaauagagcugagugacuuguuuuauguccccagauggauucauuguguguuucccacuccucaaucauguacaacauagaagugcaguuggagaguuacagaauucuucucuuuguucucagugcccucuugagaagaguaggguucuaucagugacuucuuccuuuucacuuccaauuggucagaaauuuguacuauuagaugcacuagaucuuuacuauucucauuucauuuuuuagugucuuucugucuucuccaauucuccauuuaugugaaaaauaccaucauucugcucuugauccaguaccuuugucugggacacugucuucauuccuuuuuagccccauacuguauagccaugggucaggcucuguuacuggagcgucagucuaggcugacuuugggacacauugcuuggguuccugcccugccugucauaaucucagcccccuuacuaguguuaucuguugccuuuccaagguuuacagaguacugugcauaaucccuaauggcuugcaaggucuuucccaaucuaguacuagccuauuucugucaucaucuccagauaugugugcaccuccucccacuucuaccccucaaguuguaacuauaucagauaucagaucauuuaccauuccuuucaagaccccuuucaaggccuuuugcucuugauuuuccuuuugccauaaacuccuuccuucaaaucuaccuuacaacccuucauaucauuuaggagccaaaucgaguguuaccuucucuccccauucuggcauccucaauuccauuccucuuugucuuggccagguuuuauugauucccuucuguacuuaaauagcauuuuaugcuugaacacucuuugccugcuuuaucucucccucauuguuucccacuccuaaugccauagcuuucugauuucuacccuuaucauucuacugacauugcucuugcagaagucaucugugagcucuugucuauuaaauccugugaaggccuuucaguccuguuuuuacuuaacaucucuuuggaauuuaauacucaugaucacaccuuuuuuuuauuauuauacuuuaaguucugggauacaugugcagaaugugcaguuuuguuaaauagguauauacgugccauggugguuugcugcacccaucaacccgucaccuacauuagguauuucuccuaaugcucucccuccccuagccccccacccaccggcaggccccaagugugugauguuccccucccuguguccauguguucucauuguucaacucccgcuuaugagugagaacaugcacacaccuucuuuuuaaaagcauucucuuuuggcuuccuaacacuucccucuccucguaucccuuucuuauggccugccuagcuccuuuuccuuuuugcugccuauucucucaguguuuguuccaugagggucugccuuuugcaguccccaugguuucauaucucugucuacauucuaauaauuccuaauuguauuucuuucauccagacccuauacaacaagauucuccaccugaaugucacacagcucucugacacuuaacuugcuauugccacuucuaccaaaauuauuaccuucuaucuuauaccauaucuuccacagcucugcuucacugaauaguaccaugacucuagccaccucaaaguaauguuuucuccucacuuucccuguuccauugccuuagaacaggccuuuaucaucuuucacuuggacuguccaaccuacagacuuguccccucuggucuucccuacugccauccaagugauuuucuaaaacacaagucugauuguguaaccuaagucacucuucuauuuaguggcuucacagucuccuagaguauaaagccuguaaucucaacacaucucacaggauacccuuuacaaucugguacuugccaauauuuuuacaaucucgucuucuacuugugcccacuguguacuucauccucuugucaaagcaaacuacuuuuuuuucccuauauagacugugcauuuuaagcccccuccucuuugcgucuuuuacaccaauuucuaggaugcacuccccaccccgacacccguuuccauuuucauccccaucucuagucuguaaauuucagccacagaaucucagcucuccccaaaagucacaccucuauagaauccuuccuagaucuuucccaaugaaauaccucuuuuucugggugacugccucaugaggcgauggcauguuuuccucucuuccccauuagguuaugcauuuuuggagaaaagacacuuuuguaucuccauguauccaccaagguaccugguuuguggaaaguauuuaauuuauauuuguugaauuguaguccuauggcuuauacuuauaaaacauuuucaucagccagucugugauuucugugaaggcaaaagcccuauucuuuuuuuuuuuuuuuuuuugagacagagucucacucuaucgcccaggcuggagugcaguggcgugaucucagcucacuguaaccuccaccucccggguucaagugauucucgugccucagucucccaaguagcugggauuacaggugcacaccaccacgccagcuaauugucucuacuaaaaguagagacaggguuucaccauguuggcaaaaguccuguucuauucauccugguuucuucagggccaggaacaguguuuaugacuuaaccaaaguuaauugaaacauuauuuugaggaacauuucaagagaacuuaagaauaggguaguauuaaagaucaauagauagauacuaagacauauauaauauacaucuaguauagaauuuuaauuugucaaagacuuauuuguacaaaacuaugcuagauauuaagaaaagaaaggaagucaaaauggguaacuggaagauguuaauuuggcauuuggaagguauaugaaguucucuauagauuauuuugaaagaaauaugaagcaucuuugccauaacucugagcagaauagugcuuagcaucuacacccaaggguguuaucuuagaacacgguacuauauuuuuugugaacuucaugauaggcuaaauuaaaagagguuagagggaaaaaaggaaccccaucaccucaacauaauagaacguauaucugaguucccuucccugcccuccccuucgcucaucuuccuugcucccucccccuuaacuuucuuuuuucccccacucuccauacuauauuuaaggucacuuauuuuuuauuuuuauuuuuagagaugggagucacucugucacccacgcuggagugcagcagugccaucauagcucacugcagucuugaacuccugggcucaagugauccucccaccucggccucccaaguagcugggacuacaggcaugcauuaccacaccuggcuaauuuuuauuuuuauuuuuauuuauuuauucauuuauuuugagacagagucuuguucugucacccagguuagagugcaguggcgcaaucucagcucauuguaacccucugccucccagguucaagcgauucucuugcuucagccucccuaguagcugggauuacaggcgcuggccaccauguucggcuaauuuuuguauuuuuaguggagacgggguuucaccauguuggccaggcuagucucgaacuccugaccuugugauucacccaccuuggcuucccaaagugcugggauuacaggcaugagccacugcgcccggccuauuauuauuuuuuaagauagugucuugcuauauuguucaggcuggucuagaacuccuggccucaagugaugcuccugccucagccucacaaguaguuggguuuauaggugugaaccacugugcccagcuggaucauugauugagauauagaggugaauacauacauacauauauaccuacacacauacacacacacacacacacacacacacacacacacacacgauauauuuaauauauauaaauauaugaacacaauguaauagguauauaaguauguaugcauaauauauauguuuauguaucucuguauauccuauuugaauaccagcuuuuaaguuggugaacauuugacaucugguacaggauuuuaauuuaauguugguugaaagcuguugaguacuguuucaccugcagugguugaggaggucacuuggaauagaacucuccaugaaauguagcauucuuucccuucuuaaucagcuaccaaacugauuuuucuugcugcuuauuuauuuuuauuuuuuauuuucggaggcagggucucuuucuguugcccaggcuggagugcaguggugcccaucucaggucacugcagccucugccuccuggguucaagugauucuucuuccucagccucccgaguagcugggauuacaggucucugcaaaaauacaagaauuagcuggccaccauacccagcuaauuuuuguauuuguauagagacaggguuucgccauguugcccagguuggucuugaauaccuggacucaagugauccgccugccuuggucuugcagagugcagggauuacagacgugagccaccgugccuaacuucuugcugcuugauuuaaugaaauaaaauauuuuacaagugcuucauaaagagcuuuagagguauuugguuuauaagagcagaguguaaauuuuggcugagaagaauauuggcauauguuuuaaauuaggaaucucuuccaauuccauuugaucaacuuccuuaucugagguuugcugaaguuuccuucagaaauguuuaauuacugauggucuuuucuaggaauuuaauggaauuuucagcuauacugauuacagcugaaaauagaaaaggauggggaaauucaaugauuuuuaauauauuuacagacuuguacaaccauugugaccauuuaauuuauagcauuucugucaccccaaaaagagacaauguuuaauuauucccuauuuuuaccaccagcccugugcaaguacugaucugccaucuauauauuugccuuuuauguauguuucagaucaauagaaucauguaguaugucaucucuugugucuagcuucuuuuaguugggagaguguguuuugagguucaucuauguuguguacaguggguucaaugguggccccccaaaaagcuauuuucacaucaaauuccuggaaccugugaauguuuccuuuuuugaaaaaagucuuugcaaauuuaauuguuagggaucuugagaugagaucauccuggauuauccaguuaggccuuaaauccgacaaguacccucauuaaaggacagaaaaugagaagacacaaagggggaagagcaacauaaagaugaaggcagagaucagagugaugugaucauaagccaaggaggccaaggaauggugccagccacuagaagcuugaaaaggcuacgagggauucuacccaguuccucuagaggaaguguggcccugcagauaccuugauuucagacuucuggaaaaacauaagggccccaaaucagguauccaagauucaaccuuaagaaacuggagacccaaaaaaccaaaacagaacaaaaaucagagagagaaagaauuaaccuaguaggcagaaggaagaaaauaauaaaaaggaaagagcagaugaauaaaacugaaauuaaaaaacaaagaaaaauaaccaauuugagaagacaaaucaaauugauaaaucccuagcuguauugaugauuaaaaaaggagaccaggugugauggcucaccccuguaauugcacucugggaggccgagguggguggaucacuugagcucaggaguuugagaucagccuggccaauauggugaaacccuaucucuucuaaaaauacaaaaguuagccaggcauaguggcucgugccuguaaucccagcuacuugggaggccaaggcaggagaaucucucgaaccugggagguggagguugcagugagccgagaucacaccacugcacucuaaccugcuggaucucaaaaagaauugcaggcaauaucagacaccgauaucuugaaugaaggaggugacaucacuguagaacuuaaugacauugaaagauaauugggaauuuuaugacaauuuuauacaaacauauuugauaacuuagacgaaauggaaaaauuuccuugaaagacacaaauuaugaaagaucauucauaagacacaaauaauugagauauuccuguccuguguaaaagacuggauguguaauuaaaaaccuuuccacuaugaaaacucuagauggcuucacuguugaauucuacuuuaagaaagaaaaaauuccaauucuauacaaacucuuccagaaacuaaaagaagaaacacacuccaacuuauuuuauaaggccaacauuacccugaugccuaacgcaaagucacuucagaaaaaggaaaccauagacugauauccccaaugaacugaaacaaaaauccuuaacgaaacaucagcaaguucaagcuaacaguuuauugaaaggauaauacaucaugauuaagucauauuuaaaccaagagugcaaaggaggauugaaaggauugaaaaucagacaauauaaugcacagacuuaaaaaagagaaaagguauaucaucaucucaauugauguaaaauaagcauuugaaaaaauccagcauucauucaugauaaaauuucucagccaaguaggaauagaauggaauuucuuaguucugauaaagggcaucuaugaaaaaccuacagguucaggucaaauaucuauuauccaaaaugucugggcucagaaguguucuggguuugggauucaaauuguggaauauuugcauauauguaaugagaugucuugagaugggacccaagucugaguacaaaauucauuuauguuucguaauacauuauacacauagccugaagguaauuuuauauaauauuuaaaaaaauuuuuugcaucaaacaguguguguacauugaaccauuagaaggcaaaaaugucauugucucaguuacacauguggagaacuauagaguuuuggcaucaucaucauuccugaaucucaauuuauaugucacugauaagcauuuucuuacacuuauucauacauaaguacuuaacugaaaaauaugacauauuaauacaguaaaaaaaaguaauguguucagguuaacugcgcagcacaguagcaucaccagaauacguguaucaacuguuacacaguagcaacaacaaacaguggcagacugaaugaacuguguguuguguacaugcauuuugauugcgacccaucacaugaaaucagguaucaaauuauggagcacuuuggauuuuggauauuuggauuagggauguucaaucugaaauacacuuaauggaaaaaggcugaauacuuucccccugugcuugagaaaaaagcaaugauguuaacucucauuauuucuauaugcuggaauugccagccagugcaauaagacaaauaaaugaaaggcuuacugauuggaaggaagaaauaaaauugugucuauuaaagagaccacauaaucgucuauauagaaaauuucugccaguaacgguggcuugccccuguaauuccagugcuuuggcagaccaaggcaggaggauugcuugaggcaaagaguuccagaccagucuggguaacauauagugagaccuuaucucuacaaaaaauaaaaacuagccaggcauguugccaugugcccauagcccuagcuacuuggauggaugaggcaggagaauugcuugaaccuagaaguucaaguuauggugagcugugaucacaccacuguacuccagccuggacaauagagcaagacucugucucucucucucuuuuuuuuaaaauacuuuuaaguucuaggguacacgugcacaacgugcagguuuguuacauagguauacaugugccauguugguuuucugcacccaugaacacgucauuuacauuacguauuucuccuaaugcuaucccucccccugcuccccaccccucaacaggccccaggaugugauguucccugcccuguguucucauuguucaauucccaccuaugagugagaacaugcgguguuugauucucuguccuugugauaguuugcucagaaugaugguuuccagcugcauccaugccccugcaaaggacaugaacucauccuuuuuuauggcugcauaguauuccaugacguauaugugccacauuuucuuaauccagucuaucauugauggacauuugggucgguuccaagucuuugcuauugugaauagugccacaauaaacauaugugugcaugugucuuuauaguagcaagauuuauaauccuuuggguauauacccaguaaugggaucacugggucaaaugguauuucuaguucuagauccuugaggaaucgccacacugucuuccacaaugguugaacuaguuuacggucccaccaacaguguaaaaguguucccauuucucuacauccucuccagcaucuguuguuuccugacuuuuuaaugauugccauucuuacuggcguaagaugguaucucauuguggguuugauuugcaguucucugaugaccagugaugaugagcauuuuuucaugugucugauggcugcauaaaugucuucuuuugagaagugucuguguucauauccuucacccacuuuuugaugguguuguuuuuuucuuguaaauuuguuuaaguuauuuguagauucuggauauuagcccuuugucagaggaguagauugcaaaaauuuucucccauucugcagguugccuguucacucugaugguaguuucuuuugccguauggaagcucuuuaauuagaucccauuugucaauuuugccuuuuguugccauugcuuuugguguuuuagucaugaaguccuugcccaugccuauguccugaaugguauugccuagguuuucuucuaggguuuuuaugguuuuaggucuaacauuuaagucuuuaauccaucuugaauuaauuuuuuuauacgguauaaggaagggauccaguuucagcuuucuacauauggcuagccaguuuucccagcaccauuuauuaaaaagggaauccuuuccccauuucuuguuuuugucagguuugucaaagaucagaugguuguagaugugugguguuauuucuggggccucuguucuguuccauuggucuauaucucuguuuugguaccaguaccaugcuguuuugguuacuguagccuuguaguauaguuugaagucagguagugugaugccuccagguuuguucuuuuugcuuaggauuguguuggcaaugcgggcucuuuuuugguugcauauaaacuuuaguuuuuuccaauucugugaagaaagucauugguagcuugauggggauggcauugaaucuauaaauuaccuugggcaguauggccauuuucacaauguugauuauuccuauccaugagccuggaaucuucuuccauuuguuuguguccucuuuauauuucguugagcagugguuuguacuucuccuugaagagguccuucacaucccuuguaaguuggauuccuagguauuuuauucucuuugaagcaguuguaaaugggaguucacucaugauuuggcucuauguuugucuuuuauuuguguauaggaaugcuugugauuuuugcacauugauuuuuuauccugagacuuugcugaaguugcuuaucagcuuaaggagauuuuggcaugagacagugggguuuucuaaauaugcaaucaugucaucugcgaacagggacaauuugacuuccucuuuuccuaacugaauacgcuuuauuucuuucucuugccugauugcccuggccagaacuuccaacacuauguugaauaggaguggugagagagggcauccuuuugaaucuacaaaaaugcuauuagaacuaauaagugaguuuagcaaggucacaggauacaaagucaguaauuaugagucaauuuuauuucuguugacuagcaacaaacaauuguuaauaaaauugugaaaauaauaccagugauuaacagcauaauacauauggaaaucuggccauguguguguguaguauuuauacauugaaaaccauaauacauuucugagagaacuaaaagaucuauauaaaugagaagauguacuguauucguggaucagaagagucaauaguauuaacauuucaguucuucccaaauucauguuuagauuuaauguaaucucaauuaaauuccaguugaauguuuggagauagaaauuggauaagcugguucuaaaauucaucuggaaauguaaacaacuuggaauagccuaaacaauuuugaaaaguacaaaacuagagaacuuacuuuacucaggucacauaaauuguaauuacacauauuaacauuuauuucuuuuacaagaagagcuccuugagagcaaggauuuuguuuuuguuuuguuuuguuuaaucuguguaugccuagggccuuuaccuuuucuugaauauagaaggaacauaaauacuagguccucaauaaauguugcaugaaugaaagaaauaauuucacuuuuuauccaagcauuuuaggaaucaacuuugaggucuaaucuauauacagugaggugcaauugaauguuaaauguguagauuuugaauagccagcgcuuucuuugaagcugucaaauauuuaugauauauuccaaaggaaauuuuggggguuuuguuuauaaauuacuuuugcaagcuuucuucuccgcuuuauuugggaacuuaaucgcuuaacauuacugaaagucaguuuucagagcugucaaacccagugccugacauaauguuaagauugcgcuaaccaaauuuuacaagcuaguaacuaccaaaauguaggcucaagaaagggcuagggaaacaguacacaggaauaauagagaggcacuuuguagcuccgauauaaagcaaccuagugaagagcaaggggacagaaccccaguguuauaagacaccuuggcaucuauaaaccaacagaaauauaacagauauuacuagcugcauacuccaauauacauuuccuuucuucucaaauucuguauuuucuagcuucucuugcaguuagaugugauuaaauguggcaacuauguuuugaccaaugagguguaacgaaaggguagugugaaacuuugaagaagucuccgaaagaagguuacagacccuuuucacuccuuccuuuuuacucuuuccucugccaguaauguggauaugauggcugugcacaaacagcauuuugucagagcaauagaauagaagguacccugguccuugacucuggaaccaccaaaccagcucuggaguaacuaaaucuagauuucucuuaaugagagagaaguagauuuauugauauuuaucacauauauauguauauugcauauauaauuauguuacauuuauuggagucuaacauacuuaaaguuugccuuuuuacauguguaggucugugugauuugacaaaugaaugguugugucucuccaaaaacuucccuugugaugccucuuuauagaaaccccuccauccccaccuuuaaccuuuggcaacuguuggccuauuuuuuaucccuauaguuaugacuuguucagaauguuaauauaacuggaauuauaucguguguagucuuuugaguguggcuucuuuaagcagaauguauuugaguuguuuuauaugucaguacucuauuacuuuuuauugcugaauaaaauuucacucuauggauguacuacuuuauuuagugcauuaacagaaugaagauuugggguuguuuccaguuuggggcaauugugaacaaagcugcuguaauuauucaucuacagcuuuuuauuguuuuuuaaaaaauaaauuuucauuuaucuuaaguaacacuuagaaaugacauugcuugugauaugggaaguauauauuuaacuuuauaagaaacuguuuuccacaguugcaguuccauuuugcauucccacaaucaauguaugcacauuccaauugcuccauauccucaucagcacuagguaucguuagcuuuuuuuuuaaagccauucuuauagguuuguaguaauaguguauugugauuuuuaauuugcauuucugaaaugacuaguuauguuaaggaucuuuccauauacuauuuaucaucuguuucucuaacuugaugaaaugucuguaaaaaucuuuucccauuuuaaauauugauuuauuuuucuuauuguugaauuuucagagcuuuuuagauauucuggauacaaguuaacacaagcguggguuuuuaaaaagaguccggcuuucuugguuucucuaccuugcugcugcuuucaccaugugaucucuuugcacuugccugcuccuuuucuccuuuucacuaugcaggcaugaggucuucaccaggagccaagcagaugcuggcaccaugcuuuuuguacuuccuagccugcagaacuaugagcuaaauaaaccuauuuucuuuacaaauuacccagccacagauauuuguuauagcaacacaaaaugacuaagacagucuaauuuaccaauauauuuagggauuguauuuaagaaaucuuugccuuacgcagggugguagacauuguccuucacaauuuuaaguuuuacaacuacaucuaugaacuauuuaaauuagcuuuuauauguauguagugugagguaugacucaaaguugauuuuuuuuugcauagggauauccaguuguuccagcaugauuuguaucugagaauuauacagccuucccccuauugaauguauucuguaucacuuacuuagcucuuaugucuguuugcuauguuucccaaaaauaauaaguacaaaaaguugaauaccacauuugucucuucguucuacccucaacuuugcaacaguagauauaaauuaugauaguuuuuuuaaauaacugaacaucacaaauaccagaugauacuuuagaauuaugauaugaaagaccacacacagacauaaagugucauuauuuggcuuauuuaaaguucuuccuuucuaaaaaugggaucauaauaccaacaauaaggguuugugaggauuaaaugagauuagggauauaaacauaucuaggauagugcuuggagaacauaguaggcacucaauaaauaccaggucuuuucugcucuucuucauagaccauaaauaaaauaucaaagcuaguaaguccaacagauauuuccauuuauuucagugguauauuaacagauugagacaguuuucacaauaagggaaagggaaagaaagcaguucaccuagaaguacaaauuuauccagcaucugauagugaccaauuacacuaugauuuuauggcuccaguucucugagucuaugccuaaaaaauggaugcuaaagugcuaggccauuagauaucugucaaaacauuuuaugcugaagaacacauauuuugaaacuuggagugagaucuggucuuguaaaauuaaaacuguguuucauaaaaaagauuuaaaaauagaauaaggaucugccugggccuuucuggacacacaaugaaaacauccagaagacaagaaaacgacacaggugggaucauuacauugccccaggcgcaaaugcuuucugucuuaaaauuuugaauucuuuccaguuacaaguucugaacuuucuggcaucugccgcauaaaugcaucacagaguuuggcagagguaaagggaagcauuaauuuugcauggaaaucacuuuagagaucuugguuuaauuuuucuugaaggacuacauaagcaacuugagugauauaaaagucuaaaacuugcaggcuugcuuggcagaaugaaucuaacaaggaagaccuucuuuuaaaaaaugcccaaauauuaagauauuaaaauucacagaaaugggaaaauguucuaacuucuauauaaaacccagaguaauguuuauaaacacuuuggacacaauuuuuauacauguacacaguaauugcacuaagaauacaguugcauuuaggagaaauuuauuuggugcucauguuuucuacuuacaguuauuuaaguuacauggcucuggaacauacucagaauauucauucaaucaaaggguuuggaaaaauaaaaaggucuuaugauaucuagacuuaggaaugaaugcugcaauaaauaaccacuuacacccuuacauuuauggccaauugauuuuccacaaagaugccaaaacaauucaauguaaaaagaguaguccuuucaacaaaugaugcugggauaacugguuauccauauguaaaaaggugaauuuggggccgggcgugguggcucacgccuauaaucucagcacuuuugaaggcugagguggguggaucaccugaggucaggaguuugagaccagccuggccagcauggcaaaaccccaucucuacuaaaaauacaaaaaauuugccaggcgugguggcgcgugccuguacuccuagcuacucaaggggcugacacaggagaauugcuugaacccgggaggcagaguuugcagugagccgagaucguccugcuguacucuagccugggccaccgagcaagacuccaucucaaaaaagaaaaaaaaaaaagguguauuuggagccuuacuuuaccauauaaaaauuaacucaaaauaagucauagauuuaaguguaaagaagguccuaaagaaaacauaggagaaaauauuuuuaaccuuggauuaggcagugaguucuuagaugcaacaccaaaagcacaaaugaugaaagagggaaaaaaaagauaaguuggacuucaucaaaauuaaaaguuuaugcacuucaaaagauaccaucaagaaagugaaaagaaagauaagccgaagacuuggggaaaauauuugcaaauaauguaucugauaagguacugacauccagaauauuuaaagaacaucuagaauucggcugggugcaguggcucacuccuguaaucccagcacuuugggaggcugaugcggguggaucaugaugucaggagaucgagaccauccuggcuaacacggugaaaccccaucucuacuaaauauacaaaaaauuagccggccgugguggcgggcgccuguagucccagcuacucgggaggcuaaggcaggagaauggcaugaacccgcaaggcggagcuugcagugagccgagauugcgccacugcacuccagccugggcgacagagcaagacuccgucucaaaaaaaaaaaaaaaaaagaacaucuagaauucaauaaaaugacaaccuaauuuuuuaaaugggcaaaagauuugaguacauauuucacuaaagaaagauaugcaaaugcccaauaagcacacgaaaagaugcuugccauccuuaguuauuaagaaaaugcaaauaaaaaucacaauggcauuuuucauacccacuagaaugguuauaauaaaaaagacaauuaaaacuguugaugaggaggcaaagaaacuaaaacucacauauuacagguacaaauguaaaaggguacagccacucuggaaagcaguuggaaaguuccauaaaauagcaaacauuuuguaacugacaacuuuccugaauuuguuucccugcucuaacacuuuuuuuguuuuuguuuuugcuuuuuuguuuugguagagucuuuagaguuuucuguauguaagauaauguuaacaaaaaacagagacaauuucacuucuuuccuauuuggauaacuuauuucuuuuucauuccuaauugacuccaguacuguguugaguagaaauugucaaaguggguauccuuuucuugaucuugguuuuagagaaaaagcuaucaacucugcacuguugaguaugauguuagcugugggcuuaucauauauggccuuuaauaauguugacaugcauuccugcuacaccuauuuuguugugaguuuuuaucaugaacaauguugaauuuuaucaaaugcuuuuucugcaucuauugagaugucaugugguuucuguucuuaauuuuguuacugugguaaucauauuuauugguuuacauauauugaaccauccuugcauaccugggauaaaucccauuugaucguggugaauuaucuucuucauaagcuguuagauuugcuuugcuaacauuuuugugaugauucuugcaucuauguucacuagggauauuguucuguagcuuucuuuuuuauaguauccuugucuggcuugguaucagggcaaugcuagccuuguaaaaugggguuagaauuauucccuuucucuucaacuuuuuuggaagaguuugagaagaauugguauuaauucuucuuuaacucuuugguagaauuuaucagugaagucaucagguccugguuuuuuuuugauggugaacucuuauuacugauucauucuccuuacuuguuauuggucuggucagauuuucuacuuccacacugccaacaaucuauaugaaaaagacacaugcacacguauguuuauuguggcacuauucauaacagcagagacuuggaaccaacccaaauguccaucaguaauagacuggauaaagaaaauguggcacauauacacaauggaauauaugcagccauaaaaaaggaugaauucauguccuuugcagggacauggaugaagcuggaaacucucauucucagcaaaguaacacaggaacagaaaaccaaacaccgcauguucucacucauaagugggaguggaacaaugagaacacauggauauagggaggggaacgucacacacuggggccugucggggggugggaggcuaggggagggauaacauuaggagaaauaccuaauguaggugacgggaugaugggugcagcaaaccaccauggcgcauguauaccuauguaacaaaacugcacauucugcacauguaccccagaacuuaaaguauauauauauaaaaagaaauuaagaaaauaacuuuauuuacaauaacauuaaaaaaauacuuagggaauaacuuuaaccaaggaguuaaaagaucaguacacugaaaacuauuggccaggugugguggcucacgccuguaaucccagcacuuugggaggccaaggcaggcagaucgcuugaggccagaaguuugagaccagccugcaacauggugaaacccugucucuacuaaaaauauaaaaauuagccaggcaagguggcgggcgccuguaaucccagcuacucgggaagcugaggcgggaaaaucacuuaaacgugggagaaucacuugaaccugggaggcggaggcugcagucaguggagauugugccacuacacuccagcuugggugagagagugagacucugucucaaaaaaaaagaaaaaaaaaaggaaagaaaacugucaaacauugaugaaagaaauugaaaaagacacaaauaggccgggugcgguggcucaugccuguaaucccagcacuuugagaggccgaagcggguggaucacaaggucaggaguuugagaccagccugaccaacauggugaaaccccaucucuacuaaaaauacaaaaauuagccaggcgugguggcaugcgccuguaaugccagcuacucaggaggcugaggcaggagaauugcuugaauccagcagguggagguugcagugagccgagauugcgccacggcacuccagccugggcgauagagcgagacugucuuaaaaaaaaauaaaaaaaauaaaaggacacaaauaaauggaaagauauuccauguccauggauuagaaaaauuaauguugcugacaugucuaaaccauccaaagugaucuacaaauucaaugcaaucccuuucaaaauuccaaugucauuuuccauagaaauagaaaaaaaaaaacccuaaaauucauaugaaaccacgaaagaucccaaaucaccaaggcagugauaagcaaaaggcaaaaagcuggagacaucacaucacacucccugauuucaaaauaaaagcuauuguaaucaacagacacaucaacuacuggaacaugauauaguccagaaauaaacccagguacuuacagccaauugauuuucaacaaagaugccaagaacacacagucucuucaguaaaugguguugaagaaacuggauauccacaugcagaagaaugaaauuagacccuuaucucauaccauauacaaaaaucaacucaagauggauuaaagacuuaaauguaagaccugaaacuguaaaacgacuagaagaaaacaggaaaaaaccuuccugacauucgucugggcuuagauuuuuuauaugugauccaaaggcacaggcaauaaaagcaaaaaugggcaaaagcgauugcauugaaacuaaaaagcuucuaaucuuugucuuucaauuagaauuuuuagaccauuucuaauuaauuuuauuauugaugagguugaauuuauaucugccauauugcuuuuuguuuuaugcuuaucacauugcuuugauuucuuaucuuguuuuugauagaauuuuucauuguaucuucauuauuauguauugauuauaaaaauaugauagcaauugcuuuagaguuuguaauauacaucuuuagcauaucaaauucucucaucaaauaauacugugcuauuucaaauauaguauaaaacaacauauuuuccuucuuccuccuaaccuuuacaauuauugucauacauuuuacuuggacaugguuauaaaacucaaaguacauuagugcauuguuuuuuaccauuuuugcuuuacaucaauuuauuuuuuaaagagaucuaaacauuuuuuaaaaugcauuuuacauuuacuuucauuuuuacauuuguaguauucuucuuuucuuuguguagauucagauuuccacuuuugucauauuuauucuaccuaugucuuuuaaugcuuauuuuaguagaugucugaugguagugaauuaccucagcuuuuguccauuugaaaaagucuugaguucaccuuauuuuuaaaauauauuuugacuggcuauagaauauuagauugacaauuaguuuuuucuuuuagaacuuuaaggauguuguuccauagugguuaggcuuccauaguuucuggcaagaagcugcuuaccucaucuuuguuuuucuguauuuuaagcuuuugaaauucucccucugggucuugugguguuuguucuacccucccuuacugacagugcuccuucgcuuaggacugugaguacaaggguguuacaccucugcuccaggacuaagcuguuguugcuuguugcuuggcaaaagcucagaaacagacagguguauuucuacuucuccccuaggggaaugagaucuuugcuugggcucuagagugggauguuauucuuuuaaugacuuauuuuucaguguguuuucugguguauguuaaaaacagugcauuaacacauguaagugauuuacaaauaccugccuauauagggggcagacauuaagcaguuuggcugaucagggguaaagucagaauaauuuggaggccacuuagagagggacagaauuaauaacguugaucgauuggaaguagaauuugccucuuccucuucaauuugaugacaacaugauucagaugguuuacuuuauuuccaugaguaaccucauuuauaaauagagaaucuuuuacagugcaugucuuauuuuauuuuaaaauaauuauuagauuuaugugccaaaauggcgaagcagucuuuauggacucuucccuauuuuaaccuccccccuccuucuuuuuuuuuuuaaauaaaugaaaaaucuccugaucauuuuuaggacugugaggacgugggaaguugaaaauccaaagaagcaaaaaaguguguuuaaaccacggacgaugcaaggcaaaaaagucauucccacuacgugcacauauaguagagauggaaaccucauagcagcugccugccagaauggaagcauacagaucugggaccgaaauuugacuguaaguuaaaucuuuucuuagaacauggccaccuuaaaucuuuccuuagaagauggccaccuuacaaagacaaacguguuaaaguauuaugaaggugaauuuccugaauuuagaccuaauuuaaacuucaguguuaggugaucaaacguugagacuuuuguaguauacagcauuucagcagacauuucaacucuguauuuuucaguacauauuauauuuuguuuuuaaaauaaauuuacucuuuugguauaaaauuuaaaaaccauagugcagcuuauuauauggcaucucaguuuauuugauuuugaaagugaaguguuuaauaguaauauaaaacaacacuaagcagagaacuagaaaauacccuuuaaaagauuuaagaaaaacaugaaaaguccaagaugagccaucaguuguuuuguaguuauuuuucuaguaauuuaaguaauauuuuaauauucuaugacauuucauauagauagguuucagguuuuuucuuuacaguuucaggcuauuaguagaauaaauaaaguuuggaauuggaaggaaugauagaauccauauaaauaaugaauacaaaagcccuuggcuaguucugucaauuaccaauaagcuguaaaaagcuucuuguuuuauguauagaugguaaaacaaagauguuuguuaaauggaaugagucuagacaccaguguuaaaauaaaauucuacacaaacacauuuuggauauccuuauuuuauaaaaguuucuggccacauuauuaauucaguaaauguuuacuacauacuauaaacuaggcacuguucuaggcacugauaauacuuaucaaaaauuccuguccucauggaguuuucauucuaguuaaauauauaugcauauauuccaccuuugucuaucaaauauuuacauuuugaaggggaucccaggaaacacaauuguuuuuucaggcagauguguuggaagaagguuaaaaaguguugauagacgggaaaagaaucuauacugauaaugcugaaaauaucuuuggcauuuucuguuugucagaucuuuuuauuucuguuuucaucucuacuguaaaccucauaaagcuucauaacagcauagagaucuuaaaaacuucuuugaauuguaaacugaguuuuaaccaagcaguaaauuuuuuaguaacugguuuucaucaucucugggugcuguuaacuuaaacacagaaauuauaaaacaugcaguuuucuuguguagcuuuaauaguaguguuuuuuguauaguguauauguaugugacuuucucuuaaaacccauacuuuuuauaaaguugaauauaguuuuuaaagauuugucuuguguaucuugaaauaaggaguaucuccuauuuucaguuuuguagaaagaaagccauuggaaugccacuuucuaacaaguaucucuuaaagccauucagcuaauuacagucuuugauuguuuuguuagaauguauuuaauaaaugaauguaaguuuauuauaccauaucucauuuguuauauuuuauucauauuuuuacauuuggauacaaaugugugucaacuggaaacaaaucaaguugaaaagaaaaacuugccagcaggaaacacagcuugauuugaaaacagauuuuuaaaaaauuccuugcuccccccuccccuccccuccccuccccuccccuccccucccauccccuccccuccccucccauccccuuucuuuuuugacagagucuuucucugucaccuaggcuggagugcaguggaaugaucucagcucacugcaaccucugccucucggguucaggcaauucuuaugccucagccuccugagugguugggauuacauacaggccuguaccaccacacccagcuaguuuuuguauuuuugguagagacgggguuccaccauguuguccaggcuggucucaaacuccuggccucagggauccacccaccuuggccucccaaaaugcugggauuacagaugugagccacuaugccuggccuggauuuuuaaaaaauuucuuaacuuuuuuuucagcaagaaaaauaaccauccacagggaaacacuaaagcugaaaugagaaugcccaguaacaauaguuuuuccaaacaguaguuaaauaauuauaugauggauaaugguuaaucuguauuuugugaugauuaaguaaaacauucauaauugccccauuuaauccuagaauuuucauuagaucaacuugaacuucaguaaauuaaacaaaacauaucuuuuuagaaguaagguaucucuauuaaugauacauuucuguguucucaagaccuacguuuacucuagaguuauauuggucaauaugcuagccacuagccacauuugacuauuuuaauuuuaauuaaaauaaaauacaauuagaauuucaguuucucaaucacacuggacacuuuuuagguacccaguagcaucaugugaccaguggcuacuuaauggacaauauagaccauuuucaucauugcagaaaguucacuggacauugcuccucaagaggagugguuguuugcccaagguuccuuuuauucauaugaugauggucagccuuucauuugagaagaaggccucuucagagaagcuucuguggaucugcacugccuccuugauucucuacuucccauucaccagcauaauuugagcaacagcaaggcaucuauugccuuguuggcaugaugugagagagggggaaagaauagugggagaugacauuggagcaguaaaagcaugcacccugauuuugcacauguugagccugacagucugcaacacucuuuuuuuuuuuuuuuuuuuuugagacggagucuugcucugucgcccaggcuggagugcaguggcacaaucuuggcucacugcuaccuccaccucccggauucaagugguucuucugccucagccuccagaguagcugggacuacaggcaugcgcuaccacaccuggcuaauuuuuguauuuuuaguagagagggaguuucaccauauuggccacguuggucucaaacuccugaccucgugauccgcccgccuuggccucccaaagugcuaggauuacaggcgugagccaccacgccuggccauucugcagcacucuuauagcuauucauauggcuuuuucucucaucucuuucaguucagaggacugaaauuucuucuucucagcaagaccuucccugaccacaccauauuuaaauugcagccuucucccugccagugguacucucuaccccucuuauuuucuuccauagugcugauugcugucugaccugcuguacuguauguuucacuauuuuuuuuuuuuuguuuaacuuuugagacaaguucucacucugucacucaggcuagagugcaguggcaugauuacaacucacuguguggccuugaccuccuaggcucaguugauccuucugcuucagccucucgaguagcugagaccacgggcaugcgccaccaugcccagcuaauuuucuuguuuuuuauagagauggagggcucacuauguaacccaggcuggucuugaacuccuggacuuaagcagucuccccaccucagccuccccaagugcugguaugacaggcgugagccacugcaccuggcccucuuuauuggcuguuuccuucuaguaggauauuugcugcaugagggaaaggauugcugucuguucuacucccugcuguauucccagagcaaagacagugccuaguauauagcagaccuucaguaacuauuuguugaaugaauaaauggauguguauguauucuaaaauaguaacauaaaaugagauggucaguuuaguucuaagaauacauuuaaagaauaguagcauaaaaacacuauccuaguuaugugaauacacaaugagauagaguuggguauguguacgaguuuugggguagggggagaggagagagguauugggguaguuuuugguauauucuuaauauaaauauauuaaucuguauaugugacugauuuuggauuugcuaauaacaggcaaauuuuuaaaaacuauguucaugucucuuuauaauucugggcuuucaaauaauucagcauguauagucuuaugaauaccuaauaacuucucuucauaucaaaacaccuaucagauuuauucuuugacuuugcacaaagcacuguugcuguucuuuaauaucuaucaggaaucuacaauauacuagacucuugacuaaaagaacauacuguguuuucuuaucuugcaauuacuguuuguaggcuaaguuuuugucaggaaaauugggauucaucuuauucauggaguuuuguucucccuagacacaggugaugggagggaauaauauuugagguuguuugauuuugcaguaggcaccacuagcaacuugaccccugcucuaucugacugccuucuauugcccuuuuggccugcaagcccuugcccagauucuugggcuguuccuuuugggaaagucaccacacagcacaaugccuuaccaagaaagccgcaagauuuccccagcucgguuggcuguucagugcccccauuuucagccaugccagaaaguggaacggaggaaucugaggcaguaaucauaucaggaaaucagcuuuuggcaaguaagacaacaaauaugaagaaaaaagaaauauccagcacacagcaaaucuuuaaaugucuccaguugcugucagauaacccauguuaaaagauuacuuuaugucuuucugcauccuucuucuuauuaauacauguauucacagauauauagauugggcacgguggcccaugccugcaaucccagcacuuugggaaaccaaggugggcagauuacaaggucaggaguucaagacuccugucucuacuaaaaauacaaaauuagcugggcgugguggcaggcaccuguagucccaucuacuugggagguugaugcaggagaauugcuugaaucugggaggcggagguugcagugagccgagauugugccacugcgcuccagccugggcgacagagcaagacuccgucucaaaaaaaaaaaaaaaaaaaauuuguuuuuauguagagagaauuugaagcuuguuuuuuuaauuugaaagcauaaaauaguagauauagcuugauuucuuugcuuuuuuucaaaaugucuuuauuuaaaugggauccuguaauuuuaccuacaugaaauaugugcuuuucaaaaaaaaaaguugguuuuuugguuuauuauuauuuuauucugugccacuccucuccucugucauugucccaucucuaucccuugaugcuuguaaauuaccugauagguauccuuuugugauuuucuccauaucuguauaucuguaucuguucacaucuggaacauuucaacugguauuuuugaggagcucucaccucacugagaauaagacaaaagaaauuuaaaccuauaaguaguuuguaaaaaauucagggaaugaucuguaagguaauuuaugaccaggugcuacuuuguauaaugcccaucauauggaagaguuagggaaggcagaggucagguggggagucauagggcuucugaaaggugcacaguuuggaugagcaacaggauuaauagggauuacagaguaauaauguucauaguuuacuaaacaaagcagaaauagugagcuauucugcauauaaaaaugauacuaaaggaucuuuugagauucuuacuucccaaaacagucuugaaucuucucuuuuagaaucaccagcaagcuaauuugauauaaugaaggaaaaguaaagcagaauaaagauaauguuuugugggagagguggcacuugagucccugggugcccucaaguuacuuaaagucucuuagaagucacuucucaccguuggacaccaucugcugugccuuacauuaacaauaauuuucacaauuuaaaaauuugcuuuuaguggguuuuuuuguuaaauuuucguaaugcagcuuugaacauuuuucucucacaccucaaguacacuaauuuaagacaaauucucauacuauuuguuaacuacuuucuguagugauuuuuuuuuuaauggcugauaauugcaucuuuuuguugcuuuugggauauucuuauaaagcugucauagccacuaaaaaugaaagcaguauuuacuuuuauggagguucccuauguauguguacuaagcuagauuguuagcaagaaggaagaauuuuaugauagcgugcucuuaauauuuucuuuauauuuuucauuuauaucuauuagagcaaucuaaacucccuaaauugaguguuaagcuguugguauucaagauuuuggagauuuuuuuaaaaaaaugcauugauauauuuuuagcauauaauguuuuauccuuguuuccagucuuauuugugauaaauuugucaucuguuauauaauuuuaaagucauaugacuuugauuuugaaaacauuuuauuacguaguuauucauuauuuacugccgucugcaacugugaagaugcgugaagaacucauguuucauuucaaaauuuuccuuugagauuauuuugauuucagccuuuuuuuuuuuuuuuaaaaaaaaacuucuuugacauaccauuuuagcuauuaaucuuuggaauaauguauggagagcuuuuuaaauucugauuauagucgauaaguauccuuuauuuuccugauagugauaucaucaaagacuuguauaaguuaaacaugaccuccaaugguuaagacugugcuugcagcccagacuaaugaccucaucuaggugucuucuccuuucuuucugcaaagacuaaucauuuaacaauaauucacaacuuuuaccuaauaauagguguucaaguuaaaguagcacgguauucacucuaaggagagggaguaguuguagacaaaaagaacucuauuuuauuuuuaaacaauuuuuuaauaccaaaugauuuagagaauguuucugguaucuuugagaaaaaagaucaucugugugaaauauaaagagcaaugcuagaaauucaaagcuuugucucuucaauagaccuaauucugggaauguagaagaauauauauguauauauugacagcuaaaugucuacugcauaguccuacagcauguuuuauagaugacaucugagauauacaauuacauuauauuuuacuucagauuucaugucugugaguccugacuuuccuaagcucuguucuucucauuuucuuuauuuacaaaaugagggcaugauccccccaugucauauuguuaugaggauuguauuagguaauauauauaaagcauucagauaggacgugcacauaacagguucuuaauaacugcuggucuucgucuuuuuucuuuuuaacuccuaggguacuuacaguuuuuguagaaugguaaaguuagaccucaagauacuauuuaacucuggcugugaacaucuuacgcauccaagucugacagauuucuaggcgacuaaagguuugguuuaggaggauaaagaguauaggugccuugcuccagccagucauucauuguaugcaaauguaaccaccaucaauaaguaacaaugcuauggacccauguuuuaguuaugccugaguagauacaucaauuauaaugaucuuuuuacaaauauucaacagaacacgugacauaugaacuauucuauagugcuuuaacaugccuauuuucaaugguuacauuuccaaaaaaguauaucauugauucaaaacacaaaaccaucauaacugcaaauuacuugcaggcacuaaacuuaaauucuaauuugucaauuauuuucauagaguuauauaaguuuuaauaauaaugcucuuguaaauaaugcucuuauaaaaugcuccugcaaaugcuuuuguuacacaugcuguuagaagcaacauucacuaaaugaaaaaauacuggcuuuugagaaaguuaggguaaaagguuuuuuaaaaauauggaugauuauuauccuuguuuuuuaagacucugaauaauauaauaauuuaagacuuccaguuaaaacaugguagguuaaacacauuuguucaaccaugcuuccuccugaaaccucacuaaagugacaggaaaggcucuuuuuaaagcauaaacccaaauggaugaagagaauuagagaggagaugauagcagaaaagagguaucaagauucauuuggaagcuggaagccagaugcauaaaugguaacugacuuagccaccuagagaaagcugaaaccuuagccaugguaggagaagccuguaaaaggcaaacugauuugucuuauaauucccuccucugcucuaugcagccaaaucacugcucucccuuuaccaucacagaagacaaaagaauuacuuuuaaagggggccuaauaaagagacccuauauuccaggcaaagaaaaucuucauguagaguuguuuguccucuccuccuucucuguuguuguuauuauuguuguuuuuguuauuauuauuauugcacuuacuaaguacuuacugugagccaggcaauauuuuaagcacuuguaauauuuuauuuaauccacacagcaacucuaugauauaaaugcugucauuauuguuuuacugauuuaaaaaaaauccagaaacaaagaaauugacuugccuacuaaaaacuacaguuaguauguagcguaacugagguucaaucccaggcagucuggcucaagagucuauacugagagucaggaaaacuauggccauguaccaaaucuagcccacuaccuguuuuuguauggcaagcuaagaaugguuuuuacauuuuuggaugguuguauuauuuuucuauggcugcugcaacaaacuaccacaaauuuaguggcuuaaaauaacagaaauguauuaucuuacaauucuauaggcuaaagucucuuugggcuaaaaucaagguguuagcaggguguuccuuucuggaggcuccagggagaaucucuuuccuugccuuuuccaguuucuagaggccgcccuuuuaucuuggcuccuggcacacuuccuucaucaucaaggccagcaacguuguugaguccuucuuaugucauaacacugcgaccuucuguucugcuucccucugccacuuuuuaaagaccccugugauuacaucuagccuacucagauaaucuaggauaaucucccuauuuuaaggucagcugauuagcaacauuaaaucaaucugaaaccuuaauuucccuuugccucauaagguaauauauuaacagguuccagggacucaaauguggaaaucuuugggaguauuacucagccuaucauaauggauucagaaaaucaaaauaaaaauauuuugugacacaugaaaauuauaugaaauucaaauuucaguguccauaaauuuuauuauaacagccuugcucauucauuuguauauuaucugugacugcuuuuguaucauauuagcagaauugaguaguugcaacagaguauaugguccucaaagccuaagauacuuacuguauggccccuuauagaaaaagauuuugaccccugucauauaguuucuaauuuggauuuuagggcuuuucucuucgauauuaaugguagacgugggucacuagacauuuggggaaauccucuaacaugaaauacagaaacuuauacuaaacagaauaagcaagucagaggagagagagauaauguagaaaacugaagaaauuuucaaggaaaaaauuauucucucuaagaguauaauugauacucuuagagagaaaauagagacuaguacaaccaagaaacuaaagcagauuacuaccaaaaaauuugaauguuaagagauuaagaaagaucucuugcaaaauaaauaugugauugagggauaagggaaggaaccccuaggaguauuaaaaucuccuggaaaguauauguaaauauaguugaggaagccuaggaaguagaauaaaauacagugauagaaaaaagauaggagacuuacagugucaauucagggucuaguauuugacuagaaaguucuaaugaaaauacaggagagggagguuggaauuagguaagaaagaguuacuaaaaauaaagaggucucagaacugaaaaaaagugauuuuccagagaggaaggacucaucuggaaagaaugaaaaagacgcacaccaagccaugcgucaugaaauuucaggacaccaggaauauagagaagauuuuacucacagggaauacaauaggaaacaugugacacaagaauaauaggaccauguaauuugggauguugguaagacagcugcucaaauguaagaccagggauucuguguuagugcaaagggacgucaucuuucucagucuucuguugaggugaugaaauauuuuaaguucgguaaucauuacuuuuagugacugcucaccaaaucuucuuaacucuguccuaagcauuauuuauuccagacauacauucagcuacaugugaaacaacccaccaggauuauaugccagaacuuacgcucaauauacccaaaacacaaccugucucuuguagaacucauucuuccuuuugacuuugcuauuuuuauuauuuuuccguuuagaacuuuagaauauucuuugccuccuauaaccagugucagucuuaucaguucugugcuuuaguguuucucacacucacucccucaauugcgucucucgcuuucauucuacuucauacccucaucaccuuuaacuugugaugcuggcuauccucacccuucucucuccguguucugauaaaccuagccccaguuuaaaucacguuaaacgcaauacuuacuacuucaguacuugucauaugcugaauaauguucagauuuucucagacugacacuuccagucuuucgguuuauacuuuuucccaaccuuugaguaucuuccauaacuuucuccauaaucaaaacacuuuuuuuuuugacacagggucucacucacccaggcuggagugcaguggugcaaucuuggcuuacugcagccucugccucccagauucaagugauucucccaccucagccuuccgaguagcugggacuacagucgcgcgccaccaugcccggcuaauuuuuguagagauggguuuuugccauguuggccaggcuggucucgaacuccugaccucaagugauccacccgccucagcuucccaaagcgcugggauuacagauggcagccacugcacccagccuaaaucaaaaaacuuuuuagucagacuagauuauacuuuguucccuuaugauuauccucugauuuacugccuuggugccuuuuccuauacuaaacacuccacccuauaugccucucccacaagccccccgcugcugguagaaauagccaccauccacuauccaacauccguugaagaaggcccaaucacaugccauucccuccaugaugcucuguuauggacuagaagauuauguaucuagggauauaaacccugaaaauauuuuguuuuauuuuuaguuugccuggugguuauuuuguuucccuuuaagauuaauauggucagggacuuuuugucuuauuugcuguuucucugugcccaagaugagcaugacauauuaauaaauauuuguugaauaaaugaaugaaugcuaucagagcauuauagguuuuaucuuaaauggguuugguuuucaauugcuuuauuguuguuuuuaaauuuuaaaucauuguuccuuaaacuuacuaucaaauaauuguguuuuauaaguuguuuguuugcuuuagccuucaguauguagugaugccuauuugcaucaguaguauuuuuagccgauucuuuuccaauaacuagauuuuaaagcauauaguauuaacaagugauauuuaaugaacacuuacuuuguuccagggaccauuucaagugcuuuuuauauauuuuaauucauuuaauccucagaacaauacugugaauuaaguacuaccauuaacuacauguuuuagaugagaaaacugaaguacagcagugaaggguuuaacaacucgcccaaggccaugcaucuaguuaguuuuggagccaggaacucugacucuagaauaugcacuccaaaauuucacugcuauaugguucaaaaauaaaugacccuguugggaauauucuaaaacaagauuguggugaugguuguacaacucuguaaauuaacuaaaaaucauugaauugcacacuuaaaaugggugaauuuuauggucuuaaauuauaauuugauaaagauguuuaaaaagugggugaucuguguucuuauuaaaauggauuauaauguuuuucaauauuucaugugcaguggaacuuuuagcccuaguucucuugccacuggaauaugggagugggugaaguagguaaucuaugccuugccuaaguuggcuaaggacagaaaaguuuauaugucacuguuacgagcucuuugggggugagaauuuuuucuuccuuaccuuuggaucuguugguauguaaaccauccauagcagggacuugauaaguauuuguugaauuaaaucucaagggcuuuauuuaccugcacuguagauacuuaaauuguauccccagaaauccuagcuuucauagucuaauuuuaaaauauagaccuugugcaguauacuuaaaaggugaaacauauacacugccuagaugcauagauauuaacauauagaagggaaaaauguagcuggugaaaacacuguguacaaaacuuuguagauuaauaugauugcauauugaucaaaguugcuugaggaagccagaaggaaaauugaguucacauaaguauuuacuuauaaagauuuuuaaagguauucugaaaacauuggaacucacagguaaaguuggaagaauuaaaauuuucugguaaacauggcagaaauagaaaacauauaaauauuuauggauguguauugacauuuaggacagaaaaaauggaaaccaaucaugaaccaaaaacuucaguuuaaaauauauccauaagaguugcuguuacagagucaaauguauaaauauaagcaagcaguuaauauaaucuuauauuuucauuauauugaauaagcagauucaauagaaggauguaauuucacuuugucacuauuuagugacuugaauuuagucaaaauauaaaggucaaaaugauguauuuauuaaaaacagcaagauuuuauuuguuuguuuguuuugagacagagaccugcucaguugcccaggcuggagugcaguggcucaguuucgguucacugcaaccuccgccucugggguucaagugauucuccugccucagccucccaaggagcugggauuaccaggugcccaucaccacgccuggcuaauuuucauauuuuuaguagagaugggguuucaucauguuggccaggcuggucucaaacuccugaccucaagugauccaccagcuuuagccuugacauagggaaaagugaaggaggaagugggaaaagguugagguggguggauauaucagaucaaauagggcuguuuuggcuauguagaguuuggauacucuucugagguuaaugagaaaccauuacauggauuuuaggagaggagaggauuggcauuauucaaguuacauuuuuaaaagaaucauucuggcuguucugcauggagaauaacuacaagaagagaaagguggaagcagggugacugguuaggggcuauuuuagacauaaagguaaauuccuggacaaggguuuuaguggugaagguaauguuuggauucugaagauuuuuugaagccagagcuaacaaauggauaauguaaggcuuauuuuuuacagaauuuuaaauuaugccuuuuuaaaaaagagucaggcaaugauauaaaauagauaauuuaauuuggaaaaugauuuuauaaaacguauuugcucauuccgugucauggugccuuauuuuuuaaugguuaaugggcucuuugaaagugaagaauuuggguugcaugaaauaggggaagcauguuuugaauuuguguuauucuagccaauuuugaucaguuaauuuuauuauuaucugguaucaauuggcaauauggaguaaaugcucccuaauucuuaaaaaaaaaaaaaaacuuuugacauauuacaaagcacaauuaguccucugugguuaucuagauagggcuaugucaucuaaaauguucagacucucugcaggaugacuauagucucuaaaaagccuauauaagggaugccucucucuaguagagauauuuccugagccauguuucucagcaucaggacagcuaugauuuauuuuguaaguggacaaggccaaacauuacuguuuuaacuauuauaaacaaaauaguaaauguuaaauguucacuuaauagagccucuaguagggcuuuuuauauacacaaaguaaagucugagccaaaaaugugaaacaguucucuggucugugugcauucucuuuuaaccuacucuuugauucauugcaacuggagaagugaugcaaccagugaugauuugcacuccaaagcucuuggugcugcagugaguccucccuguuugguuuuuuuuuuguuuuguuuuguuuuuucuucuacuaauuacccaagccacaguaauuuaucaaauuucuuaaaacuuuucagaaauguuuauuauaauauguuagauccaaaauaaagagcuuugcaagauucuguuaaaccucauccuuuuauaauauuuuuaaauauuuaccagguuuuuuuuuuuuuuuuuuuuuagcacagauucaaaccgguaauagcaaaaugauacaaaacugucuuaaaaauguggaaugcuucacaaauuugcaugucauucuugcacaggggccaugguaaucuucucugugucauuccaauuuuaguauauaugcugccgugaacacaauauuuaccagucuuguucuuuaucauuuuuuaugguucuuagcuuuagccaacaaaguaaugcaaggaucaaaucuuaauucagauauaauuuuaaagauacuuccccaauuuuuuauaguuaauuacagaaagaacuauucucauugagugguguuuucacugaguaaucuguuuuuuguuuguuuuuugccgcuuuguuguucuuugccaucaagguuuugaccugggugguaaacacugaugcugcauugaugcucauggggcagggcgcuaaagagcaaaucacuccauuuuucagguaguaacccuguuuuauucugaaaaacaguuuuuauaugcucucuauuugaaaauguagcagaaaagaccuauuauacuugucuuguaaagcuguauuuuuuaaucacagaaaauuacauuuuauauugugacugacuauacacauaucuuugcauggacacacaggcauauaugaaacugaaaaaggaguuaaccauagcaauuccuauugcagugugcacuccauuuuuuuuuguaucccgauuuguuccguguuuaaaguacugaucauaaccuauuaaauuguuuuuaugacccacuaaugaguuagaauccagaguuugaaaaaacacuucuaaagcaugccucaaauauaauuugaucuuuucagaggccuugugagauaggcaaggcuaauauuaacccuuuucaaacauagcuaaagccuacgcuuugaaaacagaaguuggacuaaagaaaugaaaacagaaaaaaugguuugggguguugaaugagcagaggucaucaugaacacaguguacacuugaauggugauggagaggaagaggggcugcagagauuuagaacaggaagcagauggauguacaagauauuuuguuugccucaggauuuuugccuaagcccuugaagacaucugguaugccacuagaaaucaccugaagcuaaaauuuaccagauuguugguaucuugaaaagcuaccaaaauuaguuugcaaggcucuacccaucagcuucuuacagucugccucuagaaaucucaucuauaccaauccaguccaauuucucgagguaagucuguuucccaaaauucacuuauuugcauacuacuuuuauaauucuugucauauguauacaucaccauauuguuuuuuaaauuguuagaaaugauuuuauuuaaauauuccaaauaauuaaaaaauuugagauuaacuucagacaacguaacauuaaucauuuaaagcauacagucguugauauuuaguguauucacaguguugcaaccaccaauucucuaguuucaaaaguguuucaucacccgauaaagacaccccauaccuauuaaguaaucauuccucauucucccauuuauaaaagacacauucucaugugucauuuggcugcauaaaugucaucuuuugagaagugucuguucauaugcuuugcccacuuuuuguugggguuguuuguuuuuuucuuguaaauuuguuugaguucauuguagauucuggauauuagcccuuuguuagaugaguagauugcaaaaauuuucucccauucuguagguugccuguucacucugaugguguuucuuuugcugugcagaagcucuuuaguuuaauuuagaucccauuugucaauuuuggcuuuuguugccauuacuuuugguguuuuagccaugaaguccuugcccaugccuauguccugaaugguauugccuagguuuucuucuaggguuuuuaugguuuuaggucuaacacuuaagucuuuaaucuaucuugaauuaauuuuuguauaagguguaaggaagggauccaguuucagcuuucuacauauggcuagccaguuuucccagcaccauuuauuaaauagggaauaguuuccccauuucuuguuuuugucagguuugucaaagaucagaugguuguagauaugcggcauuauuucugcgggcucuguucuguuccauuggucuauaucucuguuuugguaccaguaccaugcuguuuugguuacuguagccaaaacagcggcucaucaucacuggccaucagagaaaugcaaaucgaaaccacaaugagauaccaucucucaccaguuagaauggccaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggauuauaaaucaugcugcuauaaagacacaugcacacguauguuuauugcagcacuauucacaauagcaaagacuuggaaccaagccaaauguccaacaaugauagacuagauuaagaaaauguggcacauauacaccauggaauacuaugcagccuuaaaaagggugaguucauguccuuuguagggacauggaugaagcuggaaaucaucauucucagcaaacuauagcaaggacaaaaaaccaaacaccgcauguucucacucauaggugggaauugaacagugagaacacauggacacaggaaggggaacaucacacacuggggccuguugugggguggggggagcggggagggauagcauuaggagauauaccuaauguuaaaugacgaguuacugggugcagcacaccaacauggcacauguauacguauguaacuaaccugcacguugugcacauguacccuaaaacuuaauguauaauaauaaaaaaagaaacauucuaaccugucaaaaauguaaaaaaccaaugugauucuaaauagaauauagcaaauucugaaaauaaaauaaaacaaucauuagccagauacuagcuagauacuguuaucuaccaagucucugugucuuagauucuuccauguuaaaaagggauauaggcaaaaguuauggcgguauuaaagaccaaucaaugcuaaaucaagacuuucugcuugguaauacugaaagaauugaaggaaauuucaaaaauauaccuuucucacuaugagauucacugcuauuuaauguuauuuccuuuaccaucuaaaauuugucuugauacagcugaauucauccuuuucuucacuuuacuauuaaagggguuguauauuauucccagaguccuuuauaacugaauuccuggaauucagggaguguguucuaaauauuggugauugcaguuuucauuauuauccucaaacauauaaaauccauuauucaccaaguaguaaacuagaugcuuucagaguuuuaaagaaaagauacagauacuacuuccaaauaauauaaaucuuuguugugaaaaucaauuuaugcacaauuaacacuuagaauauaaagcugauaauaguaaauagacaaguagauuuuauucuaaaaguuaucugguuuaaauuauuuggaacuuuuauacuauuucauagagcucaaguuaauaccagcuauuaugaguauuccagauuagcacaauauggcuuaucuucuuaugaucuucuuuaaguucuccaggggugguucugguaugauaaaaauaguacuuugcaucacaaacuucaguuuccucaucugaacaauaaacuucaucucuaccuaguuauagaguucaaauaagauaaacuguguaaguacacagcacagucccugguacuuuguugaaggucaauaaaguauacauuuauuuauucaguuacucauauuuguagccauuuaaaaauuuuuuaauugacaaguaauaauuauacauauccauggcauacauagugacgaauugauccuuuccuucacuucacuguuacguuuuauuugauacauauaauguauagugaucaaaucaggguaaguaacauucaucaucucaaacauuuauuauuucuuuguguugggaauuuucaguaucgucauuccagcuauuugaaaguauauaauauuuauuguuaacuauagucauucugaugugguacagaacacuagaacuuauuucuccugucuagcuauaauuuuguuuaucuguuaacaaaucucuuucuaacccucccuucccucuacccuucucagccucuaguauucucuguuuuacuuuuuacuucuaugagaucaacuguuuuucucucacaugagugagaacauguggaguuuaacuuucuguucgcagcuuauuucacuuaccuuccacuucaauccauguuacugugaauggcaggauuucauucucuuuuaugaccgaguaguauuccguagugcauauauauaucacauuuaauuuaucuauuuauuauuggauaccuagguugauuccauauuuuggcuguugugaauagggcagcaguacacauggaaauacagguaucuuuuugacacacugauuuucuuuccuuuggauaccguaggggauaagggagagcuuucccuugguccccugauguuuugcugaaaaaucaacucauaaaaggcagauuaauuagagaaaaggcauacagauuuauuuaucauguauauaugggagccuucggaaugaagaucaaaagauacaggggaaauuguccauuuuuaugcugagguucaacaaaguauggacagucauguagaaauaugauuggacaaaaaggggugaucuaauacuaauagacuggggaaacucaggagggucaucuguuuagauucuuuuuggguucucugaguacgcauuccuuccuuccggguaugggacaagacccucucuagagugggacuguuauaaccuacagacaaacaauguaggucagauaauuccuuuguggucaguuuuuacacugaaagccagagggaaaauuagaauaauauuuauaggauuuaugacuagcuuugaggaauagggguucugguuucuacgacccaccuuggggaccagggcuucuaguuucuauggcuagcuucuggggagaaugggacagagagacaggagggcaggagaaagagaaaaauguuugcuucagaggcugcuucugaggcuuucauuuugggauauuguuuucugagcccuaaaaaauguauacuuaguaguagccuugcuggaucaugugguaguuccauuuguaguuuuuugaggaacuguucuccauaauggcuauacaaauuuacguucccaccaauaguguaugaguucccuuuucuccacauccuugucagcauuuguuauuauuuuuuucuuuuugauaauaguuauucuaacuggaaugagauguuaucuaguuauaguuuugauuugcacuucccugaugguuagugguguucaugaguauuuuuucuuauacauguugaccauauguaugucgucuucuaucuguucagaucauuugcccauauuuuuuguuguuguuuuuauuuuuauuguuuuuugaggcagagugucacucugucacuuaggcuggagugcaguggugugaucucagcucacuacaaccuccaacucccggguucaagcaauucuccugccucagccuccugaguaguugggauuacaggugcccgccaccaugccuagcuaauuuuuuuuuguauuuuuaguagacaugugguuucaccguguuggccaggcuggucuugaacuccugaccucaagugaucugcccgccucagccucccaaagugcuagaauuacaggcuugagccaccucucccagccugcccauauuuuaauuggauuuguuuuuguuuguuuuucuguucuuuguauauucuggauauuaauccccuauuagaugaguaguucauuacucauguauaaaaaggcuacugauuuuuguauauuaauuuuguacccuacaaauuuacugaauucuguuauggguucuaagagaguuuuuuuuuuuuuuuguaguaaagucgguauguuuuuccauauauaagaucaugucaucugcaaacagggacauuuugacuucucccuuuccgauuuggaugccuuuuauauaucuguugccuaauugcucugguuaggacuuccauuaguauguugaauaagaauacugagauugggagucuuugucuuguucuaguucuuagcugaaagcuuuuuauuguucauaagaugucauuuguggguuugccauauuuggccauuauuauauuuagguauauuccuucuauacuuaauuuauuaagaguuuuuaucaugaaacgauguugaauuuuaucaaaagcuauuucuacaucuauugagaucaucuugugguuuucauccuucuuucuguugaugugugugauguuuauugauuuguauauguugagacauccuugcauuccugagauaaaucccacuugauuaugauguauccucuuacugauguguuguuagaacucagcuuguuaguauuuuggugaagauuuuugcaacaguguucaucagggauacuggcuguaguuuuccgcuuguugucguuguuguauccuuaucuaguuuugguaucaggguucugcuggccuuguagaaugaauuaggaagaauucccuccucuuuuauuuucugggauaguuuggaaagaauugguauuaauucuucuuuaaagguuugguagaauucagcaguaaagccgucugguuuuggacuuuuuuguuguugaaagaccuuuuacuacugauucucucucaugacuuguaauuggucuauuuguguuuucuuuuccuucuggguucaaucuuuauagguuguauguguccaggaauuuauucauuuccuuuaaauuuucaaauuuauuggcauauuguuguucauaguacucucuaaugauccuuuguauuucuaugguguccauugugacauauccucuuccguuuaugauuuuuucaaauuugagucucuuuuuuucuuuuuuucugaguuucacuaacguuuuguugauuuuguuuaucuucucaaagaacuaacuuucuguuugaucuuuuguguauuuuuuagucuuuuucuuuagggucucacucuguugcccaggcuggagugcaguggcuugaucuuggcuuauugcagccucagcuuccugagcucaggugaucauccugccucugccaccugaguagcugggacuacagguaugugccaccaugccuggcuaauuucuguauuuuucuguagagaugaaguuucaccguguuucccaggaaacuugagaacguuuccauaguucucaaacgugugggcucaaaugauccuccaaccuuggccucccaaaaugcugggauuacaggcaugagcuaccaugccaggccucagucucaauuuuguuuauuuaugcucugauuguuuuuauuucuuuuacuaauuugggguuuguuuguuuuuuuucuucauuuucuaguucuuugaggugcauuguuagguuuuuuauuugaaaucuuuuuauuuuuuggcauaggcauguauuacuauaaacuugccucuuaauacugcuuuugcugugugccauaagcuuugguacaucguguuucuauuuccauuuguuucaagaaauuuuaaaauuucauucuuaauuuugaguuuaaccuguugguuguuuagaagcauuuuguuuaguuuccauguguugguauaguuuugaauguuccucuuguuaugucuaguuuuauuucauuguggcaagauaagaugcgucauaucuugauuuuuaaaaauuuauugagacuuguuuugugcccuaacauauggucaguccuggagaguguuccaugugcugcugaaaagaaugaaguuguuaggugaaauauucuguaaaugucuuuuaggucugugguacaguuuguguagaaacaaguucucacccugucaccuuggcuggagugcaguggcgugaucauaguucacugcagccuugaauuccugggcucaaacgauacuccuuccucagccuccuuaguagcuaggacuauaggcacaugacaucacagccagcuuauuuuuuauuuuuuguagagacagaguuucacuacauugcccaggguugucucaaauuccuggccucaagugauccucugccuuggccucucaaaguguuggguuuacaggcauaagccuccauuucuggccuguggugcaguuuaaaucuauguuccuuuguugauuuucugccuacaugaccuuuccagugcugagaguggggugaaauucccuacuacauauugaaguguuccccacuauguacugaagcccauuucucccuuuagaucuaauaauguuugcuuuauauaucugggugcuccuguguuggaugcaaauauauuuacaauuguuauauucucuugcugaauugauccuuuuauuauuauauaacguacuuuuuugucacuuuauagcuuuuaacuugaagucuauuuugucugacauaagcauagcuacuccugcucacuugauuuucaugugcauguaauacuuucaguuuaagugugucuuuauagcugaggugagauucuuauaggcagaauauguuugggucuuguuuuuucauucauucaaauaguguauauguuuuaaaugggggaauuuaauccacuuacauucaagauuauugauaggugaggacuuacuccuuucauuuuguugauuuucugguuauuuugcauauccuuuguuccuuauucccuuacuuaucauuuuuaugguuaggugguuuucucuagugguaaggauugauuauuuucucuucuuacuuuuguaucagcucuaccagugaguuuuauaguuauacauguuuucaugaugguagcuguugucuuuucacuuccagauguaagacucccuugagcaugucuuguaagacuguucuaguggugauaaauuccuuuaguuuuugcuucucuauugggagauuuuauuucuccuucauuucugaaggauagcuuugcaggguauaauauuuuuagcuagcaggguuuccccaccccugcuuucaguacuuugaauauaucaucccauucucuccuggccuguaagcuuucugcugagauaucugcuguuagccuaauggagauucccuuauuuaugacuugacucuuuucucuugaaugcuuuuggaauucuuugucuuuuacuuauuacaauuugacuauguugggcuccagagaggaccuguuuggguugaaucuguuugggguucuuugagcucccuggaccuaaaugcucaucucucucccaagacucaggaaauuuucugcuauuauuucauuaaauaugauuuccucaccuuuacccuucuuuuuuccaucuggaaugcccauaguaugaauauuugcuugcuuaaugauaucucauaaauccuuuaggcuuuccuuauucuuuuuaauucauuuuugccacugcuuguguuauuucaaaagaucuaucuucaaguucagaaauuuuuuccuccauuugguauagucuguuguugaagcucucaauuauauuuucuauuucauucauuuaauucucagcucuaggauuucuuuuugguucuuuuuuaugauaauccaccucuuucuugaauuuauuacuuauaucauaaguuguuuuccugauuuuguugaauuguuuaucuguauucucuuguaucucacucaguuuccuuaagauuauuauuuugaauucuuuuucuggcauugcauguauuaugauuguggucuguuacuagagaauuauguuucucuuuggaagugacaugcuuccucgcuuuuucauuauucugugucucuguauuaauuucugugaaucugguggucgccucuuccaauuuuauucacuaggugucacaaggaaagacuuacucauauaaauggaucuuggguuguugauuugauggagugcauuggcuuuggaucuagguggacacaguaguguaguugucauaaaauuucuucaaccguaauccauacugggggcauuugagaguuucucaguggccuaggcugagagaguuuguggugacaguagugcagcuuugccaggcuugggcuaacugggcugucucuuagguugggcauuuguucaugcacacagugggucaggcagcuuggagucuggcucacugggguuguagccacagggauguuacucuagccaggagcacaggcaugcuuguaguugcuuggcuagacuaaggcaugucugcuggggauggcucauagggcuguuucucagccauguauuuaggcucauggcugcuucaacagucugcaauguuuccaccagggguggccuacagcauuguuucucagacccuuguugaggaugugaggggguugggcaggacaugucuugggagggaagagggcacuguguuucugaaucccugagugugggcacuuagccacuccacuggcccagggcuaugucagcugcuugcagacuuguaggccucucccaccuggcagagggcaugcagugguuuggcuagcccaaggauggauuuguccuaggcaggacugguaggcuuuuagugcaauugggaguguggccccaggaguugguuaccugcuguguaggaccauagucacagccaauccugggcccauacucugcacagcugggauugugacauucauauauaauguauggacuuggcauaaucaauaugaaaccccagugcuggagaagugcaguagggcuacuggcucccugagcaaggagcauuccagaggugccucagguaacaagauggcacucugcugcaguagcuugucucacaggggagagggugcaccuugugcuccuaaucuggagcagugaaacugcaugaauuccuggcauuucuccagauggagcugagagcuuguaaggaccaugggauucuucuguuugaaggacuguaggcauuugugguggcaauggggguugguggugauauucugcuuaccuuuuucccaugauggaaaguucccuccgacgccaggcagaucugauccaggucggggagaugggguuauagaggcuaugugcuuccaugcugcccuccugucauuacagaugcaucuucacucccuugccacacugcagcacucuaucuucaacacucaaaucaaaucuuaguuguuuauuuguagccuugguccuuuuuagucuggggggacaaaugccaggcaucucuaguuagccuucuugccuaccuucauagucuuguaaauauguuauagaacuaaaucaacagaguuugcccaaugaaggcaguuagcuuuauuguaauuugauauauagagcuugaccagauaauucaucuccuucucgcugcuauuuaccucaccguuaguaacaauaguggugauaacaauauuagugauaguaguaauaauaauuauuuuaauaacugcuaacauuguguacccacuguguaccaggaauuguuauuaaugcuuuucaauguacuagcucauuuuauaguuauaugagguuaguguuuuuaucccuguuuuaaggaugaguuaacuaagauucaguaauuuaccuaaggacauacaguaagaggcagguagaucugggauuugacucuaggcagucuggcuccagggucuguacuuuuaaccaacaucucuagggccucucagugugugggaucccauucauccagccuaagugaagggccaucugaaagguagugacucuagagggcucauuuuccucuacggguuguuucaaagccagggaauguauauuaucacgggugaaauugucuguuggaggaucugucucauauagaaaaauccuacuacuuaucugugcacccacagaguaccagcagagccgggugaguggggaggagagccaggagaggcagaggggacauacugcaaagauaaucuccugguccccucuguuacaguuaauaaggaucaaaacggaauacaaguuggagaggucaguuuagacucaaguacagucaugcaccaccuaacauuucaguuaaugacagucuguguaugcgguggugcucccauaagauuaguauguagcugaaaaauuuauauuaccuggugaugucauagccaucuuaacauuacagcacaauguguuacucguguuuguagugaugcugguauaaacaaaccuauuaugcugccaguaguauaaaaguagagcagauacaguuauguauaguacaaaauacuugauaauaaaugacuuacugguuuauguauauacuauacuauaccuuuaguguauuuuagagucuacuucuacuuauuuaaaaaagcaguugacuguaaaacauccucagguucuucaggaaauauuccagaagaaggcauuuuuaucauaggagaugacaguuccauguguguuauuaccucugaacaccuuucaguggguugauauauaaugguggaagacacugauauugaugauccugacccuguguaggucuaggcuaacauguguguuugugucuuaguuuuuaacaaaaaaguuuuaaaaguuaaaaauuuuuaauagacaaaaguuuauagaguaaggauauaaagaaagaaaauauuuuguauagcuauacaauguguguuuuauguguuauuauaaaaguuuuaaaaaauuaaaaguugauauacucaaaaaguuacaguaagcuacaguuaauuuauuauugaagaaagaaaaacacuuuuaauaauuuuaguauagccuaagcuuacugcauuuauaaaguguacaauaguguacaguaauguccuagaccuucacauucacuaacuacucagucacuaauucacccacagcaacuucuaguccagcaagcaccauucgugguaagugcccuauacagggauaccauuuuuuacuuuuuauaccaugucuuuacuauaccuuuucuguguguagauauguuuagauacacaaauauugaccaugguguuacaguugccuguaguacucaguauaguaauauucuguacagguuuguagccuaggagcaauaggcuauuccauguaagucuuaccaucuauguuuguauaaguacacucugugauguucacauaaugaggaaaucaucuaacgaacacauuucucagaacuuauucucauuguuuagugacccaugacuguaauuaggcaaggagugacuaccagaguuuuuuccccuucacuauauuuccaaaugcuaucucuuaaauugacuagauuagaaguacuucagaauuuuauaucuguuucccuuaaggaaaauaauaugucaagcccauguacauugaaggaaauaauuuauucuauacuauauuuauguauuauauauuuuauuaccgagauagugagucaagauuauagaaaugguguaaaauuaaaacauuuugcugaguuuaaacggccauaacuuaaauggaauuuuuuugacauucacuagaucuaguagccagaugauaucuuacuauuuuaauuuuuaaacuuaggagguuugccuauaaaccauuuauuagcagaggaagcuuucuaaaugcugugaguuaaaacauauggagauucuaaagauacuugaauggagcuugaaugucuucccacacaugaaauaugugucgcaaagaggaaaauauauuuuagacauuucacugaaucguaguuugaaguuaacagcaaaauacaugauaggcauuauuuuuauauugauaaauuaagaauacuuugguuaaacaagauacauacaguaagccaaaaacaaagcauucccuacuauauuccuaaaucuacaugcuuacacaguaguccucuuauauaaaccugaaacauauagggcuguguguauguucaaguuugauagugaucgccaguuuguguggaguuccccauuuauaaagauagacuuggaccaagugauucuaucuuauucuacaggagaguauuuuucaauauuuuaaaaacuaguacauauggccaggugugguggcucacaccuguaaucccagcacuuugggaggucuuggugagcgcaucacgaggucaggagauggagaccauccuggcuaacacggugaaaccccaucucuacuaaaaauacaaaaaauuagcuggacgugguggcaggugccuguagucccagcuacucgggaggcugagccaggagaauggugugaacccagguggcggagcuuguagugagcugagauugcaucacugcacuccagccugggcgacagugugggacccugucucaaaaaaaaaaaaagaaaaaaaagaaaaaaaaaaaccuagugcauauuuuguguuuccuaauuaucuaagaagacuuuauuaagcuuugcuugcuguacucuguauguuacaaaaacaguggauagauugaauauacuuuuucaaaugcaucucuaaccuuaccucacacaucucuaaccuuaccucuuuugguggcauuggaguggcgugauauggagagggaagucuaugaucagacuuacauuuuuuagaaaugacuuuguucuauaaggaagacagauuggaggaaauaaggcaauaggcaggaggucaguucagagauacugagugaguccagucuuaagugagaugaugagaaccucaaccaaguauguggagugagaauggagaacagaguguacuaaagugauauuaggauguaggacaccuacacaacuugguaaauguuuguauauaaggaauuuaggaugaguuguuuaugagaauaaguaacuggagacccaggcuaccugucaagguagggagauuugcccauggaagucgggggacagggaaggcuguaaugaauuguuuuggauguguugagucacaaaauucucagguccauaaccaacucaguuuaaaagucaaugaguuaauuuacuaauuuugggggcuuguauccaugccuauuacccucuuucccuagauccuagcuaaaaauaggccccaauuuuuuugacuugaggcuggauuucuguuugcagaaccucacugaggucugauuuuuuuccucuacaguucccuugucuuuucaugccuugacccugugccucuuuuaccuauauuacuacuuugcuuaggaccucuggcccauguuuaacuagcuuucuuccugccuuacucaacuuuggaucaaacuuccuucuggaugcauauccuuacugaaauggcacaguuauccucaguagagaugcauuucucaguauguguguggacugauuuugauaaggguuaggagaggauccugcacugugguguggaagaagagcacuguacuaacuuuugugccgcugcugcuucaaaacuagcuguuuaagguaaagugcuugaccucuccuugccucaguuuucuguucuguaaaaugaguagauugggcuaaaggaccucuaaaauucucccuccagcuucaaaaauucuuuuuaaaauuuacaucugcaguauuugacucugcagaauuggauuugguagaauuguggucacaaaagaaaauucccagugaauuuuuaaaaauagauaaauauuugguguagaaguuaaauggacaacugaaucucagugagaaaaauuucaguaaaauuaaacugaaaaggaaaaaaaauuggaaaugguucauuuguguaguaaagauaauugacaaaggaauuaaguuacccugauugagcucacucuggaauauauuuucucagugauugauaugguuuggcuguguccccacccaaaucucaucuugaauuguaguucacaugauccccaugugucaugggagggugggagguaauuuaaucaugcgcgcgguuauccucaugcuguuccugugauagugagugaauuuucacgagaucugaugguuuuauaaggggcuuuccccccucuucacacggcacuucuugcugcugccaugcaggaagguuguauuugcuucuucuuccuucugccaugauuguaaauuuccugaggccucccuagcccuguggaacuguaagucaauuaaaccucuuuccuuuauaaauuacccagucucugguaugucuuuauuagccacaugagaauggacuaauacaaugauauuagucaaguugggauaauuuguuuaacaaaacaaugggggcaugucagaaggacacaggagcuaacugggaggagcucccuaugaccgaaucaggggcaagucugugaacuauaacccauagaauaaguuaaauaucaugaauccauacugauagaaauaauaaguagauaagaaacaacucuuccuuacaguauaauuccaauuaauaaauguagaacgaauaauagaaaaucaccaugaggcagauaccauaguaacacuuauuguaaucaggaaucauuaauggaugcuaaaauuaguugagcaaagcucugaugagaagcagaauauuuacauaguuucaagguauuuccucacaagauauuuaucagcuacaaagggagaauuaauaacuuuacacugaagaaaccugccagauaccaccuuaacagagacauuaaagauaacaucaucuguaauaagacauauugacaucauauaaaucuugauaugaugcauaugaaggcauaacaacacuucugucagauucuuacaaaaauguguagccuuaaccuaauaaugagaaaacaccagacaaacccaacuugagagggagucuguaaaauaacuggccacuaguuuucacaugucaaaaucaugagcuauccuagauuggaggcgacuaaggaaauaugacaacuaaaugcaaugugagauccuguauuugauguggacuagaaaaaaaagcacauuaguaggaaaacuggugaaauuggaaugaggucuguagauuagcuaauagaauucuaucaguguuacucuucuguuuuuuuugauaauuauauaaucuugauagauguuaacauuaggggaagcugugauauggaccucucuaacauuuuuaacaacuuuuugguaagucuaaaauuguuuuaaaaugaagaauuuuaggccaggcgugguagcucacguauguaaucccaccacuuugggaggccgaagugggcguaucacuugaguucaggaguuugagaccagccuggccaacauggugaaacccuuucucuacuaaaaauacaaaaauuagccaggcaugaugacaggcaccuguaaucccagcuacugggaggcugaggcaggagaaucgcuugaaccugagaggcgaaguuugcagugagccaagaucgccugggcuacagagcgagacucugucucaaaaaauaaauaaauuaaauaaauaaauaaauaaauaaauaaauaaauaaauaaaagauuuauaaauaguauuuuaaucuuaaacauguuuuugaaauacccuuguuggugucaacauagcaggguuaagucagcucacuuaagcccucaucucacacacccacaugcuaaccugaaaauggcaaaauuaauagauuuugaaaauuuugaaagagacaauuuuaggacaucaagaaggucuguuuaauaaaugaagggguaaacuuuuggucuuuaacauuccugaggauuacuaaaagcuuaagaacaugcacagggagcauauguacguauacaugacucagcuuuugagagucaccaccuggaagacaaucacgucucccgaugccauuaaauggauuguagagcacauaauucuuggaaguggagcacaguucucacuccaaaagccaagaauggcaaaugcucacuuuccuggccucuuuguauuaugagaaugcagguaugcaaccuagauuuggccaaucaauuccauguacucugggcuuugauucaggagcuagugaaaggagagaauauauuccuuuguggcagcaggaguaguggcaacauccaauuuucagggguagcaaugccacugacggugucacauccagcauucuggagugucagugguguccuccagccugguucugagucuggaaucuggcugggauccgggaugugccaagacuucuguauucucauauauuuucugagccugauuauauagccucuccagcaauuucgggaucuacuuuccauucuuugccuaauuucacuuuauacugcaguugagaaugccaucugaucuguaucccuauacaaaaaguuuagauauuauuccauuaaaaugaauuuauguuguaagaguuauuauguauauuuuucagcacuucaaguuuuaauuugcuuuuauauguauuauauugaguuaaugaauuuaguuaagucauuauaguacagugguuaauaguguggacuucggaaguaugccuggauucaaauucaggcucugcugcuuauuagcugauugaguuuuuaugguuauaaaauggggguaauagcaguaccuaccuccggacuugucaggaggaccaaaugcauacaugcacgcacaugcgcgcacauacacauaaagagcaguacuuggcaagguaguaaguuuugugucucaguauuagcaguuauuauuuugauucucauaucagcuuagaaguuuauauguuuguuuucugguugauguuaauauguuaaguucucaaacucccuucauguuagcaauaccauuucuuuuggugaaccucucuaguauguauuuuauagaagaaaguucacauugaucugagaucagagaucagauuuuguuaauugguauauuacugaauuaacucuguuauugacaguuacugggaucuguacaucaucugaguuuuuggcugauuugcuuagaaggaaaaguaauaacugacaccucagacuucagaaggagaaagguuuauuguuuucaaaagcaagacuacaauauuagcuucaauuaucuuuagguauuucuagaauaauuuaauauaccaugguacuuaaaaggaaacaaaaauguaucuaacuugauuaaauagauuuuuuaagccugaggagcaaaauuagacuauucacuggcugcccaagggaugaguaaaucagaacaguuagaagaaaugcagaacguaaaaacaaacccagagugaguauuuauguaaauaaugaacaguagcaucauugugucagagcuuugaaauucuuucccuaguugcuuauuugaguauuauuccuuuaagaauuauaacaauaugauggaaaaaccugagaaauuuccugacaauuuuacacauucugaucaugugauuaagacucagugaagcaguuuuugauucuuuccugguggauauggaaauuauuauccaucucugaagacucgucaaaacuuaccucaaaguuuuauuguagucaguuagcagucuauaaaaggaaagacacaauucacgcugaaaaugcugguaagacaggaagaaguuuaaaaauuacucucuaaauacuuuuccugucucauuuguugauccaggaacucugaucugugaaccuuacuuaugcaugaauguuuuuauaucuuaauuccuuuguuguuguuguuguuguuguuguuuugcucuuaagcucuuucuggucuaaguuuguuguacaauucugcccauggcucugaccuuuuacauguuaguuggugccagugucaucuguuuuggauaauaagcuccuugagggcaaugacucuuuuggcuugauuucuauaacacucuuugauggugaucauaaugacuaagugguuuguuccauugauuuaaaauauauccuugacuucugcuuagcauauucugagaauuaauaauauggcaacuguuucucaauagucauuuacuuuuaaauugccuauaucauauuaaaauaaaacaauagcuguuauuuguugaucauugccagaagugguuugagcacuuuaaauuuauuauuucauuuaauuuucaccacagcucacugaaauugguguuacuauuauucucacuucgcagaugagaaaacuaaggcuuaaagagguuaaguaacuugccuauuuuacaacuagaaauauuacagccaagaaacccaggugugucugauuucaaagagauugcuuucaaccacuguaucauaguuuucuuugagccccuauggacauuugcaagugauucuuuuaugucucugaagucuauauuuuaaauuuuuuuuauacacagcuuacagagaauuaccaugaaaaaugagcguuucacugauuugucuuuauuaagagcaaaaaauucuuuaaaaauuccucaaauaccuguuccacauaucuaacacugaaaaaccuguuguuucaauuuuuaaugcuauuuggacugugggagcaaacauuccugacgguugcugucagugcugauacauuuuuuauuuccaugauaauucuucuauagauauguguuacucuuucugaugugguguucacuaguuuuuaauaaauaggcuauauugugugugguuuuuuucauugagagaaugauggaguuaaaaauaaucacaauaauaauuuuaaaagaacaugcugacauuuagaucuacagacuuucuccucuaggcuauaaagucuuaaaaguaggucauacuuuggguuuaaacucugaacagauacuugcucucuauguuagcuuaccuuuugaucuuaaagcagcauuuauucuuaacuucaguaaauuuuaaauuguccuuccaaauuuggaaauucuguaugaaaugaaaaaucaccagucauuuaaaggagaaaauuaaagaaacaaguuuggcacuuuucuguucugucuccuugaagaauuggaacuuuucuuucuaucagugaucuaagcuagaaauaugagacaguuaaaaaaauacggaaguucaucuucacuugaauaaaauugagguuuggguagcguccuuaaauucucuauagguuaaccagaugaugguggaaaaagagaaugucuguagguuacauccugccucacugaguuagcauaaucgucaauucacuugcuucccaguacucuauucauuacaagaaaacugcugugggucuuuggaacuauuuuuccucagcucuaugaucacuacaaaccaaugaccuuuagccuuuucucuuuuauuucccuuauucacagcaugcuuuuuucccccugacacaauuucacucugucacccaggcuggagugcaguggcacgaucuuggcucacugcaacugcaacccaccccuucuggguucaaacgauucucaugccucagccuccugaguagcugggauuauaggccuaugccaccaugcccagcuaauuuuuaguagacaggguucugccauguuggcgaggcuggucuugaacuccugaccucaggugaucugcccaccucaaccuccccaagugcugggauuacaggcaugggccaccacaccuguccacauccuuuuuuuuuuuuuuuuuuuuuuuaagacagacucucccucugucacccaggcuggaguacaauggugugaucuuggcucacugcaaccucugccucauggguucaagugauuauccugccucagccucccgaguagcugggauuacagacaugugccacuacgcccugcuaauuuuuguauuuuuaguagagaugggguuucuccauguugaccaggcuggucuugaacgccugaccuuaggugaucuguuugccucggccucccaaagugcugggauuacaagcaugagucaccgcaccuggccucacaugcuuucuuauacuuagauuuucuccuccagccuauccuggccuaauacuuccuaguuccuguaaguauaaacauuaggcucauuucucugcuauagguacuggugacugaaacacuuacuuuugcauacugauuauuuuucuguaguagcauauuuuauauaccaacuauuuuagaaaggucaauucuguggccaaagagaguugauggguuugggguuguaauuaaauguuacuuuaaaaguuuuagauguagugacuuuaacaaauaauacaggauuugauuuacauacaccuauaggaauuuugaaaggaugauugcuauaagugugguaccuguuuacuuagaguggguauccuuuaacaguauaaacuuccuacacuuacgcaaguuuaacaaguguuucuucugagaucagcuaacuggugaugauucauuucacauuuuaguucucuuagcccucugauaccaucccucacccucacccauaauacccugucugcucuucugcucccuucuauauuaacucuauuuuuucuuuccaaaugcuuaguaaguuuguucuucccuuccuuucuucuuccaucucuucaucuucuuauugacugaagauaguaauuuaaauucuuuaaguuuggaaaauaagaauauuuauauuugacauuacauauuuuuaaaauguuuuuaauuuucauggguacauaguagguguauauuuauggacuacaugagauacuuugauacaggcauauaaugcguaauaaucacaucaggguaaaugggauauccaucaccucaaacauguauccuuucuucauguuacaaacaaaucaguuuggcaaaagcuccaaacuguucuacauagugguuguacugauuuacauucccaccaacaguauaugaguguucucuuuucuccacauccucaccagcauuuauuuccugucuuuuggauaaaagccauuuuaacuggagugagauaauuucacauugcaguuuugcauuucucugaugaucagugauguugaacaccuuuucaucuauuuguucucauuuguaugucuucuuuugagaaaugucuauucaaguauuuugcccauuuuaaaauuagauuauuaguuuuuuuccaauacaauuguuugcgcuccuuaccuauucugguuauuaaucccuugucagauggguaguuugcaaauauuuucucccauucuguggguugucucuucacuuuguugauuguuuucuuugcuuugcagaagauuuuuaccuucauaagaucucauuuaucuauuuuugcuuugauuaccuaugcuugugggguauugcaagaaaccuuugcccagaccaauguccuggagaguuucccuaguguuuucuuguaguaguuuuauaauuugagaucuuagacuuaagucuuuaauuuuuuauuugguuguuguauaugcggagagauggggucuaguuucauucuucuguauauggaugucuguuuuuuccagcaccauuuauugaagagacuauccuuucccaaguguauacucuuggcaccuuugucagaaaugaguucacuguagguguguggauuuauuuugggguucacuauuccacuucauuggucuaugugucuauuuuuaugccaguaccuugcuauuucgguuacuguaccuuuguaguguaauuugacaucagauaaugugauuucuccaguuuucuucuuuuuguuuaggauagcuuuggcuauucugaguuuuuugugguuccauauaaauuuuaguauaguuuuuuuuuuucuauuucugugaagaaugucauugguauuugauagggauugcauugaaucuguauauugcuuugaauaguaugggcauuuuaacaauauugauucuuccaauucaugaacauagaauaucuuuccauuuauuguugucuucuucaauuucuuucaucaguguuuuauaguuuucauuagaggaaucuuucacuucuuugguuaauuccuagguauuuaguuuuuauuuguagcucuuguaaaugaaauuacuuuguagauuucuuuuucagauuguuugaugguagcauauaguaaugcuacugacuuuuguauguugauuuuguaucuugcaaguuuacugaauuuguuuaucagcucuaauagguuuuugacggagucuuuagguuuuuccaaauauaagauuaugucaucugcaaacaaggauaauuugacuucuuccuuuccaauuuggauguuuuuuuauuuuuucacuugucuaauugcucuaguuagacuuccaguauuacauugaauaacaguggugaaagugaacauccuuguuguguucuagaucuuagaggaaaggcuuucaguuuucccccuaaucaguaugauacuagcugugggucugucuauauggcuuuuauuguguugagguguauuccuucuauacccaguuuuuuggaggguucauaucaugaggggauguugaauuuuaucaaaugcuuuuucagcaccaguugaaaugaucauauguuuuuuuguccuccauucuguugguaugaugugucacuuugauuugcauauguuaaacuauccuugcaucacugggauaaaucccacuuggucuugaugaaugaucuuuuuaguguguuguugaauucauuugcugguauuuucuggaggguuuuugcaucaacauucaucagugauauuggcccaucauuuucuucuuuucaugugucuuuguuuaguuuugguaucaggguaauauuagcauuguagaaugaguuuggaaguauucucuucucuauuauuuggaauuguuugaguaggauugguauuaguagcucuuuaaauguuugguagaauucagcagugaagccagcaggucccagacuuuucuuugcugggaaacuuuauuauggcuucauccuauuauuuguuauuguucuguucagauuugggauuucuucuugguacagucuugguaaggguuauguauuuaggaauuuauccauuucuucuagauuuuccaauuuauuauauaauugcucauaauagcugcuaaugauccuuugaauuucuguaguauugguuguaauagcuccuuuuuuauuucuaauuuuauuaauuugggucuucugucuuuuuuuguuaauuuuuuuguuaauuagucuggcuaaagguuggucaguuuuguuuaucuguuuaaaaaucaacuuuucauuucauugaucuuuuguauucuucauuucaguuuuauuuauuucugcucugaucuuuauuauuucuuuucuacuaguuuuggguuugguuugcucuugcuuuucuuguucuuuaagguguaccauuaggucauuuauuugaaguuuucuuuuuugauguaagugcuuauagcuauaaacguuccucuugguacugcuguugcuguaucccauaggauuuggcauguuauauuucugguaccauuuuuuuuuuucaagaaauuuuucaguuuccuucuuaaucccuucauugacucacugaucauucaguagcauguuauguuguuucauuucgauuuccaugcauuuguaucauuuccaaauuccccuuguuguugauuucuagguuuauuccauuguggucagagaagauguaugauauuauuucaauuuuugaauguuuuaagacuuguuuugugacuuaacuuauggucuauucaugagcuaacaaaaagcauaucuguucugcagccauuggacaaaauguucuguagauaccuguuagguccuuuuggucuauagugcagauuaagucagauguuucuuuauugaaaaucugucuggaagaucugaccagugcugaaagugggguuuugaaguuuccaacuauuauuguguuggguuucucucucuuuagcuccaguaauguuugcuauauacaucugggugcuccaauguugggugcauauauauuuauaauuguuauauccuccugcugaauugaccccuuuaucauuauguagugacuuucuuugucucuuacaguuuuuugucaugaaaucgauuuugucuguuauaaacauaucuauucuugcuccuuuuugguuucuauuggcauggaauaucuuuuuccauccuuuguuuucagucuaugugugucuuuguggaugaaguguguuucuuguaagcaacaggucauugggucuuguuuuuucauccauucagccaguuuguaucuuuugauuggagaguuuaguccauuuacauucaauauuauugauaaguaaggaauuacuccugccauuuuuaauuaaaaaaauuuuuuuuguggucuucucuuccuucuuuccuucuuucuuucuuuuagugaaggugauuuucucuggugauauguuuuaauuuuuugcuuuuuauuuuuuguguauccauuguauguuuuuugauuuaagguuaccaugaggcuugcaaauacugugacauuuauaacccauuauuuaaacugguggcaacuuaacacugaucucauaaauaaacuaaaaaacaaacaaagagaagaccaauaaacucuacaauuuaacuucaucccuccacuuuuuagcuuuuuguuuuuacuauuuauauuuuuuguaccaugucuugaagaauuguuuuuguuauuuuugaugggcucaucuuuugguacuuuucauaccacaauugcaguguuuuaauauuguauguuuuuuguguacuuacuauuaccaguaccuuuagaugauuuuguaccuuuugaugauuuguuuuuugccuauuaauauccuuuucuuuuaaauugaauaauccuuuagcauuucauguaggacaggucuaguguugaucaugaaauuccucagcguuguuugucuaggaauuucuuuauuuuucuuucauguuugaaggauauuuucacuguccauacuauucuaggguaaaaguguucuucuuucagcucuuuaaaugucaugccacucucuccuggccuguagaguuuccacugaaaagucugcugccaggcauauuggagcccugcuguauauuauuuauuucuuuucucuugcuccuuuuaggauccucucuuuauccgugaccuuugggaguuugauuauuaagugucuucugcucuuuuuuuagguuaaaucugcuuguuguuauauaaccuuuuuauacuugaauauugauauauuucucuuggguugagaaguucucuguaauuaccccuuugaauaaaguuuuuacucccaucucgauuauuuuuuaacuuccucuuuaaggccaauaacucuuagauuugcccuuuugaggcuguuuucuagaucuuauagguaugcuucauucuuuuuuauuccuuuuuuuccucugacugaauauuuucaaauagccugucuucaagcucacuaauucuuucuucuccuugaucagugcugcuguuaagagacccugaugcauucuuuagcaugucaguugcauuuuucaacugcagaauuucuauguaauuauuuuaaauuaucucaaucugauuguuaaauuuaugugauuuaauucugaauuccuucucuguguuaucuugaguuuauuugagauuccucaaaacagcuauuuugaauucuccaucugaaagguuacauaucucugucuccagcauuguucccuggugccuuacuuaguuuguuugguaaggcaauguuuuccugggugguuuugaugcuuggggauuuuuuuuggugacugggaauugaagaguuggguauuuauuguagucuuguaguuuuggcuuguuuuuacccaccauucuuaggaaggcuuuucaggcauuugaaggaacuuggguauuguuaucucuguuuuuggucacuguagucauauuuucauuagggggcaccccaaacccuguaaugugguggcucucgcacacucauagaaguaccaccuuggugaucuuggauaagaucugaaggaauucucuggauuaucaggcagagacuuguucucuuuccuuacucccaaacuuacuuuguuuguuucuccuaaacaagcaagagucucccugugcugagcugccugaaguuagaggaggaauggcacaagaugcuuguggccaccaccacugggacugugcuuggucagaccugaagccaguacagcauugaguguuuuacauggcagcaggcaagagagagagugugggggugcaggaaaaacuaccguuuauaaaaccaucagaucucaugagaaaucgcuaucaugagaacagcuugggggaaacuacccccauaauccaaucacuuuccucccucgacacuuggggauuacaauuugagaugagauuuggguguggacacagagccaagccauauuagguguuauaugguauuuuauuauuauuuuguaggcauguucuuuaucuguguugggaagaaaccuuacauagggugaggcucagccauuuuguauauguuaaaucuaauguaaagauaaugcagauaaacuugcaagguauuuuaauguauuuuacuuccaaauuaugggaugcuucaagauagccucugagcucuaugaaagcagagauuuuuaccuguuuuggcuggguucuaucuccaggucuaagcucuuggguucuguuccugaaagacaccauaccaugucuuucaggcuguuuuuaugccaaauauccuacuguuuucaucuaauuuuaugaagccaguccacuauaaagagugaugaucacuaugauuaucucgacauugacuugaacuacuuaauaacuuuuaaaaaauaguuuuauuuuccagagacagagaacuauucuuuuagugguaaucucuugguaguucaguuguuagaagucacuguaaaauaacaccaacaaacaugguuuuuaccaaucuugugccaucuggaauuuauggauaaaaauugugguuggggacauaucuuuggcuuuagauaaaacaacacugucaaguugaguacuucccacuucuuuguaguuuguuguucauaggauuuugaauuauggcuaaaauaaguuugucuucuuuaaggaaggaaaaguaaauugaguuuucaaaugugaagauuuauuccauuuauaaaaauguucauuuggagcaagaauuuucucuaccauuuuuuuacuuucgucucuuuuaacauucauugauccuauugaauuuugcuucuuauuaguuuaacacauuaauuuuucauuaauaacauugucaauggacucacugauuuucaaaaugaucuuuagaaauuguuuaggaaugacguaaagcuaaaaaguguuaauucugaaucauaagccacauaauggcaucuuucugugcccaacuuuguaaaaucaaaccaaaauaagauauuaaaaagggugcucuguguacacuagaaaagauucauguaggaaaaggugccuggacuaagauguauaaggcaggcagagaggagagaagaagguucucaaaguaaaggauagcuuagguaaagauauaaaguggaagauggaagucuuuccaagagauaaugaccauucagcugcaucuagaccaaaggauuuucacugggagaguaggaauuaagaccagaaauacagguugggaccagacuuuggaagaguaugaguaucauugugccuguuuuuauuuauuuacuuacuuauuuuccugaaggucuguacauauggaaguaacauguucaacaaaaaguuuuaggaauauuaauuuggugaggcauacaagauggugggaugagagcaaggggauugcuucuuccuuaauucggauuaucauaaaaauugagaugaagggagggggaagcaucaugggaagugggacuugugaucugggcaggucaguuaagcuuucugaucuuuuaugguuugccucuggacuauagaugugauacaaguaucuuuucugauugucucacuggguugucauaagcaugaaaaguuauaguacauauguaagcacuuuguaaacugugaagcucauauacauucacgauguuauuacuucuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgccaccacgcccggcuaauuuuuuguauuuuuaguagaggcgggguuucacuguguuagccaggauggucucgaucuccugaccucaugauccacccgccucugccucccaaagugcugggauuacaggcgugagccacugcgcccggccuauuacuucuuauuaucaucauuuauuggcagaucagggguuguagaacacuguuacuaguuacugaaagaaaguauugggccgggcgcaguggcucacaccuguaaucccagcacuuugggaggccaagguggguggaucacgaggucaggagauugagaccauccuggcuaacacagugaaaccccgucucuacuaaaaauacaaaaacaaaauuagcugggugugguggugggcgccuguagucccagcuacucaggaggcugagcggggaggauggugugaacccaggaggcagagcuugcaguuagccgagaucacgcuacugcacuccagccugggcgacagagugagaguccgucaaaaaaaagaaagagaaagaaaaagaaaguauuggauguaagagacagaugauaucaaggacuacuugguaaagagucagagaugaugcuuagugacugagaagaguauuguacauuaaugaaaaaauaggaagucaagacugggagaugcuuuggaaguaaaaauguaugcguuuagcucuaggaauauugguuggaggagauauaguacauguaaguggagauauucaguaucauuaacauaaaaggcuuugagagcaagguauggaauagaaugagauuuuaauuuagggauuauuugcaugguagguaauugaagcccuuugcauucuugagcucuuggggcaauggguauggaggggagagcagaugggaaaaccaugcauauauuugcuccuuuacauacucuccguccugugcucuggucccuguuuugaggaggaaaagaaacuguucuuuauaacuacuacccauccacccacuuguuuuuaaaauucugccuugaaaugcaacauuuccuucaacaaaacuuccuuucagaacuucaaucuacagaaugggcuucauuuuuuuuuuuuuuauacuuuaaguucugggauacaugugcagaaugugcagguuuguuacauaaguguacacaugccaugaugguuugcugcacucaucaacccgucgucuacauuagguauuucuccuaaugcuaucccuccccuagcccuccaucccccaacaagccccaguguaugauguuccccucccucuguccauguguucucauuguucagcucccacuuaucagugagaacaugcgguguuugguuuucuguuccuguguuacuuugcugagaaugaugguuuccagcuucauccauguccccgcaaaggacaugaacucauccuuuuuuauggcugcauaguauucugugauauauauaugugccacauuuucuuuauccaaucuaucauugaugggcauuugggcugguuccaagucuuugcuauugugaauagugcugcaauaaacguacaugugcaugugucuuuauaguagaaugauuuauaauccuuuggguaaauacccaguaaugggauugcugggucaaaugguauuuuugguucuagauccuugaggaauugccacccugucuuccacagugguugaacuaauuuacacucccaacaguguaaaaguguuccuauuucuccacauccucuccagcaucuguuguuuccuuuuuaaggaucaccauucugacuggcaugagaugguaucucacugugguuuugauuugcauuucgcuaaugaccagugaugaugagguuuuuuucauauguuuguuggccacaugaaugucuucuuuugagaagugucuguucauauccuuugcccacuuuuugaugggguuguuuguuuuuuucuuguaaauuuguuuaaguuccuuguagauucuggauauuagcccuuugucagauggauagauugcaaaaauuuucucccauucuguagauugccuguucacucugaugauguuucuuuugcugugcagaagcucuuuaguuuaauuaaaucccguuuaucaauuuuggcuuuugguguuuuagucaugaagucuuugcccaugccaauguccugaaugguauugcuuaaguuuucuucuggaguuuuuaugguuuuaggucuuacaagucuuuaauccaucuugggauaauuuuuguauaagguguaaagaaggaguccaguuucaguuuucugcauauggcuagccaguuuucccaacaccauuuauuacauagggaauccuuuccccauugcuuguuucugucaggcuugucaaagaucagaugguuguagauguguggcauuaucucugaggccucuguucagugccauuggucuauauaucuguuuugguaccagcaccaugcucuuuugguuacuguagucuuguaguguaguuugaagucagauagugugaugccuccagcuuuguucuuuuugcuuaggauugccuuggcuaugugggcucuuuuuuugguuccauaugaaauguaaaguaguuuucucuaauucugugaagaaagucaaugguagcuugauggggauagcauugaaucuauaaauuaccuugggcaguauggccauuuucacgacauugauucuuccuguccaugagcauggaauccuuuuccauuuguuuauguccucucuuauuucauugagcagugguuuguaguucuccuugaagagguccuucacaucccuuguaaguuggauuccuagguauuuuauucucuuugaagcaauugugaaugggaguucacucaugauuuggcucucuguuuguccuuuauugguguauaggaaugcuugugacuuuugcacaucaauuuuguauccugagacuuugcuaaaguugcuuaucagcuuaaggagauuuugggcugagaugaugggguuuuuuaaauauacaaucugucaucugcaaacagagacaauuugauuuccucucuuccuauuccaguacccuuuauuuaugucucuugccugauugcuguggccagaacuuccaauaauauguugaauaggaguggugggagggggcauccuugucuugugcugguuuucaaagggaaugcuuccagcuuuuucccguucagugugauacuggcugugaguuugucauaaauagcucuuauuauuuugagauacauuucaucaauaccuaguuucuugagaguuuuuagcaugaaaggguguugaauuuuguugaaggccuuuucugcaucuacugagauaaucauguguuuuuugucauugauucuguucgugugauggauuauuuuuauugauuuacauauguugaaccagccuugcaucccggggaugaagccgacuugaucaugguggauaagcuuuuugaugugcugcuggauucaguuugccaguauuuuauuaaggguuuuugcuuugauguucaucagggauuuggccugaaauuuucuuuuuuuguuguuucucugccagguuuugguaucaggauggugcuggccucauaaaaugaguuagggaggagucccucuuuuucuauuguuugggauaguuucagaagggaugguaccagcuccucuuuguaccucugguagaauucugcugugaauccaucugguccugggcuuuuuuugguuaguaggcuauuaauuacuaccucgauuucagaacuuguuauuggucuauucaggaauucgacuucuuccugguuuagucaugggaggguguauguguccaagaauuuggcuauuucuucuagauuuucuaguuuauuugcauagagguguuuauaguauucucugaugguaguuuguauuucugugggaucaguggugauauccccuuuaucauuuuuuauugcaucuauuugauucuugucucuuuucuucuuuauuagucuagcuaguggucugucuauuuuguuaauguuuuuaaaaaaccggcuccuggauucauugauuuuuuucuugaaggguuuuucaugucucuaucuccuucaguuuugcucugaucuuaguuauuucuggucuucugguagcuuuugaguuuguuugcucuugcuucucuaguucuuuuaauugugacguuagggugucgauuuuagauguuucccgcuuucucuugugggcauuuagugcuauaaauuuuccucuaaaugcugcuuuaguugugucccagagauucuuguauguugagucuuuguuuucauugguuucaaagaacuuauuuauuucugcuuucauuucauuauucacccaguagucauucaggcacaguuuguucaguuaccauguaguugcaugguuuugagugauuuucuuaauccugaguucuaauuugauugcacugugguuugagagacuguuugucaugauuucuguucuuuugcauuugcugaggaguguuuuacuccaguuauguggucaauuuuagaauaagugcgauggggugcugagaagaauguauguucuguugaucugguguggagaguucuguagaugucuauuaggucugcuugguccagagcugaguugaaguccuggauauccuuguuaauuuucugucucauugaucuguguaauacugauagugggguguuaaugucucccacuguuauugugugagagucuaagucucuuuguaggucucuaagaacuugcuuuaugaaucugggugcuccuguauugggcacauacauauuuaggauaguuagcucuucuuguugcauugaucaaucccuuuaccauuauguaauggccuucuuugucucuuuugaucuuuguugguuuaaagucuguuuuaucagagacuaggauugcagccccugcuuuuuuuggcuuuccauuugcuugguaaauauuucuccaucccuuuaucuugagccugugugugucuuugcacgugaaauggguuuccugaauacagcacacugaugggucuugacuauuuauccaauuugccagucugugucuuuuaauuggggcauuagccuguuuacauuuaagguuaauauuguuaugugugaauuugauccugucauuaugaugcuagcuaguuauuuugcccguuaauugauacaguuucuucaugguuuugauggucuuuacaauuugguauguuuuugcaguggcugguacugguuuuuccuuucuguauuuauucuuccuucaggaucucuuguaaggcaggcugguggugacagaaucucucagcuuuugcuugucuguaaaggauuuuauuucuccuucgcuuaugaagcuuaguuuggcugguuaugaaauucuggguuggaaauucuuuaagaauguugaauauuggccccuacuuucuuuuggcuuguaguguuucugcagagagaugcgcuguuagucugaugggcuuccuucuguggguaacccaaccuuucuucucuugcugcccuuaauauuuuugccuucauuucaaccuuggugaaucuaacgauuauguguguugggguugcucuucuggaggacuaucuuuguucucuguauuuccugaaugugaaugauggccucucuugccaggaugggaaaguucuccuggauaacauccugaagagugucuuccaauuugguuccauucuccccaucacuuucagguacacccgucaaacgcagauuugguuuuuucauauagucccauauuucuuggaggcuuuauucauuucuuuucauucuuuuuucucuaaucuuguuuucacgcuuuauuucauuaaguugauuuucaaucucugauauccuuucuucugcuugaucuauucagcuauuuauacuuguguaugcuucacgaaguucuugugcuguguuuuucagcuccaucagaucauuuauguucuucucuaaacuaguuauucuuguuagcaauuccucuaaccuuuuuucaagguucuuaguuuccuugcauuggguuagaacaugcucguuuagcucagaggaguucauuacuacccaccuucugaagccuacuuuugucaacuugucaaacuuauucuccauccaguucuguucccuugcuggcgaggaguugugauccuuuagaagagaagagacguucugguuuuuggaauuuucagccuuuuugcccugguuuuuuuuucaucugugaggauuuaucuaccuuuggucuuugaugcugaugcccuuuggaugggguuuuuguguggacauccuuuuuguugauguugaugcucuuccugucuguuuguuaguuuuccuuugaauagucaggccccucuucugcaggucugcuggaguuugcuggagguccacuccagacccuguuugccuggguaucaccagcggaggcugcaaaacagcaaagauugcugccuguuccuuccucuggaagcuucguccuggggaggggcacuugccagaugccagcuggagcucuccuguaugaggugucugucgaccccuccugggaggugucucccagucaggagacacgggggucagggacccacuugaggaggcagucugucccuuagcagagcucaagcgcugugcugggagauccacugcucucuucagagcuggcaggcaggaacuuuuaagucugcugaagcugcgcccacagcugccucuucccucaggugcucugucccagggagauggcacguuuaucuuauaagccccugacuggggcugcugccuuucuuucagagaugcccugcccagagaggagaaaucuagagaggcagacuggcuacagcugcuuugcugagcuguggugggcucugcccaguucgaacuucccaguggcuuuguuaaaacugugaggggaaaaccgccuccucaagccucaauaauggaggaugccucucccgcaacaaagcuggaguguccuaggucaacuucagacugcugugcuggcagugagaauuucaagccagcggaucuuagcucacugaucuccaugugggugggaaaauuucaagccaguggaucuuagcuugcugaguuccaugggggcgggaucugcugagcuagaccacuuugcucccuggcuucagcccccuuucccagggagugaacgguucugucucgcuggcauuccaggugccaccaggguaugaaaagaaacuccugcagcuagcuuggugucugcccaaauggccgcccaguuuugugcuugaaacuuagggcccugguguuguaggcaucugagggaaucuucuggucuguguguugugaagacugugggaaaagcauaguaucugggcuggaguguaccauuccucacagcagggucccucaugguuucccuuggccaggggagguaguuuccugaucccuugugcuucccgggugagaugacacccugcuccugcucgcccucgugggcuguacccacugucuaaccagucccaaugagauaagccagguaccccaguuggaaaugcagaaaucacccaccuucugcauugaucucucugggagcugcagaccugagcuauuccuauucagccaccuugccagccaccccgggcuucauuuuuauagaggcauaguauuaaaagagugaacuugcuacuuacuaugaauuucaaaaggguaaugagagggucuuuuaucucuggauaguucccucuccacuucauuuguacaugaugauuuggagagucuggcacuaaacuugucuugauuaugaaaaagguugagaaccauucagccgaugucacccugggcaucagauguauauuggaguucaaaucccuuagucuuugucacugaaucaggaccaucugguaggauuguacaaguugugcccugucauuaagacccuugauaaucugacuccaguaagucuucucugccuuaccuucuacauuucuauauucuaaccaaacaagucuguauaauguuuccagaacauaccguguacuuuccuuccuccauacuuuugacuccuacauaauaaaaaauacacguuuaacuuuugacucgcagaaauuaaccucuaguaaccuauuguuaaccagaugccuuaccaauaaauaaagucaauuaucacauaauuuguauguaauauguacugucuucuuacaguaaaguaagcuaaagaaguaaaguaaguaaaguaaaguaagcuaaauguuacugucauuaagaaaauaauaaggaagaaaaaacauauuaauuaaguggaaguggaucacuauaaaggucuucuuccucaucaucuucacauuuaguagguugaggaggaggaagaggagagaaguuggucuugcugucucggggguagcauaggcagggcaaagucugcauauaaguagacgcugcaguucaaaccugugcuguucaaaggucagcuguagaugcuaguuaaaaaagacacauauucacaaaagauaccuuuuuaguggaaauuccuuuauugacaacccucuagucauauauaauucugagaaacagcagcaugaguauuaggcuaccaagcaauugguugucuuuucuaaacauaguaugcaguuucccacuccuugccuuagaaaauaauguucccucugccuagaauaugcguugccucuuuccuugccuggcaaccuucuaguuaucuuucaaaaccccccuuaaauaucaucaccucuguaaggacauuccuguccccuaggcagaauuagucacuuccuccucccaaucugccugugugaaagcccauauaguacuccuguacuccauugugagguccccuaaauaggugccaucuguuuagccccagcuucagaagugcuaggugcuccaaccguuaagagaaugaaugaguuaaugaauaauacagaaaccccaaaauggucaaaaguccagauuuuugacaagaaugaugggcuaacauccuucccuuaccuaaccauuugccaguugugguuucuguuuuguauuauuuuaauacaaaauuaaacauuugaaguuuuauuuucaauguuugucuuccuagguccuacuagaagaccauuuaauuaaagggagggccugaagaaggggucuaggcaguuugcauuugggcuaauuaaucccugaucuccauacuagaagguucucuuuaguacuaaucauauuuucuaucuguaggaguagucucaauaaucuguacacaauucauucuauuguuuucccuucaaccagucuuagaaaaugauuugcaagaauguuauuauuuccuuuauucagggaaaaagaaaacauguucuaauuccccaguggcauauacuauauacagauuuuaagguagauacuucuacagucagaaaauagauuaauacuuccuagcaacauacugcaaugaaguaguagcaaugacauuuuuguuuuaacuucuuuguuauuaacuauggaagucauaauuugauacagauuuuuauuuaauuccauguuuuugauauucuugaaaauaguauuuuuaauuucaguuuccaauagauuuuguuccuguuuuucuauuuuuuuuauuucuacuguuuguuauugucuuccuucuuauuugcucauugucuucuaauuucuuaaaguggaagcauaggaauuuuauuugaaauaucuuuuugaauauauacauuaaaugccuuaaauucuucucuaaacacugcuuugugucuuagcucaggcugccauaacaaaauacuuuagacuggguagauaacagauauuuauuuuucacaguucuggagacugggaaguucaagauccaggugcccccagauuugguuccuaguagaggcccgcuucuagcuugcagagggcuuccugucugcauccucaugugacugaaagagauggaguggaguagggagggacaggcucugucuuccucuucuuauauggacacuaauuccaucauagcggcccauccucauaaacucaucuaaaccuaauuaccuccaaaaggccucaccuccaaugcuaaaacauuggguguuagaacuucaacauaugaauuuuggguggcacaagcauucaguucauaacaccuuccaaaaguuugauauuuuauguuuauguuuucagugaguaaauauuuaugucaaaauauuuucuacuuuugugauuuauuuuugaacuauggaauauuuagaaguguguaguauaauuuccaaauauuuuggguuucuaauauuaaucuguugauuguuaauuaaucuguuaauugauagaaaucaauugcuaauugaguucuauuuuaaucccauuguagucuggaauauaauuccuaugauuuuaaacuuuuaaauuuauaaugauuuguuuuuugauccagaauauaguuuaucucaauaaauauuucauuuauacuuagcaagaauauguauucuguuuggggauagaguauucuauaaauaucaauuaggucaaguugguugauaguguugaucaugucagccuauaucuauugauuuuaugucuuacuuauuuuaucaauuacugagagaggaauauugaaaucucaucuauaguuguggaugugucuauuucuccuuucaguuuuuuuuuuuucuguauuuuaagucucucuuauuggguacauacacauuuagcauuauauuuuuuugcugaauugacccuuucaucauuauguuacauacccugacuccugguaacauuucuuauucuuuagagccucuacuuugucugauauauagcuucugcagguuacuuuugauuuguauuugccugguaaaucuuuuucuguucuuuuauuuuuaggcugaucuucaguaaguuuuuuauagaugucugugguugacucuugcuuuuuaaaaucucauauaacaacuuuugcuuuuuaauugaagcauguagaucugugcugucccauauaugugacuacaguuggcccaacauauauucagguucugcaucagcagauucaaccaaccacagauugaaaauauucagaaaaaauuauaauacaacaauaaaagaaggccaacaaauuuaaaaauacaguguaacaaccauuuauguagcauuuacauuguauuaggauuauaaauaaucuggagaugauuuaaaguguauaguaggauguacauaguuuucaugcaaauacuacaccauuuuauauaugggacuugugcauccucagauuuuguuauccacaggaaguccuguagccaauccccacagauagcaagggacaacuguauuuaaauguaacuuaguuaaaauuaaaauuuaauuucuuaaucacaguagccguuuuuaaugaucucaauauauguggcagguggcuacaacauuggacaguauggcucuagaacauaggaggguuuacugccccuugucuugauggcagcugaaugcugcuuugugucuguagggggucuugggucagagcaaacgcuuucuuuuucucugugaagggauaggguauaggagggcuuccugacccuaugucaguggcagauaguuuuagcccuauaucgaaauguaguaucuggccuguggcccugggccaaagcagugccugccaccaguggauagugugaaggacugccuagacagagccaauuuaucaagacagaggaauugcaauggagaaagaguaauucaugcagagccagcugugugggagacuggaguuuuauuauuacucaaauuagucucuucaagcauucggggaucagaguuuuuaaacauaagauagauauaaguggggagugcugauuggucagguuggagauagaaucauagaggauggaagugagguuuucuuguugucuuauguuccuggguaggaucacagaacugguugagccagauaaccagucugggucguguuagcugauccaucaagugcagggucugcaaaauaucucaagcaccgaucuuagguuuugcaauagugauguuauucauaguaauuaauagugauuuuauccccaggagcaauuuggggagguucagacucuugcagccagagguugcaugacccuuaaacuguaauuucuaaucuuguaacuaauuuguuaguacugcaaaggcagaaugguccccaggcaagaagggcucuuuucuggaaaaggcuauuaucuauuuuguuucagagucaaaccauaaacugaauuccuucccaagauuaguucacgcccaugaaugagcaaggacaacuuaaagguuagaagcaagaagucaguuaggucugaucucuuucacugccauaauuuccucgguuauaauuuuugcaaaggugguuucauuaggaacaaagugcacuuaugaauagccuuucagaacaugacauacugguaaacagcaaagcuucaguguuuucccuuuaaaacucaggugaacaggagaguuuaagagaagauucugagcuuguggaaguagcacaguuuuacagauaagaaaauguuuuccaggauaaagguaaauacuaaauacuucaaggaguuuuuuuuuuagauuucaacuuaagaaagacugauuuguguucauccccaaaacacauuugucugcccaaaggggaaaacgaccugaccuaccuuaauuaaaauggguucagugcaucccugugcuuguauuuaaugauuuacuaauaagugaguuacaacaucuuuuuuacuucagauuaagacaguuuguuucgucauguuaccuuaaggcagucucuuuccuccaucagccuguuguugcaauguggaaaugagggguguuagaucuuuuuguuuauuaggaaaagcuggaaaucccuaauuuuuugaaugccuguaaauuguuguaaauuccucuucauuucuuccaccgucucucuuacucaaauuaaaaauaaaugauccuaaguauaguugggaguguuaaaaaagauaaaugaaaauacaauuuuauuucuuguuuuucucugacaguuacuacuugguuaaugauuguuuuuaugguuuuaguugaaagggcuacgucaguaggaucaucaaaucugagagguuuuuaacaaggaaaaaguguuauuaaaauacugagacuaugaauuacaguguaaucuucuugaaggcagagauuauguuuuacaucuguucccacaagcacagcacaaugccagggacccagaaagcaaccaauaaacauuugcuucaaauugauuuucucaagugaguaaauuggaacuccugcuuuuuugaaacaauacaguccucauaauaaacaaaauauuuauacucauuuuuuguuauuaugagggcacuuucuuuaacaaagugauuuuaaaaagggaaaaugguuuuaguuuuguaauagagcauuacaaaaguuaaaguugcauuauacugacugcgguuuugacuuuugagccaaaaaugcaaauuuaaaccaguuaacuccagaacauaguacucggagaaaaggcaaaggauuauuugauuucuguaauacauauuuuaccaagauuuuaaacugugcuuuauuuucuguuuucuacucgacuaucccaguaauaugauuuccuugcuuccuugcucuggcucuuaaguccgaccugaaaaaaagcccacaguuuugcaggguagugccauuccagauuuaugauuuuuauuuucuuuugggccuuccuggccuuggcagucucuuuuuuucuauguccaguuaauucuugucauucaucucauuggguguuuucaaacuuccccaacucuucucugguuuacguuacaacccccauuuccuacucaauuaucuccucucauuuacuuggaaaaauagggacaauaggccggacuucugguagacuuugugcccuuguauguaucucugugcgcauacugcuguggucucucagccuccuucccugcagucgccaaggaagaggucuuucucuuguaguuccccacuaauccuuccaccugcgugccugauuauguccuuccugcuuccuuugagcccuaauucuaucaguuacucccuuuccuguauuuuuauccuuuucaucccuacuggcuccuagaaaauaugcucaaguuucugcuuuuuauuuauuuuauuuaacaaaagcuuucuccaacucuaacuuuuuuuauugccagguuucuacccagaguagacuauauuugcaacauccacuucacaaauuagcuggaacugcccauaccaaagccaccgacugcaauuuaaauugcugucuuaccuacuccuccauuaaugacacagcucaagcccucaccuagaacacugcagauguuucuugacucauccucccugucuucagucuuccuuuuuccaauucaucuuucccaccacugcagggugaucuuuuaaaauacucuuaugacaauauuacuccucuguccuuaaaucccuucaaaaaaucaacauuacccacaaguugaaaaauuaaacuccauagaagggcauaugaagccacuaaugguuugaucucuggcucuccaguuuuaucugcuccuggucuguuauugaguccuaccuauagauccaaaaguaaggugcuauuucacacuucuaagacuuuucuauucaguguccucuaguggaguaguauuuccuuguaucccuagagaucuccuccuuaacuuucaaagacugugauccagcauccucaccaggcuuuaccugacuucuuuucccaucuucuauuccuucugaaccuauuaauauuauacuaccaugauaaaguugaccuuuucuugguguuuuuacuauacaguuuauggauauugccauuuuuuuguacaauuuauuguagauauuuguuuugaauguuugccucccuuucuagacagaucucauuguuggguaaggagccauuuaaccgaucuugacaucugccacaccuggcauagugccuugcacauaacaagggcuccuaaauguuuguagaaugagugaauuuuagcaaauauuaauugguuguucuucuauaagaucagcauuauacuuuuaaauuuagauaauaaguuuuggauuggauguguuuaguaucacugaacuuagugcuggaugcugugucauacaguuucaaggcaaucuaaagaauagggaagauaaauuuguagcuagugacuuaauaagauggucuguacgaauauguaggucuuuuguucauauugucaaguguaccagcucauccaugcauuccuuuuuuagucaaauuguacuaaacagagaaaagauuuccugagauguaugauccuuuuucuccuuggcuucuaaucuaucuuuccuucauugccauauagcugccagaggacuucauauacaaugaaaaucugaugauuuacuuuucucuuuauaccucuucaguucuucuuuccauucaccuauauucucaucacuuugucuccuacuuuaccaaauuugaagucuuguuauugaguagacuucuuuugagaguuuguggucacuuacagaacugcucugcauccccuuuguaccugcagcugauaacacucacuauucccuacuccaagcauguggguucaacaggauaaacauaacagcacauugguaauguuuauguuaaauaagccagucuuguccaagcaucugcugcacaggcgcagaaacagauaaguuguuucagcaauuggcugccaggggaacagaaggguugccacaacaaagucagcaaacaacccccaaaagucucuaagaagugugaacucaugcugcuggaaaauaaaaaucagucaaaaauuuguacauuuugaugcuugaccuugacuuuguuucucacaucccuauguagagauaggacuauuuucugcagcaauuggguuaucuuuagaugaguacauuucagauucacucagcuuuugaaggaaaguguauuugaaaucucccuguucucuggaaaguugcuuugucguauaguuggauuguacucccuuuggaagcuuugucuuuuugacugacuuugauaaggucagcuccaaggaaacccagcauccucuuuucccuggcgccacugggcccgccacccucuccucugcuuccucacccucccuuccuuaccaccucucuauccgucacuugaacuggcugccagcguucacagacagcuggggagagaguggcuaaaucugcccagcugcccgggaagcuuggcagccaggcugagggaaggaagcaucggcucucuuugaaggucggcugccagugaaucucaggcagcuggacuucaaaggggggcaccgccgggcuuucccucccgucuaggcaggucauuccacggcgcugugcuuccgguguuggcaugguggcuuuccucuucaauuaaaagcugaauugggaucugcacuuguguucacacuuguguuucuuaugugacauagacagccuaagauccccaacuccuguuaccccagacuuaggaguuaaagauaaagaagaaaaggugauaucauauaaagggcaacuaaggagaucuacagcagcgaguguguuuuccuuauugccaguuaguaacugugcuauuugccaaguuuuaaauuacuuuagggacucuuggugugaucuugaauaaaggccaaucagcuugugcuuauggacucaguuuagcuauggccugagauugggucuagcaacggaugauaauuuuaucuguuuucagaaacugugguagugcuaauagaacccacuauucuacaccuaacucuugcuuuacuucccuacuuuucacauucagauuccguuggugguuggugacaggacuggccuagcaagggaagaacaagggugcugcacaaacagagucuaggcucacuuuaguugcaaaugagggucagagcagagguagccugaaaucagaggaaccaugaguacuauguaccauguauaguggucguuaagugugcagauccugggacacacugcuuggguucaaauccuggcucugccccuuacuggucacaugucuaggguaacuaaccuuaccuuucugcaccccauacucucccuggaaaguggggauaauaauaguacuuaucucuuaggacaguugagaagauucaaaggguuauuagauuccaugcacuuaggacaauaucuagcccauagugaguguccaauacauguuuuugcuauuacuauguaccagcccccaugacuggaucuagagggagguaacaagugacugguaggugauuuuuauugccucuucguggaugaaacacuacuagcuucugccuuagauugaauuuauacuagacuuuuuugagaaaucuaaaauaaugcaaaaagaaugcauuauauaauuugaaggagaaaaaaaguuauuuuaugcuguccaucucacuccuugcacugucaucccuggggauacaaggaggugucauucacugagggccauucauuucacucagccucaguuuucuuguuuguaaaaugagauaauaauuacacauaccccaggaggcuuucuuuuaaugaugaaauuggaaaauguauguuuuacugcacugaauagcaacauguucaguaacuguagcuguugcuguuauuaucaucauuauuauuauuuccaccaccauuaauguugccauuuaaaauucuuacugaaucacaggaggccuuuaacuuagcuaacagugauuugacaaauagaggucuuuuuccuaagguuuuaguuuuuuccagauaaaagugagcuaauugugggccaaauucagccuguccucuuuuuuauaaauaaaguuuugcuggauugcauagccuuauccauuuguuuauguauuagcuauggcugcuuucaugcuacaacaggagaagugaacaguugcaacagagucuguaugguccucaaagccuaaaauauguauuauaagccccuuucuagaaaaaguuugcuagaccuugcucuagguauauguuucuccagugagguccagagaauguuaguucaauccaugcuagucuguacgaucugaaaaaaaaaaaaaaaaaaaaaaaaaaagguucuauagucaaauaagcuuuagaaauguuaaggagguugauuuauucuaggacuacuacuuaaaagacuuuggcuuuuaauauacucauguuuauugugaaucuucaagacaaggccauggugugcaaauaaacucuaguuucgcaggcuuacuuggcuguaguccccuaauaugaugauguuacaaaaacaaacaaagcaaaacaaaacaaaacaaaaaacaauucucuaggaacccuugcucuugggcuuucucucuggaaggacuuucuuucuaaaucauuccucuuggugauuuaggugauauccucauuuggagaccuacagaauaucauaugaaauucuguguuaguuguaucauuuuuuucccaguaaaaauuauauuuugcuuagcaucagaacaguaaaauauaccagauauuuaagucaucuaaucagauaauaucugccuuuuugaaugauucuguaugaugucugaagauuauaaauuagagucucaaaguccaagaaagacaggauguuucauuucaugccuucuugaaauucuaaaagcaugggucuucuguaggacuuaaaauguuuuuuugcauucagauuucugaagcauaaauuuagagugccuaagugauauaccaacuggucucaacuaggguuuauaagaagagagauuaaugugaagguaacuugugcauuagccauaagggguuuguuuuauagacuaaaguaaacaccuucaauuucaaguugcaagcacacagggagccagaagauuccagagcgguggcaucauauucugccugugacucacacaucuaagugguugagcuuucucccgcagcugcagcuuccagcuggucaucaguuagaguccuagguagucacacacuguggucaccugguuugagaugaccaaacaggcauauaauuacaacauaggccaguuaugaaugaaggcuggguuaucucuuugccaaacacagauaaaaaauaaaugcuaagucauagcuguuuucugaaaucccagugguugcaauagugaaccuggacugaaaguagagaacccuccuggaagauuccacccugguuguaaaugcacacucucuuucucauuugugagcuuccucauuaauggcauagagcauucuuagccauuuuggugcccuccaaaaugccugguuuauaguuggugcaauaaauguuuuaugaaagaauaugaggucauacauguuuucccccuuucccaacuugcaaauuauuucaagaaaauucuguauuuucuuuuuauuuauauaucucaguguuguguguauaacagguucucaguaaauguuguugacauuguaaauguagauuccaaaaacuuccuuauuucacuuuuacauuauggggaugcugaauggacuuuucagaaaucuuugucagaucccacugucuuuuguuuuuaaauuauuucuuuaaaagaaaggaaggaaggagagagggaagggggaaaacaucuugaccuggaacauaauuaucuuuuuuuuaaaaaaaaaaaaacauuuuguuuucuuuagagucaggggucuugcucuguagcccaggcuggagugcaguggugcaguaauggcucacuacagccucaaacuccuggacugaagcuauccuccugggcaaugagugaggcagucccagauucuccucuuaccaccuguguugucagaccacugcugguaccacuuguguuagucuggguccucugagaagcagacaccaagacaggauuaaauguguaagagauuuacuggggaguaccuagaagggaaauuggggagggagccagagaagucuggagagagucagaccaugauguagaccaugcguuugugaaggagagaggaaagaauggaauauugaauauccaucagcugaugaauggauaaauaaaaugugguacauccauacagugaaauauuauuuggcaauaaaaagaaaugaagugcugauacauacugcaacauggacgaaccucaaaaacauuacgcuaaaugaaagaagcugucacaaaaggcagcauguuuuaugauuucauuuguaugaaguguucaguuuaggcaaaucuacacagaaacuaaauuagugguugcuuaggacugaaauauuaagaaaaaaaagggagugauugugauugcucauguguaugggguuuccuuuugggguagugcgagguucuaaaauugauuguacugguggcugcgcaacucuuggaauauacugaaaacguugaacuacauaguuuaagugagcaaagugcaugguaugugaauugugucucaauaaaaaucuuauaucaaaagaaaagaaaaaaagggggaguauaugcugaaaggaucuuggacuacugcacgaugcuaagaaaguuuuggccaagcuaacuggaauuccauuuauccuccacacucaggccuugcaaagcauacucagugacagaggcagcgagagugucagucauuuaugcuuuucacgaugggaggugugagaggcuacauuucucauaagccaaagcaagucgcguguccauaccaagauacaaaguauagagaaacagaugccacaucuugauaaaaagaacagcaaaauuauauuguaaaggggugugccacauuuucaguaacucauuaaauuuucccagcagcuuaugaaguggguacuauuacuauucucauuuaauaguugaagaaacaggcauaggaagauuagcccaagaucauauagaugugaccuuggaaucacaaguaauugugacuacuuguaaguggaagagccaagauuugaucucagcagucuggcucuauagucugugcucuucaucauuauaccauacuuucauauaguauauuaauuugaaugucacaaaaucuauuagagauauuuuguuauccauuuucccucacugaaaugaaaccuucacggaauggggucuuuauuuuguucacugcuauaucgccaguggcugggacaauauuuggcauguaaauauuaguugaauuuauauggauuugcaaagcaccuuuauaugacaguucuauacuuguauccgcauuguccuuccuacaggucucuaaaaucagagaaacaggagaaaguuauauucagucuagaccuggauuuauuuuauuuuuuaaaucuuggcauauuggaguacuuuaaauccugguauaguaaguaacccuaacaugugauugaaaacauagaauuauuggaauuguuugguuaccacuaagcuugaaaacagauucccaaugaggagaaaaaacaauucuauugagaggucauagggauagguaugagaggacagucaaauguugguacacccaguuuguuagguagccuagcguuuggcucaucuuauuauuggaauuuguguuuugcagcauaguugcauuuuaggaccuuucugagaagagguacgcaugauagacuuaauaaaccuguaguauugacauaagacagggaaauagcagauuaacuguaacucagucuuuuugugagugggggagaagggcaggggugggagguugcaaggcauauuauuuuaaagauuaauaaacugaaaacuggaaaagucuagcagcuuggccaggaucaaacuuaaauguaguaagcuaaaauuuuaggucaaguaguccuagcccuaggacuaguaaucuuucuauuaauauuuucucuauuuucagacaguaauucauuuaaauucuuaccuuugaaauaguuuuuuccacuguuucuauuucuuaugagaggcauuuugaccauuuugaagacugucuuucuccugcauugauagauacacuagaguaauaggcagacauugguaucuaggcagcuacuggauauaaacugacugacuuuugguaccacuguaaaauguuaagauuauugacaauuuccagagguggcauauuuagggcuuuguggaacaggcgugguggcucacaccuguaaucacaauacuuugcugguuuuuugggggggacuuuuccuguagggaaaaagagaucagacuguuacugugucuauguagaaaaggaagacauaagaaauuccauuuugaucuguauuugaacaauuguuuugccuugagaugcuauuaaucuguaacuuuagccccaacccugugcucacagaaacaugugcuguauggaaucaagguuuaagggaucuagggcugugcaggaugugccuuguuaacaauauguuuacaggcaguaugcuugguaaaagucauugccauucuccauucucaauuaaccagggucacagugcacgguggaaagccgcagggaccucugcccaagaaagccuggguacuguccaagguuuccccccacugagacagccugagauauggccucgugggaagggaaagaccugacugucccccagccugacacccgugaagcgucugugcugaggaggauuaguaaaagaggaaguccucuugugguugagauaagaggaaggccuccgucuccugcaugucccugggaacgaaugucuagguguaaaacccgcucguacauucguucuguucugagauaggagaaaaccacccuguggcuggaggcgagauaugcuggcggcaauguugcucuguuacucuuugcuacacugagauguuuggguggagagaaacauaaaucuggccuaugugcacauccaggcauaguaccuucccuugaacuuauuugugacacagauuccuuugcucacauauuuuccugcugaccuucuccccacucuuagccuguucuccugccacauuccccuugccaagauagugaaaauagcaaucaguaaauacugaggaaacucagagaccagugccggugcagguccuccauaugcugagcgcuggucuccugggcccacuguucuugcucuguacuuugucucugugucuuauuucuuuucucagucucucgucccaccugaugggaaauacccacagguguggaggggcaggccaccccuucaucuucugacuuuuacuucagguucagggcuacaugugcagguuuguuauauagguaaacuuguaucauggaggcggggggguuuguuguacagauuauuuuuucacccagguauuaagccuaguaccuauuaguuguuuuuccugauccucucucuccucccacccuccacccucccauaggccccaguguguguuguucccgucugcguguccauguguucucaucauuuagcucccacuuauaagugagaacaugcaguauuugguuuucuguuccuguguuaguuugcuaagcauaauggccuccaucuccauccauguuccugcaaaagaugugaucucauucuucuuuaagcuuuuguaguauuccaugguguguauguaccacaguuucuuuauccagucuacuauugaugagcuuuuaggcuuauuccaugucuuugcuauugugaacaguguugcagugaacauauauaugcauguguuuuuauaauagaaccaugucuauuccuuugggcauauacccaguaaugggauugcugggucaaauggugguucuguuuuuagcccuuugaagaaucagccacugcuuuccacagugguugaacuaauuuacacucccaccaacaguguauaagcauuccuuuuucucugcaacuucaugagcgccugcuauuuuuugacuuuucuuaccccccccccacccuuuuuuuuucuuuccaacuuuuauuugaaguucagggguacaugugcaggaugugcagguuuguuacauagguaaauaugugccaugguuauuggcugcacagaucaucccaacacacagauacuaaguccaguguucauuagcuauucuucccgauucucucccuucacccaugcccccuaacaacaggccccaguguguguuguuucccccuccccauguguccauguguucucaucauuuagcucccacuugugagaacaugcaguauuugguuuucuguuccugcguuaguuugcuaaggauaauggccuccaccuccauccauguccuugcaaaaggacauuaucuucuucauuuuuauggcuacacaguauuccaugguguguauguaccacguuuucuuuauccagucuaucauugaugggcauuuagguugauuccaugucuuuguuauugugaauagugcuggaaugagcauaugcaugcaugugucuuuauaauagaaugauuaauauuccuuuagauauguacacaguaaugggauugaugggucaaaugguauuucuuccuguaagucuucgaggaauugccacacugucuuccacaaugguugaacuaauuuccauuuucuuuuuuuuuauuuuauuauuauuauacuuuaaguuuuacaugugcacaaugugcagguuaguuacauauguauacaugugccaugcuggugugcugcacccauuaacucgucauuuagcauuagguauaucuccuaaugcuauucccccgccuuccccaaccccacaacaguccccagagugugauguuccccuuccuguguccauguguucucauuguucaauucccaccuaugagugagaacaugcgguguuucauuuuuuguccuugugauaguuuacugagaaugaugauuuccaauuucauccaugucccuacaaaggacaugaccucacccuuuuuuauggcugcauaguauuccaugguguauaugugccacauuuucuuaauccagucuaucaucguuggacguuuggguugguuccaagucuuugcuauugugaauagucccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucucuacauccucuccagcaccuguuguuuccugacuuuuuaaugauugccauucuaacuggugugagaugguaucucauugugguuuugauuugcauuucucugauggcuagugaugaugagcauuuuuucauguguuuuuuggcugcauaaaugucuucuuuugagaagugucuguucauguccuucgcccacuuuuugaugcgguuguuuguuuucuucuuguaaauuuguuugaguucauuguagauucuggauauuagcccuuugucagaggaguagguugugaaaauuuucucccauuuuguagguugccuguucacucugaugguaguuucuuuugcugugcagaagcucuuuaguuuaauuagaucccauuugucaauuuuugcuuuuguugccauugcuuuugguguuuuagacaugaaguccuuacccaugccuauguccugaaugguaaugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcaccauuucuuaaguagggaauccuuuccccauugcuuguuuuucucagguuugucaaagaucagauaguuguagauaugcagcauuauuucugagggcucuguucuguuccauugaucuauaucucuguuuugguaccaguaccaugcuguuuugguuacuguagccuuguacuauaguuugaagucagguagcgugaugccuccagcuuuguucuuuuggcuucggauugccuuggcgaugcgaguucuguuuugauuccauaugaacuucaaaguaguuuuuuccaauucugugaagaaagucauugguagcuugauggggauggcauugaaucuauaaauuaccuugggcaguauggccauuuucacgauauuuauucuuccuacccaugagcauggaauguucuuccauuuguuuguauccucguuuauuucauggagcagugguuuguaguucuccuugaagagguccuucacgucccuuguaaguuggauuccuagguauuuuauucucuuugaagcaauugugaaugggaguucacucaugauuuggcucucuguuugucuguuauugguguauaagaaugcuugugauuuuuguacauugauuuuguauccugagacuuugcugaaguugcgcaucagcuuaaggagauuuugggcugagacaaugggguuuucuaaauauacaaucaugucaucugcaaacagggacaauuugacauccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuuguccauucaggaugauauuggcuguggguuugucauagauagcucuuauuauuuugaaauacgucccauaaauaccuaauuucuugagaguuuuuagcaugaaggguguugaauuuugucaaaggccuuuucugcaucuauugagauaaucaugugguuuuugucuuugguucuguuuauaugcuggauuacauuuauugauuugcguauauugaaccagccuugcaucccagggaugaagcccacuugaucaucguggauaagcuuuuugaugugcugcuggauucgguuugccaguauuuuauugaggauuuuugcaucaauguucaucaaggauauuggucuaaaauucucuuuuuugguugugucucugccaggcuuugguaucaggaugaugcuggccucauaaaaugaguuagggaggauucccucuuuuucuauugauuggaauaguuucagaaggaaugguacccguuccuccuucuaccucugguagaauuuggcugugaauccaucuggucuuggacucuuuuugguugguaagcuauugauuauugcaacaauuucagauccuguuauuggucuauugagagauucagcuucuuccugguuuagucuugggaggguguaugugucgaggaauuuauccauuucuucuagauuuucuaguuuauuugcauagagguguuuguaguauucucugaugguaguucauauuucugugggaucgguggugauauccccuuuauuauuuuuuauugcaucuauuugauucuucucucuuuucuucuuuauuagucuugcuaguggucuaucaauuuuguugauccuuucaaaaaaucagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugacauuagggugucaauuuuggaucuuuccugcuuucucuugugggcauuuagugcuauaaauuucccucuccauacugcuuugaaugugucccagagauuccgguauguugucucuuuguucucauugguuucaaagaacaucuuuauuucugccuucguuucguuauguacccaguagucauucaggagcagguuguucaguuuccauguaguugagcgguugugagugaguuucuuaauccugaguucuaguuugauugcacuguggucugagagacaguuuguuauaauuucuauucuuuuacauuugcugaggagagcuuuacuuccaacuauguggucaauuuuggaauaggugugggguggugcugaaaaaaaauguguauucuuuugauuugggguggaaauucuguagaugucuauuaggucugcuuggugcagagcugaguucaauuccuggguauccuuguuaacuuucugucucgaucugucuaauguugacagugggguguuaaagucucccauuauuauugugugggagucuaaaucucuuuguaggucacucaggacuugcuuuaugaaucugggugcuccuguauugggugcauauauauuuaggauaguagcucuucuuguugaauugaucccuuuaccauuauguaauggccuucuuugucucuuuugaucuuuguugguuuaaugucuguuuuaucagagacuaggauugcaaccccugccuuuuuuuguuuuccauuugcuugguagaucuuccuccauccuuuuauuuugagccuauaugugucucugcacgugagauggguuuccugaauacagcacacugaugggucuugacucuuuauccaauuugccagucugugucuuuuaauuggagcauuuagcccauuuacauuuaaaguuaauauuguuaugugugaauuugauccugucaucaugauguuagcugguuauuuugcucguuaguugaugcaauuucuuccuggucuugauggucuuuacaauuuggcaugauuuuacaguggcugguaccaguuguucuuuuccauguuuagugcuuccuucaggagcucuuuuagggcaggccugguggugacaaaaucugucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugccgagagauccgcuguuagucugaugggcuucccuuuguggguaacccaaccuuucucucuggcugcccuuaacauuuuuuccuucauuucaacauuggugaaucugacaauuaugugucuuggaguugcucuucucgaggaguauuuuuguggcauucucuguauuuccugaaucugaauguuagccugccuugcuagauuggggaaauucuccuggauaauauccugcagaguguuuuccaacuugguuccauucuccccgucacuuucagguacaccaaucagacguagauuuggucuuuucacauagucccauauuucuuggaggcuuuguucguuucuuuuuauucuuuuuucucuaaacuucccuucucgcuucauuucauucauuucaucuuccaucacugauacccuuucuuccaguugaucacaucagcuccugaggcuucugcauucuucacguaguucucgagccuuggcuuucagcuccaucagcuccuuuaagcacuucucuguauugguuauucuaguuauacauucgucuaaauuuuuuucaaaguuuuuaacuucuuugccuuugguuugaauuuccuccuguagcucguaguaguuugaucgucugaagccuucuucucucaacucgucagugucauucuccguccagcuuuguuccauugcuggugaggaacugcauuccuuuggaggaggagaggcacccugcuuuuuagaguuuccaguuuuucugcucuguuuuuuccccaucuuuaugguuuuaucuacuuuuggucuuugaugauggugauguacagauggguuuugguguggauguccuuucuguuuguuaguuuuccuucuaacagacagaacccucagcugcaggucuguuggaguuugcuagagguccacaccagacccuguuugccuggguaucagcagugguggcugcagaacagcggauuuucgugaaccgcgaaugcugcuaucugaucguuccucuggaaguuuugucucagaggaguacccggccgugugaggugucagucugccccuacuggggggugccucccaguuaggcugcuugggggucagggaucaggcacccacuugaggaggcagucugcccguucucagaucuccagcugcgugcugggagaaccacuggucucuucagagcugucagaccgggacauuuaagucugcagagcuuacuccugucuuuuuguuugucugugcccugcccccagagguggaggcugcagaggcaggcaggccuccuugagcuguggugggcuccacccaguuggagcuucccggcugcuuuguuuaccuaagcaagccugggcaauggcgggcgccccucccccagccucacugccaccuugcaguuugaucucacacugcgacuaauuuccauuuucaccaacaauguaaaagcauuucuuuuucuccacaaccuugccagcaucggcuguuuuuugacuuuuuaauuauagccauucugacugaugacacaugguaucucauugugguuuugauuugcauuugucuaaccaucagugauguugagcuuuuuuuuuuuucauauguuuauuggcugcauguaugucuucuuuugagagguuucuguucauguccuuugcauacuuuuuaauggcauuguuuuuuucuugaaaauuuguuuaaguuucuuauagaugcuagauauuagauguuugucagaugcauagauuguaaaacauuucucccauuuuguagguugucuguuuacucuguugauaguuucuguugcagugcaggagcucuuuaguuuaauuagaucccauuugucaauuuuugcuucugucgcgauugcuuuuggcauguucaucaugaaaucuuugccugugccuauauccugaaucauguugccuagguuuucuucuaggauuuuuauaguuuuggguuuuacauuuaagucuucaauccaucuuguguugauuuuuguacaugguguaaggaacagguccaguuucaguuuucugcauauggcuagccaguucuccuagcgcuauuuauuaaauagggaauucuuuacccauugcuuguuuuugucaaguuuguugaagaucagaugguuguaggaguguggccuuauuucuagguucucuauucuguuccauuggucuacgugucuguucuuguaccaguacgaugcuauuuugguuacuguuacccuguaguauagugugaguuggguagugugaugcauccagcuuuguucuuuuugcuuaggauugccuuggcuauucaugcucuuuuuugguuccauaugaguaguuuuaaauggcuuuaaauaauguuaaaauagaaauaguuuuaaaauaguuuuuucuacuucugagaagaauaucauuaguaguuugauaggaauagcauugaaucuguaaauugcuuugggcaguauggccauuuucuugauacugacucuuccuauccaugagcauggaauguuuuuccauuuguuugugucauuucugauuucuuugagcaguuuuuuuuuguaguuuucauuguagagaucuuucaccucacugguuagcuguauuucuagguauuugauucuuuuuguggauauugugaaugggauugcaucuuggcuuggcuguuuuuuguguauaggaaugcuagugauuuuuguauguugguuuuguauccugaggcuuugcugaaguuguuuauuagguuaaggagcuuuugggcugagacugugagguuuucuagauauagaaucauguugucugcaaacagggauaaauugacuucuucucuuccuauuuggaugcccguuauuucuuucucuugccugauuccucuggccaggacuuccaauacuauguugaauaggaguaaugagaaauggcauucuuguccuguuucugguuucaagaucaaugcauccaguuuucacccauucauuaugauguuggcuguggguuugucauagauggcucuuauuauuuugagguauguuucuuuaauaccuaguuuauuaagaguuuuuaacaugaagggauguugaauuuuaucaaaagccuuuuuugcaucuauugagauaaucaugugguuuuguguuuaguucuguuuaugucaugaauaacauuuauugauuugcauuugguaaaucaaccuggcaucuaggggaugaggccugcuugauugugguggauaagcuuuuugauauacuccugguuucgguuuaccaauauuuuguuguggauuuuugcauugauguucaucaaggauauuggccugaaguuuucuuuuuuuuguugugucugugccagauuuuggugucaagaugaugcuggccucauacaaugaguuaaggaagagucccuccuccucaauuguuuuugaguauguuuaguaggaaugguacuaacucuucuuguacaucuggaaaaauucagcugugaauccuucugguccugggcuugguuugucugguaggcuauuuauuacugguuuauuucagagcuuguuauuggucuguuuagggauucaauuucuuccugguuuagucuugguagguuguauguguccaggaauuuauccauuucuucuagauuuucuaguuuuuuugcauggaaguauucauaauauucucugaggguucuuuguauuucuguggagucagugauaauaaccccuuuguuguuucuaauuguauuuauuugggucuuagcucuuuucuucuuuauuagucuagcuaguggucuauuaauuuuuuucaaaaaaccaacucuuagauucauugaucuuuugaaugguuuuuuugugugccucaaucuccuucuuuucagcaccgauuuugguuauuuuuugucuuuugcuagcuuugggguugcuuugcuuuugcuucucuaguucuuuuaguuguaauguuagguuguuaaguugagaucuuucuaacuaacuuuuuaauguggguguuuagcgcuauaaauuuccuucuuaacacugccuuagcugugucccagagauucugguauguuguaucucguuaguuucaaagaacuucuugauuucugccuuaauauuauuauuuauccaaaagucauucaugaacagauuauucaguuuccauauaauuguauggcuuuuugagugguuuucuuggucuugauuccuaauuuuauucagugguccaagagaguggugguuaugauuucaguuauuuugcuuuugcugaggaguguucuauauccaauuacguggucaauuuuggaguaugugccauguggugaugagaagaauguauguucuguuguuuuggguggagaguucuguaguacugucagugaguuguugaagucuuccauuacuaauaugugggaguccaagucucuuugaaggucucuaagaacuugcuuugugaaucugggugccccuguguugggugcauauguauuuaggauagcuaggucuucuuguugaaauaaaccuguuacuguuauguaauguacuuccuugucuuuuuugaucuuuguuguuuuaaaauccauuuugucugaaauuaggauugcaacuccugcuuuuuucuguuuuccauuugcuugguagauuuuucuccaucccuuuaucuugaaccuguggcugucaugagucucuugaagacaacauacgauuuggucuugguucuuuauccagcuugccacucugugccuuuuaauuggggcauuuugccuguuuacauucaagguuaguauuuacauucaagauuaguaucaaaguuaggauuugauccugucaucaugauguuagcuggccauuaugcagacuuguuugugugguugcuuuacagugucaguggucuuuguacuuaaguguguuuuuguaguggcuguuaauggucuuuccuuuccauauuuaguacuucuucaggacugcuuauaaggcagggcuggugguaaugaauucccucaguauuugcuuguuugaaaaggaucuuauuucuccuucacuaaugaggccuaguuuggcuggauaugaaauucuggguuggaauuucuuuucucuaagaauguugaauauuggcucccagucucuucuggcuuguaggguuucugcugagagguccacucuuaguuuaaugggcuucccuuuguaggugaccugauuuuucucucuagcugccuuuaacauuuuuuauuuaauuucaaccuuggagaaucugauuauuauguaucuuggaaugaucuucucaugaaguaucuuacugggggucucugcauuuccugaaugugaauguuggccucucuagcuaguuuggcaaaguucucauggaugauauccugaaauauguuuuccaaguuguuuccauucuccccaucucuuucagggacgccaauuagucguagauuuggucucuuuacauaaucucguauuucucagugguuuuagaugcuccuuuucauucuuuuuucucuauucuugccugacuggcuuauuucagaaagccagucuucaagcucugagauucuuucuucauuuuggucuauucugcuauuaauacuugugauuacauuaugaaauucuuguaguauuuugucugucaguuccuguaucauuuuguugugauucuuaguuuauuuggauuggauuucaguguauuucugcaccucagugaucuuuguuccuaucuauauucugaauucuauuucugucauuucagccgucucagccugguucagaauccuugcuggaaagauaguucagucguuuggaggaaagaaggcacucuggcuuuuugaguugucagaguucuugcacuggaucuuucucauuuuugugggcugauguuccuucagucuuugaaguugcuguccuugggauuucuuuuucuuuuauccuauuugaugacuugaggauuugauuuugguguaauguggguucagucaacuagcuucauuucuggaagauuauagggggcuaaggcuccgcucccacucccgacucccggacugcaugcucuaacucuggggaacuuguaucacaaccugauuuuguuuucuggcuccuugagauuaggaacccauugugcuggggugggggcugagaugcccccagacuucugaucauuacacuuggauggguggugucagcaaaagcauuuuguagggugguggcagcaggauccauccuuguucacaugugcuaacagcaacaguagcagcagugcagggggcuggaggggugaaagguugcaugcucacuggcugcagugcuagcagguacuggggugccugccucugcacaggcauucccagcagcaguggaggaagcagagcucaggggcaugagggcccacacugguguguauguggucaugcugguggugguauuagcaugggguuaggaagcuggcaagcacaggucugugugugcccucugugcauguucaugcagccagggguuggcugcucaggguuggggaggguccaguguucuccaucucuauuuucacucuggcagcaguguuggcacugggauggggugcugguggggguggggcugaugggcucugugcccaccaaggcacugacugcaauggugguauagugggggugaggagguggugugcgcucuuaccaguaacaguguuaggacagguaacaggcaaacacugguugggcagggaaggcaaaauccacucauguagacacacaccagcagagugauguaggugguugccgugggccugggggaagcugcagugaggggagggagugggcaggcuggugcauggccacagggggcugccccacuggagcucuccacuggucaggcauggucugccaguguaggagcuaugauauaggcccccaggguugccgaggcugcacugcaagcagaccuagccaggcugggacccuggaagaggccagcugacuuagggguacucaggucagaccagccccaucugaugggcaagacugccccuacaguguucaugucaaacaguuucccuacagccaaagucuucuacggaagcaagucaauccuagggguaugggcaucccugcuggugcucuaccacagaugcucccacaccaaacucuauuggcuggcacgcugccccuacuacuuuucugagcagcucucccugccaacuaaguguccauggugguugaagggucucuuccuccugggauucuaaaggcccguggcgagaguggguugcuccuugcuauuucacuucaccugcuccccaggagucacugggggccagaaaugaguccagugugcucuaaccccacacaaguucccagcuuccucccccuucagcccagcuucugugucuucugucuacucgcagugucuucccucugaagaucugcuaggagcgugccagucauccugguuccuugguggcagcuguuccacccggcugcauguagucagcugucuugcccaaaucucccccaacacugugaagccuaggcgggaagaucgcuugagcccaggaguucaugaccagcugggcgacaaagugagaccaccccccgccccagcucuacaaaauaaaaguauaaaaaccagccaggcaugguggcuuguguuguagucacaguacuugggaggcugaggcaggaagauugcuugagccugggagguugaggcuggagugagccaugauuaugucacugcacuccaaccugggugacagaaggacacccugucucacaaagggaaaaaaaaaagacuuuauggaagacagaguuuucuguugauaauuugucagacugucagagaagaaaaacuagauuuagucagcauagccacagaagacaaccaggacccaugaguaguuguuagaagugagucuuggacccagcuuaaaaaguuguugccaguuagagccuaggcgggaagaucgcuugagcccaggaguucaugaccagcugggcaacaaacugagaccaccacccccggcucuacaaaauaaaaguauaaaaaccagccaggcgugguggcuugugccuguagucccaguacuugggaggcugaggcaggaggauugcuccagaaauugacugauauuccuuauaauguaaugcauuuugaauuuccagaggcuccaugaccaucugcugagaaaagagguauacagacaauuuuuccaauugggaguuuguauugugugaucccagacagggccuucaaaacucugggauuuugugcuugcguuuuccaucuuggugaauauuugagucuugauauucuccaaaucauaguguaaggcacaccuaagaauaagaggccuacgagauugugccauugcacuccagccuaggcaacaagagcaaaacucugucucaaaauaauaauaauaauaauaauaauaauaauaauaagccuauauaagguaguuaauuaucaaucucagcuuccuaaagaacgauauucuuugcuuaggaugauuauaacagcaguuaaaggacaaguugcaguuuuagauucccgacauuaugccugaaguguucuucaguuagguugacauuguuuucaaagugugaggauauuugucauaauggacuguccaaguguugauguuugaugcaaauuuuaggucaccuuugucucuuuuuccucauuggaauauacuuuuguuucugguuaaggugaaguuaauaauugaagagcacuuuuugauauaaaauuugggaggucuucaucucaaucaacuaaagacauugugccucuuuguuuuauuagguccuuuaaaagacaaaaugaauuaauuuugagugcaucucucccucuccugugggaucuuaauuauuaauauccagccauuuauuacuuuaaagagguguugcaauggaauauguuggaggucagaaagacuggauggggcuuguuuuguagcauauauucacucauucugcauuauaaauaaugaauucuaaaaguuucaaaacauuacaccuccaauauaauguuccuuuaaagggaauccuaaaugaggagacauaaacacguagcagaugaauauuuggugaagucuccucauacuacagcaagacaaaaucaccuguagucaaaaucccauauucucauuccguucauuauauuguaucuacacuaucaccuguuagaucuagcagaauuuuuuuuuuuuuuaauuucagaaacagauuacuuuuucuuuacuugagcacuggaaggcuauaugucuuucuaccuuagaaucccacucaggguagugaaaagcacagggaaggaagaccaauuuagggagcaucagauucacaauaccaucucuuuucuucuccagagcaacaaguuaagacugucauauggaacugucugcaugcucugggcucacacugaaguuugugugaugugaauccacuggacucuauaacuuuuaagguucuuuaucucacuuuguuuacugguauauauaugcauacacaucuauaugcauguguuuacuuauauuuucaaauaucgacauucaagauuuuaucuuauuaauaaaguauauauugaucaguuaauugaaugauaaaguauuaugcauuugccuguuuugccuuuucccuaagggucauagagcuguaaaugacccuggaaaucauuuacuucaaucucuuuauuuuacagaagacagaagugugaaccagacaagcuaaguaauuugucccaggucacaaugcuagcuuuugcuugaacugaaucuagauuuugugccuccugguuccuggcccagugcccuuuuuacuguacuaaacugucuuaucacucaugaaaugauaggucuuucuucuauuuggauaucuauacguauugcuuaacauuaaaaacaaacaaaacuuuuaaaacaaacaaauaaaaaacuaaauucauuuaggccaaaugaaguacaggacuuuuggguaaacugcuaccacuguuuauaagaucuuccaaaaguuucauuuagaguuuaguaguugguaacuugaugggauauaaggaaguggcaaauuuuccuuauugagguugguagcagaguuucguuuguccuaggaacagaauauucccagucuguucacauguguucagaaugaucauuuaaaaauaagcaaauuuagguuuccaagauggccaaauaggaacagcucuggucugcagcucccagugugaucgacgcagaagauaagugauuucugcauuuccagcugaggcaccugguucaucucauugggacugguuggacagugggugcagcccauggagggggcaagccaaagcagagcggggcaucgccucaccugggaagcgcaaggggucgggggaauucccuuuccuagccgagggaagccgugacagacuguaccuggaaaaaugagacacugcugcccaaauacugcacuuuucccaaggucuuagcaaccggcagauaaguagauucucuccugugccuggcucggcgggucccacacccacacagccuugcucacugcuagcgcagcagucugagaucgaacuucaaggcggcagccuggcugggggaggggcguccgccauugcugaggcuugaguagguaaacaaagcagcuaggaagcuugaacuggguggagcccacugcagcuaagcaaggccuacugccucuaugcacuccaccucugugggcagggcauagcugaacaaaaggcagcagacaacuucugcagacuuaaaugucccuguugagagcucugaagagagcagugguucucccagcauggcguuugagcucugagaacggacagacugccuccucaaguugguuccuaaccccuguguagccuaacugggagacaccucccaguaggggccgacagacaccucauauaggugggugacccucugggacgaagcuuccagaggaaggaucaggcugcaauauuugcuguucugcaauauuugcuguucugcagccucugcuggugauacucaggcaaacagggucuggaguggaccuccagcaaacuccaacagaccugcagcugagggaccugacuguuaaaaggaaaacuaacaaacagaaaggaauagcaucaacauaaacaaaaaggacaucuacaccaaaaccccaucuguaggucaccaacaucaaagaccaaagguagauaaaaccacaaagaugaggagaaaccagagcagaaaagcugaaaauucuaaaaaccagagugccucuucuccuccaaagaucgcagcuccucgccagcaauggaacaaagcuggacagagaaugacuuugacgagcugacagaaguaggcuucagaaggucgguaauaacaaacuucuccgagcuaaaggaacauguuugaacccaucgcaaggaagcuaaaaaccucgaaaaaagguuagacgaauggcuaacuagaauaaacaguguagagaagaccuuaaaugacgugauggagcugaaaaccauggcacgagaaguucaugacucaugcacaagcuucaauagucaauucaaucaaguggaagaaaggguaucagugauagaagaucgcauuaaugaaauaaagugagaagacaagguuagagaaaaaagaguaaaaagaaaugaacaaauccuccaagaaauaugggacuaugugaaaagaccaaaucuauguuugauugguguaccugaaagugauggggagaauggaaccaaguuggaaaacugucuucaggauauuauccagaacuuccccaaccuagcaaggcaggccaacauucaaauucaggaaauacagagaacaucacaaagauacuccucgagaagagcaaccccaagacacauaauugucagauucaccaagcuugaaaugaaggaaaaaauguuaagggcagcaagaaagaaagaucggguuaaccacaaagggaagcccaucagacuaacaguggaucucucagcagaaacucuacaagccagaagagagugggggccaauauucaacauucuuaaagaaaagaauuuucaacccagaauuucauauccagccaaacuaagcuucauaagcggaggagaacuaaaauccuuuacagacaagcaaaugcugagagguuuugucagcaccaggccugccuuaaaagaccuccugaaggaaguacuaaacaugaaaagaaauaaccaguaccagccauugcaaaaacaugccaaauuguaaagaccaucgaugcuaugaagaaacugcaucaauuaauggacagaauaaccagcuaacaucauaaugacaggaucaauaaugacaggaccaaauucacacauaacauuauuaacguuaaagguaaaugggcuaaaugccccaauuaaaagacacagacuggcaaauuggauaaagagugaagacccaucagugugcuguauucaggagacccaucucacaugaagagacacacauaggcucaaaauaaagggauggagggggaucuaccaagcaaauggaaaacaaaaaaaagcggggguugcaauccuagucuccgauaaaacagacuuuaaaccagcaaagaucaaaagauacaaagccauugcauaaugguaaagagaucaauucaagaagagcuaacuauccuaaauuauaugcacccaauacaggagcacccagauucauaaagcaaguccuuagagaccuacagauacuuagacucccacacauuaauaaugggagacuuuaacaccccacugucaauguuagaucaaugagacagaagguuaacaaggauauccaggacuugaacucagcucugcaccaagcggaccuaguagacauguacagaacucuccaucccgaaucaacagaguauacauucuucucagcaccacaucaaacuuauuccaaaauugaccacauaguuggaaauaaagcacuccucagcaaauguaaaagaacagaaaucacaacaaacugucucucagacuacagugcaaucaaauuagaacucaggauuaagaaacucacucaaaacugcacaaguacauggaaacugaacaaccugcuccugaaugacuacuggguaaauaaugaaaugaaggcagaaauaaagauguucuuugaaccaaugagaacaaagacacaacguaccagaaucucugggucacauuuaaagcaguguguaaagggaaauuuauagcacuaaaugcccacaagagaaagcaggaaagaucuaaaauugacacccuaacaucacaauuaaaagaacuagaaaagcaaaagcuuuucaaaagcuagcagaaggcaagaaauaacuaagaucagagcagaacugaaggaaauagagacacaaaaaacccuucaaaaacacaaugaauccaggagcugguuuuuugaaaagaucaacaaaauugauagaccacuagcaagacuaacaaagaagaaaagagagaagaaucaaauagacacaauaaaaaaugauaaaggggauaucaccaccgaucccacagaaauacaaacuaccaucaaagaauacuauaaacaccucugcacaaauaaaauagaaaaucuagaagaaauggauaaauuccuggacacauacaccaccccccaccccucgcaagacuaaaugaggaauaaguugauuuucugaacagaccaauaacaggcucugaaauugaggcaauaauuaauagccuaccaaccguaaaaagugcaggaccagauggauucacagcugaauuuuaccagagauacaaagaggagcugguaccauuccuucuggaacuauuacaaucaauggaaaaagagggaauccucccuaacucauuuuaugaggccagcaucauccuaauaccaaaggcuggcagagacacaacaaaaaaagaauuuuagaccaauauuccugaugaacguugaugcaaaaauccucaguaaaauacuggcaaacugaauccagcagcacaucaaaaagcuuauccaccaugaucaagucagcuucauccuugggaugcaaggauaguuuaacauacguaaaucaauaaauguaaucccucacauaaacagaaccaaugaaaaacaccacgugauuaucucaauagaugcagaaaaggucuucaacaaaauucagcagcccuucaugagaaaaccucucaauaaacucgguauugauggaacaugucucaaauuaauaagagcuauuuaugacaaauccauagccaauaucauacugaaugggcaaaaacuggaagcauucccuuugaaaaccagcacaagacaaggaugcccucucucaccaccccuauucaauauaguauuggaaguucugggccagggcaaucaggcaagagaaagaaauaaagguauucaguuaggaaaagaggaagucagauugucccuauuugcagaugacaugauuguauauuuagaaaaccccauugucucaucccaaaaucuccuuaagcugauaagcaacuucagcaaacucucgggauacaaaauccaugugaaaaaaucacaagcauuccuauacaccaauaacagacaaacagccaaaucaugagugaacucccauucacaauugcuacaaagagaauaaaauaccugggaauccaacuuacaagggaugugaaugaccuguucaaggagaacuacaaaccacugcucaacaaaauaaaaggacacaaacaaauagaagaacauuccaugcucauggauaggaagaaucaauaucaugaaaauggccauacugcccaagguaauuuauagauucaaugccauccccaucaaguuaccaaugacuuucuucacagaauuggaaaaaacuacuuuaaaguucauauggaaccaaaaaagagcccgcauugccaacacaauccuaagcaaaaagaacaaagcuggaggcaucaugcuaccugacuucaaacuauaguacaagguuacaguaaccaaaacagcaugguacugguaccaaaacagauauauagaccaauggaacagaacagaggccucagaaauaacacaucuacaaccaucugaucuuugacaaaccugacaaaaacaagaaauggggaaaagauucccuauuuaauaaauggugcugggaaaacuggcuagccaucuguagaaagcugaaacuggaucccuuccuuacaccuuauacaaaaauuaauucaagauggauuaaagacuuaaauguuagaccuaaaaccauaaaaacccuagaagaaaaccuaggcaauaucauucaggacauaggcaugggcaaggacuucaugacuaaaacaccaaaagcaauggcaacagaagccaaaauagacaauguaucuaauuaaacuaaagagcuucugcacagcaaaagaaacuaccaucagagugaacaggcaaccuacaaaaugggagaaaauuuuugcuaucuaccuaucugacgaagggcugauauccagaaucuacaaagaacucaaacaaauuuacaagacaaaaauaaccccaucaaaagagcaguggauaugaacagacacuccucaaaagaagacauuuaugcagcaaucagacacaugaaaaaaugcucaucgucacugauuaucagagaaaugcaaaucaaaaccacagugagauaccaucucacaccaguuagaauggcgaucauuaaaaagucaggaaacaacagaugcuggagaggauguggagaaauaggaacacuuuugcacuguuggugagaguuuaaauuaguuuaaccauugugguagacaguguggcgauuccucaagggccuagaacuagaaauaccauuugacccagccaucccauuacuggguauauacccaaaggaucagauauuaugcuccuauagagacacgugcucacguauguuaauugcggcacuauucacaauagcaaagacuuggaaccaauccaaauguccaucaaugguagacuggauuaagaaaauguggcacauauacaccauggaauacuaugcagccauaaaaaaggaugaguucaugucuuucagggacauggaugaaguuggaaaccaucauucucagcaaacuaugacaaggacagaaaaccaaacacugcauguucucacucauaggugggaaucgaacaaugagaacauguagacacagggcggggaacaucacacacuggggccuguuggggggugugggacugggggagggauagcauuaggagaaauaccuaauguaaaugaugaguugaugggugcagcaaaccaccauggcacauguauaccuauguaucaaaccugcauauugugcacauguacccuauaacuuaaaguauaauaauaauaauaauaauaauaaagcaaguuuagucaugcuacuccucugccuaaacuccuuuagcaacucccuuuugccuucaggauaaaaucuaagcuccuuaacaugguauauuggucuguucucccauugcuagaaagaaauacuugaggcugcauaaucuauaaagaaaagagguuuauuuggcucaugguucugcaggcuauacaggaagcaugaugcuggcaucugguuggcuuguggggaugccucaggaaacuuacagucuugguagaaggcaaagggggagugagauaucucacauggcaggagcaggaguaagagaagggggagggaggugccacacacuuaaaucucaugagaacucacccacuaucaugaggacaguaccaaagggacuggugcuaaaccauucauaagaagccaccucugugaucuagucaccucccaccaagucccaccuccaacauugugaauuagaauuugacaugagauuuggguggggacacagauccaaaccauaucccauggcuuauacagccuugauaucuggggccuguucauaucauuuccccaccaugccuuugguuucucacauuuccuauagguaagaagucuggcacagcguggcuggauucucuucucaggguuucaccaggcuaaaaucagaguauugccuugguaugugcucaggguccucuuucaagcucauugguuguuggcaggacucagaucccuguuuccuugacauguggcccccuucaucuuuaagucgauagugacaugugaaacacuucucauaucucaaauuucucugaguuccucuucccucacauuucugugacuuucuugucggcacuguagcucaugcaacugcuucagccccaccugcaauccaagauaaucucccuauuuuaaggucagcugacuaguaaccauaauuacaccugccaaguuccuuugaccauauaagguauucauggacaucacacuagggggcagaggucacaaggauaaaaauucggcuuaccacagugcaguacccucugacugaaauacucuuucuugcccucaccuccugcuccugcaacugcuaacuucuacuuuaucuguuaggucucugauuuauuuuugccccucuuuucucccucauugucaaguuuggguuaggaccuucucagugcucacguauuacucuguauuuccccauuguagcacuugucgcucugugugcugaucuguauccuuucuggggacugccaagucuuuuagaagcuauguuuaucugggcacauuuguguuuucucugcuuaacugagugucugccauacauacaguugauauccaauaaaaaaaccguugaaucaaugaauucuuuguauccaugaaagauggaagcaugauaacuaauauaaaauuccaagacuguuacccagaggaagaacugagaagccaguuuucacucaauauauacagauuauuauuauuauuuaaaugaacuggccugcuuuuguaaggugguguacucauuacuggauuuuuuuagguguaagcccagggauugggugucagggauauuauuuggagggcaaaguacaugagcucuguuuugugacucauucuucauaaggguugcuacaagagcaauggagaugagcucacuugcauuaccauaccuguggcucccaggagggacucacaugcugucauuaccagcagugccccugucuuucgcuauggaauuacccuaggaaaguugguaauggcccagaaccauuguguaauuagccagcauggcauguguguguggguacacagguacacacacacgcgcgugcacacacaccuauuauagagguuacucuauuaaugacagcuauguaggggagaaaguuuuuaauggaccaaaugucuuuguucauauagaccacacuuuuugagguaauugacuuccuaguaccuugugccaguuacugagucauaacugaguggcaagauugguguagaauuacaagucuuuaacuguguagaagcaacauuagaagcaaaaauacuauuaagauaaaucaguaagagaaggauuauaaugaaguauuuaagaauagucuuuuugguuucaaacccccagcucuacuacuuacuaacuguguggccuuggacaagguccuuaaguuucuguaccucaguuucucaaacuauaaaauggagaugauaauaauggaaccuaacuuacagagugauugugaggacuaaauaggcaagauaggaaagcauauagugccuaggauaugauaagcguuguguaaggguuagcugcuguuauuauuaucauuauucauuccacaggcacauuaagaccuccaaccaugugcagaguguauggcauauccuaggaauacaauaaauauuuugggguaaauaaauaaugugcucauuuguaauuuugauuuauauuugcucuuucagauaaauacuggaaauugucccaauaacuuuauaagcauaauaugaagaaguaaauaagaagaaguuauuguagucuugucuuguauagagcuugcuagggcaaucuggaaaaaugucuccugcuaggacuuaccuucucuguucuuuauuaaagcaaauggauauuuuuaaaagccauuugguuuuucuuuuuuuuagaaagcaaauuauaaucaugugaaauuaguacuuugcuuauagguguguauuauuuucaucguaauaaagugaaauguucuugccacaaaacuguucucuucugaauugaggugagauauuaacacuuuguuugucuuugugaauagguucauccuaaguuccacuauaaacaggcucaugacucgggcacagacacuucuugcgugacuuuuuccuaugaugguaauguccuugccucucguggagguagguuaaaagcuuucuuuuugauguauuucucuauauaaaauaaucaucuuuaacaaauaugacaauaauauccuagugcuuaguaaagcuugcuuugauuuuuguuaaugcaccuuugccagucugauuucuucauuaaaauacauuucuaacuuugcaacauuguuuguauuaaaaauuaccaaguaaaauguuuaaauauuuacuuuuuuuuggccuaaguuuuucauuuagauucaaauuccauaagaguuugaagccuccacaaaugauccuugcuucugccuugggaaguuuauagaugaucaccuauauucuuucuauaccauuuuauaauucugugucugguacuucaaagucuucuauuuguugcuugaccauugcuuuuuuuucucugccaguucaaauacuaacccaauuuaguuuuuuuaaaaaagucuauaucuagaugagauuuuuaaaaacaguucuauaugaucauauuguaaguuuacuuauccacauuuguaugguuggauauagcuuccuaauuuuuuugcuaaaucuuuaucacauagauagguuguguauugguagaaggagauggagaauagugaaggcagcauuaugggagaguaugggacauagcugaagauuuuccuacagaccuauuuguggggagagaaaagaaauagcaugguaaguaguuuggagccauguuacagagggucuuaaauaucacauaaggaaaagaaauacuaauagcaugguuaaguagaugggaacuaugcuacagagggccuuuaggcaggugaaucuaacagugcuauauuuagcuauucauucagucacucgacuacuguauauugagcaucuacuaugagcuaacauuaugcuaggugcuggguguaaaccuuaaacaucauagacagaauccuuuuccugaaagacuuuacaacccaguguauaggauaguggaaaugaagagagaggcaagagauguggcacagcuuuccccucaauuuaacuagucccuguccuuuuacccuggggaacucauucagauucucuuuaaggaaacuuuacuguuguaucuaaacuacucucauuuguauaacuuuaaaaaaucaaagcacauguacauguaauucucuauuuaugauacacauggcaaauguggauauguauaaaauauguauuuugguccaucaauucuaaccugcuacuugaguucagagaugauucccaauuaaaauucuauauauucuuuauuuaaaacaaugguucucaucccaguaguguaucugaauccccugggaaaguuuucaaaugauaauugcuccacuuaggaauucuuacauccacucuugcaucuuugggaugguauauccaagucucugagguggaguuaggggagaagaggggaaaaagggagaguguagcuugaaaauucuucacaggugauaaaauaggugagcccaaaauuacucaacugaguaauuacccaguugauauuugcucccuuagaaguauaaaacuaagucuauuucagucaaagccauuuuggugauaauucuuacuuuccuuuccaucauacacacacacacacacacacacacacacaguguguguguguguauauauauguauguguguauauauauauacacacacacacacacacacacacuagcuuuuggauaacuuaauuggucaauaccacauguaugcuguauuccaucguuuuccuuccuggauguauacaauauggcagauggaagucuauucagcaaagaauccucaggguguuacaaggugcuucugcuagcugcauaacccgcuggauuagauggaauuaauacagguuaauguuuucuuauuguuugaagauuguggagauauguaaccuuuuuuuaaagacuaaaagcaggccaggugcaguggcccacaccuguaaucccagcacuuugggaggccgaggcagguggaucacuugaggccaggaguuugagaccagccuggaaaacaugaugaaacccugucucuacgaaaaauacaaaaauuagcuggauguaguggcgcaugucuguagucccagcuacucgggaggcugaggcaggagaaucacuugaaccuggaggcugagguuacagugagcugagaucaugccacugcacuccagccugagugacagagcaagacucugucucaaaaaaaaacaaaaaacaaaaacaaaaacaaaaaaaaaaacagacuaaaagcaauaaaguaacauuccaaaggugagccuuacaaaguucucccaguacaagcagguccugaguccagccaauuguggauuagugcaccugccaaaaguuggguuucagaggaagcuucgcuguaaaaauggggauuuuuacugaacucuuuacucuccucacuugcaccugauucucauuccuuauuggacccaagggguugaggcaggucucagcugugggcacuggggagaaagaacagcgaaaacauuauguauauaaguuuggcuuuucuguucaggaauucguccuauagaaauauuaaaaagggauuuuuaaaaauuuauuuuuaagauacauauggaauacuucacaaauuugcaugucaugcuugugcaggggcuaugcuaaucuucucuguaucguuccagucuuagcauaugugcugccaaagcgaacacaaaaagugauuccuuaaaaauacucauuauucuuuaaauagcuuggcaaagcuguacuccccagcaaagugaagaaugauagcuguagguagaauuacacuggagagaagggaaucacauggcucacccuuauuaauguuaauggauagcuuuacccauacaccagugggaaaaggaaucuguuguggauugaacuguuuucaguccugauaguuguuaaauuaaacucuucucaagaaguaacguaugcucaaauacaccacgggggaacuaccaucugcucuaauaucauacuucagaguagauucuccaggguuccuucuagcuugcagaugcuacaucuaucuggaaaguaauuuccagaagcccaauucauuaucaaauagcuuucaacugcucuugcgacuaccgcuuuuuaagcucucugaacgguuaaaaaaguaaaacaugcuugugugaaucuagcuucuuucuuccuuucuuucuucucucuuucuccccuuccccuucccuuucuucuuuacaguuauacauuaaguuuagcagacucuaaacugggagcgaguucuuuuugcacaauucacuuuucugucuuuuuuuuccccucauuccucugucaggugacgauucauuaaaauuaugggacauccgacaauuuaauaaaccacuuuuuucagccucgggucuucccaccauguucccaauguaaguagcauauuuuaaauauuugaucagcauagaagaauggaaaagaaguacuuuuacuuuaauguuaauuuauaucauacgucuuuuagaucuucuggaaaagagacuugagagagugaucaaaaucuguuuuuugaaaaauauguauuuuuuuuauuuuucacauuccucagacuucaagaacuuuuuugaaguuaaaauuauguauuugauuuauucauguguuuguguguauuguaugcacgcacaagucuuggaguauuaaaauauauuuuaagagauucaguuguucuuuuaauauuguauaaaugacaagguaggccuuuuaaaauuugugguuuuuaaaaauuugagcucuagucagccaggcaugguggcucaugccuguaaucccagcacuuugggaggccgaggcgggcagaucacgaggucaggagauuaagaccauccuggcuaacaacggugaaaccccgucucuacuaaaaauacaaaaaauuagccgugguggcgggugccuguagucccagcuacucgggaggcugaggcaggagaauggugugaaccugggaggcggagcuuacagugagccaagauugcgccacugcacuccagccugggggacagagccagacuccaucucaaaaaaaaaaaaaaaaaaaaauugagcucuaauaccuucaaggcaguuuuuaauauuacugagcauuuauaguacagcuuauuuucucauuuuuuaaaucauucaaaucaauaauucagcauccuucacuuguucagacugucuugcuguggguagcugaacgcuguuaucuccaaucuacuaaauuggcaccugaaacuuuuaaagguuuuuuugaagcagcugaggcaaaacuugaccucuaaguccuauaguuggugcuuaggcaaauuguucuauuuugguagaaaugaaauaauggucaacagagaagagcaugaagauaauggaagugucaagggaaggaagcuguaugaaagcuguaugauaaugcaguacuaacucuaacaugucugcugcccauggcauuuuauguuaaaacgaacaaacaugaguuuauagcugaugauaauuuuuugagcuauuauaccugcuacaaguaaugcuaacuauauaacuucugaugguaauuuuuugagcuauuauaccugcugcaaguaaugcuaacuauauaacuucuuugggucaugucuuagauuagucacaaucagauggccagacugcuaacaacaaaagccuuggaaucauagccaucaauuagguuccagcaaugcaaccuguggcucauuucauggugcucaacuugauauaacucaaauuauuugggggugaugguagugguguuagugaaaauaguuuuuaaaauggccaaaauaaucauuacuuagacauuagucaaauauauaucuguccguagacacucuuaaugucuauauugagucuuuuuauacuuccuuuacauuaaaaaaauuacaauguagaaguuaaaaagcacagauucuggagucugacugccuaaguuugaaucccagcugugcuacuuacuuuuguugccgugugcaagguguaauuaaauuauuuucuucaguucccucaucaguaaaauguggauaauaacuaccacauaggauuauugugacgauuaaacaaauuaauauaagugcuugacucauaagcccuauauaggaguuacagagauguuuauauuuuauuuaauucacuaaugauugcuggacuguuguggaggucauaagcuuauacucguaaacucuuuuuuucuguaggacugacugcuguuucaguccagaugauaagcucauagucacugguacaucuauucaaagaggauguggcagcggcaaacuuguuuucuuugagcguaggacuuuccaaaggguguaugaaauagacaucacagaugcgguacguauauucuuuucuccucagccuugagaauacauaaaguuugccucuuacccaucuuuugguuuuguuuguuaaguagaauauaagcccuggcccuuagagcacggugauagcugcuuuucacucuagcguaggaguuaucaguauguuguggauggcugagcuacccuaucccuuuccacaacccaauauuuccuauggaccuacacuuuaguaggaauuucagcuggguuucccucucugccaaacaaauugaggagugaggaagaugaucaucauguaggauacagaaaggagcaucccacaaugggcauguuugugaggaucuagggauugucgacagaagugaaagauuaauaagugacgaaguuuaacauuguucccgaaaccaugaaaacuuugacagaacucugcuuguguggguuguagucauuaaagucaggcucagcuugcgcugaacuuaauugcuauuuaauuauuuggaaguuuaaagcauuucagauuuaacuucaacaccuuaaaaaaacacauuaguuuucuuuacagauuuauaugaacacuaaaacaccagcauucacugaugcauucauucauuuguucauguccugagacugagacuggagccacauguaauacaauaagaaugaaaauucccagaggaaaauuugaauuccuuuaagcuguauauuauuauuuacaugguaaagcaaaucauuguaauuuucugaguaugaaacaggccaauuaaugucuguguaaauuuucuuuggcucauugucaaaucuuuuaguaauauccuauaucuuaaacagugcucuuauguagguuuuuccaguuguuucagcucuuuguaaacaguugagacauauuaugcacuuacgugacucagacaauugaacaacuguuuuuaaauuaccagcaaaaaacuccugucucuaauguucuaguauuacuaugaagucuuaauuugcggguucugaauguaaaaccacgguauagaguauuauaggaaaagugaaauaaaaaugagauuaauucuagaugaguacuuauguuuaauagauucuaaucucaugacguaauuugaaaugugccagcacucacagugcuuuuucugggugcauuaggagccaacuaaaacacuagaaucaaagaaaacaauugaaucuaucaacuuucaucucagaaaguaaaauuauuguaauugguuguuccagaaauaagcuguguucuacuaugccucuaaaugacuauacauuucaguaucacacuugauguauuuuuaaauuguagcuuaaguugaacuguaaauaaauuaagggauguagacauaugauugcacuuuuaaagacaugcugggcuucuguaguuuauaggaagaacauacuguuugcuggaaaaaucagugucucauaaugugauacauuuuuguucucuguguuacuuuuauagguagaucuuuuucuccgugguacuuaccacugccucauauauuguauauuuguuugguuucgucugucuucuucuaccaggauguaagucacacagggcggaaacuuuuuguucacugcaguauccucgaugcuuucaacagugccuggcacauaaauagcucuuaauauuaauugaaugagugagagauauacuugggaagugcaaguaaggcauauuguagaucauguguaaaucuucgguuaggugugucuuuggagagugaggcaggagagagauaucuagaguuagaaagguaaaacuggucuuguauacaauuagaagaugacuaucuugugucuuuuuuuuuuuuuuaaagcagaggaagacacauucagaucuaaguuuugaaaugguuaauucuuguugaaauacaagguuuaguuauauaagauuuggugagucuguguagaugaagccagaaauuuauaauuugggagacugggugaauguucauugacguaaaaauacauagagauaaaauaaagcagauuuuggaagaaagacagugaauucuguucuugauauguugagcuugaaauaccuauaggacuucuguguagagauacucaguaugcagaugguuuaauaaguuuggugcauaagagaaagaagagacaguuuugguaaaaacauuuauagugcauaguugaaauguugauugcugaugaguuugauuaagguaagggaauaaaggauagaaaaaugagcccuaagaaaugucaucauuuaagagacgagcaaaugaaacuaagaaaggagaaauuucauuaaauaaauagaacauacaauauugaaucaucugagaaaagcuggaagacaaauuaugagauccauuguaauagauggaugaagagagaacuucaaauaggaacaaaaccacacaccccaaagaguccuauuaaauuguugauuuagugagggugaaggcuuguuguuauuguuaacaucaaacagcaucauuuuucuguuuauauauuagaaugcuauguuaaauaaauggggcuuuuaacaguccguuugaccuauugucccaaguuuuacgucuucuuggaauguaaaaaaaaaaaaauacauuucuuggaaugaauaaaagguggacacuuugcuagaagagccaaaagacaccucuuuuauaauuuuguguuggaaauaccacacuccaagguaguaaggaacuuaacuguguugaguuuuaauuugcauaaaaggcagcaucucagauucuuaauaucagcaguuaguaguguacuuguuugacuaaggcacagacagugauggcauuaugucuauccuagauguguucauuuacuggacacauauaauugguuacgcucuucccacgcccucuucuaaaacagaauaaaccccuacaugcuuauauucuaggacaccaggcucaguauacauauguggagccaaacauuguuuucagucagaagauguuaacaaucuaugcaguuauuccuuuuaacuaaaaacuaucuucacaaaaacauagcuucuuaaaaauauagcaagggcauuuucuauaauuauuuuugaaacaaaguuuuuuaaaaacccaaaacuuguuuuaauucuguucucugcauugucauauucuuugaaaaauuuccuuucucuguucauuguagauucucaagucuguuugcuaggagaugguguauguuucuuuaacauuugcuauuucaccauacgauguuugcacgcauuuuacaauucugcuaaaauuuuuagacauucccuuguagucuaauugcauuuccucaaauuauacacugaaaugauuuguuuauguccccacccaaaucucaucuugaauuguagcuccucauauguugugggaaggaccuggugggauguauuugaaucaugggggcgggucuuuuccgugcuguucuugugauagugaauacgucucaugagaucugaugguuuuauaaaugggaguuccccugcaccugcucucuugccugccaccauguaagacgugccuuugccccuccuucaccuuccaccaugauuguaaggccuccccagccauguggaacugcgagucaauuaaaccucuuuccuuuauaaauaucucagucuaggguauauguuuauuagcagugugagaacagaguaauacacacacacacacacacacacgcacacagacucacacucacacucucucucucucuccccucauuuguuaucuaauucuuugugauuugaauaguaugcuuggccucuuuucuaagaugaauuccagaauauaacuugaaucuugaguuuacaaauucacuuuuguuuuuuuuuguaagacagcaguuuaugcuuuuuauguauuauguaaagggcuuccauuacucuguuuuauacaauaaaagcacaggaaagaaagaauggauaaaauacaacuuggugaugacaugucaauuuuuaaaguuaauuuuauuuagaugaaauuauuaaauuuuaagcuuuucuuaagagccaguauuuagggaaauguucugaaauaacaauauuauuagcuugguaguuuuucaacaaaugauaauuuauugugaaaugacuaauagaauuuucuuuuuaacuaguaugaaccaagggacaugguuuaugcaauuguaccaguauauuaccauuuauauuuuuuaacuuaagcaugguuaaucagguuguuuuaaccugauauuguuucauggucucuguaccucauucacuuuuggcaauaauuucagagauagcaggcauucccauggguaaagagggaaaaggaggaaaggaaaaaagccagaaauuuuacaccugagccuaacuucuuuucuaauuuauuuguuugcuuagguacuuuggugagagaccucuaguuuuguaaauacuggcugaacaaaaugaggauaagaaagaauuaaaaaacuaaaccuuuauuuuugaaaacacugcuauaacaucuagcauaaccuagcauauagccucugaagcaacagaaaaggaaauaugcuuugauauuuucaacuaguaugccuuggacauuuuaaaguugauugaaaaggccuggcauggcggcuuaugccuguaaucccagcacuuugggaggccaaggcagguggaucaccugaggucaggaguucaagaccagccuguccaacaugaugaaccuugucucuacuaaaacuacaaaaaucagccagguguggugguaggagucuguaaucccagcuacuccauaggcugaggcaggagaauagcuugaaccugggaggcagagguugcggugagcugagauggcgccacugcacuccagccugggcgacagggugagacucugucucaaaaaaagaaaaaaaaaaaaaaaaaaaaaaaaaaaauauauauauauauauauauauauauauauauauauauauauauaguugauugaaaaucuuaauauuaacauaagaaauaugauaguaaagguauuuuaaggaagaaaaaaccucauuuuugauuucuagauaauauuugauuuucuuugggacguuuuuuaaauaguaaagaacaaggauuaucuuauauuuuuacuuccuucuaucauggcuuguuuuucagaauaucccuuuccugugagaaaugaaauguauaauaugcauaccucauucauguucucuaaaaaagaaaacugaaaauauuaaguaucugguguguucugucaguuugaaguauuaugaugaucauuguuuucaagaggcuaacucuacaguuugagaaaguauauauuguggaaaugaaagugcuaacauuuucaaguugauugaaaaggccuggugugguauaaauguuauauauaacauauaaaauuauacauaacauuguauauguuauauauaauuacauguuacacauguaacauaauuauacauaacauaaauuuaaaaaguauauucuggaaaugaauguguuagcacuuuucauuucacaaaaaaguuuuuguguucuuauuaagagagaauauugauguuuuaauucagagagauugaagaggaagacuaaauggauaaaaagggccaugaaauaauagacccuuuaugaaccuagcuauuuaucuuaauuuauaauguguaagggacauacggccauucagacuauagucagccuccauuauuuguacuuagggagggaagcagaaagguaauucaaauuaauggauauuccacaaguccucagaaauggcuuuggaauguaucuuuguucuuacauuugaauguagauauagccgaucugggaauucacuucaaacaaauuaaugauacuaugccugugaaaguuugauucugaaggaguugaggaacucaucuguucuuucauuucauacugggaauagaguaauuaucuguuuuacugauauaaagucccaacucaggcagaauggcaccuccuucuaaguuucuagaaauaaaggagucaagcauugucuuugcccagagucauacaaggaguagcauuacacagggagaacuugagcuaucagcacugcaaaugcuaacugaaaauaaacuugaaagacuacauuuggcauuugucugccuucuaaaauauagugaaaccuccuuaaugugaaacacaaggagauggaaaaaaugggcuuugaauuaaccagcuuuccauuaucugauuuuuauuauggagcaaucaggcagcugguugacuagggaauagcauuugcuuugaauuauguauuauuuugaauaacaugauaucagcuuaaugaaauuuuacuguaauucacuuuuuuuaggaggauuaaacaaugcauauccuagagggagccugaguaacauauuuguauuuaauaaaaauauuauauuugcccacagccaagugauaggacaguauaccuaacauagguguguggagcacuugcucacugagaacagaaagguggaguuucagagcacugguuguuucuuggucuuccaagauguaugaauauuugauaggaaaacugggagcaaguagaaaaugauggaguuuuaguguaaauuugccaguacauguuucuuucucugccccuaucuuuuuuccagggucaagagccaacuucuagcauggcuuauuaggacaauguuuuacugucaagaagugcaguggucacucaguacugcuaucucuaggaguauuuucuuuaaucacugaagaaaagagaugccaguggaauauggugaaaaacaauguugcauuuuugcugccuucauaauuuggacuacaagaccaccuugaaaaacuuaaaucuuuuuggggaauuuccuaaagcaagcagcauacacauauaauuuaaaugggaauuugaauucagcugggcucaccuacuaagccagcaucaauaagacuugauuaaauuacuucuugguucucauucaccuagagguaucauauuaugaagguuccagagcaguuguucuucagauuugaagaauacaguugaauguuuauuuguaggcacaugagaguaaagaggaaagauaccucagauuucuuggugguuuaacuguuaauaucuacgauaucaaaucuuaacauguuuuuaguuagggaagaugacaggaacuaguuuagugcugauuccuuuuuauuauuuuaaaaaauuaugauacuguaaaauugaucuuuuuaagaaagcauacgguucugugguuuuuaacacauguauggauucauguaaucacuaucaacacaaucaguauacagaagaguacccccuaaaaacuccuuuuugcuaucccucuauagucacacacacacccccucuuccacccccaacuccuaagcccuggcauucacugauguguucuccauaauuauuguguugugguuucaagaaugucauauaaaucagcgguccccaacuuuuuuggcaccagggacugguuucguggaagacaauauuuccacagacagggccaggauuagggugaggcaagugagaugcuuuccucaaucacaaaguuuacagggacacuaagacacuuaguaaucaagauaaguaacauuuuaaugcaacaauauaaaaaaugcaaaaaaucuauggugaauaaaauaccaaauuuuaaaauaaaaaugggaucaguaacagugcugugccaagcuguauuacagccuaaggcaaaaggaaaacucaguuggacugaucccgucuuuauuuaaaauguugauguuuuguuugccauagauuuuuuguuuuuauuuauuuauuauuauuauuauugguggaggcuagaguuggggaaaugguaacucacuucugcuugacugauacuuugaauuauggacuucuucccaaauccaccuacuacuguuuacuuuucagaguccucagauaggucucugaaaaguauguaggucucugaaaaacccuaugccuucuguccugguuuuuaaacaacauucagagggagagacugaauggaguauguuucuacugucuacaauggugauggaaaaaacaaaaugaaacaguacagauuauagcaaaugugcuuaggaggaagcuucuaaguuagcugcacauuuggagggacauucauaugguaggaaauaaaauaaugucauugcuccuagaaugagucaccccucuuacuugggcaguauguucccuugacauaacugugccacaaggcagagcuacuggcuuuugcuuaauuagcugccauugguauuaagcauacuuggcccaguuucucaauauuauuuuccagagcucauuccucuugccuaccugcacacuacgacguaacucuccuguauaaaaauuagacuuaacagauuuuacaacuucccuaaagaguucauuucuguguaugaaaucccuuaccgucagaucauuuuuuucuuuauuuuuagccucacauucucauguuuagagccuacauccuuugcucugguccucauggaguuggagaacagcugguuaacauccucuguuuccuugaagauuauaaaguuacuguucagucuugucuuugucugagggaaccaaacuuagucuuuuguucuuuuuguuuguuaacauuuccuuguggaucuuguuuucuccacaccucuguugucuuugauacucucuucucagccauuucuaaacucuccagugaccaaauuggaguaagggucuccucagggcugauggugucaugugggugguaagggcaucaucauauuacuaauguuuauuaauguaauacauggcacauaguagaugcuuggugaaaauguauuuauuaauuuugcuuuaccuuuuauuacauuuuauucuauuauauucuuguugggacuaacuguaauggccuauuccuuaccaccuucucaaguuuuuauuuuuugguuaauaguuuuuaaaaaucaauuuggaauuucagugcauauauuuuuucuuuuuuuuuuuuuuuuuuuucuugagacggagucucacucggucacacaggcuggagugcaguggcacgaucucggcuuacugcaaccucugccaccuggauucaagcaauucuccugccucagccuucugaguagcugggauuacaggcaccugccaccgcaccuggcuaauuuuuguaguuuuaguagagacggaguuucaccauguuggccaggcuggucuugaacuccugaccuugugauccacccgccucggccucccaaaguguugggauuacaggcgagagccaccgcacccggccacauuuucuuuuaggauugauaaaagaaguauacauuuauuuuaauugucuacuacuuuaaaacuuuagaugauccuuuuuucagauucauugcaaauagccagguuuuggguucauuagaggaaacacagauuuacugcagaugcuuaaaauacugguaauuuaaacucuagugaauauaauuuguuuugguuguuacacuguuaaugaauaugauauguuuccuggaucuauuuuguaaaauauacucugugcuuugaagcaaaaguuauuuguuugaauuugacacuuuauuuuaucagaagucuaaucauuacucuucauuagaauaggggacaaauacugaugugauauaguacuuaucacuuuguuuuucucaucuuuauuaucucuuuaaaaaaaaacuuuuuaauuuuauuuuuauuuuuugaaacauagucuuucucuguugccuaggcuggagugcaguggugugaucucagcucacugcaaccuccaccuccuggguucgagugauucuugugccucagccucucuaauagcugggauuacaagcgugcacuaccaugcccagcuaauuuuuuuuuucuuaguagaaacaggguuucaccacguuggccaggcuggucuccaacccccaaucucaggugaucuacccagcucagucucccaaggcgaugagugagccaucgcgccuggccucauucucucuuaaaauaauaacuuuauaaauuuuuuguaacuagcagauucuugauucagaugcaguuuuuuagauucucuauucuauguucucuucuuugaaauaacguuuacuguaggaauccagauucaaacccugcagugaagugucuuuuccuaugaccaccuauuuaacagugaucucauuugggaaguuacagggugagaugaagggccaaucacgugcugccuuagacuucgcgagcaaaagaaugaggaucaaaaggagggcuuauccaguuuaauaguuuauccauuuccuaguaucauuuaaccccauuacaagcuauauuaaaaaacauccacuccuuaguagugccagcauuugcaaaugaagauuuuucugcuucuauuucuaguccuuugaaacaauagaaauagucaguguaucccuuuugauuaaacaggaacuuuuuuccccuucucuacacaaaaguuugauauuuuauuuaauaaauauuuaaauuuauuuaauagguauuuaaacuuguguagacaugauugccaugaauggcaaagcuagauaaggaaucagccacuagguaguacuuaauuuuauuauuauaauguuauauuuacuuauuauuauuagguaauacuuauucacuagggagaaacauacuuccucuauaaaauauaaaaaaagagaacuugauuuguagauguuuaaaaauguucagaaugauacuauucuuuucauaauguguaaacaaauaauacaguaaugacuagagcuccauugucuaacccuagcaccguaucacaucccacugauggaccaagugaaggacuuuaugucuuguaggauuuucugacaguuuuucucccucagccugaaucugaugaaugaucuuugguaacaaguuuuccagcuguucuaucagaauucuggccaaacuuucacaauuauauauaguguggggaagaacaaguucuauaauuaaaaugcaucccgggauaguauuuuuccuuuuuggaaaugauagauaguggucuuguaggaggauggguugugagacccccaaaggacugaauaaaagaguaugauauuuaaaacaucuuuaccuguacuauaguaagauaaauaauauuuuacauauccugcguaguucgucuauacaggaagauucagcuuuuccuguguuuucuugguuuuacauacuuaaugauuuccaagaucugauuacauauauuucuuaucuagcaguuagagauuuaaaaaguuucaugcauuacuguuuuauuuauauaaacauaggauugauggucauuaucuuuaugccuaucucuguugauaaaugaagaaauguaaaggagcccaggucuguguagaccaaacauagaaaaaccagguggaguuggguuuacacugugggucuuaaaugaagagaaauagccauauagugcuucccaugccuucucacaaccuggucuccauaauaaaugauaauaugucauauaaacagauaaggcuccucuucucuagaaaugacuagccccagugccccaggcuccucuuaggcaugaggggcuccauaucuugauacaccuaccauaucuugguaucccauucugugcccaccagugggaagcucugcugcaucuaaguggaucccaugaggugggaccucuggggucauuugccuugcaggacgaccacccaccugggucacucacccuguggacuccuguucccagucuccuguuuguuuccuacucacagacuaucauuaauaagaauaauuaccagacuuucuucagucuuuacuuaugccuucuuugccuucacaaauucuucucaaguaacaggguuggagcaaacuuuuacuguuuugaauuagaugaacaaaauuguauuuaauuuuacuucccaagagaccuuccauuuucucugagaacuuuuucucaugaugaaauucuuuaagcagguuuauuaucagauacagaugggauucauuuagugccaaggaugacuaccagguuccagauuuuugcugcuuuagugguuaccuuuauuuuauagcacagacuguaaaugaguuauuuuaguaaaagcauuuuccaugaguuuucugggaauuaauuugauaauuagaugccaguuuuuaaaaugcauaauauaugcaucuguaucaaauguguaugacaggugcaaagcaacacuuucccuuacuugguuuuucugcagcagcccccacauuuaugaaaguacuauggcauuuuuucuuuucaccauugcacuccuaucuggccuauuagagaauuuuucaggauagggaagggagaagauugagaagauuucuggcaaaaaaaaaaaaaaaaaaaagacaguugccacaagucuggcccaugguagaauuuccuuggaacuggaggaauguggaggaggggaaaaggagaggcauaugcucacuuagcaagauguguagagaaaaugucugccuuuaaacuuuuccauugaggggauaucuguagagaucaggagguggugaugagucuuaguuauuggagacuggggcuuacucaccauguuugcuuccugaacuucagagggaugaagccaagucuuguggcccaugcauguggcaaggccaucccaaguuugagaaaagcaaggcuuugggagagaguggagggaacaaagacaggacaaauagccuggaaaaguugaaacaauucccauuuuacucucauacuucccuggcccaauauuuuaauauagaaaacaguuuuucuuucucugugaagaauaucuugggcuuguggaagucugaagaaaguucuuucuccaguauuuuuuuuguuuuuaucuguuuucuuuuuauuuguuuuggguucacaucuugaucuucuuucuuagugucuggaaucugcacacacaaacacacacacacgcacacacacacacccauucaaauguguuggauagucccaaggaugucuguaacucuaagacugccucuauacaagucugcaaaauuguguaacagacuccuucacggacaggugucaggcuuuucauuugaaaauugugaaaaaugcuuguucagggaaucacugcauuagcuuauccauucuuguacuauaugacaaaaaccaaacgugaaaaaaccagauggaguuugguuuacaguaugggucagcagcuguggaggauccggaaauggaguuucaacauaaucauguuuaagguauaaaguuaugaaggcuguuggcuuucuuuuagcauguagaauaagggcguuguuuagauaugugcauugcagaucccuaagauguuacgcaggcauugauuucuuuuauaguaacauuugugaacugggaacuagugggcuuuuuaaaaaaaugauuuuaguaauaacuccuuuuuaauacaaacuugcuaagguuucuacuggguuagguggguuuggauaugauuaaaugucagcuaccuucuuucugccccaucuuuccaaauagggcuuugcaugguuaaguaguaagggaaugaacaguggaguuggagaaaccugcuuauugacccagcuccucuaugugcgaguuauuaugugaccuugggaaaguuaccacucucuacagccucaguuucuucaucugugagaugggaugagauuauuaauuuuguaguauuugugaggacucaauuauauuaaauaauauaaaguuccaguaccuaauaauucccuuucuaccauguccuaaaauguaaaucauuucucucuuugguuuccuucuccuccuccccuuauuugcuucccugguuccucuaaaaguaaacaaaauaaccacagaaauaaauuauuuggaaauuuuuguggucuuuucacuuuugcuaagggguaauuccaaaauuccuauuuuggaauuuugacacugcuagcucgacaucgugcucucuuucuccccggccuaccccucucuuuuuucuuuggucucugcagagaagaaaaaaaucucucuguugagcacauuaaggucuuguaacuccuucuagucaugcuuauggucuccuauuccaguucuugucucuuauuuuugggcaaauuugugguuacccuccacuaccaaauuaaaggguuaaaaugaaaaugggcuuugguuuaaaagaauaagcuucauuuugugcugaaauguaaaguucaacuuuggcagcuagaggaagccauuagugaacccacauguuuuaggaaaugaaguagauuaguguaagaauaaaacacuuugucaauuuaauuaagcaaauaaguuuauuaaaauaugcagacuaauuucagaaccuaguucuuugcacugcaguggccuucugccauuggaaucucaugauauaaugugagggcuuucucuuugauucuguagaucucaugucuugauguuccuuccugguucucugguccuuuuauucaaaugugcucucuaugcuuuauuugcugcauuucucagugacuccuuaggucugaaugugucacgcucccaguaaagaagcacuucuucaagaacaggaugaagaaaguuuggggugguugguugaucgagggauuguacucuuucuaaguauuuauagcucaucugucuucugauguugguuccuuaggcuucuagcaggcacgugucgcauuguuguuaagcaaagccgguauguauguuugacaaguuagcagcguggcagcucagcuugcuucccagcccugccgcagucucagggauuguuugguuuggcagguagccagcucucugcuauaagaugcauuuccuugacaggauaaaauguggagccgcauuagcugcaaaguuuacaaagguuagcuaaacacacacaauaaauauuaauaaacaaaaaaggcccacccaccuuuggcuuuaaauuuuguuucuucauuucguguuuuagaauccuuguaguauuugauuaauaacuggucuuaggguaauugagccuuaaguauccucugccuaaaucagauugcucacuggccucucauuugcugcuuagugacucauugccacagugcauggggcucuggaaugacuguuuaguuuaaggggucuuauuugccucucccuguuucggcaugaaaggaggguaaauaugcuucucuguaagaacauauacuaaucagcuauauguguguguaaaggcucuggaggguacaggaugugaacaggaauagaggugagguguccuuggacucccuggaaagcaauuggaccuuggucuguuggcuugggcaguugccucucucuaacauuuacacccucagugaagagggagagaguaacaguaaccugcugccccuggaaacugccuguuuggcuggaugucuuggaauuuaucaggccuacauuguggaucuuuuccaauucugcacccugcucacuugaaaacauauuugagaacuaguaaucuuagacugcugagccagaccucuagagaaccaagaaagagaaauaacucuaauacugugcccuuaauauuguccugggccauuuauggguggcugagauuucugaaagccuuugacagccgcuuucauuauucugugauucauguacauucucucucucuaggaccacauuaggaggaaucuaacccugcuacauuuguaggauaccugaguauaauaaugauaugaggaaaucaaauuauuucucauggaguaaugauuuuaauuugaaaauugucuccagcucuaccuagcaaagcaauccauuuaggcaugggugaacuguagcuuuuaauucauuccuuuggugaacauuuuuugagcaccagacacuaaucuaggcacuugggauauguugccaaacaaaacugacugagaucuuugcccaugaaauauguguucuaguggggaaggcagacaaucagcaucauuaauaaauaaguuauauauuauauuaaaagaugauacaugcuauaaaaaaagaaaagcagacuaaggggaguucuggggcacaguuuuaaauugggugguuuagauagcaaugacauuuaagcaaagacuaaaagagaugagucuuggcucagauggauuucuucuacauaggguuucauaaacaugacuucaugaaguuauguuugugacucuccuuauguuuccauauaccuggcuguggccaucugggaauuuccaguggucuaucucaaauuagucucagugguggagcaccuagaagcugcacuuuguagaccaugagcuauugauauacuuaauuacaucuucccaaccaggagcaauuuuauuaggagaaaaugugacuuuuauauguaugcauuauaaacuagguuuuacaagcauagguacaaagcaacaacaaccccccccccaaaaaauacccaaacuaucaaauuaaauauaucuuauuuuuucaaguuuuucuguuaauauuuacucacuauuauauuuguuuuaucaucuuuuagaacuugcuagccuggguagcaggcaccauagauuugagaaaaauuguggaaagcaagccuaaaguugugaaaaccugccccuuuaacuuaauuuuccccccagcugauggggaaaacacagccauucugauuugauuuucucuguacaauaucccauuccucuucagugguacauagguuaagaaccacucuucuagaguaagucuguuaaaucagauaugaauuaaauaaaagucuuguagacucuuuucagcuuucuccuuaguuccucuggaaucucagguaaggguuugcagccauuuaccuauuuuuuuuuggccuauuuuuuugccauucacaugggagucagaauuuuuauuucuuuguuuuuuucuuucuuucuuucuuucuuuuuuuuuuuuuuaagagacagagucucacucugucacccaggcuggaaugcaguggcacaaucauagcucacugaagccucaaacuccuaggcucaagcaaucuuccugccucagccuccugaguagcucggacuacaggcgcgugccaccaugcccagcugggaaucaauguucuaucaaaaaggaucugagagauuucaagauauucugucuuaacaaaagaguggaaugaguagagacaaggaaccaaagaaauucagcccaaaguagauuuaggagacguagucaugauuuucauuuuaccacuagaacuauaaaaugcuaauaucuaaucauacccuuuuccccuuuagucccuauauauaguuugacaagugauagauuauuaauaaacauugaauuaaugcuuccacucauaucuuguucuaucagagugaguucuauagaaccuaguacaugggguuucuguuuacuaacauuagcuucaucuuuuuucccuuuaauucuguccacgcuaucccucccaccucugcccucuuaccacagacaaaaauuaaaaacagguuauaguucucacugagaacuugugguucuuuucagccccagagcaccacuuauuuuccuuaccaguaaugaauucauaggaucauaacuuccagugaaccuucucuuaaacagcuuuucauuuagguuaaugucaagucuuuguauucuguaucucuguuuuacuucugcuguuguccugcuguuuuaucucauagauagggagacauuauuaaaugccuacaaaugugcauuguuucugaaaaagcuuuaugagauuuggaucuuugugaacuaaaaacaauaaccaccuggucucaaucugcuguccagagggacauauuguauguguguaagagcaugaaauucgcuucagugguaaguguaacugaguuauguggauuuagcauuccaugaugccagccucacgugguaauggaccugggaaaccuaauuuugugguuucagggcuguccagaaagggagauaaugucaggaagagaacaucuuuuuuauuuuuauggaguaucacccagauaauaagugauggaauggaauuuuacuucaggaacacaacuuuaugguuuaaaagaaaaugucugaaaguuagagguaaaccaucaggaugauauuugauauaguagacuagccaucaaaguaccagcaggauuguuuccauuuuuaucuggccucuuuagucaaccacugcgcuuuuccuuugcagaguguuguucgcugccuguggcauccaaagcugaaccagaucaugguuggaacuggaaauggauuggcuaaagucuauuacgaccccaacaagagucagagguauuucauaaguauugccuguuuuagauggaugacaacaacuggggggagggauuucccucccacccccgcuuuuauuuauuucccacuuugauggagauccacccauuuagaaaaugcagcuggaacaaaguaaagccucaaacuccugguauugugcuuuaaaaaggauuugaauauugcccuugauccacacugaauucaaagcgaaaguuuccugggaauuugcaguuguuuagcugaaauguugagugcaagggggaaaaacguucugcccacuuugcauaccacccuggacagaggcauuagcagugauacauguaagagauuuaacaaagcagggaacuaaccacuuacaggaaauggaaucagcuuguccauuuugcuucuuucuuuuuuggcuucuagcaguuuggauguuuggcaagauuauucucuguccgcagaaagggacagcacagauacguuuccccuccacccccaugcccacccaaguuucaaacuuaagcauaccacuguauuucaaaagucugaaaacguaacuagagguucagucauuuccucaguuauuuccguuuugcuuaggcacaaagauggauaugugucaucacccagaaaagaugguuuuguuucucucucuuaaaguacagugacugauaagcuuucuuuagaguaagacuugguuaacuagcauuaaaauucacaugugaaauuuacuggggucccauauaaaccuguuuuaaggucccacauccuuugaggaaaggaaagccagccucuauuaaugaauauucauuggccauaauuuugcucugaauagaagcagacagccccaucuuccuucagagcuuccuggacuagaguuggaauccuggccuuauacaauaaaguauauuuaugguauuugaaaacaaauaggauuuuauuuguuuuuuaaaaaagaaauuaaaaaugcuaauguacuuaggaugggagucuguuucacuugagaaaaugaugagccucauuugauagcacccauuuagaaggcacuuucuguggaagcuuugcuuuaagaaauuuacuuauuuguauuugcuucucuugaaaaggauaacucuguacuacuaaggagaagugcaauguucuaagcacauuuuugguuaaucccacacauucuugggccauagccccucggcaacacugccaagccaacucaguuccagacacuuguacucuuguauuugaaaaguggacauaugccauuugggguguagaccacccagguugcuuuagucugagacauaaacuaaaauuuuaacccugugaccuuuagagugaaaagguuggguaauuuuauuauuuaagaucuuaaaauuucacauuauuccuauagguuuuguaaacuuguguccuguugcccuguuaccucuccaacccucuugcuuguuaauaaccacugacugacagacuugcuuuuccauaaguuuaagcuuuuaucacugagagcccaucuguugccaucccucagaaagucaaguacuuguguagauggagugcaugcacagaguauguuccugaaaguaucucauguuuucaacaugaaauuuucuguuucuaagaccaaguaaagaaaauaauuugcuuuuacacccguuaggggagcaaaauuaugugugguuaaaacccagcggaaggcaaaacaagcugagacucuaacucaggacuacaucaucacccguaagucguuaacaugccucucaaucaugcaucucucuucuacucucaugugguuuugauugcauagcuuuagagacagagaaagcccucagaauucaggcauauauuacaaaauugcccauucauguggauaggacuacgagucauguaacagcuaaccucuguggcuucugugacucaucacagggacaggguuauuucaugcagcuuucaacccaaaagggaaaagccuguucgaguccaauacauuacuuuauagcaguuuuuucaagaguaacagucuauuccaagugugaacaagaaagagugcuggucuuggaaucaggaggccuggguuuguccaguuccaccacugaguggcaaugugauguugaacaacuuaacuuuuaaucagggaaguguggcgaccagaggaagggucucuuccagcuuucucugaaauucuaugaccaugugcuagacugauccacaggaauuuguauauaaaauuaacuaccugggguaugaguagaaagcuuacuagggcagagugguuucucucacguaugucacacaaccucauuaaucuggcagauguguguucccagagccacaaucucaaaccugcaacaggugacagcuaggaaagaaauaauggaugcuacagcgauuaucauuaguggauggcccuguggacuuuaucagugacucagucuggagcccagggggcgcuguacugcuggguuuucucacugguggugggucucauaugagaccaagucccuuggagcuuaugaccaguaaagagaucccaugacacuuuuugcaagaguagaaguguuaaagucagugucauaacuagucuagcucauguaauuacaugcggccuacuuaaauuccuccagucguuugaagugaaaagcuauuuucccccuccuaaaaauacuguuguguuguguugcccaacugagugacggguggcuauguuucucagcuccccugacucaaggcaggcauguuuuacuggugagugauauggucuggccucaguuggcaguauagguagaagguaggaggggauacuggaagagguuuugagguguuauagacauuuuauugauauuauaaauucccuuuaaccuuucccuuccuuccccuggucccccgggaaaaguuucuuuuaaaggggguuuaaucugcacguaagagucaaaagaaacugcuaguacuuuucuggggcaaaaaaagggaguuauuuaauacuuccccuaauaacucuuuccuuuuccccuagaauauuauacuguuuuccuuuuuaaauucuuauaaucuuuuauauucugaaauuuaauuuugacauugaguaaacaguaacagcaauugaacgcauauuacuuugguuuuuauuuucuuauuuugcuaccauauagcaggagggauaaggccccauuaaguccccaugccaagagauuuaggcaccucuugcauucauggcaaccuuuaucccaguuucagugggauaaguguuccucccuuccgguuacucaguguugucaacuccuccugagagguggucacauuucagaaacgugugaagugauuccaguguuuaugagacaucugaggaaacuucagggcugacagcaagcuguuggcauuauucacauuuggguccuguaagaaaaaauaagaggcagucccaauauguguuucuuuucaaaaccacgguaauuaaguuuuaacugcuacccaugguuugggagauggggagccucaccgauguuuccaugacaauauuugacaguauuuccugagugcuguuagcugccaggagaggugaccagugagucuggucucaagcaaaauuggcuaauugguuacaguaagacugucuuuuauuaucagaucaagacugucauuaugacuuccauuucaucuuucaguuagucaugcuuuaacuauguuuuuggaugggaagguuauuguuauaaugaaauuuuucaaaugugacuucuuguagcucaugccuugccuauguuccgugagccccgccaacggaguacaaggaaacagcuggagaaggacagacuggauccccugaagucgcauaaaccugaaccuccuguagcaggcccaggugacugugauccagcuagugaccugcagaggggguucagaggcagggugggguaauugauauaaaauugggaaggucuuuugggccuggaugcuucuuugucuucagagagauuuuacuaguguuuuaaaaauguuuucuuuuuaguaacagaaaagcugaugcagaauccagauguauaaagcugauaaaaauugagcuucuauacugaaauagggaggaagacuggggcccuuucugcuuggucuccaacuagaguuuuccuagcuggccucaggggaacucgggggcucaguggaccuuggaacccaguguuaaaaccacugcucucaauauuggcuuaauguacaacacugggcacuuugaccagaauccaggcuggauuagguuucacacaaggcagaauguggccaucauuuagauuuguguugauaucacuagaagaugaauaaaagucuuuagaguuuuugagaaguagguaccagaagaaagccaagcagcacuggcuaauaguauagcacguaccuugacuagaauuucauuuucuguuaucaucuguguaguuucuauuuggucugcuccuucagcauagaaaacauuuugcauaucuaucuuaauuauuuuuuucauuuuuuucuaacaccguccuaacuaaaguuuccaaaaaagauuuuuucuuggauuauugugaacccuucuaacuaugcaccuuagucucaagucacucccuuucucccaccucacuucuauuugucuuauacacagcuuuaaucccuaacuccauuagcuuuucauguugcuacagccuccaaaccuucauaagcuucccacuguccaauugucuuuccagagauucaagguucuguacaguccaaaucaaaucuaccccuguagcuuuacaccuuacuucuuuccugcucugaucuuuugagauuacuguugguucaauccuguccccaaauacccauugaacuuucuucuuucugcauuuuuguacuuaacccauucugcuuauugaaaauaaccuucuuuaccuccuaagcuuucacaaauuggauccaucucuuucauaaagaccuguucaaccaccugagccugaagugcuaucuuccucuaagugccauaauaguuacuggccauacaaauuaucucacaguuaauuauuuccugccuuauuuaguuucuucuuaucuugauuuaugaaauuaaucuuuuaguguuauuuggcuuuucauauguuuauuuuaucuuccuaagaaguccuacaucuuucugaguaccagucacuauacuagcugcuagagaucuaguggggaacaaaucccugcccuuaaagagguuccuauuucauagggagauuauaguacagcagagcaacaugaaucaguauguuuagcuuauuuguuuucucuuauaauacucagcaaaguaccuguaagggacuuggaagaugccaagcccuaagauauguuuauuuaaauagcaucuaaugaauauuguuuauuuuuauuaauugaauucuaaauguugaugccagaggaacuuuuuaaagcauauagauggcaaacuaucuguaauuuuuucuauauugguaucauucuguaaguuaagcaacugagacauaacaaaaaaaucucuuccuauuuaaaagugcuaucgggaaguugagguuuggugaucucuuugguucugauugucauaaaucuaagcugaaaggaugaaauuuaaguacucuugagauuugugcucagauaaguacaguguacacagauauaccuauguauccucaugcucauucaguuucuaauuugguuuuuuuucuuuugcaauaggucgugguggccgaguuggaacccacgggggcacucucucuuccuauauugugaagaacauugcuuuggacaagaccgaugacaguaauccucgggaagccauuuugcgucaugccaaagcagcagaagacagcccauauuggguuucuccagcauauuccaagugagaauauagcuuuuuaaaacaggaaaauuguuauguuuaaugaauuggggagaacauaacaauguuguuuuugaguucuaacuucucuauuucuuauuucauacuuagauaugaaaaauaggccagguacucauggucuuuaaaccuaggcauuuguauguaucauaagacucuaaaaucaugaauuuuaaaacuaggcccauuccaucagaguuguagcauaguguaaaccauuaugugaagcccauccugcccaugauuaaaacaaacaacaaacaaaucacugcuuaugugcauuaucuuaguugacgaggguuaaaagcaaaugaagcaguuuguaggucuguuauuaugaacucacuuuuauuuauagagcuguauauguaaguaacacugcagaguagauccugccugcucguauucccucagacagcuuagcauggaugaauagggagugguuccuaaagcuaucaaaccagcuacauuuacauuaaagauagguacuauuauagaauuuuccguuuuuauuuuuauuuauuuauuuagagucaggaucuugaucuguugcccaugcuggaguacaguggcaugaucauagcucaccguaaccucaaacuccugggcucaaaggauucuccuuccucagccuccuggguagcuagcacgacaagcaugcacugccacacccaacuaauguuuuaauuuuuuguagagacagugucucacucuguugcccaggcuggucuugaacuucuggucucaagcaguccucccaccucagacucccaaagugcucggauuacaggcaugagccacuccaccuggccagaauuuucaguuucuaaauuuuuaaacuuuuuaaauuuaauuuuagauuuuuaggaaaguugcagaaauaguacagagaguacauauauacuacucacccaacuuccuccuaauuuaacacuuuacauaaucuuaguacaauuaauuaucaaaacuauaaaacuaacauuaguauaauacuauuaacuagcccaggugcauuagcucaugcuuauaaucccgacacuuuggguggccgaggcaggcaggucacuugagaucaggaguucaagaccagccuggccaacauggugaaagcccaucacuacuaaaaacacaaaaauuagccaggugugguggcaugcaccuguaaucccagcuacuaaggaggcugaggcaggagaauugcuugaacccgggagguggagguugcagugagccaggaucacaccacugcacucuaaccuaggugacagaguaagaccuugccuccaaaaaaaaaaaaaaacaaaaaaaaaaaacaaacuaaaacuauagaccuuaguuaguuuuugccaguuuuucacucauguucuuucucuguuccaggaucccacauuguacuuagucuccucccaucauaacaguuaccuuuccuauguuucaugauuuugaugcuuuuaaugaauacuggucaguuauuguguacacuuucccucaguugggguuugcuugauauuuucuuauauuuggaaugagaccaugcauguuuggcacaaauaacacaagagagauguuguguccuucucaguggaugucuuauuacuggugaugcuaacuuuggccacuugcuuaagguuauaucugccaaguuucuccacuguaaagaugcuuucauucuauuuucaguugauaaacuucuugggagugauauuuuaagacuaugcaaauccuguuucuccucaauuuugcugucuaauuuuaucauccgugaaugaauuugccuauaacaguuauuacuaugguguuugccuaagggugauuuucuguuucccucuuuucuucuguguuuauuaauuggaauucuaccuagaggaaaaguuguuccuucucccacauuuuuuuauuuuucaaguauuuuuaaaauauugguauggucucuuacauuauucugugagauaaauuccaauacuaucauuuaguuuguugcucaaauuguuccaccuuuggccaauagaagcuggaauggcuucagaauggcuccuggcaucuuucucaagcgccuauauauuuuuuuaguacuuccuuacuuucuggcaccacaagauguuacagacucaucuugguuuuucuuacccccauucuggaaucgaccacuucuccaaagagccguggcuccuuuuguuggagaauggugauuagaaacgaaaggcugugugcuggaugugcuccuugcuacugcagugccauugcuucuagguccuuucugcugacaaagcuaggaaauacauguaugcauacuaagcuacccaucuacacacaucuguguuucugaauguaucaaucuguaguuauauuuguaaaaccaugaguuugaauugauguuucugauuucaguccuguaucacagguucccuaacuuuucuccuuucuguauuuguaacuucuuucuccguuaaugagaaacccagcucuuauuuguucaggucuggcauauacauuaacuaguuuuagaauugcuaacucauaucccuguaagaaucacuuuuccuaucugcauggcauaguuuguuuacaguucuucuugucuuuagccuuaaaguauacuuucuucaccaccccagugauuguggcuguguuagccauuugaaaugcaguuagguucauuuuuuaguguuuauuucccuuuuuuggguuuucuucacguucuguuuauuuuuuggagugugugaaauauuacuaugguucuaggagucagagcuuuaaaagagauuuucuuagagaacugucucuuccucuucauuccugcucccuuuuccuauucccagucccccuuuuuuucagucccuuuccuauccaccccuuguagcuaaauaaucuuuuuaguuccugguguaucuuucggguauuucuugagcagauacguaaguaucuucuuacauccccguauuuccuaugugaaggguagcauaauguaaaucaucuuuuuuucuuuuuuggucuaaguuccacuugaaaaucuuuggugaaguguaauuacaacauaugaacacauguauagaguaaaaugucaccguuuuuaauauacaaauacuaaccacaaccaacuuuuaucacaaaauuauugcuaaucugugauuauccacaaaguaguugguuaucuaaauguuucuucauuaacauuuuaguaugaaauuuaacuuuaaaugaacuuugggaauacuauuuauaaauaugucagcaacuuuuuuuguuaugcuauuuuugaaauuugaauugaucaguuuaggauuuuagcuucuuuucaucccccaucuuuauugagguaugauugauuuaaagauuuguauauauuuugguguauaacuugauauaaauuaagucauauugauuugcuuuuuuuuuggcuuugcuucuuuuucacauagaacucugcccuagaaaucacucuacaucaguucuuggagcucacugucauugauuuucauaguugcauaguacuccguuguacgaauuuaucauaguuaauucaaccauucuucuauguaaggauauuuagguuguuucaguauuuuguaaguacuaacaaugcuauagugaauagacuuacagacguguauuuuuguauuacuggagguauauucaaguuuuuuucuugaugucuuuauguauuccuaaaguuuucucuuuaauugugagaaaacuggaugcugauuacuuuuuaaaacauuaauaugcuggaaaaagccuuuuauuaaccaacucaaucuuuauacugcuaccaguccucuacucauuauucggcgcuauuugccucaaauaaaaacacaucaucuuagcaugcauuccuuagaagcaggcccugagauaaagauuuacauaaaggugaauuauuaggguauguucccagagaaaaucaguaggggaguagagaugugucaugaagccaucaagugugcaguaucaagccaagucccagggagggucgcuuuggcuuaauccugcaggguaacccuggagacuguggucagaguuguccuggucagggccauggcaacuagaguauuuauacucccuuauuuguuggucauuggugaugguuggagguaggguugggaaagacacuucaggcacugucagcucuccagcauuuuagagguaggugcuccugcugugagugaaagcacauugcccaguaaugcuaaaaggauuugaggcaaucgaggggaagcacuguguccucugcuguuuguacuguagcagaacagacuauguaaugucaaugugguuguucacaauuuauauuaauaaacaauacagauggaacaucucugaacagugaauuggauaauaugauaacaacuaagaggucauaucaaggcuggccagcgaaauagcaugcuuuagccuucauuugaauaguauuuauauguguauaaacuaauccaugucaacacaucauuggcagucagauaaacuuauagauuauggcuguguugacacuucuguuuuuaauggaguauuuuccauuauuauuagggauuuuuuuuauacuucagaaaccuuguuuagaaacauacuaaagauuugucaagaaaacagucauaguuuaaauuuuguuaaacauggugcauguuauuuuaauggcuaacugcuccaaauauuugugucuauguuuacacacaaaucacugagaugucuucaaaaauacugauauaaauacucuuugcugauuauucauugauauuagcaacguauaauauagcaguauuagcaguguauaauuagaaggugucagagaccuaacuuaucacuggagaaaaugaaacauccagaagauaacuuuuaaaaccugcuggauaacaagucauuucuagauuccagaccaggagccuggccuuagaauuuccagguuauuguucugacaucuaauaacgaguuauuuugauaaaggaguaacuucaauuuaguaugugguuuucaugucugagauuuaaaguaguacauacacacaguaaaaacaagcaaaagaaauccagugguacuaaagguagacaauggagauuugaaagccucucuuucacuuaacccccaguuccuucauucuacugcuuagagauaccaacugccucaauuuauuauauguccucugagagagagagagauauguguagauacaugcauuguuuaaaaaugcagguauauagcauguuuuacaagcugauuugugguuuuguuuuuuacuuaguauacauuggaagauugggccagauccauccagacauauuuagcucauuauuuuuacuuuauguaccuauucaauuguauagcuauauuguacuucuauaaaaaacuauacccucuugaaugacaguuauguuguuuucagccuuuuucuuucauaaacaauacuggaauuaguaucuuuggauguagguauuugcccacacaugcaaaacuucaagaaauuuuuaucuuugccaaucugauaggugaaaauguauaauuugugguuuucaccugcauuuuuauaauuuuuuagcaucuguucucgagaaaagaugcuaaaaggagcuuucuuaaagcccuuaaaacccuguuucuugugaacuauuuaugucuuuugcccauuugccuauuugguuuuuucuuacugauuuguaagaguuauuuauauuaaggagguuaaccccuuguauaucauguauggcaaauauuucucccaguuaaucguuuuuuauuuuacuuuguuuauggcguuuuucucacguaaaaaauuuauuuuaauguggugagauuuagaaauggggugaggggugcacuuuugggguuuuauuuaggaaggcaucucccguccaauauuagucuugaaauucccucauauucccacucaauacuuuuauggauuuuuuuuuagaguuaagucuucaauucaccuggaauuauuuuagugaaauuguuauauuaauuacuacaaauuugaugucuuaaaaaguagaaauugauucugucacaguucuggaggccagaagucugaaaucaagguguuggcaggauuguacuuucuacagagacuccaggggaaaauucauucuaugccucuucuagcuucuagagguugccugaugccuugguucauagccacaucccuuuaauguugccuagucuucacauugccuucuccuuugucuucuccuuuacucucuuguaaggauacuuacaguagcauuuagagccaauccaagauaauccaggaguaucuccucaucucaagauacccuuuuuccaaaugagagaacauucacagguuccaaggaucgaaaguggauauuuuugagagaaccauuuuucaaccuaccauaguagaguucuaauuuacuuauuucaaguugguuuaaccaguugcuguagaacuuuuuauuguauaauuuaauuuuccucauuaaauugaaaugauaccuuuauuauaccuaauguacucaugaauuuuaaucaauuucuggguucucuguucuguucugucaauuggucuggcucugcaaguaucaauaccagucuucauuguuguagcgcugccuguucucauuauucuuaugagaaugugucuaucuauucuugcaggucuccaugacuuauuaaguuaucuaguaaccucccccucaaaaauuaaugaugcagacuugaguuauauguauauauuaauuuagauagaauuuauaauauuaguucuuucaaaccgagaacagaguugucuuucuagucaacaucacuauaucccucaguaguacuuuuaaguuuucuucacauagaccugucauauuuccuuuuaaguuuauuuuuacuuacuuuaucuuuuugugcuguuguaaguagagucuuuucuuacacuaaauuuauaacuuauuuguguauggaaauacugugcagcuacauauauguguguuauuuauauauauuaguuuuguauccagcuguuuauuguguuuucuuauauauauuuuaaauaauuuuuauucacuuagcuugggguguauagguauaaaauuauaugcaaguaguaaguguaccuccuccuuuccaauuuuuauaccuacuauuucuuuuuaucugauugcacugacugcugccagaacaauuuaaaauaaccaucagugauagugcacauccuuuuuucaauuugaacuuuaaaaggaaugauucuauuacguuaaaccuuacaaaauuuuccuuuuuguaggugaaaaaaucaaauaucagcaguuuuauauuauucaaucuaaugguauuuccacauaaaaugugauaauguuugaaaacacacaagauguuaagaauccaauucuuuauuuauucaugcaaaagagauuuacugaacaccaacuauguguuagauacuguucuaaguuguagggguacagccauuuuauggagcuuauaugcuaguagagacagacacuaaauaaauauauaaauauuaaaugguaauaaugcuaagaagaaaacuaaaagagggauauaucccuuuuauaaaaagauaaaagggggacauagauaaaagagggauaaaagggggacauagaguaaucaggcggagaaaaggcgcuauuuuagauacaguggucagggaagaacgucuacaaaaguuaccuuugaccugagugaaaugagggagugagccaugcaaauaccuaggggaagagcaucccaugcagcgaacacaagaggccuuuacugaauuccuucaucucuaugaaagugaucauggaauuuuucuacuucgaucuaugaaugggaugaauuauauuacuagauuuccuaacaccgagccauccuggcaucuuugauacgaccguuauaugauuguaguuuauucuuucuaagguguuagacuggcuuccuaaaaauuuuguguauuuuucuuuucuauauguacccucaaacuguuuugaauacauuugaacuuauccauuuuauaaagauuugauagaauucaccuguaaaaugugaaagcuuuuguggaguggagggugaguaguaauuccuuaauuuuucucucuuuuccauccccuccuggcaaauagucuauucugaguuuucugacucuucugaggcugcuugguaauuaauauuuucuuggacagucauucauucagauuuucaacuuucuuuaaauaagaauuaauugcagcugaaaguguuuuuguucacuuucaaaauaucuaaagauauuuuucugcauuagagaugauucaguuauguuuacaaaugaauucgugcuagcauaauagcagcucuugcaagguagguagaucaggcauugucauauccucacuuuacaugugaggaggcuguagcuuagagaucugcaauuaacaaugacugaaacuagaacuagacauuaguucucuugaucccuaaccuaaugagcuuugcagaggacugcacucucuuccugauacacaccuuucugccgcugcauuuugcuaucaucucuuugcuuccacccaauuucgucaccuugcauuuguugcauacuaaguucauggcacugucugucuguggcauguaauuuguuagcuaggauugcagugcuauuucuccuguguucaccugcuagaguauacuguuuacugccaaguagcaaaguauuugaaaggaagcuaauauuuaaaaggaucuuuucguaaaggucacuguaauugagaaugugugucugguugguuuuuuuucuucacugcaauugacuucugucagugaugaaaugaagauuuauuuaccauaucucgcuuuaucacagaaaagcacaauuagacauuccacaaaugugccugccuacacaugacauacacucaccaauauccacuggugaugauaacaaagagucuuuaaagaguuuacauuuauagauuauuuaaguuucauuccuggcccuagcaauguaacagccaugaaaauuuucaaacacagcaggaucacagaggacucuuguucagcuacacauaggcagauucaguuucaguuucuuguaagaagaugcugcuggagggagagaaaaggagcuggcuggggaaugggcaggauguagauccagaaagcuauuagcuuacacaucagacaaggauagaugugugugggagccuggacccuggccagcagccugacagaaugacagcucugucaaccacgucacuuuucuugccagauaggcugccauuauuugcugguucggucaacuuaauuuucagugugcauaucuugucugauauuggauauaugaauauguguguauguauguguuaaaauaucauucccaccuauaaaggauccauuuaaagucauguugaguuguaggcaauauuuaaagaagccacucugugagcaagugaagguuuauguguuauuugugucaggaagaaucauaaaugcacagagagaaaauauauuuuuuccagaguuauauuuaggugacuaauugucacucuccacuguauuccuguguagaagccaauguuucugaaagugguuuugugaacugccugcaucagagcgguguauguaguuuuuuuuuuuuuucuuuuuuuuuugcgguggggggguuguuuaaaaaugcagauuucuggacuccauccuaaaccaacucaagggggcuuugugggauuaggggugggaaucugaauauuaagaggugcccugggugauuguuuugcacacuuauguuugguaauaguaaaaaguaauuauggaaaacaacaaauuauucuguaauaguacaaaaguaauuaugaaaacaagcaacaaauuauucuuuaauaguacaaaaguaauuaugaaaacaagcaacaaauuauucucccuuaagaaaauucaaauuuacugacuagauuauuucaauuauagaaauucauagugaagaaauauuauuugcuuaauaaaauuauuuccuuuaaaaaguagcaagcugcuauauuguguuuaacauaaaaauuaauuuaccaaauauauucuacauacugcuuuugggaaauacaucuauuauaugaagugaggaacaccugauauccaaagcaagguauauaauaauaaugauacuuuuauuuuacuuauacuaugccaggcuuguuuuaaaacuuuauauauauuauuaauuuaauccucacagcagcccugugaggcaaguguuauuauuguccccauuuuaccgauaaggagauugaggcuuauaauuugaccaaagccacagagguagcagguggcaaaacugggauuugaaugcaagcauucuggcuucagaaucaagccuauaacuguaacuaaguacaguguacugcuuuucaucauaaagcaacugguaguaguuauuagaaaacuugaguaauaguaaagcuaaaagaucauuguaugagccagcaugguguaacagagggaacacuggacuaagaaucagaaguccugagauuuagcuucagcuccgccacccccuggcgaguuaccuucacugaggcuguuuuccugauccaugaaguugggcagggcuacaccaaugccaagcuuucgugcauguuuuuuaauagaaauuguggcacacaguuauauaucuuauaaaugggaacuuauuaagagagugcuuuggugauaccugggcugucucaagccuguguguucuucaaagauuuugucuuuguaacuuguuuauccauuuggugauaagguagcuaauggcaauuuuguagaauucuguuucucuuuuccugucucuuucuuuguuuccuauuuucacaguuuccguaggucucauguauguucuuuuuuccaucuucacagucuuugaacucucacacauagcauaaugagucaguauacccuauuuaugagccugagauguguuuauuuucuaaaauauuauauguucauuuccugaagaaaauagaaaaugcuuuaucuagaaacaucuuguugccuagugugccuaauauuuaaaaaaaaaaaaaacaaacaaaaaaacaacaacuucgauuagcucuucaccaaaaaaaggaaucauuucaaguggaauuuuuuggucaaggcuuuuauuuaaucuuaauaauucugcaauugugaugacugugucagaguucaucugggccauauucauucuaacaggguuaacaagugugucagauugaaagucauggcuauaauugacuuuggcuuugagguuuuccuucauaauaaacaaugggcccugagccaaaaaagcuugugguuuauacucaugugcugaugacuaaguaaugcaagugauuucgccucauacuugcucuguuacccuggagcucacuuuaugcuuuuugaaggaaucauaucagaggaacauccauaauuaaaaagaauuugaccuguggacuuuccacugcagcugaaaacauuuuguuacagugaagacgacuucacucuggccugagugcuagagaagggccguguagaagacauaggucaaagcuuaaucagaagagaaaggacaguccuguaauacuuugaaucucucacacaaacaaugcaccccaaaaaugcccuuuuagaagauugcagagggacucuuuauucauuacuggcugcucuacacaaaauuccucuggauggaagcacugaaggugggacuugcuuucuguugaguuucuguuauuuuucuguagcauacaguugcuggaaaagacucacuuuguaaaaauaaucuugagaaucaguuuuccaaaaaguaucaaggggaaauuuaaucagcacaaaguaucagcuauccagaauuuauagauuugagaaagacauuugcuuaagcuuuucuguuugcuuuaugaaaucauauuaacuauuagcaaaugcagaguuaccgaagcuaaagcaaaauaaaacaaaaaaccuuuuagccuucccuuguuugcuuauuuaaugauuggcagcaaugaccacguugaugucuaaucugcucuccuuuucuugguaacucuaguaaacaaguugacauuuauaaucaaguggaaaauguuuacucuuccccagaugaguuacucaaacuggaaaaugcaagguucacaucagcccucuguaaguuuagguuuuuaaauuagucgucagaaacauggguaagugugggccauaaaccaguauauggaauagucugguuaaagcugacuucguuaagguagauacuucacucauucuccagugaggcuugcuagauccccauuaaccuguuguacacccacaguaauuauauauuuggcugaauggaauguuccccuuaccuacuuuuccuucgagucaaucccuuuauaggcuuuugcuuuuguuuugggcaagggagauaaucugccaugaggcaguaagcuugaguugauaauuucuugucucuugagaaaugagguauaaaauucugaaagaauuguuagcuagaagacacagaauggguaggugacagaauugcuuucuggaagugguggaguauauuucuugcaauuuguuuguguauuucuuauguugcugucauguuuuuagugucuauuugauuuguuggguucuacucuuccuuguggaagcacccaacagaauauuucuuuuucauauauauauauacuuuaaguucugggauacaugugcagaacauacagguuuguuacauagguauacacgugccauggugguuugcuguacccaucaaccugucaucuacaauagguauuucuccuaaugcuaucccucccccagccccccauaccccgacuggcccuggugugugauguuccccucccuguguccauguguucucauuccaacagaauauuucuuaacaucaguguacaaauuccauuucuucaagcagcccagaaaggaaaccauuuuuguggccagugacgauguaaaauagaggguuuguugguuguuauuguuuuuauuuguuuccuguuagcuuuaaaagugggaauuuguggaccagcuuuuaaguguuuucaaauccauuaacauuuuaucucuuuguaucugucguuuuacuuuugcuugauguuguugauuuauuuuuauaguaguuuucugugccaagggcaaauuagaccaucccccagggaagaaaucuccugguucuaguccuaacauugcuagagguugccuaaucaucuguuccucauuguuuugauaaaguggugacuaaagaaauccauuuaaaauguccuagauagcucugaauugaguuuuuaaaauauuucucauauguggauuucuaaacguuuucaaaagaauaacugcuggaaauaaauucaaagauaaaaauugccaaaaagaaagaauagcuacaauguuuaaagcuaugauucucucacuaugcuccuacaaaacacugguguuccuuaggcuugguagagauguucagugugcuaaaguugaauacucuuuuuuugaagaaccuagucuuuauucagcaaacaacacacagcucuuauuaaagguucugaauuaugcuguaagaauguugguuuugagggcaggauggauuggaaugagagaaaauuccuucugugggccauacuuugcuucacuuccccaugccuaacuccccaaaaucaaagaccacuccuuuaaggaugggccugagaguguaaccccaaauuuuauucuuucacccacucuucaguagcaucauacagggccaauuuuuccagauaugagaaauauuuucccauaguuggaggaagcucaucauguguaaaaguuuguuaaaaauacaaauucuuacuccacagacuuguuucaaagcccuguuuuucucccuucuuugccaagcuaggggagggauggagcucucaagagguacugcucacucugguccaccagccagugcugaugagguaaauguagaauucagaguaacacuuuggacauuuuauagcaauuugauguaucuguugaaucuaauaaaaaccuagauuuguauuuuguagucuuuaaauuuuauguuucuagaaauaaaauauuugucugcagaguccuggaaauuagaaaacaaagacuggcccuccaucacagaugguuugagaagcaguacccuaggcacugcucuagguuggaggcuaaggcccucuccaaggcaccuccuuuuugucccaggaaggggauuuguucuuccuuacucccaagcccaagagccuaguucuuuuuuuuuuuuuuuuuuuuaauuuaaaaaggucuaauuuugguagaauaaacaugagauaaaacuuacuaucuuaaccauuuauaaguauauaguucauuaguguuaaguacauucacauuguugugcaaacucuccagaacucuucaucuugccaagcuaaaacucuaugaaaccagcugucuccaaccuuuuuggcaccagggacuaguuucguggaagacaauuuuuccauggaaugggaguggugggauaugguuuugggaugaaacuguuccaccucagaucaucaggcauuagauucuuauaaggagcucacaaccuagauccgucacaugugcaguucacaauaggguuugugcuucuuugagaaucuaauacugucacugaucuuacaggagguggagcucaggugguaaugcucacucgcccacugcucaucucaugcugggcagcucaguuccuaacaggccauggaccaauagcagucuggggguuggggaccgccugcauuaaacaacucuccauuucacccuccacccaguuucuuguaagcaccauucuacuuuuuaacucuauggauuugacuacuguagguaccucauauaagcggaaucaaacaguuuuugucuuucugugacuggccaauuucacuuagcauacugucuucaggguucaucuguauuacagcauguuaucagaauuuccuuccuuuuucaggaugaauaauauuccauuuauguauauaccauaucuugcuuagcuaucaauguauaguugaguugcuucuacucuuuggcucuugugaauaaugcugccaugagcaaauaucucuuuuauguuuucaguuuuggaggguauauacccagaaauggaauugcuggaucacauggcaguucuauuuuuaauuuuuugaggaaccacuacacuguuuuccauagugucugugccauuuuacauuacuaucuauagcaugcaaggguuccaguuucucugcauccuggccaauacuuguuauuaucuguuguuuuuuuuuuuuuuuucaacaguagccauucuuguggugaggugguaucucauugugguuuaggucuguacuucccuaauuauuaauggcauugagcaucuuuucaugcacuuucuggcuauuuguauaucuuuggagaagugccuauucaaguucuuugcccauuuaaaaaauuuuuuuauuguuguuguuguaggaguucuuuauauauucuggauauuaauccuuugucagguauaugauuugcaaauauuuucucccauucugccuuuucacucugucaguuguguccuuugaagcacagaaguuuuuaauuuugauguaguccaguuuaccuacuuuauucuucuguugucugugcuuuuggaaucauauccaagaaaucauugccaaaucuaaugucuguguuuucuucuaugaguuauauaguuuuaucucuuaugguuaggucuuugauccauuuugagguaauuuuuguguaugguauaaguugagguucuaacuuuguuguauguggauauacacuuuugccaacaccagguguugaugggagcugaguucuuauucucaauuauuccccuaccugaccaacagaaugaaaaaacaggugguaaacaagcauugggaaaauugccaggaaaaucuagaguuuauugccuugguuuuuccaauuuggggaaaggggaccauuacaacuuucaaguuagaugugaugccuugaaauaucacaugaaauauuacgggcagggccaagauggccaauucaaagcagcgguguucagaggcucccauuggaaaaaaacauaauaagcaugugaauccuucaccagcagccaaggcauccagguucucucaucaaaauugacuagaaggcuggugugucccacagaaggaagggcauguggcgcagcaacccacuugagagccacacggggaaggggaaccccccucccccaagcuaagggaggcggugagugaacacgcuauccagcuggggaaacugcuuuucccauggaacugugcaacccacggaucagaagaucccacuugcagacccaggccaguggggccuagcauccuaaccccggaaugugcagaugugcagauucuuacagccucucagcuggaaucugcuuaagccuaccgaauucccaggggaaggggugaccagcacuggcuauggcugccugcuauuuggcuccuugugggaggggcagcagcuagcacugggacuagcaacugccuaacacgcuaagcucucuggguaggggaagggcagcacccauuucuauaacuccaggcugcauuuuuccccugcuggagccaggaaggcuagacggcuuggucccaagacuuguccccacagcccaacacaccggcuguggcagucuguggccagagugccucuucaggucuaacccugaccuauucuuccucaguggucauggcuucccugcaugaucuccaauaacuccagccagaggcucagggacagaauugggaucucccugggccugagccccuagcaggagggguggccuuagucuuugcagaccaacagacuuugccuuuucuccugguaguucugaggaauccgggcagcccagacgaguggguuuccccccagcaaaacacacccucuccaccaagggacaaagugcuucguuaaauggguccugcuccccaugccacccaacugggugagacccuccaacagagauugucagacgcccuauacaagagcaauucuacuggcaucagguuggugccccucgagguuagaggucccagaagaaggaggaggcacccaccuuggcugcccuccagccuccuugagugacaucuccaggcaugggagcgaaucagaugaauggagccugaagugaacccccagcaaacugcagcagcucuagagaagaguagcccugauuauugaaagaaaaacaagcagaaaguaacaacaacagcaucaacaacaacaaaaaggccccacaaaaaccccauccaagggucaguagccucgaagaccaaaacuagacaaacucaugaagaugaaaaagagucaacaaaaaaaugcugaaaacccacaaggccagagugccucuucuccuccaaaugauugcaucgucucuccauuaagggcacagaacuggauggaggaucagagggacaaauugacagagguaggcuucagaaaauggguaauaaaaagcuaugaugagcuaaaggagcguguccuuacccaaugcaaagaagcuaagaagcuugauaaaauguuggaggaggaauugcuaaacuagaauaaccaguuuagagaggaacauaaaugaccugauggagcugaaaaacacagcacaagaacuuugugaagcauacacaaguaucaacagccaaaucaaccaagcagaagaaaggauaucagaguuugaagcccaccuuacugaaauaagacaugcagacaagaauagagaaaaaagaaugaaaaggaaugagcaaagccuccaagaaauaugggacuucauuaaaaaaacgaaccuaugauugauuggaguaccagaagaagauggagagaauggaaacaagcuggaaaacacacuucaggauauuuuccaggagaacuuccccaaccuagcaagacaggccaacaugcaaauucaggaaauacagagaacaccacuaagauauuccaagagaagaucaaccccaagacccuuaaucauuggauucuccaaggucgaacuguuaagggcagccagagagaaaggccaggucaccuacaaagggaagcccaucagaccaacagcagacuucucagcagaaccucuacaagccagaagagauugcgggccaauauccaacauucuuaaaggaaagaauuuucaacccagaauuucauauccagccaaacuaauaagcuucauaagcgaaggagaaauaaaauccuuuccagacaagcaaaugcugagggauuuuguuaccacgaggccugcacugcaagagcuccugaaagaagcacuaaauauggaaaggaaaaaccaauaccagccacugcaaaaacacaccaaaauauaaaaaccacugacacuacgaagaaacugcaucuagugugcaaaguaaccaaauagcaucaugacaacaggauugaauucacacauaacaauacuaaccuuaaauguaaaugggcuaaaugucccaauuaaaagauagacacagacuggcaaauuggauaaggaguuaagacccauuggugugcuguauucaggagccccaucuuaugugcaaagacacacacaggcucaaaauaaagggauggaggaaaaucuaccaaguaaauggaaagcaaaaaaaaaaugggaguugcaauucuagucucugacaaagcagacuuuaaaccaacaaagaucaaaaaaggcaaagaagggcauugcauaaugguaaagggaacaauucaacaagaagagcuaacuauucugaauauauauguauccaauacaggagcacccacauucauaaaacaaguucuuagggaccuacaaagagacuuagacucccacacauuaauagugggagacucuaacacuccacugucaguguuagaucaacgagacagaaaauuaacaaggaaauucaggacuugaacucagcucucgaucaaauggaccuaguagacgucuacagaacucucuaccccaaaucagcagaauauacauucuucucauuuccacauggcacuuauucuaaaaucgaccacauaauuggaaguaaaacgcuccucagcaaaugcaaaauaacugaaauaauaacaaacagccucucagaccucagugcggucaaauuagaacucacaauuaagaaacucacucaaaaaccacacaauuucauggaaauugaauaaccugcuccuuauugacuccuggauagauagugaaauuaaggcagaaauaaagaaguucuuugaaaccaaugagaacaaagagacaauguuccagaauuucugagauauagcuaaagcaguauuaagagggaaauuucuagcacuaaaugcccacauuagaaagcuagaaagaucucaaaacgacacccuaacaucacaauuaaaagagcuagagcggcaagagcagacuaauccaaaagcuagcagaagacaagaaauaacuaagagaagaauugaaggagauagagacaugaaaaacccuccaaaaaaaucaacaaauccaggagcugguguuuugaaaacauuaacaaaauagauaaacugcuagcuagacuaauaagaagagagagaagaaucaaauagaugcaauaaaaaauaauaaaagggauaucaccacugaccccacagaaauacaaacuaccaucagagaauacuaugaacaccucugagcaaauaaacuagaaaaucuagaagaaauggacaaauuccuggacacauacacccucccaagacuaacccaggaaaaaguugaaucccugaauagaccaauaacaaguucugaaauugaggcaguaauuaauagccuaucaacuagaaaaagcccacaaccagaugauucacagccaaauucuaccggaaguacaaagagaagcugguaccauuccuucugaaacuauuccaaacaauugaaaaggagggacuccucccuaacucauuuuaugaagccagcaucaucuugauaccaaaaccaggaagagaaacacacacaaaaaagaaaacuucaggccaaugucccugaugaacauugaugcaaaaauccucaauaaaauacugccaaaccgaacccagcagcacaucaaaaaacuuaauccaugucaucaagucagcuucaucccugggaugcaaggcugguucaacauacguaaaucaauaaacauaauccaucacauaaacagauccaaagacaaaaaccaaaaacauauuuacaagaaaaaaacaaaaaagugggcaaaacauaucaacagacacuucucaaaagaagacauuuacguggccaacaaacguaugaaaagaagcucaacaucacugaucaucagagaaaugcaaauaaaaccacgagauaccaucucacaccagucagaaugaugauuauuaaaaagucaggaagaauaaaugcugggaggcuguggaaaaauaggaacacuuugauuaucucaguagaugcagaaaaggccuuagauaaaauucaacaccccuucauuuuaaaaacugucaauaagcuagguauugauggaacauaucucaaaauaauaagagcuauuuaugacaaacccacagccaauauuacauugaaugggcaaaagcugaaagcauucccuuugaaaacugauacaagacaaggaugcccucucucaccacuccuauucaacguaguauuggaaauucuggcuggggcaaucaggcaagagguauucagauaggaagagaggaagucaaguugucucuguuugcagaugacaugauuuuauauuuagaaaaccucaucaucugaaccuaaaaacuucuugaacugauaagcaacuucagcaaagucucaagauacaaaaucauugugcaaaaaucacaaguauuccuuuacaccaacaguagacaagcagagagucaaaucaugaaugaacucccauucacagucacuacaaagagaauaaaauaccuaggaauacagcuaacaagggaugugaagaaccucuucaaggagaacuacaaaccacugaucaaggaaauaugagaggacacaaacaaauggaaaaacauucaauccucaugaauaggaagaaucaguauggugaaaauggccauacuacccaaaguaauuuauagauucaaugcuauugccaucaaacuacuguugacauucuucacagaauuagaaaaaacuauuuuaaauuucauauggaaucaaagaagaaccccguauagccaagacaauccuaagcaaaaagaacaaagcuagaggcaucacguuaccugacuuuaaacauacuacaagguuacaguaaccaaaacagccauauagaccaaugaagcagaacagaguccucagaaaccuacacaucuacaaccaucugaucuucgacaaaccugacaaagacaagcaauggggaaaggaucuccuauucaguaaauggugcugggaaaacuggcuagccauaugcagaaagcugaaacuggaccccuuccuuauaccuuauacaagaauuaacucaagauggauuaaagacuuaaauguaaaauuccaaaccauaaaaacccuagaagaaaacccaggcaagaccauuccuaggacauaggcaugggcaaagacuucaugacaaaaaugccaagagcuauuguaacaaaagcuaaaauugacaaaugggaucuaauuaaacuuagagagcuucugcacagcaaaagaaacuaucaucagagugaacaggcaaccuacagaaugggagaaaauuuuugcaaucuaccgaucugacaaaggucuaauauccagaauuuacaaggaacuuaaacauauuuacaagaagaaaacccaucaaaaagugggcaaaggauaugaacagacacuucuaaaaagaagucguuuaugcggccaagaaacaugaaaaaaagcucaacaucacugaucaccagagaaaugcaaaucaaaaccacaaugagauaccaccucacgccagugagaauggugauuauuaaaaagucaggaaacaauagaugcuggcaaggcuguggagaaauaggaacacuuuuauacuguuggugggaauguaaauuaguucaaccauugagguagacaguauggcgauuccucaaggaucuagaaccagaaauaccauuugacccagcaaucccauuacuggguauauacccaaaggcauauaaaucauccugcucuaaagacacaugcacacguauguuuauugcagcacuguuuacaguagcaaagacauggaacuaacccaaaugcccgucagugauagacuggauaaagaaguauaguauuccauguggaauacuauacagucauaaaaaggaaugagaucuguccuuugcagggacauggaugaagcuggaagccaucauccucagcaaacuacacaguaacagaaaaccaaacgccucauguucucacucauaagugggaguugaacauugagaacacagagaggggaacaccacacaccagggccuuuuggacguuggggugugagggaaaggaacuuagaggacaggucaugcagcaaaccacauggcacauguauacugauguaaugaaccugcacauucugcacauguauccuguuuuuuuuuaagaagaaaaaaaauauuaugcauacguauaauguggccauuuugcuggcaacauuaugauuaguucaaaaguagaaauuaaaugucauggaguuuugcaaaaaggacuaugauguuuaacugucuuaccuuccaaacaacuuaauauucccuacauuuuaauuccuaguggggaccaaggaaacuguugugaucuagugauuagaaaugacaguugaagugacccugaugcaaacauuuacucaaugaauuaacugaguucaauacuaggugaaaaaaaaaaccaaaaacgcaguaucuccuuugaaaaacaaauauuuguccuuuuucuuuucucauggcugcuaggaaauucagugcuaaguuuaaugcucaauuacccuuucauuccuugguucuuuauuuucuaccaauuuguuuuguuuuuaguuucuuuacaaaucaacuuuauugagguacaauuuacauacaauaaaauacaaaauguacccauuucaaguuuugacaaaugcauacaccuguuaaucaccauuucugucaagauuauagaacauuuccaucccaccaaaacauccucucaugccucuuucuagcuguuguuauguaguuuuguugauucugugcccuuugauguuagccaucaaccuccuacggauacuuuuggaagguggaauauuaaaaagacuaauaucuuggcugggcguggugacucaugccuguaaucccagcacuuugggaggccaggauggguagauugcuugaggccaggcacuugagaccagccugggcaacaugagcaagaccaugucucugcaaaaaaauaaaaaaauuaaucagacaugguggugcacaucugcaguccuagcuacuggggaggcugaggcaggaggaucacuugagcccggaaguucaguuacagugagcuaugauugugccacugcacucuagccuaggugacagagaaagacccugucucuaaaaaaagagugauaugguuuggcuguguccccacccaaaucucaucuugaauuguagcucccauaauugucacaucaugggaaggaccuagugggaaguaauuucccaugcuguuguugugauacugaaucucacaagaucugaugguuuuacaaaggacaguuccccugcacacacucucuugucugcugccauguaagacauaacuuugcuucucauuugccuuacaccaugguuguuaggccuccccaggcagguguaacugugaguccauuagaccucuuuuauaaauuaccuagucucagauaugucuuuauuagcagcgugagaacagucuaauacagagaauaacaccuuaaaugaaauaaccuuuuuggacucuacauuucuuccuguaauuugccauuuaauuuccuuuuuuauauacaagaaacuagcauugcaauuucuuaguacuuaaaucucauuacaacuaacauugaugagcugguguccuacgaagcauuuucagauauccuuggaagaccuuguuccuuuuuuucccccugagaaguuaaauaucuaauucaaaggauuuuuuaaccuggacaaauuuguucuugaacagguuuauccauaccuaacuggucagcaucuuugccagaagaugaaauauguaauaagcaccaauugccuuguuguagcauguuagaaagccaguuaggaauucagcaacuuauggccuaucaaaaccuguagcugcuuuucgaaauuuaagagcugugaccuguuuauagauaucauaacagugucuuaaagugacaacaagaaguuuaaccaacuggguuguguauggggacagcuuaggcucuagguaggugugugagguaacuggagagacaggaauaaugaucaacuuauucacgagcaauucuaguacaugacucaugucagacaacaucagcaugaguuguggaugguuuaugcuuuuuccccaggauaauaaaaaagcagcaagagggaauauaaaguuuauccugguuuucuugccaaauaaaaggaauuauaguugucauuauuuuuaccauucuggaauuacguggauauaaugauucuaaaugaaaauacaagccgaaauauauaaccugcagaugugcuuuaauguuucuucauaaugcgauagagcuguuuuuuaaaauaaaaucagaguagcaugaccaaaaggggcagacauuauaaccacuugacauuuucuuggagauauuucuuaugugaguagugugaaaagggaugucauugaaccgguauguuuacgaagcacagaaagucuuugugcagauugcuugagguguguggcaguauuacagccauguaucagugauguauccuaaaaugcuuggcauuuccaugcauugggcugaguguaggaaugcgggggauauucguuuucuuugguuuuuauuuuugcaggcucaaauucauuagauaagaaaacaaacucauauuuucccauuuauguguacuauaaacacauauuuacacuacugaagccuagggacaacccagagagcuuaauaaauggucuuaauaaagaucauguagauucuugcuuggugacuguaguucguucuuccauacggucccaguuacccagaguuucagguggagggugguuaggaugggugaaguuccacugaauuugaugcauuuucauuuuauuuaaggaaagaacaguguguauguacagucugccacagaggguaaaucuuuaaaagaaucuuuugcucuuuuccugaacauaauuaaauuuccauuaucuuuuucuuugccagaaguuuaaugauuuauauuuaauaauugaguuguaauuuauuccccacauuugcucccacuugaugaaggaagcaaaaucuaauguaacaaauacuuucugacuaaauuuuuccuucucuucuuuaacuuuucuuuuaggacucagcccaaaaccauguuugcccaaguugaaucugaugaugaggaagcaaagaaugagccagaauggaaaaaacguaaaauuugaagaaucucauuugagagcuguuugcaugagugggagggguaugggacagguuuggguuuuuuuuuuaugcucaugaaauuaaaaauucauuuuuaugaa

SEQ ID NO: 192530 - RNA, 78947 nt, Homo sapiens
gacucucgccugacuuccuaauuugcuacuuauccccagcguuggucccggcgaggauaugcugagauuuauggcacuguuggcugcauuuuuggagaacagcaagcagcuucuuuucagguuuuuuccuuuccucacuuucuucauuguagauacuugagagggcaagagugaagagcaagcucccaguugaagcagaaagaggcaaagaccucaaccuuaaugagcuucucgccgcucucaagugcuuauggcuaaggccauaugagaagcaucuccagauccaagucccaaauuuguucauuucuccuguuaguguuugaguagaucguaagagcaaacgaaguuaauuuggaaauuuagcauguuaucuuaaagauacgcuuugcuuuauauuuauuuguuuauuuauugagacggagcgguucccucuucgcccaggcugaagugcaauggcgcgaucucggcucauugcaaccuccgccuccuggguucaagcgauucuucugccucagacucccaaguagcugagauuacaggcgccugccaccaagcccggcuaauuuuuguguuuuuuaaguagagacgggguuucaccauauuggccuggcuggucacgaacucugaccucaagugauccgcccgccucggccucccaaagugcugggauuacaggcgcaagccacugcacccggccaagaaacgcuuuauuauguguagagauguguguuaugaaaugcuggaggaucuuaaaagaacuaccaguggaauaaagaaagagaacagggaaaucacagugcuuauguacagggagaguaaggcagaauauguguugacaauauaggugacuggaaaguaauuuguuuaacaguuuuaaguuauaaccagcuccccacggcuuauggaauuacaucaguugcuagaaaaagugaccccuuugugagauggaauuuggagaaaaccagcgaaguguaagaaagaaaagauuguuggugagcaagaaccaaaguaaucuaaauaggauaauuugugcaguguaaaccgagaacacuucugauuauuuauaaaaaucauugauagcuuuguaaucaaagaaaugauagaaacaaagauaguauuugcucccuacagcuacuuaccaaugagcgugucuuauaauaccugauuggccuauuagcaauuaucaucuugaacaacauuacucauuuuggccuccuuaggugugaaaacaagauauaaaaacagugcaugcauucugguccuucucuuacauaucucaugccuuuacacacaccuuccucuuucacccagucucuuccccuucuuuuccauccaauuuuucauccguugcucugauuacagagaauuuagcauauuuuccguaagaagccccaucuucaggauuuccucaggauuuuaucuuacuuuuauuguuucugcaauguucuuuuuuugccugacaaacuuuuuccagacucccugugaaaguccuuaguuucucuuuguugucuuucuuuuucuuguucuuuuuuuuugagucaaggucuaguucuguuaccaggcuggagugcaguggcaugaucacagcucauugcagccucuaacucaugagcucaagugguccucccgccuugcccuccccaguagcugggacuacaggcgccugccaccacacccagcuaauuuuuaauuuuuauguagagacguagucucacucuguuacaaggcuggucucaaauuccuggcaucaagcaguccuccuaccucagccuuccaaagugcugagauuacagauguaagucacacuccuggccugaagucuuucguagcauucccauccucacuaaaguuaucgauuccucccucuguguucccacugccauuuaacauggugaucugccaccuucggccuauuaaaguuauguuuuaggauuaaaugggaugucuggauuugcuuuauuuauuuauuuuuugagacagagucuuacugucacccagccuggagugcaguuggcauaaucuuggcucacuacggccuccaccucccagguucaagcgaugcuccugccucagccuccugaguagcugggaucauagguguucgccacuggcucauuuuucuauuuuuaguagagacaggguuucaccguguuggccagguuggucuugaucuccugaccucaugugauccgcccgccucggccucccaaaguguugggauuacaggugucacccacugugcccagccuggauuugcuuuaauaugaauucagcccaauagucucagcacuuugggaggccaaagugggcagauuacuugagcccagaaguuugagaccagucuuggcaauauggcaaaacccagccucuuaaagaaaagaaauacaauaauacaaaaauuagcuuggcauggugacacacacuuggacccccagcuacuugggaggcugaggugggaggauaacuugagacggggagguugagacugcagggagcugugauugcgccgcugcacuccagccugggcaacagagugagacccugucucaaaaaaaaaaaaaaaaaaaaaaaaaaaaggccuggcgcugugccucaugccuguaauccuagcaauuugggaccuggaagugggguggaucacuugagcuugaguuugagaccagccugagugagcaacauggcaaaacccugucucuacaaaaaguggcugggugcgguggcucacgcccauaaucccagcacuuugggaggcugagguggcagaucacgagguuaggaguucaagaccagccugaccaacgugguaaaaccccgucucuacuaaaaauacaaaaauuagcugggugugguggcucauggcuguaaucccaguuauucaggaggcugaggcaggacaaucgcuugaaccagggaggcggaaguugcagugagccgagaucgcgccacuguacuccagccagggcaauagagggagacucuuucucaaaagaaaugggaggcccaggugggcggaucacgaggucaggagaugagaccauccuggcuaacauggugaaacccccaucucuacuaaaaauacaaaauaauuagccgggcgugguggcgggcgccuauagucccagcuacuccggaggcugagacaggagaauggugugaacccgggaggcggagcuugcagugagccgagaucgcgccacugcauuccagccugggcgacagagugagacuccgucucaaaaaaaaaaaaaaaggaaaaagaaaaaugcuguuuggcugggcucggugguuuacuccuguaaucucagcaauuugggaggcaaaggugaguggaucacuugaggucaggaguuugagacuagccuggccaucauggcgaaauccugucucuacuaaaaauacaaaaauuagccgggugugguggcacacuccuguaguccuggcaucucgggaggcugaggcaggagaaucucuugaaccugggaggcagagguugcagugagccgccauugcacuacagccugggcgacagagcgagagcccaucccaaaaaaaaaccccaaaaacaaaaaaaaaauuagcuaggcauggugucaugacacuguaguccuagcuacucacgaggcugugguggaagauugcuugagcccaagaggcugagguugcccugagcugugauugcaccacugcauuccagccaaggcgacagagugaaaccccgucucaggaaaaaaaaaaaaagagaaaaagaguucggccgggugcaguggcucacaucuguaaucccagcacuuugggaggccaaggcaggcggauuacgaggucaagagauugagaccggccgggcacgguggcucacgccuguaaucccagcacuuugggaggccgaagcgggcagaucacgaggucgggagaucgagaccauccuggcuaacacggugacaccccgucucuacuaaaaauaaaaaaauuagccuggcguggcaacaggcgccuguagucccagcuacuugggaggcugagacagaagaauggccugaacccaggugguggagcuugcagugagcugagaucaggccacugcacuccagccugugagacuccgucucaaaaaaaaaaaaaaaaagauugagacuauccuggccaacauggugaaaccuugucucuauuaaaacuacaaaaauuagcugggcgugguggcucaugccuguaaucccagcuacccgggagucugaggcaggagaaucccuugaaccagggaauuggagguugcagugagcugagaucgcgccaaugcacucuagcuuggcgucagagcgagacuccgucucaaaaaauaaaaauaaaaagauaauuggggaaggagugaacaaugauaaaaaugaaacaugauuggggauauuacugguuauuaaguuggauaaucaguacauggguauuuauuguauuuuucuuauauauauuuuaaaaauuuccauaauacacuucaagauuguuuuauaugucaguuuuccuuaacaucuuuguacucuauagaaccugagaaagugccugagauaaguaggucaucagucaggucuaaauaacgccuuguccgggagcaaggguaggcugaguagaccagcccacuccuguccuuagugauggagucuuagagcaagagaaagguugcccaugagaacacuuuauagagcagucuuuguuuuuauccccccaauaagauacugcuugugggguauuauuuguauuugucuuaguggucuuggggauaaaucuaaagggaaaagucauggguuguuuuaaucuauaaauguuuagcugguaaaggcaguauuuucccccagucauuauuuuguuugcuuauagucauuuuaccuuugagccccaaagcaguuuuauauuuucccauuucagauuagcaaaaugauagaaaaacacuaaauuauuauuuuuaaauuuuuuuauuuuuaauuuuguguguacauaguaggcgucuguguguguguguguguguguguguguguguguguguguguauauauauauauauuuuuuuuuuuuuuuuuuuuuuuuuucuccccgagacagagucuugcucugucacccuggcuggagugcaguggcacgaucuuggcucacugcugccuccgccucccagguucaagcaguucuccugccucagccucccaaguagcugggauuauaggugcuugcuacugugccuggcuaauuuuuuuguauuuuuaguggagacaggguuucaccauuuuggccaggcuggucuugaacuccugaccuugugaucggcuugccucugccucccaaagugcugggauuacaggcgugagcuaccgcgcccaacgguguauauauuuauguggugcaugagauguuuugauacaggcaugcaaugugaaaugaucacaucagggaaaaugggguaucuauccucucaagcauuuauccuuuguguuacaaacaauacaauuacaugcuuucauuuuguuuauuuauuuauuuauuuauuuuugagacagagucuugcccugucgcucaggcuggaaugcaaugacacaaucucagcucacugcaacuuccgccucccggguucaagcaguucugccucagccuccgcaguagcugggauuauaggcgcacgccaccaggcaggcuaauuuuuugugucuuuaguagagauggaguuucaccauguuggccaggcuagucucaaacuccugaccucaugauccuccuaccucggccucccaaagugcuaggauuacaggcuugagccacugcgcccagccacuuuuauuuuaaaauaacacuaaauuaucaaauuuaaacauuuccagcugggcacgguggcucacaccuguaauccuagccuuuugggaggccgaggcgggcggaucaugaggucaggagaucaagaccagccuggcuaacacggugaaaccccguuucuacuaaaaauacaaaaaauuagccgggugugguggcggacgccuguagucucagcuacuugggagacugaggcaggagaauggcgugaacccgggagguggagcuugcagugagccgagauugugccacugcacuccagccugggcgacagugcgagacucuaucucaaaaaaaaaaaaaauaaaauaaaauaaacauuuccuuuguuacagagcaaguuuuuugagauaugacuuucccuuuaggccugaaaccaguaacuguuccuaccuucacaagggaauauuucaggacuacuuuguguugggucaaaacuagaauauucucucuguaccuuuggaaccaacacacaacaauuuuuuuguggcacucaauccuuuuguuugcccgguugaugagcaguacauuauuauaaauacuucauuuucuuuuuguagauaaucccaccguuucuggcaugucagauauggauuauccuuugcaaggaccugguuugcuguccguacccaaccuuccagagaucaguuccauccgaagaguuccucucccaccugaacuuguugagcaguuuggacguauccuauuacuuuguauuuauuuuaaaaauguuaaaauugguauuuuucauucuuauaauucuuguucuauguuuaauuaauguguuauauauucauuuaaggguuuuauuuaaaauucguuuaaguauauggguuccauguuguauuaaagaguggacacauugugauuuuuuacguaaauauuaagucaaaagcuauugaaacaaguuaaagaagaauaagauucaccucugucugccuuacauccacacuaccucagauaugcaguguaauugcaugauggguguguucccuccuaucagcagagcuuggcucacaauugacagugauauauucauguggaacuaugaggauggguauguauuuaaggcugguuugcuuuaagggugauuggaauuuauauaaacuuuacuguagcuaguguucucauuagaagcugcuugguuuaucuuucauucaucuagccuuugggucagugcuucucaguaucagucaucuggagauguucaaaugugcauucugucuuaguaguccugagugaggcucaagagucugcauuucuaacaagcugccaacugcugcugcugguuuaggugccauucuugaguggcaggagcccgggucccaagcuguuagcccguaguaaaaauagauguuggcaauucauugagagaugauuggacauuuuuaaagacuucuguuuuccuugcauuucuauggaguaggcaugugauauuuauuuauuuuguugucauuuugugaauuugacccguguguaaauuauauguauagaaaugauucugagugaaagccuaagguacuuuugcuuaaauacagcauguuggucuggugaucucccuguugacuuuuuagagauagauuuuguuuuacuuccaguuguccauuacauuauccuuagaugaggugugggauaaacauaggaaagcccauauaauuaagauguuacucuuguuccugaguaauuaaugaucuuuuuaggaacacacgugcauuaaaaagacacuguaucggccgagcacgcugacucaaacgccuauaaucccagcacuuugggaggcugagguggguggaucaccugaggucaggaguccgagaccagccuggccaacauggagaaacccugucucuacuaaaaauacaaaaauuagccaagugugguggcacaugccuguagucccagccacucgggagcugaggcaggagaauugcuugaaccugggagauggagguugcagugagcugagauagugccacugcacuccagccugagugacagagcgagacuccaucucagaaacaacaacaacaaaacacuguauuauugaaacaaaauugaaacuaaaugacagcuuaacaccuauagcuuaaacgaaaccauuuuuuucuacuagaaguuucguagcaauuuuucauguugaaauguaauaguuguaauagcagugauguaugauugugauuauuuuucauguacccugaauguuccccacuuuguuauguuaccauaacauauucauuuuuauacuaaauaaugaaaccuuuuuuguuuagguauguaucuuuucaagagaagucauugcaaaaauauuacagaacagauaaaugugagaauaauuguuuucuuuaaaauauguuuucggcugggcaugguggcucaugccuguaaucccagcacuuuaggaggccaaggcaggcagaucaccugcagucgggaguucgagaccagccugaccaacauggagaaagcccaucucuacuaaaaauacaaaauuagccuggcaugguggcacaugccuguaaucgcagcuacucgggaggcugaggcaggagaaucacuugaaccugggaggcggagguuguggugagccgagaucgcgccauugcacuccagccugggcaacaagagggaaaacuccaucucaaaaaaaaaaaaacacuaaugaaauuuuuuacauuuccauuaacauccaacauauuuauuuaacacauacauauugaucuuauguaucugacacuguuguugugguaggaacaguacugaaugagaugaauguaguucugcccucauggaacaaacaguccuaccuuacugugugucuuaguccgagcugcuaaaacagaauaccauagccugugaucaacaugaauuucuuucucaugguucuggaagcuggaaguccaagaucaaggucuggugaaagcccacuucaauguucauagauggcuaucuuuucacucuguccucacauggcagagggguaggggaguucuuuggguccucuuuuauaagggcacuaaucccauucaugagauauacccucaugaccuaauaaccuuucaaagaccccaccuacaaauacuaucacauuaagaguuaggauuuaauaugaauuuuaggaggacacagauauuugauccauagcaguguguguucauuuaaagaaaaauuauuugaagaauguacuuauuuuaaaaaaucaaggcacaagguccacaaauucaauuuuguaaaauuuauacuuaguuuaaauauucaauuggcuuucuauuauaaauccuaauuccaccuggaugauaaaaauguaaucuuggucauuucauuguucucuaacccccaaauaucucagcauuggaucguaguuccaagaggcugugccaguuaucaaagggcccuguggaauggcaugauguaagaggauggggaauccuaguccgcauaaguugccauuuagcuauuuuguuccuguguggauggccuuuucaggaugacuggaagcuuucuugaaagucuagaucauauuuuuucgugguauuuuuucugcuucuuguucucugagcuucuuagaucuuuaguuugaugucuucuauuauuuuuagaauuuuuuucagcuguuaucuuuauuucucucucucucucuccuuuucuguucagccauugucuuuuuuuuuuuuuuuuuuuugagacagagucucgcucugucgcccaggcuggagugcaguggacuaucuugguucacugcaaccuccaccuccuggguucaagcacuucuugccucagccucuggaguagcugggacuacagguaugggccaccacaccuggcuaauuuuuguauuguuauuagagaugggguuucacuauauugacuaggcuggucuugaacuccuggccuccagugauuugcccuccugggccucccaaagugcugggauuacaagcaugagccaccgcacccagcccagccauuaucuugaaauauucugauacauucucuuucuucagaaauuucagcuauacuuuuguuauauaccucauuuuggaugcuccauucuguuuuuuguuuuuccacuuucugucucuaucucccuguuuuuugggagacggagucucaaagugcugggauuacagguguaagccacugcgccuggaccccccccccuuuuuuuuuaucucauuccguugcugaggcuggagugcaguggcaugaucucggcucacugcagccucaaccuccuggguucaagugauucuccugccucagccucccgaguaacugggauuauaggcaugcaccaccacacccggcuaauuuuuguauuuuuaguggagacggaguuucaccggguugggcaagcuggucucgaauuccugaccucaggugaccugcccaccucagccucccaaagugcugggauuacaagcguaagccaccgcacuuggccuucauuggcuuuuuuuuuugagacugagucucauucuguugcccaggcuggagugcaguggcaagaucuuggcugacugcaaccuucuccucccugguucaaguaauuccccugccucagccuccugaguagcugggaauacaagcgugugccaccauggccagcuaauuuuuuuuuguauuuuaguagagacgggguuucaccauguuggccaggacggucucgaucuccugaccucgugauccacccgccucagccucccaaaaugcuggggauuacaggcgugagccaccacacccagccucgcugacuucuuauaauuuuuaucuuuuugucgaaauucuuuaccuauuuuuuuuugucuguuuuauuucucccuuuuuuuugagacagagucucgcucuguugcccaggcuugagugcagugguaucaucuugccucacugcaaccuccaccucccagguucaagugauuuucaugccucagccuccggaguagcugggauuacaggccugggacaccaugccuggcuaauuuuuucuauuuuuaguagaaacagguaucauuguguuggccaggcuggucuugaacucauggccucaagugauccacacgucucaaccucccaacuuuaccuauuuguacauauagucaauuagguaauuuuuccuauauaaagccuauauguauaguucauaguuacuuuacauuucuugucugauaguuuggauucauagcugagucugguucuauugauuacuuuguuucuugacacugggguuuuuuuucuuguuauuuugugucucaugauuucuuauugaaagccagaaaucauguuaagacaguagauacuguaaguaaguagcaagugguauuuauucuuagaaaugggcaugucuuuuccuuggcuaagguauagcagaucuuuauuauauggggaauugccuuuuuccaggucaggacuugagcuggauuuggguucuguuguuguacuuagggugcaaguugguuuacuggagauuuuuucucaguguuccucuuacauccucagucuuaggcucuuccugugauuccauccuuguaagauggcccucuucuuacccuuaucccugccccagcaguagauugcuauuacuugaugugcagcccuguuguggagauguuuggaauggggagcagcauuuucuauuuuuguauuucccuauuuuucuaguucauccuuagccauaagcaggucuggaucccugggucuuggaacugaaacaguuuucuuugcuuguuuauuuuuucauuauauauauaaugaaaaauauuuuuauauauucaauauauauaaaaugaaaaaguuauauauauauauaaauuuuucauaaagaccaagucucacuguguuucccagggucuugaacucuccugggcuccugccucacccucccaaagugcugagauuacaggcaugagccaccucucccagucuuuuuuuuuuuugagacggagucucguucucuagccaggcuggagugcaguggugugaucucggcucacugcaacucugccucccggguucaagugauucuccugccucacccucccgaguagcugggaccacaggcgugcgccaccaugccgggcuaauuuuuuguauuuuaguagagacgggguuucaccacauuggccaggauggccucaaucuccugaccuugugauucgcccaccccggccucccaaagugcuggguuuacaggugugagccacugugcccacccagucuuuucauuauauucugugucuaaauuuauuuaacuaauaaagagcauucaggaguucaacacuagccugggcaauauggccaaaccuugucucuacaaaaaauacaaaaauuagccaggugugaaguggagauugcagugagccaagauugugccacugcacuucagccugggugacagagcuggaccuugucucaaaaauaauaguaauaauaauaauaaagaucauuguaagauaauacuugguuuucuguuuuucuuuucuuuucuuuuuugagacaggcucucacuuugucacccaggcuggagugcaguggcaugaucacuacucacugcagccucaaccucccaggccuuugcgauccugccaacucaguggccucacacccccaugccuggcuaauuuuuuguuucuuuuuuguagagacagucucacuauguugcccaggcuggucuugaacuucugggcucaggcaguccuccugccucagacucccaaaguacugggauuaaagacaugagccaccacaucuggccuauuugcuuuauauguguaacauguuuuucuucauuuauucacagaggagaccuugccuauuuugauggacuuagugagacuauucuugcuguggggcuugugaagccaaaagcagguaagaaauaaaacuauaaggaagagauuauguuuguauauguaaacuccaaaugguauagaccugaacaacaacacacauuuuuuucgagauggagucucguuccaucgaguaggcuggagugcaguggcgcaaucuuggcucacugcaaucuccgccuccuggguucaagcaguucuccugccucagccucccgaauagcugggauuacgggcgugcgccaccacacccagcuaauuuuuguauuuuuaguagagacggggcuccgccauguuggccaggcuggucucaacuccugaccucaggugauccgcccgccucagccucccaaagugcugggauuacagauguaagccaccgcgccuggcugacaacacccuuuuuuaaacaauuguauucuccauugaaguuuuauuuugaauucuaauuagaaauauguaaagugauuauuaauguuuaacuguuuacuuuaaugguauaagugacacugccuuuaaaaauguuaaacuguaauuuuuugaauuuuauuuuauuugcuuuuuacugcucuuucuugauauaccugaagguuuugcacuauagauuuuucauuaauugcugaauuuaauguuaagaaaaauuuuagugucugcauuuuauuagucugucuuucucuuuuuuuuuuuuuuuuuuuuuuuuuuugagauuaaggucuuauacucuaucacccgggcuggagugcaguggcaugaucauggcucacuacagccucaaccucccaggcucaggagacccucccaccucagccucccaaguagcugggacuacaguuuugugcuaccacaccaggcuaauuuuuguagagaugggguuuugccauguugcccaggcuggucuugaacuccugugcucaagcaauccacccaccucagggaugcuggguuaacacuugugagccacugcaccuggccauuuuuuuagucuuuuucuuuuuugagacagagucucgcucuguugcccaggcuggagugcaguggcgugaucuccgcucacagcagccuccgccucccaggauugagcgauucucuugccucagccuuccaaguagcugggauuacaggcaugugccaccaugcccagcuaauuuuuauauuuuuaguagagcaggguuuugccauguuggccaggcugguuuugaacuguugaccucaggugauuugccuaccuuggccucccaaugugcugggauuacaggcgugagccgccgugcccuggccauauucuugauggcccguggaagugagaacagaguuuagaguaaaucuuagaaacgucacaagcauuguuuaacuuauuguuucacccucauaaugccaaaucucuuaucaggguuacugagaaggagaauugauugauuuaaauuuaaaauauauccuuuaaauguaccuuucuuuuuuuuucuguuacagagucucacucuguugcccaggcuagagugcaguuuagccaccuuggugcucacugcagucucgccuccugaguucaagcgauucuccugccucagccucucaaguagcugggauuauaaacgcaugucaccacgccuaauuuuuauauuuuuaguagagacaggguuucgccauguuggccaugcugguuucgaacuccugaccucaggugauccucccacaucggucucccaaagugcugguauuauaggcaugagcugccaugcccuggccauaauccugauagcccauggaagugagaacagaguucagaguaaauuaaaucuuguagauaucacaagcauuguuugacuuacucuuucacccucauaaugccaaaucucuauuuuuuuuuuuuuuuuuugagauggaauuuugcucuuguugcccaggcuggaguguaauggcgugaucucggcucaccgcacccuccgccuccuggguucaagcgauucuccugccucagccucccaaguagcugggauuacaggcaugcaccaccacgcuuggcuaauuuuauauuuuuaguagagaugggaauucuccauguuggucgggcuggucuugaacucccgaccucaggugauccgcccaccucggccucccaaaguguuugggauuacagacgugagccaccaugcccagcauaaugccaaaucucuuaucagaguuacuaggaaggagaauugauugauuuaaauuuaaaauauauucuuggcuggacaugguggcuugagccuguaaucccagcacuuugggaggccaagguggguggaucaugaggucaggagaucgagaccauccugacuaacacagugaaaccccaucuguacuaaaaauacaaaaaauuagcugggcuuggugguggucgccuguagucccagcuacuugggaggcugaggcaggagaauugugugaaccugggagguggagcgugcagugagccaagaucacgccacugcacuccagccugggcaacagagugagacaucgccucugaaaaacaaacaaacaaacaaacaaauaaauaaauauauauauauauacacacacacacacauucuuuaaccguacuuuuuuuuuuuugaaacagugucucacugucacccaggcuggaguacaguggagucaccuuggugcucacuacaaccuccgccuccuggguuuaagcgauucuccugccucaggcuccugaguagcuggaauuucaggcaugugccaccauucccggcuaauuuuuguauuuuuaguagcaugugguuuggccauguuguccaggcuagucuuuuaacaccuggccucaagcgauccgcccaccuuggccucucaaaguccugguauuacagaugugagccacugugcagccaaauguaccuuuuuauaggaggaaauaauagacaaaaauuacuuuuuugcaaggccuaagugaaauuuuuuaagauuauggccauuuugcaauuauagauacucaguuaaguaaaaacagacuucuuuuuuuuuuugagauggagucucauucugucgcccaggcuggagugcaauggcacgaucucggcucacugcaaccuccgccucccggguucaagcgauucuucugccucagccucccgaguagcugggauuacaggcgcccgccagcaggcccggcuaauuuuuguauuuuuaguagagacaggguuucaccauguuggucaggcuggucucgaacuccugaccucaagugauccgcccgucucugccucucaaagugcugagauuacaggcgugagccaccacgcccagcccaaaccgacauuuuauacacuauuuauuuacuugcauugaaaauauauuuucaggcugggugugguggcucacaccuguaaucccagcacuuugugaggcugaggcgagcagaucaccugagucugagacuucaagaccagccugggcaacauggugauacccugucugcaaaaaacagaaacauaagccaggcaugguggugcaugccuguagucccagcuauucaugaggcugaagcgggaggaucgcuugagcauaggaggacaaggcugcaguaagccuugauucugccacugcacuccagccugggcagcagagcaagacccugucucaaaaaaaaaaaaaaaaaaagaagaaauaaagacacugggugcguugguucacgccuguaaucccagcacuuugggaggcuggggcggguggaucaacugacgucaggaauucgagacaagccugaccacauggugaaaccgugucucuacuaaaaauacaaaauaagcugggcauggugccauaugccuguaaucucaccuacucgggaggcugaggcaggaggaucacuugaacccgggaggcagagguuauagugagccgagaucgagccacugcacuccagccugggcaacaagagugaaacucugucucaaaaagaaaagcaaagcaaauguauguccuuuacauagaaucuaaaagagaugcauuaaguguauaaauauugcuauauacuauuaucaagguuguaaucuuuucuuguguagauaacuauagguguaaguuuuauuuucuaaaauugucuagcuuuuauuugcauuucaaaaugaaaucuauuauauauauuuuaauugugguaaaauacacauaauacaaacuuugccaucuuaacuguuuuuaagccuauacuucagugguauuaaguccauucacguuauuguguaaacuucaccaccaucuauaucuagaacucuguauuuuguaaaauggaaacuguaccuauuaacuaaaaacuccuguuccuccuucccucagcaguugguaguaaccauuccacuuuuugucuguaagaauuugacuauucuagguuuccucauauaaauggaaucauaugguacuauauuggucauuuugugacuggcucauuuuauuuaaccuauguccucaagguucaucuguguuacagcaugcaucagaacauuuuuccuuuuauguuuuuauuuuuuuauuuuuuuugagauggagucucacucugucguccagacugggguguaauggcgugaucucggcucacugcaaccccugccucccggguucaagcaauucuccugccucagccucucaaguagcugguacuacaggcacgugccaccacacucggcuaauuuuuuguuuuuaguagagaugggguuucaccauguuggccaggcuggucucaaacuccugaccucaggugauuugccugccucagccucccaugggauuacaggcgugcccggccaacuuucuuacuuuuuaaaguucaguaguauuccauuuuguguguguguguguauauauauauaugucauuuuuuuuaaugcaucuaucgauggacacuuggauuuuguuuucaccuuuuaguuauugugaaaaacacugcuaugaacauggguauacaaauauacaucucuauauuuuaauauauuuaaacuauuuuguaauauaacacuuuuaaaauagcauuaaauacugaagugauuguuuucuaaggugguucuuuuccacugcuauuaacuuuuuuuccucuucauuaucuugaugacauucaaaauuuacuuauuuaaaugaucauacauaauaauauuuuuaacaacagaauugacuaaacugcauccagacuuuucauauaccauuuaauuaguagcucacuuuaaugguaauaaaagcuuacucuguuagugcuuaaaugcugaaaguauuccugcccugugucuacuuuaucuuaggcaucuuucaaccucaugugcgacaccuccugguuuuggcgaccccuguagacauaguaauucuuggacucagcuaugcuaauuugcaaacagguauggcaacccacauguuaacguuuuuuaaaauaauaguauuuuggccaauugauauuacaguuaaaagcuaaucugggugaaauguugaauuccauugacucacauuaaugauuauuacugccaaauccucaggcucuuuuccacaaguuaacauuggguuaguuuuuuguuuuguuuuguuuuguuuuguuuuuugagacggauuuucgcucuuguugcccaggcugcagugcaauggcgugaucuuggcuuaccgcauccucugccucccaggcucaagugauucuccugcuucagucucuugaguugcugggauuacaggcaugcaccaccauacccggcuaauuuuguuuuuuuguuuguuuguuuguuuuugauaagggagucuugcacugucgcccgggcuggaguguaguggugcaaucuuggcucagugcaaccucugccucccagguucaagcgauucuccugccucagccucccaaguagcugggauuacaggcacccacuaccacacccagcuaauuuuuuuguauuuuuaguagagacaggguuuuacuguguuggccaggcuguucuugaacuccugaccucgugauccaccugccuuggccucccaaagugcugggauuacaggcgugagccacugugcccggccuaauuuuguauuuuuagaagagacggggugucuucauguuggucaggcuggucuugaacugccgaccucaggugaucugcccaccugggccucccaaagugcugggauuacaggcaugagccacggcacccggccggguuaguuucuuguuuauuaucuuacuauauaauaaacacacaggcacacacacacacacacacacacucacacacucugcagguucuguuuaacuugaauuaucaaauuguaucagacuucuuuuaguaauuuuaaaauguauauuauagaagcuguugacuauguuaauugucaguaagaauugaguaaggcuggguaugguggcucuugccuguaaucuuagcacucugggaggccgaggcaggcggaucacgagaucaggagaucgagaccauccuggcuaacacggugaaaccuugccucuacuaaaaauacaaaaaaaaauuagcugggcaugguggcgggcgccuguagucccagcuacucgggaggcugaggcaggagaauggcaugaacccgggagguagagcuugcagugagcugagaucgggccacugcacccagccugggugacagaguaagacugucucaagaaaaaaaaaaaagaauugaguaaacauauagauucugaugauaaugcaaagauuuuuaaaaacuguggaguagcuaauaaacugauuuauguauucuuucuuaaauagguucuggaguucuuaaugauaguuugucugguggaaugcaguugcuuccagauccuuuauauucucuuccuacugauaauacuuaccuuuuaacaauaacuuccacugauaauggcagaauuuucuuggcuggaaaggauggcuguuuauaugaaguagccuaccagguaagucugacauuuguaaacguuuuuuuuucucucuugauggaguagggaaagauaagccuuuauuuuguuuucuaauuauauaaggacauuaauauauuuuuaugguaaauauucaagcauacaguugaagcuguaguccccaugacuacaccaugccuacaaaacucagcccucagagguaaaagucauuauucuauguauguccucguggaacauaaggcacacaucaaugucucuauagauaucuaugcauauguguuuguguguauauacacauauacaaauacaaaaugcacuuuugcaaauauguguuuucacuuggauuauugauuuaauucguaauugcuuuuuuuuuuuuuuuuuuuuuaaaugugauggagucucacuguaucacccaggucuaucacccaggcuggaaugcaguggcugaaucuuagcucacugcaaccuccauccccuggguuuaagcaguucuccugccucagccucccaauagcugggauuacaggugugcaccaccacauccagcuaauuuuuguguuuuuauuagaggcagaguuucaucauguuggcuaggcuggucucgaacuccugaccucaaaugauccaccugccuuggccucccaaagugcuaggauuuacaggugcgagccacugugcccagcccauaacuggcuuuucaucuaacaguaugucuugaaauucuuuccuugucaguauuugguugauauuuuaaauuaugggcuaaacucaguaguuaauuuugaauaauaugucucguuuuguugauuauaacugguauuagugauuauaacugguauuucaugaagauuugaagguuuuuauaaauauggauauacaguaguuauuguaagggaguuacauacuuuuauaagucgucuuucuacuuuuuucuuuaaggcugaagcagggugguuuagccaaagauguaggaaaauaaaccacucaaagagcucacuuucuuuccuuguuccuuccuugcuacaauucacguucucagaagaugguaaguagaaaacaauaaauuuggcaaguacaacuaauuucuaacacauuguucccucaacguuuucuucagaaauuaucauucuuaauugaaacaauuuguuauguuaaguagcauuucuuauauauucauaaggucuuuuaaaggguaaggagaucauaaccuagagaaaguguggauuuuguucucaaguuuacuuauuuccuauaaauguagcaucaaagaacuugcgucuaaaacagcuguacauaauuaaaccaaaauauguguauguaugugagagagacagacauucagacagcuaauacauuguuugcuuggucuagaacaaauuuccaguauaaaaagaauauaucuuagcuuuuaaugaacugagagauuucaacaggugaaauaauuuuuaaaaugcuuuggcaaaauaagaucuguauacccaaagauuaauaugacugaauuuuaaaauuauuuucuuucacacaaucaauuaggccaaacuggaaguuucuuaacauaaaggaccagguauacuuauucuguguuucuaggauguaguaaacauucauuaauguuuaaauaacuuagaauuuauuuucuaaguuauuucaugaaaaaauaacuuagaauuuguuuucaguuuggcuuaaaauucauuuagaggacaaaauaacuuacuuucuaugcucauaacccagucacaguauuuagcauguguuuuuuucauguguugucugaccaaaaugcuuuuuggacuggaucuuaugcaaacauccuaggauuuaacuacaaagcaagagaguagaaagccccugaauacaaaguucugauucaacaguuuguuguaacuagcuaauguauuugcuuuguuaauccuuggguuuacuuuuuucucuuuuuuuuuuuugucuuacuuuuagauccuauucuucaaauugcaauugauaauucuagaaauauuuuauauacacgaucugagaaaggaguaauacagguuaguauuaauauuauuauaccauuaagagucaaauaaauccuuauuuuuaaggaagacaauucccaccucuuaaauuuuuccuaugaacuguguaacuaaaaaaaaaaaaagccugcugggcaugguggcucaagccuguaaucccagcacuuugggaggccaaggugggcggaucaccugaggucuggaguuugagaccagucuagccaacaugaugaaacccugccucuacuaaaaauacaaaaauuagccagguguggugguaugugccuuuaaucccagcuacuugggaggcugaggcaggagaaucauuugaaccugggcggcggagguugcagugagccgagaucaugccuuugcccuccagccugggcaguagagcaagacuucgucucaaaaaaaaaaagcccaacucacuucucagaaggguccccuuucuaugaaauuucgaaucugaauguuuucauguuuguauuaaauaccaauauuaaaggaucccuuaaaagaaagaguuuaauaauauguguauaguauauaaucauguuuaagugagaaugauuuuguauucacagguguaugauuugggacaagauggacaaggaaugagcagaguugccucugugucacagaaugccauugucucugcugcugguaacauugcuagguaacauguaauuuauuauuaagcauuucauuugcaggcauaauuauacuauuuguguguagccuucuaaaaguauauauuauucccucaucaaaaugucucuaaaagacaaggaauguugaagagaugacacucuacauuauguuugaaauggagcuguuagagacuccuuuauuuauuuauuuauuuauuuauuuuuuugagacagggucucacucugucacccaggcuggagugcagugacacaaucuuggcucacugcaaccuccaccuccuggguucaacugauucuccugccacaggcucccuaguagcugagauuacaggugccugccaccaugccuggcuaauuuuuauauauauuuuuuuugagauggaguuucgcucuuguugcccaggcgggagugcaguggugcuaucucugcucaccgcaacuucugccucgcgcguucaagcgauucuccugccucagccucccgaguaguugggauuacggacaugcaccaccaugcccagcuaauuuuguauuuuuaguagagacaggguuucaccauguuggccaggauggucucgaucucuugaccucgugauccgcccgccucaaccucccaaagugcugggauuacaggcaugagccaccaugcccagccuaauuuuuguauuuuuaguagagauuggguuucgccauguuggccaggcuggucucuaacuccugaccucagguaaucuacccaccacgccucccaaaauguggagauuauaggcgugagccaccgugccuggccaagacuuuuuuuuuuuuuuuuuugagauggaguuucacucuuguuguccaggcuggagugcaauggugcagucucggcucacugcaaccucugucucccggguucaagugauucuccugccguagccuccugaguagcugggacuacaggcaugcgccaucacacccagcuaauuuuguauuuuuaguagagaugggguuuucuccauguuggucaggcuggucucgaacucccgaccucaggugauccaccugccuuggccucccaaagugcugggauuacaggcgugagccaccgugcccagcuugagacucuuuuauucuuauguuugauaguuggaaauauaagguagacugguuuuacuacguaaaguacagcuugacguguuuuuccuggcaacuuuacauagggaucaugacuaggaaacugcaugucucaaaguuuccccacuuuuaacuauucacucuuucgguuuuuuguuugcuucuuuuugagauggagucucgcucuguugcccaggcuggagugcaguggcuccaucucagcuugcugcaaucaccaccuccugggcuuaagcgauucucccaccuaagccucccgagcggcuaggacuacaggcacaugccaccacaccuggcgaauuuuucuauuuuuuauagagacagggcuucaccguguugcccagacuggucuugaacuccuggacucaagcaauacacccgcucuggccucccaaagugcugggguuacaggcaugagccacugcacccggccacuacucacucuuuuaacagacaugugugguucaagcuuaguuggucugauuauugacacaaguacagaacacaauauuucaaaguuguaguacccauuuuauucaugaggaaacugaaacuaagggaugauuugccugagaucuaacuccuaaauaaguacaagaaccuaacgcggaagccaagucuucagacaaucugcauuaccauuugcacauaucccaacuaccuuggucaagcugcaaacgcucucucucucuuuuuuuuuuguuuccgagacaaagucucacucuugucccccaggcuggagugcaauggcgcgacuuggcucccuacaaccuccaccucccggguucaagcgauucuccugccuuagccuccugaguagcuggaauuacaggcgccugucaccacgccuggcuaauuuuuguauuuucaguagagauggggcuucaccauguuggccaggcuggucucgaccuccugaccugaggugaucugccugccuuggccucccgaagugcugggauuacaggcgugagccacugcaccccaccugcaaacacucuuuuuauaaugaaggccucaaauuuuucaacuucuauugucauugugccuagauuauugcuacaaucagagugaaauaaaucaacuuuuuguuuuuuuuuucagacaggguuucacucuguugcccagacuggagugcaguguugcaauuguagucugcuauagccucaauuuccugggcugacgugauccucaugccuaagcuuccugaguagcuaugacuauagaugugugccaccaugcccaccuaauuuuauuuuuaguagaccuggggucuugcuaucuugcucagccuuuuuguuuuguuuuauucuucagugacaagaaaaaaauucugaaggcagacacaauugaaaacacauaauuuucuguuuuucccucuaauuuuuuucuggaauuuuuuucaaauccacaaaaaaauuaaaagaacaaugugacaaaaacuaauacacuuuuuuuuuuuuuuuuuuugagauggaaucucacucugucacgucacccaggcuggagugcaguguugcagucucagcucacugcacccucugccugccggguucaagcaaugcuccugccucacccucccaagcagcugggacuauaggcgcgcaccacugugccuggcuaauuuuuuguauuuucaguagagacaggguuucaccaugcuggccaggaugguuacgaacuccugaccuuguuaucugcgcgccuuggccucccaaaguguugugauuacaggcaugagccacugcacccggcaaaacuaauacacucuuuaucucaauuuuaacauuuugccucuuuguugccugucuuaugagccauuugaaaguacauuguagacaucaugacuuuuuuuuuuuuuuuuuuuugaaauggagucacacucugauacccaggcuggaguacaguggugcgaucguggcuuacugcagccuccuccuccucccaggcucaaggcauccucacaucucagccucuugaguagcugagaccacagacgugcgccaccacaucuggcuaauuuuuuguauuuuugguacagacgggguuucaccauuguugcccaggcuggucuugaacuccugaggucaagcaauccgcaugucucagccucucaaagugcugggauuacaggcaugagccaccgacaugccuuuagucuguuacauaacaauauacuuaguccauauuaaaauugcccaguaguccccaaaaucuuuuuuuuuuuaacucugcugcccaggauugagugcaguggugcuugaccucccuaggcucaggugauccaccaacuuuagccucccaagcagcugggaccacaggcacggacaccuccaccuggcuaauuuuuguauuuuuuguagagaggggaucucaccauguugcccuggcuggucuugaacuccugggcucaaaugacgugucugccucagccucucacaguccugggauucugggauuacagaugugaaccaccgugcccccaaaaucuuuuuuuuuuuuuuuuugagauggagucuugcucugucacccaggcuggaaugcaguggcacgaucuuggcucacugcaaccuccaccucccggguucaagcaguucuccugccucggccucccggguagcugggacuacagaugcacaccaccacaccuggguaauuuuuguauuuuuaguagagacgggguuuuaccauguuggccagcuuuuaugccucagccucccaaagugcugggauuacaggcgugagccacugcgccuggcuucgaaaucuuuuauaguuguuuuucuuuccauuuuucuccaguuauaucagaauuuaugaauuggauugguuguuagucucuuuaauauaaaacagcccccuggccaccuuuuuuuuuuuuuauaauauugacguuuggaaggaagggcaggauaauuauacaaauuucugaauauaucuuuuuuuauaauuagauucugaguaauauauuuuauauaugauguuuauauguauuuuauauauguauauuuucuuucuuuuuuuuuuuuuuuucuuugagacagaguuuugcucugucacccagucuggagugccauggugcuaucuuggcucacagcaaccucugccuccgaguuccagugauucucgugccucagccacccaaguagcugggacucuagaugugcgccacuauucuuggcuaauuuuuauauauuuuuuaguagagaugggguuucaccauguugagcaggcuggucucgaacuccuggccucaagugaucugacugccucagccucucaaaaugcuaggauuugaggcaugagccaccucaccaagcaguaauauaucuuuuagccaguauuacauaggcagugugaaaugucuuacuacauuauaucaagagacacauaauagcaguuuucucacuguugaaagcuucauugaggugauuuuaaccaaaugucuacauuauaaagauccauuuucucccuuuuuuuucccccuugagauagagucucagucuguugcccaggcuggacugcagugacgugaucucagcucacugcaaccuccaccuuggguucaagugauucuucugcuucagccucccaaguagcugggauuacaggcaugcgcuaccaccccuggcuaauuuuuuuguauuuuuaguagagacggggguucaccauguugaccaggccagucuugaacucuugaccucagguuaucugcccgucucggcuucccaaagugcuggaauuacaggcgugagucacugcaccuggccuuucuccuuuuuuaauuagcaguaaugauacuuugacacugagaacacugcuccccaccaaccauucacccaaugguuuuagucuuuuuuugugaucuuuguuugaaaauaggguuacucuuaauaauauaaauguaaaaaauacacauuccagaguuuuuccaguucuugcugcucuuguauuacuuuccuaagaagcuagucuuaaauuauuuagcauauuuagaaaauauaaggcugggagcaguggcucacaccuguaaugccagcacuuugggaggccaaggcaggcggaucaugaggucaggagaucgagaccauccuggcuaacauagugaaaccccgucucuacuaaaaauacaaaaaauuagccaggugugguggcgggugccuguagucccagcuacuugggaggcugaggcaggagaauggcgugaaccuggcagguggagcuugcagugaguggagauggcgccacugcacuccagccugggcaacagagcaagacuccgucucaaaaaaaagaaaaaagaaaaaaaaaagaaaauauggaaauauguggucgggcacaguggcucacgccuguaaucccaaucccagcacuuuggaaggccgaggcgggcggaucacgcucacgcgaggucaggaguucaagaccagccuggccaacacgaugaaacccugucucuacuaacaacacaaaaauuaccugggcgugcuggcgcgagcccguaaucccagcuacucaggaggcugaggcaggagaauugcuugaaccugggaggcggagauugcagugagccgagaucacgccacucuccuccagccugggugacagagugagacuacaucucaaaaaaaaaaggaaaauauggaaauauguaaacauucugaugggaaauauuucuuauaauuuagcagacacauuuuaaaaauacacuuuauuuucuccuuucuuuuaggaccaucgaucguucuguuuuuaaaccaauuguccaaauagcagugauugaaaauucugaaucacuggacugucaguuauuggcugucacacaugcagguauguuguuuuauuuacauaucugcuauuacuguuacaacuucugaaaauucuuagauuuggaaauuuauuauuagaaauauauuuuuccuucuauaucugccguaaagccauauaaauaguuuguaaaauaaaggauuuugaaaacugggagauuuuucuaauucuguuucuucauuuuauagauauaaaaccaaaccuaggccaggcaugguagcucacauuuguaauccuagcgcuuugggagaucaaggcaggcagauugccugagcccaggaguucaagacuaaccugagcaacauggugaaacccuguaaccccgucucuacuaaaaauacaaaaauuagcuaggugugauggcacggccuuguaguaccagcugcuugggaggcugucauggaaagaucacuugagcccaggaguuugaggcuacagugagcugagauuaugcuacuacacuucacccugggcaauagggcaagaucuuuucucaaaaaaccaguaaaaaagcaaaacaaaagccaagccuaaaaggcgcaguggcugacauuuuguaacaaagccugaauuggaacacaagauuucuugguuugucuuugcaaguucuuucuaaugaaauguauugauucaccucucaauuucgagugacauuuucuuagauauauauuuuagcagauagucuauaugguaauuuaagaucagucaggggagccgggugcgguggcucacaccugugaucccagcacuuugggaggccaaggcggguggauccugaggucaggagaucaagaccauccuggcuaacacggugaaaccccaucucuacuaaaaacacaaaaaauuagccagacaugguggcaggcaccuguagucccagcuacucgggaggcugaggcaggagaauggugugaaccugguagguggagcuuacagugagccaagaucgcgccacuacacuccagccugggagacagagcaagauucugucucaaaaaaaaauaaaaauaaaaauaaaacaaauuagacgggugugguggcacaugccuguagucucagcuaccugggaggcuaaggcaggagaaucgcuugaacccgggaggcggagguugcaguaagccgagauggcgccacugcacuccagccugggcgacagagcuagacuccaucuccaaaaauaaaaauuagucaggaaaguuauguaugguuuuagcagaguguugcauugcuguauguaauugcuucaauaacacauuuaccucagguccuuguuuucuauuacugaugcauaauuuuaccccaucuucagguguuagguuauauuuuagcacuuguccauucagacagccauuagcacggccuaauacacugacgcugguucauguccgcuuaccuccuggauucucagcaucuucaaccguggaaaagccuucaaaaguacauagagcucuuuauaguaaagguaaguucugaaauacuaucagauuuaagauuauauucuuaaaauuguuaaaauuauaugguguugugaaguauuugaaaauacccuauggcaacaguagaaacugggaacuacuagaagggucagggaaguaggggagcaaggguugaaaaacggacuauugggucuuaugcucaguaccugagugauggaaucaguuguacccuaaaccuuagcaccacgcaauauacgcaaguaacagauuugcacauauaccuccugaaucuaaaauaaaauuugaaauuguagugaaauucaaaaguugaaaguguaguuuucacugcuacauuuagguuuuugaucuguuuugugauaauuuuuguauguugugugaaguaggaaucugacuucauccuucugcaugugguuaucuagcugucugagcaccauuuguugaaaagacuauuauaucccccauugaauugucuucaucuuacugucugaagugaauuacccguuaauguauggaaucuggauucucaguucuauucuguuggucuauauuauccauccuuaugucaguagcacagucuugauuaccguugcuuuguaauaaguuuugaaauugauaagugugacuauuccaacuuugaucuuuuuuuuuuuuugagguggucuggcucuguugccgaggcuggagugcaguagcacaaucucugcucacugcaaccuccgcuucccaggcucaugcuguccucccacuucagccuccugaguagcugagagagacuacaggugugugccaccacacccggcuaauuuuuguacuuuuuguagagauaggcuuuugccauguugccuaggcucgucucaaacuccugagcucaagugauccgucugcauuggccuccuaaagugcugggauuacaggcaugagccaccgugcaccuggccugauuuuuuaaaagaugauuuuggcucuucucaguuucuugaauuuucauaugaauuuuagaaucaccuuguuaauuucugcaaaaaaagugagguggggccgggugcaguggcucacgccuguaagcccaacacuucgggaggcaaaggcagguggaucacuugagaucaguucaagaccagccuggccaacauggcgaaacccugucucuacuaaaaauacaaaaauuagccggguguagggggcaugucuguagucacagcuucuugugggcugaggcaagagaaucgcuugaacuggggaagugaagguuacagugaaccaagauccuaccgcugcacucuagcaugggggacagagcaagacuccaucucaaaacaaaaacaaaaacaaaaaacacacaaaaaagugagguuggauugugauagcugaaucaguauaucaauuuggggcauguugccaucuuaacuauguuaagucuucaaauccaugaauacagaauauuuuuccaagucauuugaggguggggaggaagguucucacucuguugcccaggcuggagugcaguggcaggaucuugggucaccauagcuucaaccuuccaggcucaggugauccuccuugcucaaccuccugaggaguugggacuacaggcaugugccaccacuccuggcuaauuuuuguauuuuuuguagagacgggguuucaccauguuucccaggcuggucuuaaacuccugggcucaagcaguccuaccaccucugccucccaaagcgcuaggauuauaggcgugagccaccguguuggcaaguuuuguugagauaauugccuuuuuuuuuuuuuuuuuugagacagugucuacugucacccaagcaggagugcaauaugcagucaugacucauuacagccucuaccuccccggcucaagcaauccuccugccucauguuuuguugaaacaaggucuuacuuuauugcccaggcuggucucgaacuccugggcucaagugaucagccugccucagccuccgaaacugcugggauuacaugcauaagccacagcaccuggcccagauaauugcuucuauaguacacuuaucucugccauuccucuagcaccuucaucauuuuuauucaugguguguuugaauuaaccaguauauaaacuguauuucauugaauauuagcuuguauuacauugugaauuugucagucauggcauuuuuauauacuaaguauauuuuuauaaaauuaauaauuaaauugauaaacccauugacugcaagauaugcccuaaguucagaaaugcuaaaaugugaaaaaaaaauguuuaucugagagaaauacaguuuaaaauugagaacacuuaaggagucuaccuuaaaaauaauuauauagucuuucagggaauuauuuuauuuuguaacuuguuuguuuauaaagauugauguucgguugggcgcaguggcucacgccuguaauuccaguacuuugggaggccaaguugggcggaucacgaggucaggagaucgagaccauccuggcuaacacggugaaaccucgucucuacuaaaaauacaaaaaauuagucgggcgugguggcaggugccguagucccagcuacucgggaggcugaggcaggagaaugacgugaacccaggaggcggagcuugcagugagccgagaucgcgccacugcacuccagccugggugacagcgagacuccgucucaaaaaaaaaaaaaaaagauugauguuguguguguauauuuauauaugcuaguuuuaaguuggcauaaaaguacgugugguuuuguaaaauuuuuuuuuuuuuuuuuuuugagacggaaucuugcucuggcgcccaggcuggagugcaguggcacaaucucagcuuacugcaaccuccaccuccugcguucacgccauucuccugccucagccuccugaguagcugggauuacaggugccugccgccaugcccagcuaauuuuuguauuuuaguagaaacaggguuucaccauguugauuaggcuggucuuggacuccugaccucgugauccacccaccucauccuccaaaagugcugggauuacaggcaugagccaccgugcccagcccgguuuuauaauuuuaauugcaaaaccgcaauugcuuuugcacuaaccuaauaauuauuaagguuauugaggaugcauauuugacaugauguaauaauauuuuguauauuaaacuuuuagguauucuauugauggcagccucagaaaaugaggauaaugauauuuuauggugugucaaccaugauacuuuuccuuuccaaaagccaaugauggaaacccagguaaguuauccugacaauucugaaaaaacuauuauauaauuuuaagugaaggauaauauggaagaaacuuuuaucuucugauguauugcuguuugcuucuaauaacguauuauuagaaauuauaaaguaaagaaauuauccugucaauuauuuguuuuccucugucaggguagaaguuacugugguaaucacaaaaaaaaucuuuaaagaaaacauuggacccuuacggaauauuuuccauaauguacuagaaaauacauacaucuuuuuugaaguugucuuuuuuuuucugaaaacaugucagguucauaugaaaugaucuuuaccucauuuaaauauguugcucguuuaguuauuuaaauaugaggccaucuauuacaguugugacuuagauuuuauucuaacaaucucuuuguaauuuugucuguuuuuuuuuuaauuauggaaacuuucaaacauaaaguuugaagagucaauugaaccucacguaagagaauugaguugccaacaucuuucuuauuguauuucauuuuucuuucccacauaaacaaagagacacccacaaacacacaguuuugauuuaaacacaaaaaucaccacauacaucaugaaguggauauggucuuccugggugaggaccgaggcugcuaugaacccacgaacugccccugcccccagcugcccauccuaguccccaguguauaaggaggugaggggaggcuaccugucuccauccccuugguguccucugcucacuccugccuguccuccugaauaguccugcauagcccacagaggcugcugaucaaaccagauaaaccagccccuaguggggugugaaugucugguacucugucuuuagagcuaccucuucacaggcauuuugcuucuaguuuucacugaaaacuagugguucuuuggugguucuuaaauuugaacccuuccagaugggacuggaaaaagguguguguaagugggaggaguaaaaacugaacucccagggaugggaguauugucugccugagcucuaccaaauuucugacaagguucaaagagcugggguaggagcaggaggaagauaaggagguaaggagugccuucuuuccuuuauucuuuguacuaccagccuagugcugugauaaacuaugaggauucagaacuuaauaagauauaaacccuguccugguugggaugcuguguugggggaguggaggacaugcuuuuggcucucuguuucuuccucuauaauaguuauaaucguaccuacuacgauggaguugugagacuaaaugagcucauguguguaaagcacucagaacaaugccuggcacucauaggaagcaccauuccauaaauguuaacuuuuuuuuuuucuuuacucuuuuaaaagacagcaucucacccuguugcccaggcccaagcaguccucccaccucagccucccaaguggcugggacuacaggugugcauuaccacguacagccgauuuuuaaauuuuuuguagcgacagggucugacuauauugcccagacuagucuugaacuccugggcucaagcgauccucccaccuuggcuucccaaacugcugggauuacaggugugagacacuguccuccaccuaacuuuuuuuuuagaacaaaugcugcaugucauauaauuugauuuaauauuugaguuuuucucaaacaaagguggacuuuuguuuuuaacaaaaaaacucaucaaguauaguguaugagcuuugaucaaauccuaguuaucaaaaauagucauaaaagacauuagaacagcuggguaaauuuuauauugguuagguguuaaauuauauuagggaauugauaacuuuuuuuuuugagacaagguuucacucuguugcccaggcuggaguacaguggcacaaucagagcucacugcaacugccucccaggcucaggggauccuccuaccucagcacccgccacccccuccccgccauguagcugggacuacaggcacaugccaccacucuugucuaauuuuuuuguauuuuuaguagagacaggguuuugccauguagccccugcuggucucgaauuccuaagcuuaagggauccaccugccuuggucucccaauguguugggauuacagguguaagccgugucguccagccaauaacauuuuuaaauguuauuauaugguuuguaagaaaacauucuuauuuuuaggagauaugugcaaaaguauuuaagagugauaaaugaugucuauacuuucaaauaguacaauaaaacaaauauacagaaagagagagaaugcagauauggcgaacugcuaacaauuguugagucuagguauugggcauguggacuuuuacuguauauucaacauuuuuggcugcuugaauuuuuuuauuauaaaguauuuuagaagauuaaaauacuuuuuuuuuuuuuuuuucugagacaggguuuugcucuguugccuggaguggagugcaguggcauagauagcucacuauagccucaaacuccuggguucaagcaauccuccuaccucagccuucugaguugcugggaauacaggcacacgccaccacaccgaggugguuuuuuauuuuuuguagagaugggacuucauuauauugccuaggcugguaaaauacuuuuuuuuuuuuuuuuuugugacagagucuuguucugucguccaggcuggagugcaguggcacaaucucggcucacugcaaccuccaucucccgggcucaagcaguucuccugccucagcauccagaguagcugggauuacaggcgugugccaccacacccggcuaauuuuucuauuuuuaguagagacaggguuucaccacauuggccuggcuggucucgaacuccugaccucggguaccgcccgccuccaccucccaaagugcugggauuauaggcgugagccaccucgccgagccaguaaaauacuuuuuaaaggaaagauaguaucuuagcagauuuaguugauccuggaaagaugguagaagguaguuacuugguuaagagaauuauaauuuuauuaaagaguauuuauaguuuaucuugagaaaaguuugcccuuguccucuaguacaaaaagauuuauguauuaguauagaaaaugccugcuuauggcugggcaugguggcucacgccuguaauccuagcacuuuggaaagaggccaaggcaggcagaucaccugaggucaggaguuugagaccagccuggccaacauggcaaaagccagucucuaauaacaauacaaaaauuagccggguaugguggugugcgucucuaaucccagauacucggaaggcugaggcaggagaauugcaugaaccugggaagcagacguuacagugggcucugauuaggccacugcacuccagccuuggcaacagggugagacucugccucagaaaaaaaaaaaagguaaugccugauuagcacuuugagaggccaagaugggcagacugcaugagcccaggaguucgagaacauccugggcaacaugguaaaacccuguucauacaaaacauagaaaaauuaggcggccgugguagcauucuccuguagucccagcuacuugggagguugaggugggagaaucaacugaacccagggaggucgagguugcagugaguugugaucgugccagcgcacuccagcuuaggugacagaguaagaugcugucucaaaaaaaaaaaaccccagaggccaggugugguggcucaugccuguaaucccagcgcuuugggaggccgaggugggcggaucaccugaggucgagaguucaagaccagccugaccaacauggagaaaccccguccccacuaaaaauaaaaaauuagcugggcguggugacauauggcuguaaucccagcuacuagggaggcugaggcaggagaaucacuugaacccgggaggcaaagguuacagugagccaagaucacuccacuacacuccagccuagacaacuucgucucaaaaaaaaaacaaaaaacaaaaacccagaaaauaccugauuuaaaaaaaagauaguagaaaauuacauaauacuuucaaaaauauucauguuaauguacuauuuauuaaauuuacuucuuuauuaagucuguaguuuuuucuuuugcauuauguaacuucaauaugauguauaaaacauuuauuucuuuuacauagaugacagcugguguugauggucauuccugggcucuuucugcgauagaugaauugaaaguagauaaaauaauuacaccuuuaaacaaggaucauauuccaauaacugauucaccaguuguuguacagcagcacauguuaccuccgaagaaauuuguucuccucucagcacagguguguacguauucuguuaugguagugacaaaaauaagcgauguauaauauuuuugucaaguucucugaaguaguggcuuaauugaauaauuuucuuucuuuuuuuuuugagacggagucucgcucaucacccaggcuggagugcaguggugugaucucagcucacugcaaccucugccuccccagaucaagcaauucuccugccacagccuccugaguagcugggauuacaggcgcacaccaccacaccuggcuaauuuuuguauuuuuaguagagaugggguuucaccauguuggccaggcuggucuugaacuccugaucucaggugguccgccugccucggccucccaaaguucugggauuacaggugugagccauugcacccagccuuccugguuucuuauuugacuuuguuuauugagauuuuucccaggcacacaagcuuauaauuagucaaaauuaucaguuaucaguugauauuuuauuuuauuuauuuuauuuuauuuuagacaaggucuuaaucugucacccaggcuggaguguggugcacagucuuggcuuacggcaaccucugccucccaggcucaagggauccucccacaucagccuccugaguagcugggaauacaggcguuugccaccacacccaguuaauuuuuguauuuucuguagagacaggaucucacuaaagcccaggcucgucucaaacucuugagcucaagcuauccacccaccucauccucccacagugcugagauuacaggcgagagccaaucugcccagccaucauuugaaauaugucauaguugaaaagcuuccacucacuaagguuuauaaaagaauccacucuuaguugcuuuuguuuauugauuggugcaaaaacaauugagguuuuugccauugauuguaauggcaaaaacaccauccuggcuaacacagugaaaccccgucuuuacuaaaaauauaaaaaaauuuagccgggcaugguggugggcgccuguagucacagcuacucgggaggcugagacaggagaauggcaugaacccgggaggcggagcuugcagugagccgagauugcgccacugcacuccagccugggagacaguacgagacuccgucuaaaaaaaaaaaaaaaaaaaaaaaaaaagcuguaauggcagaaaccucaauugcuuuuguaccaacguaauauuaugauaguuuuauuuuguccuuuaagucuuuugaucuauuuggaauuuacucugguauaagguaugacuauguuucuagcuuuuuuuuuuuuuuuuuuugccuaaauugauauaaauaguagcaacaugauuaauuaauaaucuaacuuuaauucucugguuuaaggggcagcuuugccggggcaauugcauuaaguuuucuuuauagauauauagaucuacuggagguugaguagagaaguagaugaucuuuuugaccaguuguacuuuuuauaucaccucagccauuccuccugccucagccccgugaugugcuggaaauacaaaugugggccaccauacccagccuacuuuguauuguugaaugguuuuuuuuguuuguuucauuuauuuuaucaaauaagguagagucaguugcuaucagccaaucuugguaaaucucuuguucauguucuuucuucaaauuucuuaggggagccuuauguuucauaaacuuagaccuguagaucaacugaggcaucuacuugugaguaaugugggaggagauggagaagagauugaaagauucuuuaaauuacaucagguaauuauauauacuuuuaaaaaaugugaugcuauuuuaaacaaacagugggagucauaguuuauguaaauugggacuggaauacuguaauaaauauauauauauauuuugagauggaguuucgcucuuguugcccaggcaggagugcaauggcgcaaucuuggcucacugcaaccucugccucucagguucaaaugauuguucugccucagccuccccaguagcugggauuacaggcaugugccagcacucccaacuaauuuuguauuuuuaguagagacagaguuucuccauguuggucaggcuggucucgaacucccgaccucaggugauccgcccaccucggccuccuaaagugcugggauuacaggccgugagccaccaagcccagccauaaauagauaaucuuaacaauauuccuuucuuugccuaagucacuguaugugaacugacauuugaaagcaggauuaauaugagucuuguagugagcuuucagauuuuuauucucuguuguugauaaauucuuuuuuuuuuuugagacagagucucgcucugucgcccaggcuagagugcaguggcgugaucucggcucacucuaagcuccaccucccagguucauuccauucuccugccucagccucccaaguagcugggacuacaggacccccccaccacgccuggcuaauuuuuuguauuuuuaguagagaugggguuucaucauguuagccaggauggucucgaucuccugaccucaugauccacccgccucggccugccaaagugcugggauuacaggcgugagccaccaugccuggccuguuguugauaaauucuuauugaagucugcuaguaagaguuucuuguucagguuauaugauaaaugccuuuucauuaaaagcacaagacauuuagggacaaguuguuuuugguuuguuuguuuguuuguuuguuuguuuuggcuuaaugaccugaggaagaaaccugaggcaacaguguagagaucuuaguauuucagagccacaacuggaauugauacgguuaaaauugggaguaguucaaaguuaaguauacagacucuggauucaaagcaccuguguuaaaaaucccagcuccaccacugagguaaauuacuugacuucucugggcuucaguuuccuuauacauuauaauaggaugugguaugaggauuaauauaugcuaaacucuuaaaauaguaccugacacaugguagguauucaguguuaccacuuaauuguuauuuucuagaaagcagaaagaccacaggaagaaaauuggagacauaagccggaaacuaagucagaaucuagguuaaaaggaaaagagaacauccuguaauccuagugcuuaugaugaacuuaaaaccaguaguguuuacuugucuuuuuaacacuaacugauuucauucagucagcaaguauuuauugaaugccugcucugugcuagauacagacuuuaauacugcaucuagcaguacacaaaucauuuuaaaauuuguauuuaauauaaggccaauauuccucuuuuuacacaggaagaccaggcuugugcaacuugccuuauucuugcuugcuccacugcugccugugauagagaaguaucugccugggcuacucgggcuuucuuuagguaugugaaaguuuuucuuguuuauuuauuuguuuuuuuacugggccacuuuuuaaaaugauuuuaucaaugugauaaagccuugccaaacaguugagugacuauguaggcaaauuaccaaaauucauuugcaaaagggugaaaucuggagagauuauaaugguaauagaagcaaguaaauuagcauaguuuaugcauuauuacuuuaacucuggauucuguucuguaacuucuugucuacuuucuacacuuuguucuaccucaguuacugucucaucuaucuuuuuuacuuccccaaacacuaugccaauucugcuuaauauguaucauuaguauugaaggcuucugaauuacuuuaaggaaacuugguaccaaagagauauuucuauuuagaaaauauuuaagaauuugaaaugugauuuuguuagaaacguuuuuugaaguacuaucuaaccauaaccuaguaugaaaauuacaaugccauuuacucacaaaguaaauucuaugcauugcauaucuuuuucuuagaaguuaucagagucccuuauaauucuuccugguagcaguuucaaguccacauuuacugaauaaauauuuauuauaagucuuaugcauauacuuuacugucagcacaauacauugaagucucuaauguuuaaagcauuuacuuggaagcuaaacaggaaaaggaacaauuccaguuuuuaagauggaugguuuguuuuacugaauaaacucaaccucuugucauaaaaauagguaugguggugaagcacagaugagauuuccaaccacucuuccgccuccaaguaauguuggucccaucuuggggucuccugucuauucuagugaguauggaacauugaaaugaaauuguuucuaaucguuugaaucuuagaaccuuuauagcaauuuuuaucaauaagccuuuucauuauguuuuauuuacugcuauuguauaauugaugaauacaucuauagauucugauucuuaaaagugaucuauuaauauugaauccuuaauguaaggaagcaaaauaagauguaaccaaucauauuuacauaacucauuugguauauauucagagggaaacagaugaaugauuuaauaauuaacucgcacaucaguguuuuccaaggugggaguuguuagaaacuuacuaggagaucagucccuaauucuugcauauaucguggacaauguaacuccuuaugcuuagaaauagcuucuguggccaggcacaauggcucacaccuguaaucccaggacuuugggaggccgaggcgggcagaucaccugagguugggaguuugagacuagccugaccaauauggugaaaccaugucucuacuaaaaguacaaaaaguagccggccugugguggugugagccuguaaucccagcuacucaggaggcugagacgggagaaucgcuugaacccgggagacagagguugcagugagccgagaucaugccacugcacuccagccugggccacagaaagagacccugccucaaaaaaagaaaaaggaaauaccuucuuuaccuaauuuugaucacauucaaaagauugagauguucuuuucuaaaucuuuauauucuucuuucccuuuuuagguucuccuguuccuagugguagucccuauccaaauccauccuuuuugggaacaccgucucaugguaccucuuuucuuuguuuuggauuggauucauuuugaagugcuaacauuaugaguuaaccuuaaugcuuagugugaaaaagaugaacuugccuuauucccuugaaaauaaauauaauuuuagaagcgcuguccaagcaaguuuuggcauuuggaugugaaugccuuuauuuaggaggaacuccucuuauaauaagccuggaaagcccauuauuuggcuaccaggauuaaauugaacccuaaaaucuguguaaucaguucuauuucacugucagcauuacaagcaguacuggcaaguuuguuuccuuuucauucugcauugugaacacuugcaagucuaucugggaguacccauccacauuuaaaucucucuucuuauuaaggaaaaccaaguuaaauaucuauguauuucauuguuuuuguaaauaccuuugugucuagauacacaaacuuggguuaugagaauucugaauuuuauggguucuaagauuaagagauuuauggguucuaagauuaagauuaagagauuuauggguucuaagauuaagauuaagagauuuguuuuucuuauguguguacaagguauacagccuccugccaugucaacuccagugugugcucugggaaacccagcaacucaggccacaaauaugaguugugugacuggaccagagauuguguacucuggaaaacacaaugguauuugcauuuacuuuucucggaucaugggguaaguuugucaugaaauaaugaauuauugcucaccuugucccaucuugaguaguuaaauauuuuuaacucugaauuugggacaucauuuauuccuauuaaauuuuaguuuuagcucacuuguugaucaauaaaacuuuucuauuauuccaguuuuuguuaucuaacuauauucauugcuguguuuuauuucucuuacucucucauaaucuauuuuuguagcaucaaaauacaguuguuccuuaacacagggguuaggggaugccaaccaccauuccucaaccuucauguagucaaaaauucauguacaacuuuugacuuucuuaauuacuaauagccuacugucuagaagccucacugauaaguaaucaauuaacacguuuuguauguuuuuuguguuuucuuuuuuuaacuuuugcaugguguaggaguaugggggagucucguaaaaaccagaaaaccugcuagacaaauucuaaaacagccguaacacugauauuuuguguuauauguguuauacacuauauucuuaccauaaaguaagcuagagaaaaaaaauuaagaaaaucauaaggaagagaaaauauauuuacuauucauuaaguggcaauggaucaucauaaaagucuucauccuugucuucacgcugaguaggcugaggaguaggaagaggaaggguugguuuugaugugcugggguagcauaggugggaaaaaaaucuguguauaaguggacccacacaauucaagcccauauuguucaaaggucaacuguauaucuacuuacauaugaauguacaguguuacaaacuuccccauaacucagugacaugugucuacaguucaacagggcaguucuugucuugcugggcuaacucaagaauaggcaaucaguugugaaguuaaagagagcuaugcuuaucuuggcuagacucucacauguucaagguuauauuuuccagcuggucuagaauggcccaagaugaaacagcuugguuguucucuacaugguuucucaucccccagcaggccagccaaagauuauuuaguuggugguggcagaguuccuugagaaagaguagacacuugcaaaaccuuuauucuaaacucagaacuggcuuaccaugcacuuuuccgccuuauucacuuggccagagggaagucacagggccaacucagauuuaaaaggugggaaauagaccaccuuuuaggggagagacaucaaaucauacugcagaggggauagauauagggagggauaaagaaaugugguuguuuuugcaaucagucuaucauguuaucuuaguuagcuaucaugccuaauauauauuucucuuagauuugagauguaugauuucauucaucucauuugcuuaaaaguaugaaacaguacagagccccuuuauaaauuuccuguuuacaauuuauuauacagagccuuuugauuuuucuucaguaauauuucauuaucugaaaaacuuagguacaucagguaugaaaauuuucuaguauuccacucuucuagauagcuuaguaaaauguuaaaugaaaccacugcaaguuuuaaaaacugaauaaagccauuaaguuccuagagaaagaaauuuauuguaauuguuuuuauucauuuacagcacaaucauuaaaacuuuuuuuuuuccagaaacauuugggaugcaagcuuaguuguggagagaauauucaagaguggcaacagagagaucacugcaguaaguguguauaauauuauuuuguuauuuuuguguagccaguugaugguauaaaugguuagauuguuucacauuuccugauauuacacaaauaagauggcaaagguuauuuuuuuuuuuuuuuuuuuuuuugagacagaguccugcucugucucccaggcuggagugcaguggcccagucucagcuuacugcaaccucugcccucuggggucaagcgauccucccaccucagccuccugaguaccugggauuacaggugugcgccaccaugccuggcuaauuuuuguaguuuuuguagagauaggguuucaccauguugcccaggccagucucaaacuccuagacucaagcaaaccaccugccuuggcuucccaaagugcuaagauuacaggcagggggccucagcgccuggcggguuauucuuuuauguauauguuugcauucuuggacaacaaacugcuuaccuucagguuuaaaucucaucucuaacauugauuaacugucugaauaugaguaaauuacuuaacauuucagagccugauaccucaugguaaaagaaggggcguaguauaucucccucauaagguugucaugagggauaacucaagcaacuuaauauugcucaaauuuuacuauguaauacuuugacauauauaugaacgaaaacuccauggacccagcacuaauuucuaugaauuggcauacuuuacagacugcuuuuugcucuuguugcccaagcuggagugcaguggcacaguuucacucuuguugcccaagcuggugugcaauggcauuaucucggcccaucguaaccccugccuccuggguucaagcgauucuucugccacagccucacgaguagcugggauuacaggugcgcgccaccaugcccagcugauuuuuuguauuuuuaguagaaacaguguuuuacuauguuagccaggcuggucucgaacuccugaccucaaaugauccgcccaccucggccuccacugagaauacaggcgugagccaccacgcccaguccaaauauauuuuuaauugugaggcucuuaaaguucaugaguugggcacaguggcccgugccuguaaccacaaugcuuuggaaggcuugagcccaggaguucaggaccagccagggcaacgcggccagaugccuuuucuauaaaauaaaauaagauuaaaauuagucagauaugugguggcaugugcugguacuuccagcuaauugggaaggagggucacuugaacuuaggaagucaaggcugcaguaagauaugauccgcgccacuacacucccaggcaacaacaagacgcugucucucaaaaaaaaaaaaguucaaguuucuaagaauaagaguguauuugccuaacacaguauaugauuccauauauauauauggaagucuaaaaacuuguaaaauuaaucuauguugauaggaguaagaaaaguaguuaccucagaggugggaugacuaauggcuacaaaggaacauaggaaacuuucuuugguguuggaaauuucuguauuguggucugggugaugacuauacaaaaauauauaaaaguaaucaagauguuuucuuaguauuuguauuuuauuguauguuaguuaugcaucaguguuacuggcaggagaggaaguguguagguauacuuuauucggaucaacaggugugaauugauacaagaaauaacuauagagauacucauuucaaaauuaaaauuguuuauauuauagcuauacagaggguguguuuuuaaacuuuugaaaaaucuuucauuuuuacagauugaaaguaguguucccugccaacugcuagagucagugcuacaagaacuaaaggguuugcaggaauuucuagacagaaacucccaguuugcaggaggaccauuaggaaauccaaaguaagaauaaauaggguuuauuaauucaucuuuuucuuuucguuguauuuuuuguugagaugauuuacauacuacaaaguugguccuuuuaaagugugcaguuuaguauuuuuuaguguaucuacaagguuaugcaaccaucaccacuaucuaauuuuagaacauuuucaucacagcaauaagaaacucuugugcccaugaccagccauuauuauucauggaccuucccccagucccuggcaaccacuaaucuacuuucugucuccacagaucugccuuuucugacuauuuauauaaauauuauauuuuauauauuacauaagauacacaauauauaaauauauuauaugaauauauguaaauggaauguuuauagaaauauaguuauauaaauggaauauuuauagaaauauaguuauauaaauggaauauagaaauauuuauaugaauggaauauuuauagacauauuuauauacauggaaucuuuauagaaauauuuauauaaauggaaguaugcaacagauaaccuuuggugucuguuucuuuccccaagcauguuuucaagguuugauuguuguagcauguauuacuacuugucucauuucucaguuuaucaguugauagauauuuggguuguuucagcuuuuuggcuaauaagaaugcugauaugagcauuccuguacaaguuuuuguguggacauguguuuagacggacucuugcucugucacccgugcuggaguacgaaggcuccaacuuggcucacagcaaccuccgccucccagguucaagcaauucuccugccucagccucccaaguagcuuagauuacagaugugcaccaccaugcccagcuaauucuucuuuguauuuucagcggagacgggguuucaccauguugaccaggcuggucuugaacuccugaccucaucauccacuggccucagccucccaaaguucugggauuacaggcgugagccaccaugcccgaccaagaguggacauuuggguuuuuuuuuugagacggaguuucgcucuugucgcccaggcuggagugcaauggugcaaucucggcucacugcaaccuccaccuccuagguucaagcgauucuccugccucagccuccugaguagcugggguuacaggcgccugccaccaugcccagcuaauuuuucuauuuguaguagaaauggaguuucacuauguuggccaggcuggucucaaacuccugaccaccuucaggugauccaccaugcccagcaauaauggauuuuuuuuuuuuuuuugagacagagucucgcucugucgcccagccuggagugcaguggugcggucucagcucacugcaaccuccgccucccggguucaugccauucuccugccucagccucccgaguagcugggacuacaggcgcuugccaccacacccagcuaauucuuuguauuuuuaguagagacuggguuucaccguguuagccaggauggucucgaucuccugaccucgugauccgcccgccucggccucccaaagugcugagauuacaggcgugagccaccgcgcccagccaagaauggauauuuuuaagccucuaauauaauacggacuuuuuguugaaaaauaauaaucacauggcauugggggagucacaucacuccuuagaauuguuaacgagguauuacaguauaaucuuuuuaaagcauauguaggccaggcagaguggcucacaccuauaaucccaacacuuuggaaagccaaggcaggaggauugcuugaagccaggaguucgagaccagccugggcaauauaggagaccuugucacuacaaaaacacauaaauaggccgggcgugauggcugaugccuguaaucccaguacuuugggaggcugaggcaggcggaucaccugaggucgggauuucaagaccagccugaccaacauggaaaaacccgucucuacuaaaaauacaaaacuagccaggugugguggcacaugccuguaaucccagcuacuagcuaggcugaggcaggcgaaucacuuaaaccugggaggcggagguugcggugagcccagaucgugccauugcacuccagccugggcaacaagagugaaacucugucucaaaaaaaaauaucauaaauaaauaauaaagcauacauaaauauacacuucuuuaaaagcaaaaacagagucuaaguaaguacacuuuuauauaacauuauucauacuuuguguguguguguguauacauauauauauauauuccccugccccugccgaggcagagucuugcucuguugcccaggcuggagugcaguggugcaaucucagcucacugcaaccucugccuccugggcucaagcaguucuucugccucagccucccgaguagcugggauuacaugcaugugccaccaagccuggcuaauuuuuguauuuuuaguagagaugggguuucaccauguugcccaggauggucucgaucucuugacuucgugcuccgcccgccucagccucccaaagugcugggauuacaggggugagccaccgcgccuggccugucuuuaucuuuuaagcaggagaauuuaccuccuucccauuuuauuggaauuaguuaaaugugguuuauuguuuugguuugguuuuuuuggagacagagucuugcuuugucgcccaggcugcaaugcaguggugcaaucucagcucacugcaaccuccaacucccuggcucaagcgauucuccugccucacccuuccaaguagcugagacuacagccccacaccaccaugccuggcuaauuuuucuauuuguagcagagacaggguuuugccauguuggcaaggcugaucuugaacucuugaccucagauaauccaccuucagccucccaaaguucugggauuacaggagugagccacugcaucuggucuaguuaaauguuugauuuuuuucuccccauccugaauuugugcuuuuuguuuauuuucuucccuuucccauuuccuuauuguauuggauugaucaggccucucucuaccuuaaacaccaauuaagaaguucuacauaugauuuuucuuccucuguuagucuuaaauucugacagacaugcaucucagucagcauuaauaauuuaacaaacucuauuacauuuuguuuccuugccuucuacugccaucccucucccuccaaauuaucuggaauuuuacuugucagauguuuuuaguuuguuugguuuuuuuucuaacauuauggucuuuuguuaauugaauuuuaccauuacaucugcaauuauauguaaauuuucuaaucuacuucuaauuucucuuaauuacucauuuaucuuuacaguuuuuagcaggauguuuuuuucauugauguuucuugaauugucacagaagcaguucugucaucugcaaacagagauaguuucaucuuuuccaucuuuucuugucuagcucuacuugcuuucuccucucugcacaagguaaucucucucucucucuuuuucuuuuuaauugagacagaguuucacucuuauuaccuaggcuggagugcgauggcaugauccucggcucaccgcaaccuccgccucccggguucaagcgaugcuccugccucagccuccugaguagcugggauuacaggcaugagccaccacgcccagcuaauuuuguauuuuuaguagagacgggguuucuccuuguuggucaggcuggucucaaucucccaaccucagguuauccacccgccucagccucccaaagugcugggauuacaggcaugagccgcugcgcccugccacuuaucucugucugucuuuucucuuuuuuuuucuuuuuuaggcaaucuugcucugucauugaggcuggagugcagugaugugaucauuauucccugcaaucucagacucagccgccugaguagcuggggcuacaggcaugugcugccacaccuggcugauuuuuucuuauuuuucucagagauagggucucacuguguugcccaggcuggucuaaaacucuuggccucaaguuaugcucccuccuuagcuucccaaagugcugggauuacaggcaugacccacugcauccacccuuacuugagguguuuuuugguuuucuuuuuugagacuggucucacucuguugcccaggccggagugcaguggcaugaucacggcucaccgcaacuuugaccucccagcuucaagugauccucccaccucagccuccugaguaguugggacuacaggcacaugcuaccaugcucagcuaauuuuuuuauuucacauuuuguagagacaaguucucacuguuuugcccacguugaucuugcacuccugggcuuaggugauccuccugucuuggccucaaaaaaugcugggauuuuaggcaugagccauccgcacucagcccuuauugaauauguuuaacauauucauauauuuaacauauugaauaugcuuaccauauucaauaagugaguuugucaaauguauuuacugcauuuuacagagaugaucauaucauuuucccccuuaccuuuaacaauagaguuaauacauguccuaauuucgaccaacccuuggauuccuauaacauuaguuucauugacuauggaaauuuuuuaaacagauuuuugagaucuacuuuacauaccacuaaauuuacucauuuugaauguucaguucagugacuuuuaguaaauucauagaauugugcaaccaucaccacaguccaguuuuagcacacuuccauuaucuaggagacauaccucauguccauuagcagucacuuuccauucccacuucuuagccccagacacuuacugaucugcucuaucucuguagaugugccuauucuugacaugucauauaaacagaaucauacuguguggucuuugagucuggcuucuuucacuuaguguguuuugggggcucauguuugagauuuaugugguaggauguauucaugcuuuguucguuuuuauugcccaaugaaugugggauuuuaagaucauagaccauuucucagaucuucguauacauuuugcaccauuuucuucccaaaguuuaauguuguagaugaaaaaguacauuaucuguaugauucuccuuccuuuguaagugacuuaguguuuacuuugaaauuuuuuuguguuuuuuucuuuuuguuaccgaaauucaaaagucacaugaugucuuuagguauaucuucuuuacagcucucagugagccuuaagaaugaacgucuuggcuuugaucaguuuucuucucucguuuuuuauguauugugauacacauugaauaucccuuauccgaacuguuuggaaccagaaguguuuuggcuuucacguuuuuuuugauuuuuaaauauuugcauuauacuuagguugagcaccccauuccgaaaauuugaaaucgaaauugcuccagugcgcauuuccuuugagcaucaugcugaugugcaaaacguuucagauuuggggacauuucagauguuaguuuuuuuuuuuauuagggauacucaaucuauguuucuucugucccauucucuuuggagaaucauauuaacucuuuuguaucuagcuuguuucuucucuuccguaauuuccuuccuuccuuucucuccuuuacccccucuuuuuacuugaucuuuuuuuuucuacagguuaggaaaauuuauagcugauguucucagucauuuaauugauuuaaucucagucauuuuaaguagcaucuguuuagucugugucauaaauuuuuucuggccaucagcccuucugguguugguugcccaaccuucugaauuauuuaaaaaaaguaaacauauuaaauguuugaauuguacuguauguguuauaucucaauaaagcuguuauaaacacacacauucugcaauuucuguuucaguacuacugcuaaagugcagcagaggcugauaggauucaugcguccugaaaacggaaauccccagcaaaugcaacaggaacugcagaggaaguuucaugguaaauuauugcuucucaucaguuaagcguacaugaccucaguaaaauuuuauuacuugaauagaaaacaauggacuuucuuaguaagauguacuuuguacacaaauauuuguaauuaaaauaucaguguaauuggguccggggugguggcucacaccuguaauaccagcacuuuggaaggcugaguugggaggaucaccucuuccugggaggcagagguugcagugagcugagaucaugccacugcacuccagccugggugacagagugagaaccugccucaaaaaaaaaaaaaaaaagugugauugggaaaguaggauaauauggauauuaauauggauauuguauauuucccuaucucuuuuagcauauacauuuuuguuccuuccuccaccagaaaacaugauacacaccuauuucauuauguuuuuuuuauuguggugaaauauauauauaccauaaaauuuaccauuuuuacuuuuuauuuguuuauguuucugagacagaguuucacucuuguuucccaggcuggagugcaauggcgugaucuuggcucacugcaaccucugccuccuggguucaagaaauucuucugccucagccucccgaguagcugggauuagaggcaugugccaccacgcccggcuaauuuuguauuuucagaagagacgggguucuuuauguuggucaggcuggucucgaacuuccaaccucaggugaucccguccgccucggccucccaaagugcugggauuacagaugugagccaccgugcccagccccauuuuuacuuuauuuuauuuauuuauuuauuuuuuugagacagagucucacucugucgcccaggcuggagugcaguggcaugaucucggcucacugcaagcuccaccucccggguucacuccauucuccugccucagccuucugaguagcugggacuacaggcgcccgccaccacaccuggcuaauuuuuuuuuuuuguauuuuuaguagagacaggguuucaccguguuuaagcaggaugaucucaaucuccugaccucaugauccgcccaccucagccucccaaagugcugggauuacaggcaagagccacugcgccuggcccguuuuuacuguuuuuaaguguacaguucaguggcauucaguauauucauuuuauguacccauuaccagcaucuaucuccagaacuuuugucaucuuccccaaaaaugucacucugggcugggcgcaguggcucucaccuguaaucccagcacuuugggaggccauggcagguggaucaccugaggucaggaguucaagaccagccuggccaacauguugaaaccccaucucuaccaaaaauacaaaaauuagccaggcgugguggcgggcaccuguaaucccagcugcucgggaggccgaggcaagagaaucacuugaacccagcaggcggagguugcagugagccgaauuugugccauugcacccuagccugggcaacaagagcaagacucugucuuaaaaaaaauaaacaccaaaagucacucuguacccaugaaauaauaaccccccauuuuuuuccccuauccuaggucccuggcaaccaccauucuacuuucugucucuugaauuuuacaacucuggguacccuauuaggaugaaaucaaauuuuacauuuuguggcaggcuuaugucacuuagcauacuguccucgagguucauccauguuguaacgugucagaauuuccuuccuuuuuaagacugaguaauuucuauuguguauaugugcauaugugcacauauaccacauuuccuuuauccauucaucuguugauggacacugaguuacuuccguuuuuuggcuaucgugaauaaugcugcuauuaacaugggugaacaaauacaaauuaaagccucugcuuucaguucuuuuggguauauacccagaaguggaauugcuauaucauaugguaauucuauuacuaauuuuuuugaugaacugccauacuguuucauagcagcuacugcauuuuauguuuauguuuaucuuuauuucuuuuugagacggaguuucacucuugucucccaggcuggagugcaauggugcgaucucagcucacugcagccuccaccucccagguucaagcaauucugccucagccucccgaguagcugugguuacaggcaugugucaccacacccagcuaauuuuuuuauuuuuaguauaguugggguuucaccauguuggccaggcuggucuugaacuccugaccucaggugauccacccacuucggccucccaaagugguaggauuacaggcgugagccacugcgccuggccagccacagcauuuuauacuucuaguagcaaugcacaaggguuccaauuucuucacaucuuugccaacauuugucauuuuucuguccuuuuauauauagccauccuaaugaacauggaauggcaucucauugggauuuugauuugcauuucccuaaugauuaguaauaugccuuuuuauagagcuaaaaauaugaaucaaauauuucauugugcuuuuuaucaauuauaaguaguaacaaguaaggaaagagcaaggcaacugaaaaguucucauaaucuucaguuauuccagauacaaguuagaacaauaauaaguuauugcaugaacuuuuugugccauuuaauuuuuucuaaguucuuuugccuuccauuguuaggguuagaguuacuuuuucuggccgugauagaacuuucugguuuguuuguuuugagauggagucucgcuuuuucgccgaggcuggagugcauuggcacaaucuuggcuuacugcaaccucuaccucccagguccaagcgauucuccugccucagccucucaaguagcugggaucacaggcgugugccaccacacccaucuaguuuuuguguuuucaguagagaugagguuuugccacuuuggccaggccggucuugaacucaugaccucaggugauccgcccaacucggccucccaaagugcugggauuacuugcgugagccaccacgccuggccaguagaacuuucucaguuaacacucaaccauuuacuuuugucccaaguuacuuucuucccuacugaggacccuagguuucuauucaucauuuuguaaauucuuuuuuacuaucuuuuaaauuuuuugucucucuuuuauuuuuuuggagauggagucuugcucugucgcccaggcuccgccuccuggguucacgccauucuccugccucagccucccaaguagcugggacuacaggcacccgccaucccccccaccagcuaauuuuuuauguuuuuaguagagaccgaguuuuaccguguuagccaggacggucucgaucuccugaccucaugauccaccugccucggccucccaaagugcugggauuacaggcgugagccaccgcgcccagccacacagcaauauuuucaugguuuauguguaccuacacaaacacagaagcauauauauauacacacacggagaagauaauaacauaaauacuacugauuaucaugguugccuguaaugggggcuaggaagaaaacaacagggauuucaaccuuaacuacaguuuuuauuugaaauaaagcaacuuaaccuauguuauuuuauaauaauuuauuuuguuuucucauuagaggcucaacuaagugaaaagauuucacuucaggcaauucagcaguugguucgaaaaucauaucaggcucuggcuuuauggaaacuucuuugugaacaucaauucacuaucauuguggcagaacuucagaagguaauuuuuuuuauuuuuuuaugauuauaccauuaauacuauguuuggauuuuuuggaugaguauuuuggcuuuggaggggauuauuuugggaagcauuuaaguuaugaugaaguuaguauguuaugggaagauggcacaaaaaaagcguaccaacuugggggaccuauuuuuucaaagccgcaaguuuuuacuuguggguaugugaaugaagucauacuuuacaaaacauauuuuuuaaaacaguggacuuuacccuuuauuugagcuacagguucuucugagaaucugauaaaagcuaucucucacuacccuuaaagaaaugcauaucgacauggacacacagacuuuugcuuauaauuucaaagggcccaacaaccuaaauuaaauacucuugacugggcaccaugccucacgccugugaucccaacacuuugguaggcugaggcaggaggaucacuugagccuaggaauucaagacuauccugggcaagaugucaggacccaucucuacuaaaaauaaaaaauaaauuagucaagugugguggcacaugccuguagucccagcuacuugggaggcugaagugggaggagcacuugagccugggagguugaggcgccacuuagccaugauggugccacugcaccccagccugggugacagagugagacccugucucucucugucucucucacacacacacacacacacacacacacacacauauacaccacuccuacuucauuuuauguuuucuuuuuuuuuuuuuuaagagauggagucucacucugucgcccaggcugcaguugugcaaucucggcucgcugcaaccuccaccucccggguucuagcaauucuccugccucagccuccugaguagcugggauuacaggugcaugccaccacgcccagcuaauuuuuuguauuuuaguagagacgggguuucaccguguugcccagggugaucucgaacuccugagcucagguaauccacccgccucagccacccaaaaugcuaggauuacagacgugacccaccaugcccggcaacugcuccuacuuuaaaggaagauauuuaucacuguaggaaauaaaugguucauauuucuuuugauguucacauuugaauccuuucuaaggauaaggauaaucaacauuaaucuaaauguuagauagaauauauagaggaaauuuauuccuaccuuuuauuuaauugugagcauuucuaaacguauacaaaaguagagcaaaaacuguaacucccauauacauuugacucauucagcauuuucaagauacuguguuucuaaaaaaaauagacaguuccuugaacaacaacaaugucaugaucaguuaccaguuuuucuugagacagugucucgcucugucacccaggcuggagugcaguggcaugaucacggcucacugcacccuugaccucucuggacuccagugauucuccuacuuuagccucccgaguagcugguacuauaggcacgcaccacuacgccuagcuaauuuuuguauuuuuuuguggagaugggguuucaccguaucuccuaggcuggauaguuaccaauauuaacugucaauauuugauagcaaaaucugucuuaaaaaugucuuuuuacagauugguucauucaaaucaggaucuaaacaguuuaagggguuugcucauggaauuuguuuuucucuuucaucuguuucagucuaaagcagucuuuccuucuuuuucuuuuccuugcuguugccuuguagaaauccagucauccauccaguagaauguccagcauucuaaggacauucuaaggcuuuuuuuuuuuuaauccucuuuguagcgagcuucuuccucuaucuccugcauuuucuauaaaaugaaaguuuauuauauaggcuugauucaguucagguccuuuuuugaggaagaauagaauacuucauagguagugguuuauucaucagacuguuagaagauacaaaagguuucguuguccuucuuuuaguuauacuaagauaaauugcuggauucaaguaguaagccuaauacugccauuguggaauucuccaucagauuuuaaucauccauugauaaucauugcuggaauuuauuauuucauuuaggauuacaaaaggguaauauuuauuuauuuguuuguuuguuuuuuauuuuuuuugagacagugucucauucugucacccaggcuggagugcuguggagcaaucugagaucacuguaaccuccaccucccggguacaagcaguucuccugccucagcuucccgaguagcugggacuacaggcaugugccacaacgccuggcugauuuuuguaguuuuaguaagagaccggguuucgccauguuggccaggcugguguugaacuccugacgucaggugaucuaccugccuuggccucccaaagugcugggauuacaggcaugagccaccaugcccggccaaaaggauaauauuuuaaaucugugauuccuuccccaguuacuagcugcaauucuguaaaaaaaaaaaaaaaaauucuuuuuccuuguccuguauggauauuucauuacucugaaacacuuacuuuuugacucucguauaccauuuuucaacguuggaaggcagucuccucauucuuuccacuaguguccaaugaauaguguggcuuuuguuggugguuuuguuucuuuuaaauacauacuguuuuuuauuuuuaaaaauucaagcuaauauauuuaauuaugaaacuuaucuuuuucauaccaaguagaauaauaauuuugaguuuuauagagugauaaauauauuguagguagguuuuuauccuggguauguuuuugugauccaucuucaaagcucucuuccuuacaucaccaauggcaugcucaaugaaugcaaauuaaagauuuguucaagaauuuuaacacaguuuggguauuuccuugaauuuagaaaaaagagauagcagucacaucacuaacagaaucuuuuacuauaguauaaaucaauacuuuagagcuucauuuggacaagcagauuuguucacaauacagauuaaacuccaauauuauuauaaggccuagaauaauggaauucuaacaguguuuaggaaggaguaauauguaagcccaagauuuucaaauauagccaagugauuguuuuuuccauuuuauaaccaaagccaggagaucugacucuaguuuuggcucuacuuaagcuuuacuuuucucauuuggaaagugagaguuuuggacuagaucuacuguagguucuuuuccaacucucuaugauuuuauguaaguucgcaaaaauuuguuucuacuaauuaguauauuuucgcuuuucaauuauagagucuauuaauauuuagguuauuuuaauuuauuaaaauaauuucauuauguuuagaaauaugguauuucuauaauugugauagaaaaguuuuaugcuccuaggaacuucaagagcagcugaagaucaccaccuuuaaagaucuuguaaucagggacaaagaacucacaggggcauuaauugcuucucuuaucaacugcuacaucagagauaaugccgcuguugauggcauuaguuuacauuuacaggauaucugcccacuucuauauagcacugaugaugcaauuuguucuaagguaugauacuuuauuaccuauuucauuguuuguuauaagagguaucauguaugaugaaccaucuuguuucacuuaauauaggaccucagucaguuagaucucuuaaccucuccuagccucagaauccucaucuaagaaagggguuggaauauguggcuucuuaaaaccaguguauacucuuuuaagcuuagcuuuucuuuuuaaaaauauuuuuauuuauuuauuugacacaggguuucacucuguugcuuaggcuguagugcagugcugugaucauagcucacagcagcuucuaaguccuagacucaagcaggccucucauguagcuaggggcuacgggugugcaccacuacacccagccaauuuuuuuguuuuuuauagagacaaguucugauuuguugcacaggcuggucuugaacucuuggcuucaagugauccuccugccucagccucccauagugcugggauuauaagugugagccaccaugcccagcccuccuuuaaguuuuucauaaagaauauucucucuuuuuuuuuaagacugaguacgaucucagcucacugcaaccuccaccucccagguucaagugauucuccugccucggccucccaaauagcugggauuacaggugugcaccaucacaccuggcuaauuuuuuauauuuuugguagagacaggauuucaccauguugucuaggcugguuuugaacuccugaccuccgccugccucagccuugcaaaguguugggauuauagacaugagccucugcgccuggcccauaaagaaucuuugauaguguuucuaggccauauuaaaaaaccaaaggugagaaauuaagaaaaaucacuaaauuuagaaauuaaggaaauuuaggggauaauuuaucuccuuagcuuaaggaaaaguacuaaaacuucaaguaaaucuuuuagugaauuagaguuaaugggggcauuuuuauugauccuuuccuacagguggaaaaaauaaauaaaucagugucacauggacugccugcugcccaauaauguauugacuaggcaagagaauuaccagacaaaaguucucuugcuuaacauauuugggagaggaauuaagaauagcuaggaaucuuuggucaaaaacuuuucugccuaaaauuaagaaguaaguuuguagaguuguuuucauuuuaaugguaauaaccauauauaaauuuagacauagacuaaaacuuaguugacagcaucaucugucugcuugauuuuauauauuuuuaaguucuuguuaucuccucuucuaggcaaaugagcuucuccagcguucccgacaaguucaaaauaagacugaaaaagaaagaauguuaagggaaucauuaaaggaauaucaaaaaauuagcaaucaaguggaccuuuccaauguuugugcucaguauagacaaggugagaaauaaaauguuucuuguaucuuuuacucaacucaaaagacaaacaauaguguaugaaugaagcaagcuaaugaugaaaagccacuuuccagaugcaaaucuucuuucagcaucagaggccgagugaaaggacguaggaaugugguaucauuguguugcaauauuugaugacuacacugaccugcagaagcuguaauguucuuucuauuuuuugaaauguacuuuuuuuuuuuuuuuuuuuuuuuuuugagagucucgcucugucagccaggcuggagugcaguggcacgaucucagcucacugcauccucugccucccagguuccagcaauucuccugccucagccucccggguagcugguauuacaggcgcacgccaccacgcccagcuaauuuuuuauuuuuuuauuuuuuuauuuuuuuuauuuugagacagagucuugcucugucacccaggcugaagugcaguggugcgaucucagcucacugcaagcucugccucccagguucacgccauucugccucagccucccaaguagcugggacuacaggcgccugccaccaugcccggcuaauuuuuuuguauuuuuaguagagauggguuucaccauguuagccaggauggucucaaucuccugaccucaugauccacccaccucagccucccaaagcgcugggauuacaggugugagccaccgcgcccggccauugcccagcuaauuuuuguauuuuuaguagaggugggguuuuaccauguuagccaggguggucucgaucuccugaccucaggugauccacccaucucagccucucaaagugcuaggauuacagacaugagccacugcgcccagccgaaauguauaacuuuuuagcauuagaguuucaguucuuguccaguucaauuacuguauguuuuacauugcuuucuggauuacauuuauuuuucagauauuuaaaauuuuuuauugaguuuuaagguauaaucugcuuacuuuuuaaaaaauuacuuuaaaucaaaucuaacauaauguaaaggccauaacuauuugcacagguauuauuuugaaucccaagguauuuuuuuccccccaguagggaacuaaaacuuuccuuuuuguuauuugaaauaggaucuuuuuuuuccaaugaagaaauauauauauauauauauuuuuuuuuuuccuuuuucuuuuuuuuuuugugagacagagucuuguucugucacccaggcuggagugcaauggugcaaucucagcucacuacaaccucugccucgcuaguucaagugauucuccugccucagccuuuugaguagcugggauuacaggcgcaugccaccaggcccagcuaauuuuuguauuuuuaguagaggugggguuucaccauguuggucaggcuggucucgaaccccugaccuugugaucugcccccucucagccucccaaagugcugggauuacaggcgugagccaccacaccuggcccccaaugaagaaauauauuuaacaguugccuuuuaggcauauuaagaccuuuuccuucugaagaccuaucagaaauauuuuauguuagcagggugacuauuguacaguagagacauaaccuugaucauuauuuucaugugccagcuaaggaaaaauguauccaacuuaguaguaagucauaggucuucauucuuuucuuucccaucagugagauuuuaugagggugugguggaacuuucucuuacggcugcagagaaaaaagauccucaaggucuugggcuucauuucuauaaacauggagaaccagaagaagacauaguuggacuucaggccuuccaagaaaggugcauuccauuacguuagcagauugucaucuuuauggauacagacuuuucuuugcauaauguuuuuuguuuuuuguuuuauguuuuuuuuuuuuuuuugagacagagucuugcucugucaccugggcuggagugcagucgugugaucuuggcucacugcaaucucugccucccagguucaagcuauucucgugccucagccucccauguagcugggauuacaggugcacaccaccacgccuggcuaauuuuuguauuuuuaguagagacaggguuucaccauuuuggccaggcuggucuugaauuccuaaccucaagugauccacccaccucagucuugcaaagugcuaggauuauagccaucagccaccgugucuggccucuuuguguaaaggucgaccacccaaagugcugggauuacaggcaugagccaccauguccaguaggauuucauuuuaaaggauaauuuuuaaguauucccaaauuuguugagacuguuaaaaaggaaauguguguccuuaaaagaaauauaggccaggcacaguggcucacgccuguaaucccagcacuuugggaggcugaggugggcagaucaugaggucaggaguucgagaccagccuggccaucauagugaaacccugucucuacuaaaauacaaaaauuagccaggcgugguggugcacacccguaaucccagcaacuugggaggcugaggcaggagaauugcuuuaacccgggaggcagaggcugcagugagcugagauugcaccacagaacuccagccugggcgucagagcagggcuccgucucggaacaaagaagaaauauauaaccuuucuauaacauauauauauggaggguguuuuguuuuguuuuuguuuuuguuuuugagacaaagcuucacucugucuccugggcuggagucaguggcaccaucauagcucacuguacucuugaccuuuugggcucaagugauccagugauccuccuaccucagccuccugaguagcugggacuacaggcacaugucaccacacucggcuaauuuuuuuuuucucuuuaauuucuguagagacagggccucacuauauugcccaggcuggucuuuaacuccugggcucaagcaauccuuucuucucagccucccaaagugcugagauuagaggugucagccaccacaucuggcgaaaacauauuuuuuuauuacuauauuuaaugacuuuacccuuuuaauguuuaaccaaacacuucucaaacuuauugaaaaaguauaugguuuguauuauuuuaaaugccaaauauguacaucuauucugccaaauagucuugaaauccuuguauauacuuagguaagguaaaucaauggcuuucuuuuuuguuauuuguuuuguuuuguuuuugggggguuuuguuuuuuguuuuugagacagggccucauucuguugccugagcuggagugcaguggcaugauaauagcucacuugcagccuugaauuccuaggcucaagcgauccuccugccucugccucccaaguagcugggauuacaggugcacaccgccacgccugguuaauuuuuuguuucguuuuguuuuguuuuuuguucguuuguuuuuugagacagggucuugcugucacccaggauggagugcaguggcaugaucucagcucaccucaaccucugccucccagguucaagcaauucuugugccucacucaccugaauagcuggcacuacaggcaugcaccaccaagcccggcuaauuuuuguauuuuugucagauacgggguuucaccagguuggccaggcuggucucaaauucgugaccucuggcagucccccugccuucgucucccagagugcugggauuacaggugugaggcacugugcccagccaauuuuuuuguauuuuuuguagagacguggucccgcucuguugcccuggcuagucuugaacucccagccucaagccguccuccuaccuugacuucccuauggcuggcauuacaggcgugagucaccacacuuaccaucauuugcuuucuaguuaaauaauguaauuguuccuuuuccauuuucuuucagauuaaacaguuacaaaugcauuacagacacacuucaagaacugguaaaucaaaguaaggccgcuccucagucucccaguguacccaaaaaaccugguccuccaguguugucaucugauccaaauaugcugaguaaugaagaagcaggacaucauguaagggacauaguauauuuucauucugagaauacacuguuuagaaguucuccaugguaaugguagcacagucaucuuggggaaaggugguaguucuuagaaguuaucauguaaggauucuugauuucuuacuggaguuuauagggcuaaaggguugugaugcccagaaacagagccuuuaacugcuaauuuuuacuauuuucuuuauuuuaguuugaacaaaugcuuaaauugucacagcgauccaaggaugagcucuuuaguauugcccuuuauaauuggcuaauacaagucgaccuugcagauaagcugcuacagguaaaucuuuuuuuauugcaguuguguuaauuauucuuaaggagcauaacucaaugauuuaagcacauauauagauguaaaaaauucaguuucucaucccaugccugcuauuagauguuaguauaaagcugaguaaugcaguaucuuuuccuaaggggcaaaguaggcuacugcuccaauuuucuuguuaauucgaagcugauugggauaguuuguauugcgggguagaaaucacuggauuaugaauaugaguccuguaggucaucuuaucuuaacucugcuguuaagucacugugacuucagauauguccuuuuaccuacccuaaguuucaguguuccucaaucuguuuaaugaauacauagcauuugauaauuucaauaaugccuuugagcucaaugucuaggaaucaauagcuguguuaucaaaguuuauuuaaaaauuuguaauuuuauaguaaauuucccuuuuuuuuuuuuuuuuuuuuuuuugagauggagucuggcucuguugcccaggcuggagugcaguggcaugaucucagcucacugcaaccuccgccucccggguuccagcaauccuccugcuucagccucccaaguagcugggauuacaggcacccgccaccacgcacagcuaauuuuuauaucuuuuuaguagagacgggguuuuaccauguuggccaggcuggucucaaacuccugagcucaggugaucugcccaccucagcuucccgaagugcugggauuacaggcaugaaccacugugcccggccaaauuuccuuuucuuuuuugaggcagggucucaaucuguagcuuaggcugaagugcagugcaauggcacgauaauggcucacuguagccuugaccucccuaggcucaggugauccucacaccuaacccuccugaguaacuagaacuauaggcccgcaccaccacacccagcuaauuuuuuuguagagacgagguuuugccauauauugcccaggcuggucucaaacuccugagcucacaugaucugcccaccucggccucccaaagugcgaggauuacagacaugagucgccaugcccagccuacuaaauuauuguuaucaaccuaauagaauuguuuuggaaacucuuaugcuaacugugguaaaacaaaaauuguuuauaauaagaaaauuugcccucucuuuuaucuguuaguauuggauuauaauuuugcuuguuuucauaaaacaaggcaaaguuguaguugacuuaaaaauacuauauuuuccuuaucaggaacauuaucuguaggugguuagaaaauuuuucugaauaacuauauaauuucuagguugcuucuccauuucuggagccacaucuaguccgaauggccaaaguugaucaaaacagaguucguuauauggauuuacucuggcgguauuacgagaagaacagaaguuucaguaaugcugcucguguacuguccagacuggcugacaugcauagguauggcauaauauucuuauugugaagaaugauucaaaacugagcuauauguacuuacauucaguuuucuuuaauuuuagaagaaucuaaguuuuaauauacugaccuaaauuuuuuaaauaggauguuacuuuuuagucauaaauguauuucuuuauguguugucuaaaauuguggaucucucuuaugagaaaucuaaaauagauuuuuuuuuaaaucuaaugauuuuuuuucaaguuucagauggcuuuuuauguguguuugguaugaaacaguacauacuaauugacguauuuguaucaucaauccuuaagaaauuguguaacuaaaaauaagcguuuucccuucuagcacagaaauuucacuucagcagcgacuagaguacauugcucgagccauucuuagugccaaaaguuccacugccauuucaucaauagcugccgauggugaauuucuucaugaauuagaagaaaaaauggagguaagugcuaaagaucuuaagcuguguccacauugaguacuagccacauaguuauuccacauuccauucuucccuugguaaguaauaggucugagaagucauuauuauucuaguugcuuuugucuguuuauauuuauuuuuauguuuagauauaaaucuuaaagauuuuuaaggaugcacuugggucauaaaaacauugcuauaauuuagaaguuuucucuuuggcacuucgaaagguuuuucccagcugggugcaguggcucacgccuguaaucccagcacuuugggaggccgaggcagccagaucaugaggucagaaguucgagaccagccuggccaauauggcgaaaccuugucucuacuuaaaaaaauacaagaauuagccgggggugguggcacacaccuguagucccagcuacuugggagacugaggcaggagaauugcuugaacccaggaagcggagguugcagugagcugagauugcaccacugcauuccagccugggagacagacugagacucugucucaaaaaauaauaauaauaaaaaauaaauguuuuucccaacuguuucaacagcaaguggauuacaucacauucaccauuuauuuuggaagcaaauaaguagauguaugaaguagaguaggcuaaaauucccuaacuaagagaaucaaaaacauaccaucguccaaauacaaaaguuuguuucuuauucacaaaaauccaaggugagucuuccugauuggcagcuggcuuuccuccgugugguugauuuaggaacccaaguucuauuuucuggcacuaccauucccuagggccucugcuuuaucuucagcagaggguggaaggaaaagaaagaacacauucacugucuuaaaaacuauagcccugacaugacacacuacuucuacucacauuccuuugaagagaacuugguuguauggccauaccuccccuacagaggaggcugagcuguauagucuaaccauuuggcuacagucuuggaagguauaaguauugggcagcaaggagucugccacaguauacuuccugugaaaucuauuauguuuaguugaugucuguuaugauaauauuagccuauuaugauagaaaucuucauuuauacauuauuuuagcaaacuuaaagucagauaguaggauccguucuuucaaacguauguugauuuaucauaaauaaauuaagacauccuguuuucugcccaaacuagguugcuaggauccaacuucagauacaggagacacuacaaaggcaguauucccaucauucuucuguacaggaugcaguuucucagcuggauucugagcugauggacauaacuaagguaauaaaaaagcaagugaaauuuuuauaguaguuaccuaauaaugagaaauuuuuguuuuuuauuuugcuuuuuguuucauggggaaaauuaccuuaucuccacaaauaagauaaggcaucuuuggcagcuugucacugggcugacagaucaccacugcuucaucugacuccuagaaaaaggcuaagcuacucuuuccaggccaguagcuacaaagaaccuaucauccucgcaugagagcuguguuaaaaccagcuuauuuccagccugggcaacauggcaaaaccucaucuuuacaaaaaaauagcaaaaaaggccaggcacuguggcucacgccuguaauccaacacuuugggaggcugaggcgggcagaucaccugaggucaggaguuugagaccagccuggucaacauggggaaacucugucucuacuaaaaauacaaaaauuagccaggcgugguggcaugcgccuguaaucccagcuaccugggaggcugaggcaggagaauugcuugaacccaggagguggggguuucagugagccgagaucauggcacugcagucuaggagccugggcgacagagcaagacuccaucaaaaaaaaaaaaaaaaaauuagccaggugugguggugugugguuguaguucaucuacucaggagucugaggugggaggauugauuuagcccaggaggcccagguuguggugagccucgauggugcuacugcauuccagccugagugacagagugagacccugucucaaaaagaaaaaaaaacuaaaaaaccaaaaccaucuuauuuauggccucgcuucuugccuuggaaaaacuaacuuaucuuugcuuaacucucuaaaccucuuucucucucuguaauuuucugagcaguuccuuccucuucauuuauucuuagacauaguuccagguacccugaaacacuuugagauuugucaguauuccugugauucuucaacccauuguuuauacaacacuaguucuaaaauaccauugcaggagguuuguagggaagguggggaugguuaauggguacaaaaacaaaaugaauaagaccuaucugauagcacaauagggugacuauagucaauaauaacuguauauuuuaaaauagagaauguaauuggauuauuuguaacucaaaaggauaacugcuugaggaauagacauucuccaugacaugcuuauuucucauugcaugacuguaucagaacaucucauguaccccauaaauacauacaccuacuguguacccacagaaauuugaaaaaaugaauuuuaaaauuaauaaauagaaugucguugcaacaucuucuucccagccaagaaaaaagcucuacaugcuaaaauguguuugaauguauuuaccauacccuuacccuuuuuuuuuuuuuuuggcggggggagacagagucuuucucugucaccaggcuagagugcaauggcgugaucucagcugacugcaaccuccaccuuccucagccuccugaguagcugggacuacagccaugcaccaccaugcccagcuaauuuuuuuuuuuuuuaaauuuuaguagagacgggguuucaccauauuggccaggauggucuccaucucccgaucucgugauccgcccaccuuggccucuuaaagugcugggauuacaggccugagucaccguacccggcccauacccuuaacuuuuuaaauauggaguuauaaccagcuacauacaucaucacaucuuuauaucauauuucagaaacuuuauguaaaaucuuugguuauuuuuuaauuuucaaggagugcuucacuauuaaucucugaauguugaucucuaguuggauguuaauuuugggauuuucucucacagcuuuauggggaauuugcugacccauuuaaacuugcagagugcaaacuugcaauaauucauugugccgguuauucagacccuauauuggugcagacacuuuggcaagauaucauagagaaagguaaguguucaguuauagguauguuagcauacguuauguagugacuugguggaggaaugcaagcugcuaguaacuaauauaaugcaagcugcuaguggcucaugaaaauuguguauaccuaagaagagaguaaguggaagucaccuggguaugguggaggaugaucauacacagaaugacccaagugaauauucgggagaauacucagugaaaagguuauuuaauuuauauuauuugugcugccuuauaaaagauacugagacacucaccucagaaucuaauaaccaguauaaccugguaagacaugagaguaucucagacaauaacagaaacaccaaaucuguuaaucauauuaaugugacuaucuguucuaaaguauuuugaaccuugaaacagaauuaaauaaccaauguaaacauuucacauuaaaaguaauuuggguuucaaaugacaugucuuuuuguuacagaauugagugacagugugacauugagcuccucggauagaaugcaugcucuuagucucaagauuguucuccuuggcaaaauuuaugcuggcacaccacgcuucuuuccuuuagguaagcugugaucuuaggugcagucacguauuuucuguucugaugguuuucuccguugauauggacaaauaacgaucuuucgaguaaaauaaagaguuucuuugcuauuuaguucagcacuuuaauucugccucuccggaaagacuuccaaagaauggcagaauuuguuaaugaagaguugaguaugaaacuuucugugacuaacuuuccaaguuuauauuaccugucuuaggauugugcugacugacaaacuaugauuauauuguugguaacccuauacaaguuucugaagagaaaagaaaaacgguugauguuuuugugcauagguaaucugugauugauucaacuguucuuuuuuuauguugagggcauguuuuucuuuaaaauagcaaauaauuauguuaaaacuuaguguuugaaucccuuucuuaaugagauaugguggcuauaauuuuuaaauaagguagcuaauuaugagcuauuugccaaccuacaaguguuuuccucagugguaaaacaauagaagcaacauaaauacauccauaaauuagaauaucaacuacuuuuguguuauuuaaaaauauugagagacaugaaaauccucacaauauaacuuuuuuuuuuuuuuuugagacagaggcuuucucugucgcccaggcuggaguggaaugaugccaucucggcucacugcaacuucugccuuccagguucaagcaguucuccugccuagccucccaaguaggugggauuacaggugccugcaaccacgccuggcuaauuuucuguauuuuuauuagaaaugagguuuccccauguugucuaggcuggucucaaacuccuggccucaggugauccgcuugccuuggccucccaaggugcugggauuaaaggcguucgccacugugcccagccuaauuuuuuuuuuuuuuuuuucaaaugagcauucaaacuuguuuacagaccaucucugacuuagggucuauucccucuggacauagucagaaauaaaaccauuuuauucauacccuuacuuuuguagguauaauauggaaacgguucccuuuccauaccauuuuauugauccuaaaaauaaagagaaauaaaagagcaaauacauacuuuauauaaauguuuauaagugugugaaacugguacuuuugauaguuguuuuaaaaaacacugcaccauggcugggcaugguggcucacagguguaaucccagcacuuugggaggccgaggcggauggaucgcuugagcccaggaguucgagaccagccugggcaacauggcaaaacccugucucuacaaaaaaauaggaaaauuauccaggcauaguggcaugcgccugugguuccagcuacucgggaggcuauggugggaggaucacuugagccugggaggugaaaacugcagugagcugagaucgaaccacugcacuccaaccucagugacacagugagaccccauuucaauaaauaaauaaauaacacuguauuguacauaguucuuuuuaaggaauuuucauuuuaauuuagaaauaaucaugugggcuuugugugguggcucacaccuguaaucucaacacuuuggagaggcaaaggcaggaagauugcuugaagccaggaguuugagaccagccugggcauagcaagccccgucucuacaaaaaaaauuaagauuagcuaggcaugguagcacgugccuauaguccuagcuaaucaggcugaguuaggaggauuucuauguuuuacuuauauauauauauuuuuuucuuuugauagagaagggaucucaugguguugcccaagcuagucuugaauuagccacaccuagcuaauuuuuuuguauuuuuaauagagacaggguuucaccauguuggccaggcuggucucgaacuccugaccucaggugaucugcucaccuuggccucccauagugcugggauuauaggugcgaaccaccacgccuggccauaacuauaaauuuggcuguuacuguuuaugauaagauaggcaguuaaaaguaagaaugaggccacaguuagaacugucaaauaaaucuagggguggggcauuaaaaaacacauuuaauauuucugaaaucaggaugcaguugcccuuuucugaaaagcuguuaaagugaggaaaccuauuuauuuauuuauuuauuuauuuauuuuuauugaucauucuuggguguuucucgcagagggggauuuggcagggucacaggacaauaguggagggaaggucagcagauaaacaagugaacaaaggucucugguuuuccuaggcagaggacccugcggcugccuuccgcagcguuugugucccuggguacuugagauuagggaguggugaugacucuuaacaagcaugcugccgcaugcugccuucaagcgucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuaccucuuucuauacagacacggcaaccauccgauuucucaaucuuuuccccaccuuuccccccuuucuauuccacaaaacugccauugucaucauggcccguucucaaugagcuguugggcacaccucccagauggggugguggccgggcagaggggcuccucacuucccaguaggggcggccgggcagaggugccccucaccucccggacggggcggcuggccgggcggggggcugacccccccaccucccucccggacagggcggcuggccgggcggggggcugaccccccccuccucccucccggauggggcggcuggccgggcagaggggcuccucacuucccaguaggggcggccgggcagaggcgccccucaccucccggacggggcggcuggccaggcggggggcugaccccccaaccucccucccggacgggguggcugccgggcggaggggcuccucacuucucagacggggcggcugcugggcggaggggcuccucacuucucagacagggcgguugccaggcagagggucuccucacuucucagacgggguggccgggcagagacgcuccucacaucccggacggggcgacagggcagaggcgcuccccacaucucagaugauggguggccgggcagagacgcuccucacuuccuagaugggauggcggccgggaagaggcgcuccucacuuccuagaugggauggcggcugggcagagaugcuccucacuuuccagacugggcagccaggcagaggggcuccucacaucccagacgaugggcggccaggcagagacgcuccucacuucccagacaggguggcggccgggcagaggcugcaaucucggcacuuugggaggccaaggcaggcugcugggagguggauguuguagggagccgagaucacgccacugcacuccagccugggcaccauugagcacugagugaaggagacuccgucugcaaucccggcaccucuggaggccgaggcuggcggaucacucgcgguuaggagcuggagaccagcccggccaacacagcaaaaccccgucuccacccaaaaaauacgaaaaccagucaggcguggcggcgcgcaccugcaaucgcaggcacucggcaggcugaggcaggagaaucaggcagggagguugcagugagccgagauagcaguacaguccagcuucggcucggcaucagagggagaccuuggaaagaggggagagggacagggagagggacagggacaggaaaccuauuuuuuuuaaauacuguuacuaaaaaaaauuaucagugaaguccucuucaauauugggaucgugaaucgucucuguuuucuucuuauaucuuucugaguuuucuagguucuguaauuuuaauuuuaggacauuuucaucaucccaaaaagaaacucugugcucauuaguugucacuucccauuccuucacacccuccagcccuaggcagccacuaaucuacuuuagauuugccuguucugguauauaucuuacuuuuauuuaaaaaaaacuuuuuuuuucuuuuaagcugagagugauggugcacacuuguagccccagcuuacuugggagguugaggugggaggauugagcucaggauuucaaggcugucgugcacuguaguugcuccuaugaauagccacuauuucuagucugggcaacauagcaaaaaaaaccccccgccccaaaaaauugcaauuggauuucagaagauaucccccuagaaacuauucaguuaugaauaagaccuaccuuuuaguaucaagagcuaaaaauccaaauuuccgaucuuuuuuuuucuucccagauuuuauuguacaguuuuuagaacagcagguuuguacuuugaacugggaugugggcuucguaauacagacaaugaaugaaauuggaguaccauuaccuagacuacuagaaguuuaugaucaguuguucaaaucacggguaaggaaaauauuaaauaacauaaaauuauuuucuuuaauuaaaguaacuuuguagauauagagugggguauuuugauugcauuuuuguauccuaucacuuagucuaauuacacuugguugagucuuggaaauuaugcuuuugacuuuuuaaacugauaaugagaguugcuuuccuguauaucaugauuaaaaugaaauauuauuuuugaauauuaauaaauaugcuuuacucuuggugaaagaggcuaaaccaaggugugggcuaaacucauuacauuaagaaucaucauuugcuuuauuuuuuuuuuuuuuuuuuuuuuugagacggcgucucgcucuguugcccaggccggacugcggacugcaguggcgcaaucucggcucacugcaagcuccgcuucccggguucacgccauucuccugccucagccuccccaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccaagaaucaucauuugcuuuaaaagaacaagauuacauuguauuuauuuacuauaaccucaucuaaaauaucagugcuuaaagauccuucucacccugcugaaccuuaucagacuauauguuuuguaauuuuuaugcuaaggauaaaagauccaaauaaaaacuugucaaaguagauugugucuuuuauagcagcaucacacagugcuuuacaacauuagccugugauggaaaugagcagguaacuguaguaucuccaucuuauauugcaaaaaacaagagcagagauguuaaauaaccugcuuaagucacauggcuaguaacuggugaagccagaccuagaauuaaguuucuguuacugcuaguuuagucucuuuaugaugucagacuaaaucugcauagguucaaaguaaaaguggugucacaacccauagaaagaaagauuuuucucuuaucucagauuccuaagcgggacauuuacaugcucugcaaaguagauugguauaucaaauaugccuccuaaguaauaucauaguguuguuaauuaauaaguuuuuaauguuguuugaaauauuaacuauaaucagauauauaauuuaguagccaugugauauuaaaugcuuuuuaauagcgauaaguuuugcauggauccugaugucuacuuuaguauaaaugauuuaaauaaucaauugacacaauuugccucacauuucauuauguauauuucuucauaggauccauucuggaacagaaugaagaagccacugcaccuuuuggauuguauacauguauuauugauaagauauguugagaaucccagccaaguuuuaaauugugaaagguacuuaugaauuaaauauuggaucagcaaaagcuuuuaaaugcuucuaauaaauaccuggguaaaaaauuugaagagaagaugggaagauucuuguguauauuagcaauaacuauuugaaugauauugaucaccauguaugaaaaauaggaguuuuuuccauuuucaacccuuguccuaaauccuuucuacagcugaacauacauaauguauucauuucuucuacuuuagauuagugaucuaggaccaaaacauuucaauuaugucuuugugauauuauuggccauuuaagggauauucuuuugaaaaagaauauuagcaggaaucaucucuuacugcuuucuucucauuguaaaaaucuucaggccaggcgugguggcucacaccuguaaucccagcacuuugggaggcugagaugggcggaucaugaggucaagagaucgagaccauccuggcuaacacgugaaaccccaucucuacuaaaaauacaaaaaaauuagcugggcgugguggcgggcaccuguagucccagcuacacgggaggcugaggcaggagaauggcgugaacccaggaggcagagguugcagugagccgagauggcgccacugcacugcagccugagugacagagcgagacuccgucucaaaaaaaaaaaaaaaaucuucaaauggaacccaccuacacccaaguuuucuuuuuuacuuuauuucuuauuuacuuaaucacauggucuuuccucuccugugagaauuaaaguugccagaaguugguggggaagaaguccugcaggaggaaauguuuguaaauguauaauuaaucaugugucuuuuucguuguaggagaagauuuacaaaucucugccuggaugcuguuugugguuaccuuguugagcuccagucuaugagcucgucaguagcaguacaagccaucacugggaauuuuaaaucucuucaagcuaaauuagaacggcuucauuaauuacugugauauacuuucauccguuuuaugaucuguaaaauaaaaacucagcuggguccag

SEQ ID NO: 192531 - RNA, 48602 nt, Homo sapiens
aggcggaagcgggcggcgcuacggcugacugggaaaugucagccgcuggacuguagacggauuuuccuuucucgggagcccgcaggccuucuggugaucgccagcgcugucgucucugagcguggaucccagaaccuggacagcuguggcggccgccguuucccggucccguccagacgcugucuggcgagaucggacggugagccuaaggcggaacgcgugaggcgcuuuugagucugggguccggggccgagagcaggcggaaagagaggggacccggcagaccccgaguggccgccgcugcggggcccaaguccuuggcugcugaguggugacaguagcccagcccgccggccaggugagaggcugcgaacugcuggcgucgcaccuguucguccuuuugccaggaagcuucuuccuccgucggggagaaggcggcccuaagaauugggucuguggacgggauccuuccuuuaucuguaaaauaacgcacaacagcuaaacacgccguuggaacgagagacaaugguuuaauuuuaggggagccggagaccccagcggguccuguguggugggaaggcugcgcaugcccuugcagccuugacaggucucauaaauagcaacaugggaauaaaugaaaggacuguauuuugcaacgagcuuuacccgugcacgcagggggccuccagcaaagccauuugguugcuugcugucgcucagcuggcuacguguguuugcgucgccgccuaaaagcgagcugcuuucagccuaucucugcugagaagaguuugggggcaguaagaguagggagcgugacauauuccagguacaaugaccaugcgaaauccauugggcaaacuauacuacaacugugaccccgggaaaacaguggaagagggaagggggaugaauucuaagccucauaaaaaugaagauuuauaaaguucauaaggaagcauaacagcuucaucgcauauuagaauauucagugaugcuguaugacacacccucugguuuccuugaaaaaaugauucgcucuguagugaaauuaaaccucccuugugcagguauaugcuuguuucaagcuugguccuuagcuugaaaaguaacugccucuugaggaaggaauucaugaaccuuuagcucguucuugaaagaugagauugguguaaagaagggaucuguucacaacuugguuuugauuggaacuaggugcagaauccuaggcuaagccguucaucaaacuaauguuauauggaaagcauuuuaaaaugcaauauccugauguuuuacagaaagugaccuuuauguuacuuuggcuaaggagaaagcauuugccuuuguuugaagcuacguccuuucccugaagauugcaacucauaggagaaaauauuuuugacacaaaaaauuauaguuuccuucaggaaagggaacaaaacagagagagccuguaagcuaauggaggagaaagaauaaacaaaaauauuuaagaugccauaaugagaauaaacaguuuugagauguaaaauaauugggagagcccacuucagauauagaucucauagauaggaagguuuaaucgaugagaugauucuaaauuuaaagaugagaaauaucuuuguucagucuugguuuuacuaggaguuaccugggaacuagaauacuugcaacaucugaauuagugaacacaagauccucucuaggacuucagggagagccugucaguuuugaaauucaguuugauaguuugccccgguaacagacauacuucaucuuccuaauaugggaauaauuuuuuuuugccuuccuucuaaucaugacuauugccuuaauauaauaaaugcaaguuuaaauugguacauuagauucuuuuuaacguaaggaauuguguccauugaagacgagauuaguagguacauagagguugcuaucuggucauaaagaacugcauugugauugcuacugauguaucuuauuuuuucugauuaauuuuauuuuuauuuuuugagaagaaauuucacucuuauugcccaggcuggagugcaauggcgcaaucucggcucaccauaaccuccaccucccauguucaagcaauuccccugccucagccuuccugaguagcugggauuacaggcaugcgccaccacgccuggcuaauuuuguauuuuuaguggagacgggguuucugcauguuggucaggcuggucucgaacucccgaccucagaugauccacccaccucagccuccuaaagugcugagauuacaggcgugagccuccgugcccagccgauucuuacaucucuuuaaaaggaagacgguccacccuucuuuguuucuccauccugcugucuagaugaugauaggauuccuggaguuccagcaucuguccuggaacauaaggauuaaagccaccugcuaaggauguggacuauagaaggggccugggccucugauaaucugcuaacuugccauaaccaccuaucucaagacuuacacgagaaauaaauucugcauuguauaagucuguacuauauuggacuuuucuguuauguguagccaaacuaaucuugaauaauguauuuccagaacugauagucucuguggugguggcagcuaccuguuuacauaacccuuaucacccccuaauguauuuuuuuuaauugccuguuucuucccacuagacuuuuuaagggcagggacuuugcuuggauuuuucuaucuccagccccuugaacagagcucaccauauaguaggcguucaguaaauauuugcuaaaugaaugaauggugcuuggaacuaaguagaucuuuaauucauuguaauuuaaugcucuaagauaggcagcuuggggcaagaacaaacggauucuaauuuacucuauguuuuccacuuuucccauguagaguacagucauauauuacccuuaaaucaaguaauaguaguauaaucuguaauguaaaaaguuugcguuaaauucuuuauuaaacaugacuaagcauucuguccugauauaucuaaaagaaaugggagaaaguuucuaauuuguucccugugaagacugaacaaaauaaaucauuaagcaauuuaaauugcauuaagaaacuaugucuagauuagagaagagacauguaauuaugauccaggcucuguaguaaagaugccucuauuugaaucccagcuuuaccauucaccagcucuguuaacuuggacaaguuacuuaaccucucugcacuguuuuuuuucuguuaagcaaggaaacgaacagcccuuucuuacuagguugugaggucuaauuugauaaagcuuggcagguacuaguauuaauacaaugcuuaaaauuuagugaacacauucuaaauguuagcuauucguuuuuugaaauuauuuuauuauuaggaaggacuuuacagauuauucucuaucaaaaugucuugcaauuucuauguaugaaaucuuuaagaauucaguaaaauuuuaguucuuuuuucuuauaugcuuacaugauugcuaccucuucucuucaugccuugcaaaagguaaagcaggacaguaugccacuguccucaggggcuugucacauuuuggaauucagguuaccugguugguucgccaacucagcucuuagguaccuuuaaaaaauauuaugaugguuuuuuuuuuuuuuucauuuuucgagugggaguaauagucucuugcaguagucuguguccuaaacugaacucucucauaccugaaaucuuuaaauaugugaauaacgauuauguuuggaagauuuaaauuuaauuauugguggaaaauuguugacuuaaucauucacuucuaauucugguucuuuugauuuuucauaauuaggauuuugaguugucuccugguuuuuauuauuuugcacauaucugaguaaaaauacagauaugugaaguuagauaaaauuuccaauuggaaccuaaugauucaucagacucagauauuuaaguuaacaguauuugagaaugaugaaucauuagguuccggucagaaauuuuucauucaguuucagaaucuuugguuuugacaaaauuguugucaguguuuuguuuguguucugaucacuugguacccauucucucucucucucucucaaaacauuuggaauucuucaaacuacaaaauuaucuuaaccucugaaguuccaucaaaggguauuuggccugaaaaacuauuaucagccguaaaguacucaggaaacaguacuuuagucaguaacauuagucaguaacauuaacacgcuaauugugaaaccauuauaaaggcauuugaaaguaauauugaauaauauuuugaugauuggaaaaagauugaauuggauuuuaaauguuuaagacuuucagaacugguguuuugaaggguacgauaugcccacacaucgggcacuaaaaucugguaguuuuaaugaauugccauuuugauuucgaguauaaucaaguuuugcuacuguggugcuuaaucacauggaacugaauuuuuauuuaccuccccauuuuaguaucaccaucaucaucauuaucaucauuaucauccccuuucuucuccuucuucccuaaaccuugcaacucaucacuugaauguuggcacaagguuaaagauauggacuuugaaacuauuauuuucucaaguuaggaaaaccccaauuuuuaucuccaguuucaugggaucacugguccuaaucugugucauaauaaggcaauauaguucggccucaacagaaauagaugguaugguaaacagaauaauaaaccccuaagaaugucuaugcucuuaucucuggaaccaguaaaaaugaugaaauuauucaggcaggcccaguguaaucagauaagcccuguaaaacaaauuucaagugugagaagaauuugacaagccauugcugcuucuaaaauauucaggaccacagacacacacacacacacacacacacacacacacacacacacucacacacacacacacacacgcagagagagaagugagugaggagauagauauguuaauuuguuugacuauggugauuauuucacuguauauguacaguauaucaaaacaucacuguugugcacuuuaaauauauacaauuuaaaaacauauacagagccacaugcaaagacuggggagaggccucuagagcuaagguuaaaugccagcugucaguuugcaggggaacagggaucucaguccuauaaccauaaagaacugaguuuuggcuuggcuagguggaucaugccugaaaucucagugcuuugggaggccaaggugagaggaucacuugcagccagguauuugaguccagccugggcaacauagcaagacccugucucuacaaaaaaaauuuuuuuuuaaaauuagccaggcgugguggugugcaccuauaguccuagcuaucuggaagcugaggugggaggaucaguugagcccaggagcucaagguuauguugagccaugaucaugccacugcccuccggccugggcgacagugugagacccugccaguagccugaaugagauuagaaauggauucuucuucagagaaagaugcaaaccugcugacaccuugauuuuaaacuugugugacccuaagcagagaacuaaguugaacuaugcuauguuugaacuucugaccuacagaagcuauaagauauuaauacuaaauggauguuguuuaaagucacuaaguuuguaguaauuuguuacagcagugguaagauacuaacacaugaagugugggaagguauguaaccaaaucauuuauuacuagaauaaaggauccauaauucuauuucuucaucuacaacccuuuaaagugcugacuaugaaucagacugaaaaacagagugccauaguaaaaaaauuaauagcuagugucagguuuauaacugauuuuguuguuugcuuauuaugcccauaaucuuaccaccuaaagacuauugauguuuuaauauauuucauuguuaccuuacucuuuuuuaugcuuauguaaaaauaugugccaaauuuucaauugcuguuaggguaauuuucugauguuauuaaauaaucuuaacaaacauuauuucuuauacuacaauaauauuucaucauuuggcucugccaugcuuuauuuagcauuucuuugguaaucucuaauauuuagucuuuuuuuuguaugauugucauauuccuugcacuggacaauuucaggucuaguucaagucauaaaaggauuuucaguuaauuauguuauauuuaaacucacaucaauuggguuuuuuuaaagaaaaaaaacccuagaucucgaagaugguuuuguuaucagcacauucugcauugagcuuucagccaacuacuuaaucuaugcuuagcuuaaaaauaagauuuggcugggcgcuguggcgcaugccuguaauugcagcacuuugggagcugaggcagguggaucacuugagcucaggaguucgagaccagcccaggcaacauggcaaaaccuugucuauuuuuuaaaacauaagauuugacuuuguugugguauaaguuguuucauagaauaugaaauuugaaaauuugaguaguauuugguaauguucagaguuuuaagccuuuugaguuguaauaaguauuuguuaaaucaguuuaccauuacacgaguuuuacauugccuuugaagucgucaguaauagaaaaauaguguauguacuaaacuacacaguauuuuuuauuauuucaacaaauauuucuugauacuacuguaugccagguacuaacuacaucagacaacuggaauauaguauggaauaaaauagucaagucucugcucucauagagucucugggguaaggggagagguguggagagacaauaaauauaaagaauguguauuauaucagaugaauaaaugcauugaaggaaaauauagcaggauaagaggguagagauugaugaaagaaguucaauuuuagauaauuaagaaaaaugaaaauauugacaguugaaauggaaacuguuuaccaauauaaaaaauagugaagaaaauuguucauuaaaugugauuuuucuaugugauaguucauguaggaguauuuuguauauaaauuuaaauuuaaccauuuaaaguacuuaaauugucuuuucuauuauucuaaauaguuuuaguuaaagauguuuguugauuugaaguauuucauugguucucccuuauuuuguuauuuauuuauuuauuuugagacagaauuuugcucuuguugcccaggcuucaguguaauggcacgauaucggcuuacugcaaccucugccuuccagguucaagcgauucuccugccucagccuacugaguagcugugauuacaggcacccgcuaccacaccuggcuaauuuuuguauuuuuaguagagaugguguuucaccauguuggcccaggcuggucaugaacuccugaccucaggugauccgccugccuuagccucccgaagugcuaggauuacaggugugagccacugccccuuauuuuauuuuguuggguugaucacacucuugauucucuguguuaggauauuaaucaauuccuugaaauacuguaguauguagauaaacaaaagucuaacauugauuuuacaaaggagaaaaaguucauauugccuuugauuaguaaauuuuuuuaaguauagagagauaucaaauuuuucaauuuuaaaauagagacuuuaaaucucuauacucuaacuuuuuugaguagagagauaucaaguaaacuauucgcugaugacuguaucauaaaauuaagaauguuuucaaauguaugacuuuaauagucauugauaaauuuucugcauauaaaauaguagaaaaauuaaaaaugagaauuuaucaaaguaaguuuaaagauuuauguagauaaauggaagugauaaauauauuuuguaaagcagugaguaagaauuucaugaaaguugaguuguuaggugaaauuaacacaaaagaaaaauacuauuucaaaaaacaaaagguuacuuuuaaauggucucuuuccguuuuuuccuuccucucuuuuagaaaaucuuaaauuauagaggaugaauaaucuuaguaaaauguauuuuacuaaguaucuaauuuccuaggauuuaguuaacagcuuauuugcauaaacuauucuguuaggacuuauaauauuaagaaacaaacuccagaugacacuguauuaaaacuguucacaucuaaaauaagaacuucuuaauuuguaauauuguaagaacuaauaauuuuuguuaaguuuuugaaaauacaagguacgugaaauuuuuuaagugugcuuuaaaaauaaaauauaaguacuugaggauaggaauuacccuuuuaaucuuauucauaguccaaugugaagcaugacauuucuccaaagaguugauuaauguauuaauguacuaauaaauauucagaugaaauuuccaaaugucauuuccuguguuaaugaugcauuuuaaccuucuuuuuacuuuauagauaugguccagaccuguacaugaauaacuuugguuagucagagugaaauauucaauaaugaguggugcagcuuugggacuugagauuguuuuugucuuuuuucuggcauuauuucugcuucaucgauauggagacuuuaagaaacagcauagacuugugauuauuggaacacugcuugcuugguaucucugcuuucuuauugucuucauacugccucuggauguuaguacgguaaggagugaaauuuauuuucacaauuuaaaagacaaauuuuaaucauacagcauguuggaaauaauguuauuucuuaagacagcuaaguuaugucaguuuugaauuaaaagauuauauggccauuugaucauuaaaaagcauagccaagggccgggcgugguggcucacgccuguaauuuuagcacuuugggaggcccagacuggcggaucacaaggucaggagaucgagacuauccuggcuaacacggugaaacaccgucucuacuaaaaauacaaaaaaaauagccggacgugguggcggacgccuguagucccagcuacucgggaggcugaggcaggagaauggcgugaauccgggaggcggagcuugcaguaagccgagaucgcgccacugcacuccagccugggcgacagagugagacucugucucacacaaaaagaaaaaaaaaaaaaaaagaauaaagcauagccaagaagguaaguuuagauagauagauuuauaaacucugauguccuuuaaguacuugguaaccuuuugauucucauuuuuaaaccauacauucguugcuuuagacaauauacaaccggugcaagcaugcugcugcaaauucaagcccuccugagaauagcaacauuacaggauuguacgcaacugcuaacccuguuccaagguauuuccuuuuuuaaaaaaaauauauaaacauuguaggggacacauuguuuaaaaauugaaaguuuuuaccauccagacuuuauauuuauguaaguuauccucauucucuacuaauucuccccaccucuauucuuuccuaguagacuuuucauuacaucauauucuaauuaaaucuaauuuuuaauauuuauugguccacaaagcccuucaguagacgguagugagaaacuugaagaaguccugauuuuuuaguccugguucuucuuuaccaaguauguaauuucuaaaaccuguuuuuccucucagccuaucucagauuuaaaaacgugggauguauuuucacuuuugccuaauuuacaagguuauaauaaagacaaguauuucugaacuuaugguauuccuuucauauugcacauccuucaaaagcauuauagauuuacauaaaaaauuaauaaaguucaaauuguccaaagauuauauugaauucauaucgaacuuuuaaguaaaaagcuuauauauguugacuauagccuuuaugaaugcuuucaguaguauuugcaugcuucuuuaugcauauuuuuaaaaaaucuaacuucagaaaagguaaauuuaaaaugcagguguuacuuccauuugaagcacuauuaaaaaaacuggauaaagaucagcagcagcuacagauuguugcaaguucuugggauauccuucuagcuuaggaauauggcuccauggcagaauuuaugaucagagacucaucaugucuucaaaaauuuaaacagaauuauguauaauugcuagcaugcaucuccauagaagcuauguuauagugagugauuuaauuagcauuacaauuuucaggaauuaauuaccuaauguuuuccccucccaaccccuauaaccugaaaaaaaaaaaacccaaccuauaaauggauuguguauuuuaaagguaaucauuagaaauuuuauuucauaauacauuugcuuuuaaugauuguugcacuuuuagucuauuaguugaacauuaaguuuucuuuuuacccaaugacuaaaaauacacugaaaguugaaaacuuaaaugacauuuucagaacaaucuauuuuguugcuuuuguguguuuuuuuaguuuggcagucagcuuugaauuuuaaaauuucuuugaaauuuuauggguuauugauuauuagagucaguaauuuaaaaucugaauguaaauuaacuuggccacaugcaaauuaauuguauaauucauuuaaguagucauuuaugauuaguuggcuuuaacuuuuuauucaacagccagcauccuuguuucaagccauggaguuacauuccugauggaaucaugccaauuuucuggaggguaguguauuggacgucacaauuuuuaacaugguaaguuacaguaaaugauaaaauuuuuaaaauuuuggcuaaaggaauaaaauguuuuucaaucaauauaguuuggaauuuauuuaugugucauaugcauucugaaucuuucuacccauuauuuuuaucuuucugcugugcuccaaacucauaguuauccacugucuacuaagcaucucuuagaucugcaaacaacugcacucuaaaacuggaggcacugaacauugcaagagaaaaauuacauagcagaguagugcuuuuguaaagucaugucuauuaaauucaacugggcucucaacauugccagacuuuccuucuuuguuuuuuuuaguuugcuuucuuuccauuuucuacaagaaauauuuccauucacuucaaacuuccguccucuuuauggcuuucucucuugugcucccuaacaacaacaacaaaaucaucuuuacucuuagccucuuagcagaugacuacuuuccauccagcaguuaaaacaggagucaucagacggcagcucuuucagcuucucaccaacaaaucuacauaccuacccaucuuuuuuucuuuccccuccaaagauggaagagucaugcuuguuaaagccaauacuucugucacaggauccuuagggguguuguuuugccagcuggaaaccucuauggccaguagcaccuuugccugaauuuuacucaggcccgcugggcuuauuccgcuuacucagccuggcagguugcacuuagcucaugcuccuggcucugaucucaugacucccaagggcgagccaggcauggaguggugaggggugugugagugagugagcaugggauccagccacugagcacagccagacacgcuggcugcuguggcagggugggcagcuccaggcaucggcacaggugucggcucugugaaagccuguggcugggucagaugcacugcaagcagcuucugcugugggcaccugcaucuggaugagaggaauguggugguacccagaagcuuggagaugccagaaaccucagagcuccaaagagggugucacagcccuagcuuggggagccccuagaucugggcuccuggaagggccacagcucuucucuucucgucaccugcaacauggcaaguggcagggccauguuucagcccuguuuguguuucagcuccuucaguucugccauucagcagguccugaguucuuguccuacauccaggaagaaugagguaugcagacaacuggagggugagcaaggugaagaggugcuuuauugagugauaguacaacucucaggagacccaaaguggauagcuccuuucugcaggcagguuguccugacaaguauagcucucaguggagaggagccccagaguggguagcuccuaucugcaggcagguuaucccaaucgucugugcagcccccaguagagaggagaccugaaguagauagcuccuaucuguagucagguuguccugucaucuaccuaaguggggcugagucugggguuuuuaugggcuucagagaggagaaagugugcacugauugggccauaggcagaccuggauaaagcacccuaaguucucacucugguccacagagcugauggccuggccuccaugcuucaggcugucccuggcuugaagguggggcuucaccggggaccugcccacuucugcccaggagccuaucugccuccugccaccaucaaucaugucauuuauggcacccaggcuguucaugccaaccagugccugcaggcccaugcugagcugcccucagccccacugucagccucccuucugugcuuguugauguccaaaguccagagugggcugaggcagccgggggcuggugucagugcugcccugagcaugugugcacacccagcuagguuacaacagugccuggauucagucacaacuuuucuccaaaaucagagcaggugucaggagcagguacuuccaagccuguagggguaugggggcuuucuggguccccgaaagugcagggaugccuggguccacagccacagcugggcagcugcagcuaugcccagagcagggcuccugccccgccaacucggaaggggguggggcucccaccucuucccagcuccugcuagcuccauggagugcacaguccccgccaguccccccacacugcggccagcaacuuugcugggggccacuccagacaagcugcugcugccaucacuucuuccuaaaauauggauccauccccuucagcucuuguuacauacuuguagcuuucaauuucaacgaagcaugcacauuucucucaucuuuugaaaagaaaacaaacaaaaaugaaagucucucaauucagauuccuuuccagcuucugccuuguugaucugaucacaacuaaauuuuuuuagaaacuuuuuaaaauugaagcauaaguucguaccgaaaaaugcauagauuguguuuaguuugacuuuuuucaaagugaauacacccauacaccagcacucagaugauguuauagaacauuagcaaugcccccagaagccucgcucacgcuucccuguguagucaucccgcacuccccagaaguaaccaugauucugacuuccgucaccauagauuaguuuuugccuguuuaugaacuuuauaagcauagaauuauacauugugaacuuuuuugcaucucucuuugcucacauauuugggaaauucaucuaugcugugcuguauguaucaguauucuguucuuuuccauuucuguaacauaccccauuauauguauaugccauaguuuauccuacccagccaaacuucuuaaauaaauucucuauauuugauaucuccacuugcucauuguuuacuuauuucuuaaccauaguacucugcuuucuauucuccuccacuuauacauacagguucuuaauuuacuucaccucuuggcggcauuugauucucucucuccacuuuaacuuuccucuccuaguuccuaauccauaugcuccuugguuuucuuccuugccccacuauuguucugucucagucucuuuugcuggucuacccuccuucuguucucuaccucucuuaaaaguugauauuucucagaguucugucucaguucuuuccuucacauucuccauacucauucuuacaguugaguaucuacugauguuauuucacugccauugauacagugaugacuucggaagcuauccauauuuuuaguccgcucuccugaacccugaagcuggguuugugugcagcuccucuuggaugucuccuagguacuacuucaaagucaguaugcugucaacugaccuucucccuuuuugcuucuuaccaccaucaucacccuucccccucccaacuaguuccaauuuuguuccccuuuuauccauucuccgugugaagccuuaggaaacuaaaauuugaucaaaaauguuuucuuugaauguaguccagacucuucauaaaggcuuuaaagacccauuugcuuucccuaaaauuuuauauuacaaaaauacucagucaucuauuauaguuauuaaguauucaugauuacuuauaaacauuuauuaaugagaagaccuauucauuaaaauugagauucauauauuucuggcacuuugagauuauacagacauaucaauuauuuggguuuuuaaucauauuuuuucuauccaucuaggauucucuuaccuuuuaugcagucauaugcaagaucaggaggguuuuccaucacuggaaagaucaaaacugcacuaauugagaaugcaaucuacuauggcaccuauuugcugauuuuuggagcauuuuuaauuuauguagcuguaaacccacauuuacauuuagaaugguaagaaaaguagucuucuuaacauugcuuuaauguauguuugcauuuuuaaaaaaucauuuuuaauuucauaugugcagguaaaaagacauuucauugagaaauauauuguuacauauuuuauggauuuccccaaaagaauaugugaauaauccauauuacuaagaaaauauggaaugacaucuuuaaauauagauuuuaggcaaaagauuaaugauuagucuaauggcuauauauuaaaaguaauaacccuuaugauuuuuggauagaauuucaaaauuuuuaugauaaaauaacugguuuuauuuuucauuggaacuugugauuuuuuuuguuuugauuauaauuugaaggcauauuuguucuuaauguuaccuuggauuuagauauuucaauaaaauugaaaucuguuuuauacuuaugauuuguaauauaugugaaggucuacaucugaaaauuuaggaauagaucagcagugcuaggucucacuauuguauuccugagauuugcuaggucagcaacacagguuaauuugaaacauuuucaaacuucuuuuguuuaauauagaauaagaaaucaccuaaugaaaaauguuuccuuugggaaaauauauacauauuauugccaugaauuauucuagaugcuaauuuuaacugcaguagaaacagugucuccuguguuaaagucuauuuaugcagucgcauuuuaucuuuccauuaaaauauacauauuaucuguuguuucccuuucuuaggaaccagcuucagacaauugggauagcugcugcaaauacauggggucuguuucuucuuguguuguuguugggguauggcuugguggaaauuccucgaucauacuggaauggagcaaaaagggguuaucuacuuaugaaaacguauuuuaaggcagccaaacugaugacagagaaagcagaugcagaagagaauuuggaagaugccauggagguaagcaaguuugaaccuuauaagcaauagucacuaagucauauguauccccuuuuagucauuuuugguuuguuguuguuguuagugcauugaugggcuucagacugcaaaacugguguugugcaauccuucaggaugucucauccaggaugacuuuuuagcaguucagccucaugaugugucuuguccaucuucugucugacagagauucauggaaaauauauucaauagugcagggcuacgccuauuauuuugagguaacuuuuaauaguacccucuuuaauuuucaaaagucuccgagauuaaaugauaaauuguaugguuacccuaacauaguagaacugagaauaaugaccagaggacacuuauuuccgaaagguuaaccuaagguaaucccaccaauucuggaaaccucuuuaaagaacaauuugcaugggaguuuguauugguaaguuuuguuuccuaucuguaaucuuaauaagacacuucauuuuacuugaugacuuaaccuaguuucacaaaguuguugaaaguauaacuuucaauacuguacauaaaaauauacaacaaauuauaaaauuuuucuguguuaaauaaaaauuuuguuauggauuuaaagagauuauuguagucaccucacauuuuugcuucccagggaaaauaugcuacucagcugaugauacucuccaaauuaaaacuccuguugaaggcuuuucauucauguuagaauaaacuccaaaauguuuuaaugcagccuacagaaaaauaauuuggccuauguuuagcucuccagcuguaucccaagccucuauuuucuugcacuggucaucuuugguuucucaaacuugcuaauguugaugaaauaauaaacaauucuauagacuuaauauuuaccuaacacucaacuuucguuccucaaacuuaguaauggugauaauuauaguaaacaauuauauagacuuacuauuugccuaagagggacuuucuaagcacuauacauauauuuaauucucaugacuuuaugauagagauuuuuguaaauccccauucuauaaaugaagaauaugaggcacggagagauuaaguaacuuucucaugucuacauggcuaggaagugauaagagccaggcagucuugccuuaaacagggacugacaaacuuuucuguaaagggccagauaguaaauauuuuaggcuuugugugcaaugucauuucuauugcaacuacucugucauuguaggaugaaagcagccauagccaguaaauaaaugaaugagaguggguguguucuaguaugagaacaaguaguggacugaauugaucuggcuugaugaccauaugcuuaauuauuacacacauugucuuucuuuucuaucuuugagcaugcuauucccaaacuauuagaaugcucuuuucagcacucucuucagcuaauuccuauuucauuuucaagucuuaacauaaaugauaauucuucagggaagcuuuauuagcuuccuaggacugcuguaacaaaacuacuacaaacuggguggcuuaaacaauagaaaauauuggcucacaguucuggggacuaacguucaagauuaagguaucugcaggguugguuccuucugaggguucuagggaaaaucuguuccauguuugucuucugucuucugguggucuacgaucuuuggcauuccuugacuuguagaccccugccuucaucuucacaugguguucucccugcgugccaguguccaaacuucauuguuuuguaaggacaccagucauauuggauuagaguucaucccacuccaguauaaccucaucuuaacuuagcuaauuaaaucugcaacaacccuauuccaaauaagaucacauguuaagauacuggagguuagguuucaggggacacaauucaacccauaacaucuucccugauuguccagacucuuaaacacucagcaaccauuuuuuaaaugaaugaauaaaugaauaaaugaauguauacugugauucgaaaauuuuacguuggcuuugcagcauuuauucucuacaaaauguaagaacuacagcagaaaauauugauuuaaauguaggagugagucuguaaauaguauuauuuaaauugaaaugaauaaauuuccuguuauauucaacauucccaugaugaauguuauuaugucuuuugaaagaacauuauuuauauuugauaaauuuuacauuuauauuugaaauuuugaauuuuugaaaaaauugaaaacugauauuucaauaagauacuuauauuugauaaaagaaauuaauuuaaguuuaaguuugauagcguuccauccaaaaguugguauuaaauucaguuguuucagauuugaggaauuuggauuucacuaauuuauucaacauuccugcaaaaaaaauaaacccagcuauuauuugaguuauggauuuucccuagaggaagcuuugcugucugaauaaaauagauuuuguuguuguuauuuuaaaauaggagcccuuugcuuagaaauaggauguggaaaauuaaggaccagcauuggacuucucugcuauuuuaguauaguauucuuaaguuuuaagcuguguaaaaaaguuuagauaagaaacugcucuuuaaaaauggauguuuugaaaauagcaguaaguacacauagauagcaggagaacucugaaccucuuuccaucaaaaacaaugcaugauuucucagguaugaauuucuuuuuuguuuguuuuucugggguuuuaaaaaauuuucguacaugcucuucaccucaagcauuuauuuuucuuuauguuacaaacaauccaauuauauucauuuaguuauuuuaaaauguacaauuacauuauugacuguagucacccuguucuaucaaauacuggauauuauucacucuaacuauauuuuuguauccauuaaccauucccacuucccacccuccccucuacccauaaccccucccagccccguaaauaagugggaacaugugaaguuugucuuucugugccuggcuuauuucacuuaacauagugaccucuaacuccacccauauuauugcaaaugacuggaucucauucuuuuuaauggcugaauaguacucuguuguguauauguaccacauuuucuuuauccauucauauguugauggacacuuagguugcuuccaaaucuuggcuauugugaguacugcugcaauaaacaugggagugcagacauuucuuugauauagugauuuccuuguuuugguuauauaccuagcaguggaauugcugaaacacaugguagcuuuuuuuuuuuuuuuaauuuuuuugaggggccuccaaacuguucuccauaguaguuguacuaauuuacauuacauuauugucugucuuuuggauaaaacccauuuuaacuggggugagaugauaucucauuguagcuuugauuuacaucuuuuugaugaucagugauucaaaaaucaguagcauuucuauaugucaacagcaaacaaucugaaaaagaaaccccauuuacaauugcuauaacacaaauaaaauaucaaggaauuagccaaauaagugaaagaucucugcaaugaaaacuauaaaaugccuguuuuugccuguuugccauuuguaugucuuuuuuuuuuuuuuugagaaauucaaaucuuuugcccauuuuuaaucuuauuauuaaauuuuuuuucucauggaguuguuugaauuccuuauauauucugguuauuaaccucuugucagaaagauaguuuacaaauauuuucuccuauucuguggguuaugucuucauuuuguugauaguuuccuuugcugugcagaagcuuuuuaacuugaugugaucccauuuguucacuuuugcuuagauugccugugcuuguagguuauuacuaaauaaauuuuugcccaguccaauauccuggagaguuucuccaaugcuuucuuguauuaguuucauaauuugaguuauuagauuuaagucuuuaaaucauuuugauuugauuuuuauauauggggagauaacuggucuaguuucauucuucugcauauauccaguuuuccaguuuuccuggcaccauuuauugaagagacuauccuuuccucauuguauguucuaggagcccuugucaaaaaugaguucacuguagauauauggauuuauuuuggaguucucuauucuguaccauuggucuguuuuuauccuaacaccaugcuguuuuguuuaucacuuuauuauguaguuuaaaggcagauaaugugauuccuccaguuuugcacuuuuuacucaagauagcuuuggcaguugaggcucuuuugugguuccauauaaauuuuaggauugcuuuuucuauuucuguuaagaaugucguugguauuuugauagagauugcaucgaaauuguagauugcuuuggguaguauggacauuuuaacaauauugauucuuccaauccaugaaaauggaauaccuuuuuauuuuuuguguccucuucaauuccuugcaucaguguuuuauaguuuucauuguagagaucuuucacuuauuuggcuaauuccuugguauuuuauuuguguuauagcaauuguaaaugggauuucuuuuucaaauuguucacgguugacauauagaaaugccacugauuuuugaauguugauuuuguguacugcagcuuuacagaauuuguguaucacuucuaauaguuuuuugguggaguuuuuagguuuuuccaaaugugagauuuaucaccugaaaacaggauaauuugacuucuuucuuuccaauuuugaugcccuuuauaucuuucucuugucugauugcuuuaccuaggacuuccaguacuauauugaauaacaguggugaaagugggcauccuugucuuguuauggaucuuaaaggaaaggcuuucaauuuuuccccauucaguaugauacuagcugugggucugucauauaugacuuuuauaguguugagguauguucccuguauauucaggguuuuuuaggguuuuuaucauaaagggaugccgaauuuuaucaaugcuuucucagcaucaauaggaaugcucauauggcuuuuuuccuucauucuauuaauaugauauaucacauugauugauuugcauaugucaaaccauucuuguauuccuaguauaaaucugaauugaucagauggaugaccuuuucaacguguucuugaauucauuuugcuaguguuuucuugaggauuuuugcaugagugucuaucagggauauuggccugcaguuuucuuuuuuugaugugucuguuucugguuuuggaaucagggcaauacuggccucguagauugaguuuggaaguaucccuccuccucuguuuuucagaauaguuugaguaggauuuguguuaguucuuuaaauguuugguaaaauucagcagugaagccauuggguccugggcuuuucuuugcugggagacuuuuuauuaugacuuugauuuuauuacuuguugucaaucuguucagguuuuggauuucuucaugguuugaucuugguagguuguaugugucuaggaauuuguccauuucuucuagguuuuccaauuuauuggcauauaguugcucauuagaagucucuaauaauccuuugaauuucugcaguaucaguuguaaugucuuuuuuaucaauucagccacucugugucuuuugauugaagaguuuaguucauuuacauucaguguuauuauugauaagugaggacuuacuccugccauucuguuauuuguuuucugguuguuuugugauauucuuuucuuuccuuccuuccugucuuccuuuuugugaaggugauuuucucuggugguauguuuuaacuucuugcuucuuauuuuuuguguaucuguuguaugcuuuuugguuugagguuacuugaggcuugugaguaauaucuuauagccuguuauuuuaaacugaugacaacuugacauugauugcaaaaauaaacagagaaaacuaauaaaaacucuagauuucacuucaucccuccaauuuuuaacuuuuuguuauuucuauuuauguauuauuauacuaucugugucuuaaaaaguuguuguaguuauuuuucuuuauuuuauuuuauuauuauuauacuuuaaguuuuagcguacaugugcacaaugugcagguuuguuacauauguauacaugugccacguuggugugcugcacccauuaacucgucauuuacauuagguauaucuccuaaugcuaucccuccccgcucccgccacccuacaacagacccuggugugugauguuccccuuccuguguccauguguucucauuauucaguucccaccuaugagugagaacaugcgguguuugguuuuuuuguccuugcgauaguuugcugagaaugaugguuuccagcuucauccaugucccuacaaaggacaugaacucauccuuuuuuauggcugcauaguauuccaugguguauaugugccacauuuucuuaauccagucaaucauuguuggacauuuggguugguuauuuuucauugguuugucucaagauaugaguaguuuucacaccgcagucauaguguuaauaauauucuuuguuuuucuguguacuugcuauaaccaaugaguuuuguaccuucagaugauuuuuauugcucaucaauguccuuuucuuucagaucgaagaacucccuuuagcauuucuuauagaacaggacugguauggacgaaaucucucagcuuuuguuugucuggaaacguuuauuucucuuucauguuugaagaauauuuucacuggauauguuauucuaggauaaguuuuuuuuuuuucuuucagcauuguaaauauauccugucacucuccuggccuguaagguuuccacugagaagccuguugccagacauauuggagcuccauuguguguuauuuguuucucuucuccugcugcuuuuaggauccuuucuuuauccuugaccucagggaguuugauuauuaaaugucuugagauagucuuauuugagauaaaucuucuugguguucuauaaucuucucaugcuugaauauugauaucuuucucuagguuugggaaguucucuauuauuaucacuuugaauacacuuucuacccuuaucucucacucuaccuccucuuuaaggccaagaacucuuagauuugcccuuuugaggcuauuuucuagauuucguagacacuuuucauucuuuuuuauuauuuuuugucuccucuaaccauauuuucaaauagccaaauuuucaagugucuucuagcucacugauucuuucuucugcaugaucauuucugcuguuaagauacucucaugcauucuucaauaugucaaugcauuuuucaacuccagaauuucuacuugauuauuuuuaauucuuucaacagcuuuguuaaauuuaccugauaugauucugaauuccuucucuguguuaccuugaauuuuguugaguuuccuugaaacagcuauuuugaauucucugucugaaagggcacauaucucugugucuucaggauuggucccuggugccuuguuauuuauuuuauuuaauuuuuuugaggcagggucucacuguguuacccaggcuggagugcaguggcaugauuuuggcucacugcagucuccaccuccuggacucaagucauccucucacgucagccucccaaguagcugguagcugguacuacaggcacacaccaccacccagcuaauuuuuguauucuucuagugacaggguuucaccauguugcccaggcuguucucaaacuccugagcuuaagugaccuccagccuuagccucccaaagugcugggauuacaggagugagccacuguacuuggcccuggugccuuauuuaguucauuuggugaggucauguuuuucuggaugggcuugauucuuguggauguucgucggugucuggacauugaaaaguuagguauucuuuauagucuuugcagugugggcuuauuuguagccauccuucuugcaaaggcuuuccagguauuugaagggacuuggguauuguaaucuaaguuuuuggucacuacagcuguaucuauauuaggggacaccccaagcccuauaaugcugugguucuugcaaacuuggagaugugugccaccuugguggucuuggauaagaucuggaagaauucucuggagcaccaggcagagauucuuguucucuucccuuacuuucucccggacaacuggagucuuucucuuuguccugagcugccuggaggugggggaggggugucucaagcaccccuguggucaccaucacugggacugcacugaguuagaccugaaguuaucauggcacugugucucgcccaaggcccacgguaaccacugccuggcuaccgucuauguuugcucaaggcccugguccucuacagucagcagguggcaaagccacccgagcuuuuguucuucccuucagaguggcaaguucucccugaguugggguguguccagagaugccaucugggagcuagggccuggagccaaaaacuguaggaaucuaccuguggcuaaacugguacccaagccacaagacaaaguccuucucacacuuuccuccccuuuucacaagcagaggagucucucuccauggccacuacugccccagggccacaaugaguauauccucauuaccuccaguguucauucaaggcccaagaucucuucagucagcuuuuggugaaugcugccaugccugggacuuucccuucagggcacuggacucccaugugacccagagaagguucaacaaugcugucuaagagccgaguccugcaaucuggggccccaagagcccacuuaguacuauagccaacaguggcugagguuguaccuuguuuuuugguuuuuaugaaggcacuuuuuuguguggauaguugcuuaauuugguguuccugugaggaggacaaucaguggagacuucuguucagccaucuugcuccaccuccuguguaugaauuucucuggccauauacuucaagguauuuugggauucuuucugcuuuucugaauaucuggaaacuuauaaacuugaggagaaauguauuuaucauuuaaaaaauauuuacugucuuccugccauguuaagugcuaugcagaacuggccagaauagaaauuccuauucuacugacuuucuagaguagaaaauuggacagagucccuuacaguuuaugguaaaugugacaugaaugaugaaaaugcucuaguauggagagguaucacuacugaauaauggucaaaggacaugaaguauggccugggccuugcgggauggguagaauuuugauagcugauaacauucugggcagauaucaggaaguuuuaaaaccaaauuaguuugagcauaaaguuuacauuggaaagauaaagcuauaucuuggcuuugaaugccauacugagaaguccagucauuugacagauaacaaacuucaaucacuuuauugguaauuauuuuuucagcuauccauuuaaucucccaaauguaguuuuauaaaaacuguuugguauuuuuaugauauguuucucucugaaauugauauaugcauuugugugucuauuaccuuucuuugaagcauuaauaaaacuuauaaacuaugucaaaucauucaaaagguauuugcuagauggccaaaaaggucaccucuaccuuuuaucauuuuucuagauagagaauuuuagggagggagaaacagcuacuuuuuuccacugaaaacugccuguuagccucccuucacgaaugcugucugaccugcuuagaaaagaauuugacaagacacaguaaugaaagagcucaaaguuacauuauuuuguaugaagaaggcaaacaguauauuucaaauacuuuccaugcuuuauuaaaauuaugaacuuuugaaggaacccuaaauuuauaauagauauagcaaauguuaauuaauuguuucaguacuuguuuuuuaauauggcuaaauaauuuaaagaaaaaaacaugguauuucacauauaauauauaaacaaauuguuuaguucauauuaaaaguaugauaaauuugugcuaacaagucaagaaacuuuaaggcagcuuaguaauggaaaauagauguaaugaugcuuccagguaaccucuuaaaaacccaagucuuaucuugucacugucauguauaggcaucacacauuaaccucaaaauaaaccaugauuaagggcuucuaggaucacuuugaucuugcucuuucagccugagccagugcuaugcagacccuuaaucucccuuucccuguaaucacacuggacuuuuucagucccuucaaauaauguacucacuuacgccuggaggccuuuauguguccugucccugucucuuugccuggaauauucuagucucucccuuugguugacugacuucuauauauuuuguuucaucucauuuuaaauaaucaguuaaucagaaucuacauucuccccucucagagcaccucauacuuugacagcaguuuccacaucauuuuuauuuauguuuguuuuccucauuaagcuaaauuccuugacaggaauagugucuacugguacagauuauuuauaaaguaugcauauucuaaauuucaauagauguugugaaauuaccuuuaaauagauuauaucacuuuuugcuguguauaggagggccuguuuucccagucuuaccucuuuacaugauaucaauuuugaaaaaagcuucuuauuuuuaaaaucuguaacuguuuuuagcgagcucagauaucuuuuuagacauuuauuggccaauuguauuguuuucuauauucccauuuuucuguugauuuguaagagcucaucacauauuaaggauaaugagucugucauauaaauuacaaauauuuuuucgcaauuuugucuaugugcuagauggcuucuccgccuugaguuuuguaucccuuaaaacccugcucuacucuaugccccagaauguucuucuaaauauccugcucacuucucuuaugcuuuccaggcugugaacaugcuauuucaccugacuaaaacagugguuucaacuucuuaaaaauuucaugaauauuauagaauauugugauuccuuaggaacuacugguucuaaagagucuucucuuuaacccuuuugugccuuuuauacucagaauugcuuauuuaauuauccauuacuggacugaaauuuuaagacugacaauuccuugucuucucuccccacccuccaguauggauuacgggggccuuacaccuagcacaguacuggcaaauaguaugcuguuuuguuuguuuguuuuuaaguuauucuauuuuuaaauuuuaaucuauuuauuuauuuauuuauuuauuuagagaccagguuaugagacuggcuaauguuuguauuuuugguagagacaggguuucacuguauugccaaaacuggucuuaaacucugggacucaagugauccaccugucucagccucccaaagugcugggauuacaggccugagccacugcgcccgccaguagauagugugcuccugauaagcaaguauggaguuaaucaaucaugacugcucuagaguacucuucuauuggaaaagagcuggcacuuugugacauuuguagccuuuucugcuuccucugguuuuucacuguauuuuauauaaugagaucauugaucuuggugaguaaggcagaggaacauaucccuauucuuuuaggaccauaaaguuugucugaucuuuuguggacuuuuaaauagugcuuauucuuuuuuguguaccaaguaaugaagugaugagagagugaaucuagaaaguaaggaaaaguucaggguauagaaauagcuauucagugacuuuguauuuuuacuuguguucuuaagaaccuuuauucauguaaugcaaaguaauuuguguugaaguugaacuugugagaaaauauauaguaccuaaugcauucucauuuggaauaugugaucuguagaaauggaaauauuuuuauuuauuuuacuguuuuuauaggagguucguaaagugaaugaaagcaucaaguauaaucacccauugagaaaauguguugauacaauacuuaaaaagguaaugaaaucaucuugucuguuuccuuuugaaauauacacuuauauaauauuauaccaaaaguaccagaaaaguaugaaaacagccuauagcugaggucuucuaaauucauuuucauagaaauaucaacccaacaccauuuguacuuugaauuuuuuuaauuacugcaaguuuaacacuaauuauuggcaguauuuucuauugaaauauggagauagagguugaguaauauauaaggauugucaugacaaugauggaaauaaaccuuuaaaaugucauuguauauguucacuaaaggcauaucuccuauaagaaaauaaaccaaggccucaguaauaucuuacaaucagcugccuacacguuauuuuacaaauauauuucauuaauauauucaugacauauaucauaaaaugaaugauguuaacauagacauuuaauaaacuauacuauauuuaacuauauuuauauuuauauauuuacuauauuuauaauaaacuuaacuauauuuaauaaaguuaagguuuugaugcauugguauugaauuagggguauucauauacuuccaaaaaugguuauuugcaguuccccaauugucuuuuaaacccacagaaccauggaaacauuuauuuuccuagauuuuaaaucuguuauacugauucuuguguaguguucuguuuggcuaagauaauacucauggaaucacuuuucuaacuauuuaucucacauuugcuacuuuuugagaacuacuaagagagguuaacuaaguugcccaaguucauauagguaauaagugaguaguaguauggaagaugacuuuaaaugcauguauuuauuucucugugcuaugccuuucaaaaauucagcaucuuggauuugucaugauuuugcuucauucuuuagcuagaaaaauaauuuauccuacuuagaauaaucuucucaaauacuaguugcuuccugcagguaagcuccccugccuauagccaucuauaccuaucugguauauaugaacacaaagauuaauauuauaaaggugagaagaaacucaguacaucuuuuaagacauuuucaagaaaauaucagcaaaugaagucuaacuagagaugacaauaaaguaggaagauguuuuugagaaaauuagaacugcucaagaaugaaagauuuuuaauaaaaauaaauuuuuaucuuuuuacaauuaagauuuuuaaaaaucuacuuuuuuuuuuuuuuagugcccuacagaguaucaggaaaaaauggguaggaacauggaugauuaugaagauuuugaugaaaagcauaguaucuauccaagugaaaaaagucugguaaaacugcauaaacagguaacuuuguuaauuauaaguauuuuacuuaaugaugauuuuaauuagacuucuaaucauugcucauaaaaaaaggaauuuuuagugaauguguauuuaaaacuuccuuuaaucccguccuuaucauucuuugaaauauuuuaucucuguguauaccagcagggguauuauuggcguuuggggagggagaauucuucacugagcauaacuguuacauuauauaaaacuguuacaucauuuuggaacauuaauauucucagccugacccaguaaaugcccuagcacuuucccauuguuaugacaauccaaacaugcucccuaguggagaguugaaccacuguuggaucagaacacugccaggucuacccccauucucuuuuuuaggugauuuauucaguucagagacaccgucgaacucaaguacaauggcagauucuuuuggaacaagcauuuuaucuagaagauguagcaaaaaaugaaacuagugcuacucaucaguuuguucacaccuuucaaucgccagagccagaaaaucgauuuauccaauauuuuuauaauccuacauuugguauguaauuugauauaaauuucaaacuuuaaugaugaaaaguuuucuguagaaagaaguuauguauuuucaccaaugcaaaguugaauuuuauuuguauuauuugauuuauaccaugugauauuaaguaucugguaacauuuccccaaaauaacuguuuuacuuaucauauaacauauaauccaucaguuuccacuguuacuucacaaauaauaaaaauucuauuaaaaaacauguauacaucaagcauauuuuuuauaaugcauaauauauacaauuaugcauugcuuaaugacugggauuacucugagaaauguauuguuaggcaauuucaucacugcaugagcaucauaggguauguacuaaaccuagaugguauaguacagguaggcaauaugguauggcuuauuacuccuaggcuacaaaccuauacagcauguuacuguacugaauaguguaggcaguuguaacacagugguuuuuguguauauaaacauagaaaagauaauaguaaaaaugcaguauuguaauuuuaugggaucaccauuguauaugcaguccaucauugacuggaauguuguuaugugacacaugacuguacuuaaaauaguuagaauuuuaaguaauuuuacaucacaagcuugggucucuucuucagucuugacauacuacugaaauauuugcuuaaguaguccucuuugauuauuaacauuuauuagucuuauuauaaaaccuauacuuuguaguuaucauuuuucuccuuuuugcuaauuuauggcaaucccuucaaguauugucaaauuuagugugaagaaacuuaaagcaaguaccaaagugucauaguauuaaaacuucuauuuaccuuauuuauuuuaaaaaaauuguuauauucacuugauucuccuuugcauguuugguuuugaguaugaagacuuaauggcuauaacaaauaucucagaaaacuccuuuaacaaaaauccuuccuaauuaaaugaaggaaugauguguuaucuguuuucauucauucaacaaauauuuggguacauuagugcuauguauuauugggugcuggguagcuugguauauaucaguuuaaaaagacagaaauuccugcccuuguggagugagaaaaacagacaauaaacauauaaaggcauaaagauucugaauaggcaguugauuauagaaauugaaauucaagggaggagucugaauugcagauaugaauuaggguaccaucaauguguagggaaccauggggucaggauaaaaucaauaaagaaguaauugagauagagaaaagagaaaagucugaggaccaagccugaggcacuccagaauuuagagauuagguggaugagaaguaacuagcagaaaagacuagaaaaggaggggccagugagauaggaaaauuaggacaaugaaguguuuugaggaaaagaguauauaaaguaccuuuucaaauguugcacauagauuaaggaucauauauauuaagaccugaccauuggauuuuagagaagugaggggagaggauaaaaaagucugacuguaauuuaaaagaaauaagaagaggagcaauuggagacagacuagaaaacucuaaaaauguuuuccuuauaaaagggaacagagaaaagggguaguagcugaaagaggauugggggcauagucaagagaaauuaucacauguaauuaguaaaugauauaauagaauuugaggccaggcgcgguggcucacaccuguaaucccagcacuuugggaggccgaggcgggcagaucacaaggucaagagauugagaccauccuggccaacauggugaaaccccgucucuacuaaaaauacaaaaauuagcugggcgugguggugcgugccuguagucccagcuacucgggaggcugaggcaggagaaucacuugaacaggaggcggagguugcagugagccgagauugugccacugcacuccagccuaccuguagucccagcuacucgggaggcugaggcaggagaaucacuugaacccaggagguggagguugcagugagccgagauugcgccacugcacuccagccuaccuguagucccagcuacuugggagacugaggcaggagaaucgcuugaacccgggaggcagagguugcagugagccaagauugcaccacuacacuccagccuggggacagaaugagacuccgucaaaaaaaaaaaagaaauaaagagagagagagaugaaagaaaagaaagacaaaaagaaagaaagagagaaagaaagaaagagaaagaaaagaaaaaauucauagaauuugauaagacaauagagaauuucuaagacaauguucaugacuaguagagaugagauggugggaaauagugaacaaugaagagaaugguggagguaaggcacagauguaacuagcugagaagguguaguguuagaaacuugggaaaauucucugaucgcuucuguuuucucaaugaaauguggagaguaaguauaggagaggagauuuuagagauuugaggagggaagagaaggugcaaaauaguugccuaggagaguggcaugggagaagauuggggaauuauaguaggcuagugaggcaguacugaggacccacuugaagcuagugauuaagaauuuaaagugaggccagucaacaagguggggugucuuucuccugcaaugugcagcuguguggaugcaggcugagaguagccagcgaguuggauuuaaacaggugugauuuagcuuagcagguacaguggagcaaaauggggcaaaguaagugggauacuguccucaaagacuggaaucugagcugcaugaggaaggaaggguaucaaaguguuaaauaacgguaaaaugugauagaauaaauugauuuuucauccagguauggucaguuaguggaguugaaauacuguacuagaugaagguauuguuugaagacaaggaugcuggaaugugauuauauggaagggcuggagauauugauaauaaaagguuuaggcaucacuauagcaacaaguaauugagguaggguggagggaaaguucauuagaggagaggaggucaaagaaaugagagauaaggguauugaaaggggaaucauuuauguggauauugaaaucacuaggaauuaugagaggaaaguuguaaagaauuacagugaaccagaagcuaacuauucaguaaaugaacuaaaaauauagcuuuuuaauuuauugagcuuucuuuuuuaaauuuuuauuuauaccuaaauucagacuuaaaaccaaaauagugcugggaguggugccucacaccuguaaccccaacacuuugugaggccgagguggguggaucauggggucaggagauugagaccauccuggcuaacacggugaaacccugucucuacuaaaaauacaaaaaauuagcugggcaugguggcacgugucuaauaaaaauacagaaaauuagaugggagugguggcacacgccuguaauuccaguuacuugggaggcugaggcaggagaaucacuuaaaccccggaggcagagguugcagugagccgagaucaugccacugcacuccagccugggcgacagagcgagacuccaucucaaaaaaaaaaaaacaaaaaaccaaaacaguacaaaauauucccauauacccuucaaccaggcucuccaauguuaauauuuugccauauugauuugcuuuuucuguauguauuuuuuuauuacuauuuuagaguuguauccagacaugaugccuccuuguuccuaaauguuuccguguauauuuucuaaaaauaaagauauuuucuuacauagccaaauacagccaucaaaauaaaaaaauuaauauuuauacucuaccauuauuuacagaccuuauucagauuuugcuauaauuaucccaauaauauuuuuuguaaaaaaucccagaucaugcaucgcauucaguuguugugucuccuuaguuuccucuaaucugacacaguuucucagucuuuguguuuuaugauauaucagaaauguuuuggggaguauaggccaguuuuuuguugaaugucccugaauuugacuuugauguuucuuuaaaauuagacgcaaguucugcauuuuucacaggacuaccacagcagcaaugucacauuccuaucaguacaucauagcaggaggcacaugaugucaguuugucccaucaugggugucauuugguuagguucguaucugccuggauucuccacuguaaaauugcuguuuuucucuuuguaauuaaguaucuuauuaggagcuauuuugaaacaauguaaauaucccauuacucuuuuguaguuuuccuaaucauuuuuuucuuuugucuucuagaaugguacugggaaugucuuuugcgaccaugguuuuacaagauacuugcugugguucuguccaucuucucugugauuguuguguggucagagugcacauucuuuagcacuacuccugucuuaucccucuuugcggucuucauacagcuggcagaaaaaacauauaauuauauuuauaucgaggucaguuuauuuuaugucugucauaaauagaugucacuucauaguauaauccuuaacuauuuucuccauguauuucuucuaguaaaaaugaaagcagugagguuuucugcaguguuguuauucaaacuuccagaaaugugcuucauuauuuuacccacacuauagaaauuaauaacuguauuugaggagagaugaaaaguugcaagauagugcagaaaucugagauuuuuuuuuucuuucuguuuuuuuuggaggcagaaucuugcucugucacccaggcuggagugugguggcaugaacauggcucacugcagccucaacuucccgggcucaagaaauccucucaccuucaccuuagccucccaaguagcugggccuacagccaugcaccaccauccccugcuaauuuuuguauuuuuuguagagucaggauuuugccauguugcccaggcuggucuggaacucuugcacucaagugaucguccugcuucaggaggauccaucacacuuggcccugggaauacuuugauuauauuuaugccaguaaagcuacauaacuuauaggccucaugugaagaguugccaagggaaugggaaaacaggcucacauuagaagguagauucgaaacuuuuggaucuaggauguuaaacaguuugaaguguuggguuuuuuucauaaucuuagugggugauuaaaaaauucucuauuacuguauuucaauuuuagagcaucaauaaauguuagcuagaaaugaaggccaggcugggcgugguggcucacaccuguaaucccagcucuuugggaggcgaaggcgaauggaucaugagaucaggaguuugagaccagccuggcaaacauggugaaaccccaucuuacuaaaaauacaaaaauuagccgggcgugguggcacaugccuguaaucccagcuacucaguuggcugaggcaggagaaucacuugaacccaggagguggagguugcagugagccaagaucgcgccacugcacuccagccugggugacagggcgagacuccaucucaaaaaaacaaaagaaaaagaaaugaaggauaaugccuguaauuguuaagugcuaaagucuguuuguuuuaaacaaacugcuuuguuuuuguuuuuuuccagauugccugcuuccuuuccaucuucuuccuaaguaucuguguuuauucuacuguguucaggauucguguauuuaacuauuauuauuuggccucacaucaccagacugaugcuuauagccuucuuuucaguggcauguaaguaggauuauguuuagaaacaagagaaaugucaucauugaguguauucuuauggaucuuuuauuuuuuguuguuuacagguguuccacuaacaucuauauuucuaucagcuaauugauuaguuucaaauauuaaauugauguuuguugauugccagcuacuuccugcuugagguuuaagguuaaaauaggugugcuagguuaggcuagaaggcagaagaagcauacuuagugagcccggauuuaccaaccagagauuagcaagcaguagaaacaauggacaguuuagagacuaagucagaccuagaugguguucuaagauucagcggucucucacugaguugaggaggacugagaaaaccaacaagaacaauuuuuccugaggaauucagagaggauuuagagagaugucuucaaguugggcaagauuguacaaucuauuaccuguucuuauuguuaaaugaguccuauuagguauuuauaaaggaugaacuuagauaauuuuauagaggaguugacauccaaaguauuuuuaagcaucuuuuuuguuguuuuccaaauaauuauggacucaugggaaguugcaaauguagcacaaaaaguccuauguaaccuucacgcuacccccagugauaucaaaaccaggaaaugagaguaaaacauuacuauuaacuacaaacuacagacuuuauuuaguucucaccauuuuuuauccuucauucguguguguguguguguguguagauuccuguagccaccaacacaaucaggauucagaacaguucuaucaccacaaaagaauuaucucauauuauuuuuuuuuaauucauacccacacuuuauucuccccagccccaauuauccaaguguguggguuuguaaggcauucuuuuuauuuggacagaauugaacaacuuuauaucugugcuugucagaaugacauauguugauacaacuucaguucuuuuauguacugaauacaauucaccuugaggauguuacuguccuugucaugcugugagauggauuuuacggauggcuuaguuguaggagaugauacaaaggcacuccacaacuuguggggauaaagcaauggcagaaaccauaaaagcaaggagcuugaggcuguagucacguaggcauugauguggcaauuuucagaauaucucccaaguaagugagggcaggucacauuaagaauucaauauauauauaaagcaaauagaugaaaauuuuagcuauaauuaucugaaauguuuuuaauacaucucaguauacuauaaaauguauuuugcugcuuuacuuuuuauauacauauuuuuaaauguuuguugcaggcuauuuugccguuugacaccuccuuuaugucuuaauuucuuggguuugacccauauggauucaucuaucucucacaagaauacucaaccaacugcuuauacaucuguaaguacggucagaaaauagaauuccuuagguucacuaucuauaugaggugcuguuauugugaaauuucuuuuaaugccagcagaaaaguucuauaguguuauugguaaaauuuucucuuaaagauuguauacguauuacuauugacuagauaaaagugauuuuccuucuuuuaugauaaaaauguuuuuuuugguucauauauguugucuagcugaccaguaucaaaagaacugaccuauacuaauauuaacuuuauauuuguagucaauguaugugauaauuuugaguaauaauuauauuaauuuucuuuaagagaaaaccucaauaaaaagcagauuuuaaaaaauaaguccauuuacugcuuuuuuucuacuuuuuaaaaaguucaaauggauugauauaacugguuauaggcaaauuuucuaaugauggaaaggaauggaaauuauagagcuauuccaauuuaacuuacuuuuuucuugcucuucagauuauggguuccaugaaaguuuuauccuuuauugcagauggauucuauauauauuauccuauguuggugguaauucucugcauugcuacuuauuuuagguaagaaacuuaacauuguuuuuucuuuugcucuuaaaucuggauauccuuucucuuuaaagcucuuuuaaauauuuacugauugaguuucaguuuguuucauuguagcuuuggagaagcuggggauaguuugaagggacuacuugagugaucaggugcgagucucccucuaaaaaauuuaaagaaaaaagagguagaguuauuauucuauuauaauaaauaauacuauuuuaacauuauucuauuuaggcuaaaaaaugauaggauuaauuacagaauguuaacucuaaguccuggccuuugacacugacagcuaucguagccugcaaaacacccuuauguccagcuuuuuucuaaugacauaaauuagccuuagagcuuuccaauaauuauugcugggugucuaaaugcuucagaccauggccagcacaaagggucaggugaggaccgauuguaaucaagcuguacauuaagauuagaggagaaauuuucuccugugucauaaaguacauggcaugcuguuuucauggaauuagaaugaaugguagaaucuaggcaggagugagauucaaaagggauuaaaggauagguguacuuggcuucucgcaucugucuuuccuucuuuuuacaugucaggccuccucauccuguacucugcccucuuucauugcugaagugcuccauaacauacccaaaauaccacuuuuucaaaaauacuuaaaaauguucauugcuuacucuucugagaaaaauaaauuuuaucuacccacuuuauuuaaaucuuccaauaccauuuuauaguuguuacagauaauaucuacuaacauuacaguaaugaguaaacagauauuguuuaaaauacauuuucuauugaauuuuugaaaauauauuuuacuuucuuauaaguaaaauaacuaaaagauuauaacuucaaauuguagcaggaugagccgcagacaagaaccccucagacaccgaguuguagaaggaaagggcuuuauucagcugggagcaucagcggacucacauguccaaaaaccgagauccccgagugagcaauuccugucccuuuuaagggcuuacaacucuaaggggguccucgugagagggucuugauagauugagcaagcaggggguacgugacugggggcuguaugcaccgguaauuagaucggaacagaacaggacagggauuuucacgaugcuuuuccauacaaugucugaaauuuauagauaacacaagcaguuaggucagggguugauuuuuaacuaccaggcccagggcgcggugcuggguuaucugccuguggauuccauuucugccuuuuaguuuuuacuucuuucuuuggaggcagaaauagggcauaagacaauaugagggguguucuccucccuuaaaauaauacuuuuaauaugaacugauagcaaaucugauauuuuuaguguuuucuuuagguggagacaguaacagaucuacagugugaaaaugauguauuaaaagaagagacuagucauacuuugugugccuaaaacuauguuuuuauuaugugcuuaaucauuugaaaaguuaauaaaguggaacauuaagaacuuguauaaauuuuuuuaauguuacaguuaugcuggcaagauuagcauuucuucuuaccuuauuagaugguuauauagaucaagugauauggggcagaauagugcucugucaacuauaaaaucuuagcuauaaggaaucacuauguccgaaagcaaaauuguuaagauaaucauuaaaagugucuuucuagaguuaaucaggauaaacuuugagugccauuuuaucuuuaagggaaaaaaaagguuguauuccuuaauuuucggauuaacucacaaaauagaucuucuguuauagaaacaccugaagcaaugccuuacugacauuucaaugauagguuaacuugauaaguucauuuucauuugaaaugcugccauaauuagucuaauucccacacuauuagcaacacagccacacccagaguuaauauucagaccuaccugccuagagagcauaaguuguuuccugauacuucagacaaagagaaaacuuucccagagacagugaucuaauucugagcuucucaucccggaguauaguacucccauaaggauaugaagaugguaaggaaauguuugaagucagagaauuaacaugaucaucuacaaaaccccaauuuuacccaaugguaaugcauaaaaaacauuuuuauaugaaugaaacaaguagauauauuauggauuagcuagauauuuacacauuuuuacugcaaaauggaauggagaucuucacuuuuucuaaauugcuuuccuguuuucccuucgucucucucucucucucucuccuucaccacuuucuccuccucuuccucccucucuguguagaaguacaucauugaaaaaguuugagaacuaauauaauaaaaagagcugcuugguuuuuauuuucucugggauuuaaauucuaggucugucauuuauuaagggaucuuuagcaaaguauuuaaccccuuaggccuguuuucuuaucuguaaagugauauuuaucucuuagagugauaguuaaaauuaaauaagaaggcaucuguaaauuaucugauguauaguuggaucuuaagaaauauuaauccugcuuauucaccuaucauuuccuuccuuguguuccauauuuucaguauucuugucuuguacaacaaucaaauuuaaaguaaauagcaaauaagauauaagguaguagucuucagauaagauauaguaaucaauuuguaguguauaaaagcuauuuaaauaguuaacuagaucagaggaaaaaaauugcucuuacauuauuacaguuaucauuuuagcaucuugguauaauuguuuucugaagguaugcugauaacuugacuuaacugacaucuauaagaaaccugaauauagugcauacccuaaucagugaaguacagggcauacacuucuuagaaagggagauaagugguacuuccugaagcaugucagaugugacaguagauaacuauaugauaacagauaaugaagcauagucuucuuuuggagugacaaugcuaaagaacaauucaucuaaauauuuacaaugugaaauaauguuugucuuuuuaaaaaaucugcuuuuauuaguuugggaacccguuguuugaaucugcucgguuuccagcaguuuaugggagaugaugauaugacaucagacuuaguuaaugaaggaaaagaauuaaucagaaaagguaagauuugucuuuuaaaauaaaugaagggaaaauacuaagugcuaagacucaaaauacaaaauuaauauuuguguaguuugugaauauuuuuuaaucuauucuaagaaauuaugaauuaaugcacauuuuuagcuaaaaauguacaauggccuuucuagcaaaaauaauuugaaaacaugaauaauuguuuuaucggucuuuaagaaauucugaagcuuaaauuauuaguaugucugcagcgagauaacacccuuguauggucuuggaaucauuuucauguuuaccuugaaacauauuugcgaagcucuguacaacuauaaaacucauuaauuuaaagaaucaucgguuugauacugcaugggaaaucauucaaacaaaggcuacuuuuuuagaacgugaucauuaacagccuguuagaauacaugguacucuaguagaaucaaaucacaaaacugaguguauuaaauuuacugauguucaaagugaugauagcauggagggaaaaaaacuugacuuuugggacauugguucuuagacauucucccuacuugagucuggggcuuuuguguaauuaugaguugaauguaagacaaaauguauugcagcuccaaaauaagccaguguagccuucacgugcucuccuauuagaccucauauggcauagcacauccaguccuggguaagauuuuuaagaauaagacugauaaauuagaagguauuuagagaaggacagcuagaauugugagucuguagggcauauccugggggaaaaaaagugaaaacaucuugucuguaaccuaaagagaguaacaaggaaagcgacucauacagaaagaaaagaaguaugaacuuaacuuagaagacaggaauaaaagaauagaauuuacagagaaacaaauuucaggucauugugagaaagaaaucuuucuucccuaaaguuauuuaagcggagacuacagggccaucugcaacaaaaauagagaaggcauucacuacugaguaagguaaccucucaaauuccuuccagcaauaaccuauaacauuugauuuugugauaauuuaaaagaaauacuggucauugcccgcuaucuuuacuucaguugcacuaugucugauuaaaccauguuaugccauauuugagaucauuuuucugucuuuagagaagagaaaaaggcaaaggcaagaagaaggugaaaaucgaagaagaguaaguacaguauuaauuucuguaaucugaagauuaauuugaaauuuaauuucuuaagaaucuuacuaauuuggaauaauuagcuaaagacagaaaaaaacaguggaaaaauguuauaagauauauuuuuaaagaaagggaauuuuaauacuuucagguauauacgcuaaguauccugacagaccuguucuaaaagucauuaguaauaaauuucuuuguguuuagcaucgagcagcuucuugcuaaaguaggugcuccaugaauauuugucgaaugaauaaauacauaaauuuguguauucuugcuauuaaagugguuuugauugcuuuaaaauuguuucucuuuuuuuggugcugugacauuaauuuuauuccuccuuaauuuuucuuuaagccuccauuuucugaggcaaacuacccuccugaagaaaaugaaaaggcaaaaaaugaguaaaaucuaauuauaauuaccacacauuuuuuuaacaaauggguguauauacuggcaaaguaaaaacuaacaggaaacuuaauaguugucuuuguguaucuucauauauguguaucuucuuuauuuuagaaugcagaacuagaaccaaagaguagaaguuacuagagauagauuucucuucucuaugggaauuucuaaauuacacaauuuaccagaauugcaauaggcuucucggacauaggaaauuacaugcuaucuagucagagagccaaaaagcaucuggcaaggauguuuuagaaugagacccugcacugcauggaaaguugcauuaggugacuucuaaugucccuuucaauucuaagaauuuaaugaguagaauccaguuaauaugguuugacugcauuuaagauaacacacaaugccgugugagucauaggcuaauuauguuuguauacaacuuuaacuguugacuuuuuggcucucuaauauuuguaguuuauuugagugaaagaaaaucuuguuaacgucuguuagucauuauggguucucuuaacuuuuacauggucaaaguaagcuuguaguaauauuguuuuacaauuuagauagaugaguaacaaccaaaguuagcaaaaauaucucuaugucauuuguaaaaguugaaguuuauagagacugugacuucaauaaaucauguaaaaauaaaaacauugaccuaugauuuuuaaagauacuaggauaauuauauugauuacuaaugaaucucugaugaaaauaaauuauauugcauauguaaucucuugacauuaaugaauuauuuucuguucuauuauaugauuauuugugcuucuuuucuaggaauggaaagaacguuauggacacaauagagaagauuccacuaggaacagaaauauucauacugaccccaaagagucaaacuucucagauguuaauaccaaccguuguaaguaguuuaucuucuaguucacuuggaaauuguuuucuuaugcuuucuugcauagagauugaguguuagaauacacacauccagaaaugccuuuguagaauuauaaaugguauauuugcagugacuucuuuuuuuucugcauuccucaguauauagaaggauggggaagcucaaauauguacugugguagggaaaggagaaacuggggcaucaaaugaauaguucuaaguauacuaacccuaaauaauguaagcacuuaucccagguauguucuaggcagguguuuauuucuacaacuuaccuugauguuuuucuuuccuauuaguagguguagguuauuuggucauuuuuauaauaauuuauugacugacccauauaaguuaggcauauucccagguauacagcaauacaaagaagguauauuucuuguccucaggaugcucauaauugagugagggacugauaccagacagaagccaucugcuaccaggguggguuaggaaacuuuguaucacugaccccacacugacaugaugcagaagcuauuuaggaggugccaagaaaccaguuuuugccuaggaccuugaacugaguagaaggaagaggcuguuuuugggagagaugcaagauugcugaaaagcuccaccacugaggcuucaguacacaggguuuaagacugaggauggaggagaaaaacugagcacucucacccacucagcuacaaguuuugcacugagcaccaagccauaguagucaauuguuggaggaggaauagaaacauggagaagacucccucuguggcauauccauauccaugcagggacuacugaaaucugagaguggaaaaagaauacugagagaaaccaucugacacuugaggcccuacuaaguacaaggucauaggauuucauuacuagagaaaugugaagucuuuggggacuuaaggaaacuaaagcaacaaccaaauccaaacucagaucaacuauagguugagugauucaagccaucagcaaugaugaucuaauagaagaggugugcccauucugggcauaaaacuaugauuucucuccaucuuuuccuucuuuuacacauaaugucuagcuuuuaacccaaaauuaugagauauacaagaaaguaagauaauaugagccauuuucaaaacauaaaauagugaacauaaccagacccagagguggcucaaauguugaaauuaucagacagugcagugacuuugaaauaaccaauugauauguuaaaugaucugauggaaagguuggacaaugugcaugaacagauaggggggaauuucaccagagagauggaaacuauacaaaagagcuaaauagaaauguuaaaaauauuuuaauuacagacuauguaugauauuguagauuucucaugacagcucugauagaaggaugcacaccagaugcagaaggaauucagcuuggggauugaaaaagagggcuuaucuuaggaaagaguuuuuauaaugaagaaauauuucuguaauaaggacauguuuagcugaguauuuaagaaggaauaguaccuagccaggugaaggguauuuuaauuagaagggagacuaagugcaggacguuguggcaugagagaaccuuugggaaaaugcauguuuuucucuaacuaaagccuaagcauggggaggcuaauaagagaggaggccacagaguaguuggggaacagauauugucauucuccaauguuuggauuuggggccaggcgcgguggcuuaugccugugaagcugagguggguggaucaccuaagguuaggaguucgagaccagccuggccaacauggugaaacgccaucucuacuaaaaauacaaaaaguagcugggcauggugguaugcaccuguaaucccagcuacucaggaggcugaaaugggagaauuacuugaacucaggaggaggagguuguagugagccgagaucaugucacugcacuccagccugggcaacagagcaagacuccaucaaaaaaaaaaaaaaaaaaaacgaaagaaaaaaaaguugggauuuugaccuaaagguaagauuucaaucugggaagaagcaugauaagauuuuugguuuagaaagaugaauuugauggcaguauaaagcauaauucuuggggaagugagacuagaaaccauuucagagacuguuugguaauacagucaagaaaugauuauggucuaaaauaaggcaguuguccuggagaugaagagaaaaggauuuauuugaaggacuuuaggguauaauaaauaggaaagggcuaaaggcuuaguuaaaacuaggaaauaggauucuguaaagggauuuggaugcuugcuuaccauagaguggaagaaguuuacagaauagaaagaccuggcaagacgggagagugcuuaaaagaagaggagucacaaagucauaggaugaugaauuagagagaaucuagcauguauugggcaauugcgauuugcugaaugagugagagaaaagaugaagagauuugcauuugggacagaguccaagcuuacaaaaauguaaauaugauagaauuggcuugcauuaaguuuucagaaagaacuauagcauaaagcuguuguaaaucuacuuggacuccucugaacaacauugugaaaauuugguuuguuuauauagaaaucccuauccacauagagaagggagaguuaguuuucuuuaucugcugucugguaugauaaucauuagccacacguggcuauugagcacuugcaacauguugaaaugguaauauuuuggauauauuguguuuaaauauauuaaaauuaauuucacuuguuucuuuuuacuuuuuaauauagcuacuagaaaauuucuaauuaaauaucggcuagugccgauguuggcuagugcuacccauacucuugccuuaugguaaaaagacacaccuuuuuuuaagaguuugagcugauuacacauuaaaguccuagccaagaaaugagguuuacuguaaaaccaacucaaacuacuuuuguuaauaaacaguuucaccauugugauaccauaguuaaauguuaauucugaguuacacuaaugaaauguuugcacugugucugcuucugagcuuagagagcuucuuagcuaacuacaagccuagagaacuuuuccuugcuauauucuauuauacugcuuauaauuuuaaucugauuuuaaggaaccauguaguuaucuuuucuuauguucuuugucuucagauuccuuggaauuuugauuuuucuuucuguaccuccauagacugugacccauaaguuaaaagacaguagggaaguagacauuuuucccccuuccuuugcagcugcauucaaauauaccagggcuaauaacaggacugaaagggaccggauagaacuucuccaagaugcagaaccuuuggauuuuaaugcagaaacauucacugaugauccucuugaaucugaaucaggaagguaaguucuggcugugacauuuuagcucuagcauuccucuacacuuuuaauaacacauugacuugacaagauugaaaauaaguaaguaaaggugaaaguaaacaagugauaaguaaaggaaaauguucauuuucacuaacaauaaaaaauauauuaaguaacuuuugauaccuuuuuagacuuucuaaugcuuuuauaucauccaguaaugguaacuaaaauuguuaucuucauacaauacuagugguauuauaaauaagaaagaauaauugaaauauauagcaaaggaucacaacaauauuuauaugccuauuucugauugucccauuugugaaauuuauuauauuuaguaacugcugcauagcagugucuagaugccagacacuauucuaaguccuuuagcaaaaauauuguaauuguaugguugcaaauucagcuggauuuaaauccagagaggcucaguaaagugcccagagucacacaacuuguaaauggcaagucaggcauucaaaguccaguauucuggcuacagagucuguacuuuuagccauuaugcuauaagcacauaauuaaauaaaagcaaaauaucaugugcacgaaaauguuuacuauaguauugccuauaugcaguaaaaaccuagguuauauuuauuugcaacaauugagagugguuauugaauugauuaaucucccagaugugucuuacauccccugcccccuucuuuuuacaucucucacucugucaugcauauauucuagggucuaaaaccguugcugguugauuuauaauuaaguccuuuuggauaauauacuuggaggguaaguuucugcuuucagcuacugacuagauuuuacaguacuuacaaauuauauggccacucccuuuuaauguauucuuguuuuccucucuuccuuuauuauuuuugaugccucagaucauuucuuuauguucccuuuuuagguaucagccugguggacgauaucucucgaugucucgcagugacauauuuaaugauguuuaaagucugaaaaaguuugugggaccacuaaccaaggucaacacaucaguucagucuugaugaacaucuguguacccuagaauuuccucuauacacagugaaaagugucaagauaacaaaaaaggcacugagaauuaauuauaucuuaggaauaauaguuuaaugugcauugaauagaguaucaccuuuuucaacaagauuuauuacauaucauuuccuaagcaucugccuuagaaauacaguuacaguggaaggacuuuaagaaagaucaacauauguuaagaacaugcaguucaguuuguuucagauuaauuuuuuuucaagagaguuauuuuaaagauucaaggaagccauaagucauacuaaauaauauuauauacaguuuuguuauugugacuuacauuuuuguuacuucuaaaaaguauauucaaccuguauuucccaaagaaauguaagugaauggagaccucaaauaauaacuguauucauaaaacucgugucuuaaaacaaggcuuacuuacuagacauaacugaauguaaaaagugcuuuuucaaaucuguuugcaaacucgugggggauuuuugcauguauaagauuaagauuauacuucaagugaugcgugucuguguauuuagcauguguacuauaaucaggugauauaguauuccuucagucuuuguaguaacuggauuuuuuuaugcuucugguauugcuuuauaaaagauuuucauuucag

SEQ ID NO: 192532 - RNA, 29372 nt, Homo sapiens
ugagaggccagcuaucuuuuauuaagcuaaauguuaaagagauuuguaaaaauguaaaacaauaccacucuucucauuuuuuguuuugaaaaauagucauucuucuuauuuuuuuaacauaauuuuuaaauucuaacagaaaauaucaauagauuuaacccacauacaugaaaacucuuugggguucucacuuuugaagaguguaaagggaucuugagaccaaaaguuuugagaauugcuguucuaaugcauggcugucauuuacucaaugacuuuuguaugagguucuuuugcuucuuuaauguauuccagauacgaauccuuugacaguuccaugcauugcaaacauuuccuugucuguagcuuguucuuuuacagucucuauuguucuacagaagccauguuuuuaugcaucauuuuuuccuguguaugcuuuugugucuugcuuuaaagaaauccuucccauuugcaaaaucaugaaaauaaccuuauagauucucauuuaaaaguuuugucuucauauuuaggucuuuaaucccuuuguuuuuggggaaggguauaagguaguacauauuguuuuccccauagagcuugccguaucugucaaaaaucaaguucccauauaaacauggaccuguuucugggcucuuuauucucgucagggaucccuugacugaccucuacuggcaccagccacacacuacuuuaacugguauaccuuuaaaauauucuuugacauuguuaggacaaguucaugccucuuccucucguccuucuucaaaauuaucuugcuuuuucuuaaucuuuuucuucccauguaacacauuuugagguguaacagaaggccuacugaguugggaguccaggcaucugcccuguucuacuggcagccgccccuaaccagcuguggcuguggagcucauaucucccugagcucagcuuccucuuccauagaacaagaaaucugaaaaucaccucuaauuuuuccucuccaaucccaagagccuauauuuuuaguauaaagacauuaaauuuaacagauaaggaagggaauugaauagagauacuucagcauugcagauuauagggaacagaacuucugccacauaaaugguaauguuuaggaauucauaaaaaaguuuaaaaguucucuucauuauuuuauguugaagguuaggcuagaaucaucaccagagaauucacgggauuuuggggguccucuaaaaugaaacuaugucuugcuauaggaauuuuacuuccugcgugaguuaaaccacaauuuuagagacaaucuucuacaaauacaagaguaauuuccaaucugaaaauuuuguaggggaggauuuagaaaaaaugaaaacuucugaugaaauccuuuauaagucuucucaugguaccaaaauuccaauauuacuucaccagcaaucacuaggucaugaacucugaugugacuugaccuccacuaacucauucacagcucugcuuuuccuucuuugugaccaaaggcaggaauuagaaaaaugcuuggcuagagcuaaggauacugcucuuauuuugaagcagggaaagucuaaauagccauuguagggaacccccagcuuuggcaccacugaaugaauuacagaaagaaaaugagauuuccccuaacuuucuucuccuggacccucauucuaugaaucuccacaucugagcuaacuucaaucaagauggguacuuagcacugaccucuaauaagaucaguguaagaugcaugcccauguauuuuaguuuauuguuuuaccucagacaagugaaauuaaaugucugcaauucaccaaaaauauuuuacccuuagcaaaauauaugguacguuccuguuuuccucuucaaaaguagacuuaggaagcaaauuccuauaaaacuuaauugcccauuuaauccaacauguauagucugcaaauauauaaacuaaaaaagauuuaccuuauuuaaauucaacaauauuuuguauaaagcuuuuguguuuaaaaagcauuuucauauauacuacuucauuuuacuuucauaaugauccuguaugauaaauggagacaauauuauuaugguaauaacuguguuagagauaagaaaaaguucugagaaauuagaugauuucucaacaucauaaaggaugagacgcaagacuaaggucagcuuccagucacaacccaugaagaucccuugaaaauuaugguugauuuucgucaauccgaauaaaagcgacacauaacuccacucaacccucauuaaacaaauuaaauaccugcauguuugguauaagagaaagcaaagaagucauagggacauuugcaguacauuaacugccuuucaagaugacuuccuauuuuuuaguguauaauaacaugugacuaguauguccucugguucauuaauauuccuauucauaauuauggccaauucaucuaguucagauaagaaggcggcagagcacauucagaugaagucucaggguacgagaucagaagauacaaaacugccuaguauucccccugaagagaucaagaaggggagcagggacaauuauaaggaauuagugauagaaauuagcaagaaauagaaagguaugaagguaaagaaaaaaacauaucucuaaauggaaaagaaaagaauuuaaauuaagguucaaaugcuuauuuuuaagacaauaacacagaagaaaucugaucaucaauacuauccaugaagcuaucagaaaagaccuugccauuaaggacuuuaguguuugagagcugaucuguaaccgaaaauuuguucauuucguuaaucugaagauucaaggauauauggaaagcaauaacuucauuguacagaaagcacacauuucaagccagugaguuuaaaauuacuuucuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgaccagccaaaauuacuuucaagaccaaugaaaagaacugacuaauccauccuaaaaauggacucaauacugaucaauguacacgacuguucuaacacucaguuauaacaguucuccauauuuccuuuguguuaauauucaucacuguuauagaauagauguauaagcaucagcucuaucacaaaaucuuucauuaacaaagcuuuucuccacugagugauggaaaaaaaaaaaagaacaaaaacuucugaaaauagugaagaaaaaaacucaaugaagaacaccacaucucuucuuaaauaguauaaauucuguaccaucugcuaccuuguuccgucauacuuuacagcugucacugugccuagggaggacaugccauguaaacuaauuugcuuccaccuccacaauucaaaucggagcaaaaaacugaacaauacaccuuacugguaaaccaguaaaauaucaaauuaaaucaaguaaaaccuugaagagacacuauucuugaaagacuaccaaauguucaauuaguuucuaccuaucacuguucuugagaaaaaaaauacaguaaucaauaaucgguuauuuaaaaauaauuuuuaaaaucggaaccagugucauauggaaaaaugaucuaugaugcuuuuuaaaagauccgaguuuuucacauauuaugaaguauuaacaaaacacaaaagcauuaaguaaaaguaaugugaaauucagaaaauaaagcagaaaguugcacuucuguguguuaaaauaauguaauucucccuguacauuucuguccacaugagccaauaaacaucaagaauacacacuuuacaguauuuaccuguuuuaagacauucaagucaauucagauggcaaaaguagaauucaaucacuagugaaauguuuuaaaaauauauauuaaaccaaaaaaguguuuuuacaagauaaaaaauaaucuuccacaauguaauuaauugcagaucacugaaauuuuaacucuuuagaugauuucaguucaguuuuuugguuucaaaaucuagagacagucaaacaaaagcacaggcagaaucucuaucuguuuuuacguuucucuuucuugcuuugacuacuuguugcgcuguuuaaagacgaugaugaaggugcucuugcaugaccuguggccuuuagauggucaaaaaguuuauuccgagauggaaauucacuauggcagguuguacagcugauaagaacacucugagaagggcaaaaaaucauaaauaaaaguaagcguuaucacuugaaaguaguguuuuagguuuuaauaucaagauuaagcaucaaacaauuguaaaauaaagauguuuuaacagaguggacagguaauaaacacguucaacaaaggcagauguucuuggagguuaaaucccacuaaucaacacgauuaacuuuaaggguccugagacuuucaauagcauguaccucauggacuaaaaaagaggaagaguuuaugcuucacaauuaaucuccagaacuugacacauguaauucuuaucaccaaggcuuuagauugaaaaguaauagaaaacaacaguaacuguucugguacagucuagcauuuccaaugugcuucuuuuuauuuuaaugaaaaaaaaagauacauuauaucaaacaaaacuguugauggauccacaucuuugcaggcucuuugcggaauggcucaccaaauacacauuuccaucuuuagaucauuauacugcuuaaacagcaagauaugcuaaagagauaugaauaugauuuugaccuaccauuguuugugguucagcagguacucugacagguuuuuucauaucuuugguuuucuuuccuuuggguuuaggaacacuggaaaauaaauaauucagcauaauccaaaaauaacauacuccuuuuaaccaucauuauuugagugcucucuagaacacucaaaaaagugaacugcacuuuaaaaguuaauucauuaauuuuaaaggcaauuuaaauaaucuuuacaucuuaaaugaacaucuuuaaaaagcaacuucagaaaucaaauugaauaucaaauuuggcacaaaaauuaaggaauuuccuuaaaacaguugaaacaaaguuaaaacaagguccuuaaaauaucucugaauguuuuauacagagauaaauguuuuauacaguguuuaauacaguguuuuauacagaauguuuuauacaguguuuucauaaaaacacugccaggcacgguggcucacaccuguaaucccagcacuuugggaggccaaggcggggagaucacuugaggucaggagcucgagaccagcuuggccaacauggugaaaccuccgccucuauuaaaaauauaaaaaauuagcugagcgugguggcaggcaccuguaaucccaguuacuuaggaggaggagcaggggaaucacuugaacccaggagguggagacugcagugagccaagauugcaccacugcauucuagcuggggugacagaguaagacuguuucagggggaaaaaaaaaagcacaaagcacuuaauacuccauuuaaaggagcaaaccaucuucaaaacuaaccaacgguaaucauaaaugaucugacaugaagugugguuccccaaaaacauuaacuuuuuuuuugagauggagucucacucugucacccaggcucgagugcaguggcgcgaucuuggcucacugcaaccucugccucccggguucaagcgauuuuccugcuucagccucccgaauagcugggauuacaggcacgugccaccauacucagcuaauuuuuguauuuuuuaguagagacaggguuuuaccauauuggccaggauggucucgaacuccugaccucgugauccacccgccuuggcuuuccaaagugcugggaauauaagcgugagccacccugccuggccuaacauuaacuucuuggacgugauccaguuuaacaaacacuucaauagucgcacagagaaaugagugaaacaaagacuuuguaaugcauuuuucauaaaauuaaauuugcucaauauaaggaaguuacuuuuauuuaaaaauuauguccuuucuguugaucugaugguuuuuccccaccauaccauuuagaucagaaacgguauaguuggguuccucuuguucugcuugaacuccugaacauuccucuacucaucuccuacaugaauuucaauuuuccuuggcauuucauacuuucccccauuugugcuaaccaaauucauaggguaaaaaucuggguccaacuauacuguacagaacagacaggauggguuauaaugaguaagugaugauaaugcuuccaguuuauagguauacuauucuucaagcagaggccaauagucugugcuaaguuaaacggccuaugcauuuaaaaaaugcagauuaggaguguaacauauuguguaggauucagccagcuuugaaaacaucaagaaaaggacacaauggcauaaaaggcaacaaauaauacauacuaauuuucaaacuaucaucacagauaugucagaaauaugucuaacaaauuuaggauaauauuccuggcaaacaucacuuauauuaugaaagacaguuacaucucugaagcugauaucuaagaccuuuauuuuuuaaaaauacuauacacacacacacacacacacacacacauuuuuuaaaaaaacacuucucaguagguggccaguguccacaccacuccagagaagcaacagaggagcugccagcauaaaggcccuggauccaggggacagcagagugguguggggagggugcuggguauaauguaucuaucuuagcucugccauucugcagcugugaagaagucacuugaauucucugaauccuuuccucacaucagugaaauuagagagcugaacuauaucagugguugcccaagccugagaacccuucuuccuccccagaucaauucucauguagaaguaacauggaggccagacacgguagcucacaccugcaaucccagcacuuugguaggccaaggcgggcagaucaugaggucaggaguucaagaccacccugugcaacauggugaaaccgucucuacuaaaauacagaaaaauagccaggcguggcagugcaugccugcagucccagcaacucgagaggcugaggcaggagaauugcuugaacccaggaggcggagguugcagugagccgagguugcgccacuguacuccagccugggcaacagagcgagacuccaucuccaaaaaaaaaaaaaaaagaaguaacauggaaaacauuuuaguuuuagaugaaaaagggguucaggggcccagagccccaccuccuggcccacucuuugugcccaucccacaggacacacaggcuccauggagucagaugaucugggugccuucaaguugucaggcagauggaaugaagugucagccuuucuacucaauagcuuuuguccuuggacaauuaaccugaaauucaguuuccccauuuguagaaagggaacaaacaccuggugucagagugaaauacaugugaauuucccuuucuaggcuucaacucuccaaaguucuucaaagcuucaacauuaccaguuuguguaguucuuuauauaccuuuuucuauagccagagucauacuguaggucucacccacaucuguuuccuccuuccuacuacuaagugccuuaaacuccgaaguacacacacuccccaccccaucacuguugcuccaguguuagcauuuucacgucaugcucccacuuugcucucucacuuuaauucuuuucaggguucuguaaugacagaaacuugaagcuccucacuaucagaucuuuccucaagaaauaagaaaugauucucuguucuagaggaaccgaggaggauggggaaaagaaagucagacaagaggaggaaggagagaacaggacuggcuaccucccuugggugagaccuccuccuaguccacaccauggccuugugcagcaccaagaguccagggcuccucugagcaggaagggccccagcugcugccauguguccucacaacaugguggggcccaacacaggcugcugucgugagcauggagauuugcuuagugacacuccagggacgcagcaggagucuuguucucaugugagugucaaguguuaaugauccacgacaaaaucagcgccacagcaggauaagguaaacaagaacuggaucaaagugacaucuuucugauuuuggccaugcugcugagaugugugugggcacauuccucuagcauccucuucucaacgcucuucaucuguauacauauguguguguguaucuauacauaaauauguacagauacaucuaaauuaccuggucagucaugggaaagaagauuuuauuugauauaugaaaagcuacauccuuacuaucaauauucaguaauuuacaaauaauaugcaacuuugacuuaccuuuuagcuucacuuuuuggaucaucacaugguuuaaugaucucugugacacugacauuuuccuggggacuaucuuccaauucuuuggcacugucuugauuuaaguuaguaucuucuggaucaaccuuuacuccuucuccagguccauuuacauugaaauugucaucauaauucuagguaauaaaacauaugugccguuacaaaauaaauauaauacuacuacuagcuuuuuauguuauguugccaaauaguuauauaccuucgggaaauaaaaaggagaagcagguaaguuaagaacauggaugcucauuacagugauaguaaauuaagggaaaucugaaaagaauccaaauguucaaaaagugaauggcugaauauaugaagaaaaauucugaagugcuuaaguaucauguuuccaaagauacucaauuaugugaaaaaauacuuacaacauauuagcaaaaguagaagaaagaaaauuauacauaguguaaucacaauuuaauucuuuauuaaguaaucucuacagguaaaauuaaggaugauacuuuuccauauuccaaaugauaagcaaugagcaacuauucuucuacagucacaaacaauggcaacaacaaacaggcauuauaaaagaaagacgccuggcaaacauauccuaagcguaccugucuguuuucaagcaacauuuuggcacauuugugcucgcucucuccaucucuucucucucccaacacacacuuuuuuccccaagccaucugaaagugagcugcaggcagauaugaaucuuugccagguacauccuaagaaucaaaacauucucuggcacaauacucacacucaagaaucuaaugcuaauauuaucuguuacacaacccacauucaaauuuaccaauuacuccuuuuccuguauagggauauacaggauaggggguguaaucaaggaucacauguugcauuuaguugucagguaccuuuaaucuccuuuauucuagagcagcucccccacuuuuuuuuugucuuucaugauguugacaauuugauguuuuguagagugucccauaaucuggcuuuguuugguuguuuccaaaugaucagauucagguuaaacauuucuagcauaauacuauaaucccgggaagcaaaaugaguuugucauuuuucagugauauuauuaaguuugaucauuugguuagggugguauugccagauuuuucaacuguaaaguauguuuucccuuuuuaaauuaauaaguaaucugcagagugugacucugagacugugugaauauccuguccccaugaccauuuaccgaauauacuuggcaucuauuaaugauucuugccugaaacauuuauauacugguggauguagaagagugauuuucucccucuauuacuugugucauuugcacuuguacuaauuaauauuuuucuguaauaauaaagcuuuccuaucuccuuucuccaacuuuuuuuuuuuugagacagucuugcucuguugcccaggcuggagugcaguggcgugaucucagcucacugcaaccucagccucccagguuccaacgauucuccugccucaggcuccugaguagcuggaauuacaggcgcauggcaccacgcccggcuaauuuuuguauuuuuaguagagaugggguuucacuauguuggccaagcugaucuugaacuccugacuuugugauccacccgccuuggccucccaaaguucugggauuacaggcgugagccaccgcaccuggccagcucucacuauuuuaaaagucaauauagauacauaaauuucuuuuuaacaaaugcaauguaugaagaucuauuacccuuauuccuuuugaugacucaaguuuucccuaacuggcaggccccgcaagcuggaucuugaguacuucuaacguauccccaucaguuuuugagcacuuccuuaguuucuaguauaagaugcucuaggcucacguuccacuuuccuagucucagcccugaaaucagguauuucuccaaagagcaagccuguuuccuuuucauggaaaagugaacuuaaaaaccaaaacgugugcauuagguguacucacugcuaggggugucacugcuucuagguccucacaaugcacacugcucacacacuuacuuucuuuaaaucaugggcucauaccaacaucuccacuucaauccaacucuacaguauucuucuucucuuuuccucaauuuauauuuguauuucccucuucccacaaaaagaauaugguucccagcuacaauuuauucauuuaauuccuuuuuuugggggaggggucaaggaucaaauaauuuaauuuuauuaagaugucaauacaaccuacauugugaacaaauucaauauaauuucuauaaaaaucccaauagcacaggauuuuuuuuuacagaacuauugcuuaaaauuuuuaaauuugauuaugaacuauaacuagccaagcacucacgaaaaagaggaggcauuauacuuccugauuucaaaacauauuaaaagcuacaauaacaaaaacaaugugguacugacacaaagacagaaaaacagauaacagaacagaauacggcacagaaaugaacucuucuauauaugauuaaaugaucuuccacaaaguugccaugagcacaugauagagaaaagauaaucucuucaaaaaaaaaaaaaaaaacauggugaaaacugcaugucuacacugauaaagcuggauccucuccuugaaucauauacaaaaaauauuuuaaauaaaauacuuacacauaaaaauaacuaacaaaccucuuagaaaaaauauaggggaaagaaaugacaugggucuuggaaccauuuucuuagacacaacauuaaauaugugauuaacaaagaacagaaaaauuuaacuacgugauacuucaacauuucugcacaucaaugccuccucuaugaaauuggugaaaauauacucauuuacuuucaaaaauaccacaccaauaccaccaaaaaacauacuaaauucaggacuuacuuuuuuggcaguuaauuuuaucuuucaacuauaucccuuggaagguauucagucagaguacuauguuugaguuacuugaauuaaauuuucuuuccugucagucagggucauuucuuucuauuuacauucaguuuuaaucugggaggguuuucuuguacaauuccuuguugguuauggaauuuuucuggccauacagaaaacuuccccaaucucaaguuucaagauacucauuauuugcugccgucugcucuuaaaucuaucaguacauuucuccacacugcccuucccuucaaaaagagcuuagaaaauaucaggaaaaguguuacaucaagcuaggucugaacuugcuacaaucaggaaucauaaacgagagaugcuauaaaggaauauagcuuuugagagaaacgaugggguguucauuugaagcauuuucaucaguaagaaaauacuaacguauguguuuaugguugcaaucaauagaaucuaugcuccauuaaucaagguaauacaggcucagguuaaacauaaaucucucuccauuuauuuuguccuuacuguaaugguacugacauacacaaaggaaagagaaaguguuccaaacuaauaauuauaagguguuuggauggaugaugguagaugucaauuuauaaaaagaacacauauuugcuaugcgguuuuauaacugaagcaaaaaguuccaaauuacaauuuuaagugauuaacucaugugucauauaucauuuuuugaauaggaaacugauuuuaaaaaagacuauuaaauauauuauuauaaccauuuggauaaauaaaccaaaucugaaguuuuauuaaaaagcauuaauguguuuucuuaaaaauauuuaauacuuaauguaaguuaauauaacuagauuauacuaaaaugccauaaauccaaauguccuugguaaaauggacaaauucacuuuauuuuuauagguauaacaacauaauaccauuuuauuuaaaaauaguccuuaagacagagaaugaauuuggacuucagcugugaaauauuuaaauuacuuaaacuucagaaaaauagaaacauuuuuucaagacucacaaucauuacaaguuucuaaccaaauguuccuuuugcaauguuuauguuguuggcagaauaaacugagauaaaaaaaugaccaaucccagauuuuccuauuucaagauuuuaauuguugucuugacuuaaaagccuuuugugagauguauucagauuuuuaaaauacugaaaauucagcuaauucauaccaggggaauucuacaugcauacuuguuaaacacacuggcagucauaauuaaguuuguuauuacauacauacaaggggggggaagcacuaaaaaaggaaaauauuucuaauuccuuuuuaaucaaucuuacaaucaacauaaaauuauggaguauaaguuucucuccuuaacacagacuacacugaauaaauaagagcacugcaacuuuaucguuggcauuuaauguuaacaaaaccuuucuaacauaccugugcugguuucuguuucuuuuucuucuguuuuuuagaaagccuaagagcaaauauaaaucgaaaugucaaauacuugacucugugaagaguaaguggaaaaaaaaaaaaguugaaacacuagugauaaaguaguaaaacagaaguaaaagauuaaaaauauuuaauaucuuaaagcauuaaaaggaaaauaaaguauucacauugucauuuuagagaauaacacaaggcuguaguucaauggauaguaauuagcuuaucaacugccagguauaaaaacugcuuuuaauauagugauaauauguucuauaaauauuauaguugacgucuguauccacuucaacacuauaaaguuccauuaacuagaaaauauggagacaaucuuuucuaguuagaauaacuuccuugggauaaaacagccuuuaaggccgggcgcaguggcucacaccuguaaccccagcacucugggaggcugaggcaggugaauuaccugagaucaggaguucaagaccagccuagccaacauggugaaacucugucucaacuaaaaacacaaaaauuagcugggcgugguggugugugccuguagucccagcuacuugggaggcugagggaggagaaucacuugaacccacaaguuggagguugcagugagcugagacugcgccacugcaccccagccugggcaacagagugauucuccaucucaaaaaaaaccuuuuaaugcaaucucugaaugugauaaguauuucuagugacauuuaauauuuagaaguacuuuuguuuuggugcaucuuccauuucuuccucagaauugucaucuaauggauuuucaucaauuugaggucuugaaaaauuuucuucuuccuccuccagcuguuguuuuagcaaggccaccauuucccgaugcuucuuugacuucucgugauucuucaugcugaaagagcaaucugacgugagcagcugcgcuaaaauuaguucacguguccagauaauguugcuggauaacugcaaccaagauaaaauuagcuuuuuucccacuaagcaaaacguuucugauucuauuuauuuuuuucuuuuuuuuuauuuguucaugauuuuauacagagaaacagaacgugucaggauuccuuggcagugagcauacuggaagcucguggccacacucuuucuuuccguaccacagcuuucccugucuuucucuguccuuuuaucuacauacauuuucuuccuuucuggggaugggggaaugucggcagggggagguuuggacaaauucucuacuuauuauuuugauuuuucaauucuuaaagcuuccgccauuguuuucuuuuaaucacuaaguauuugcuaaguguuuuuacauuccaggccaucccacagacuuggagggaucacugggaaauuagaagacacacauuuuaauguuaaaaggaagagcccccuggacuagagaaaugguggugggaaggcuugaaauacaagagcaguuuacugccucuugcuuuuucaacagcugcuuuucaccuucucaggagaggucuccuuucucacucucaccaccguaacguacauucagacacaucucuaucccuguguucaaaacccugcuggcaaugucugucucagcacaccuacaggcaacuaaaaagcauucaacaaaacaggguugacaacauaagcuacaagaguuauaucaacuaaaaagcaggaaacuuugucaacuaucuacuucaucucaucuguucaggcuuuugguauuauaguuuuaguugcuguuuuucuuuccuacuaaaauucuccuugagaccaagcugcccuggagauaauggaagauccugugucugaaaguaaguccuccaaaaaaguuauaagcacaugucaaaaggacacaagggugguuugaaggaaugcucacuaaccaauucuggaaaaauuugagcaugaaaaggucaguaaugaauuauaaaacacugaaaaaaagaaauaaauucaaacugauaauagauaaauggauaaaagggaaggcuccuguuuacagcagaaggccaagugcuaacugauaaaaacuugaggggguacuggcacuggaaaagcaucauucugcaaccaucauaaaaaagacugacgcaagcuaaaaccaucaacagaugcuaaagcuaugaggaaaacuuuuaugagaagcaagauaucugcauaguuuuaaagugucuccucacagauuaaacauguuacaagggaaaaccuguugcaagggaaaaaauacuaacucuauaguaaaauuaguaguauaguaguaaaauuagaugacaccuugauugggugaugaaaauuaucacgacaaaugagggguagaaggacuuuacgugucuccagcuaugaaucccugagagcacaacaugcuugugcggcgucccuccuggggcugcauaaccugaaucuaaucaugaggaaaugcacaaagacaaaaugagaagaauucuaugaaaaaagugaaaacaguguacuucuaaaauguaaacagcauaaaagacaacacaagcuguuccagauuauguucuuagacugcauucuguauuggagaaaaauucuauauuaauaaauaauugauuggcaaaauuggaaugcagguaguaaauuagauaaaaauaccauaucaauguuaauaauuucuuuuauuuggucacuguagcaugguuacauaagagaauaaccuuacuuuuuuuuuuuauuuugagacggaguuuugcucuuauugcccaggcuggagugcaauggcacgaucuuggcucaccacaaccuccgccuccugaguucaagcgauucuccugccucagccuccugaguagcugggauuacagguaugcgucaccacgcccagcuaauuuuguaguuuuaguagagacgggguuucuccauguuggucaggcuggucucaaacucccaaccucaggugaucuguccaccucaaccucccaaagugcugggauuacaggcgugagccacugcgcccagcgagaauaaccuuauucuuaagauauagugaaguauuuagagguaaaggaacacuauauauguaaguuacuuucaaauuauucagaaaaauacuguguguguguugagcguguagagagaaagaggacaugcaaauugugcaaaacguuaguaacaggucaaucagacacacuauauucucuucuugcaauuuaccuuuaagugugucauuuccaaauaaaaaaaaauuuuuaaucuccuucauuguugaccuuuuucuugcuuguuucuaauuuuucugccucuuuccacuuccccuaguacucugucauuucucccugaggucauaugguaauaccauuuaugacucucacagcgccauucucauccuuuggccuccuuucucucugauugcccauuuugcuuuuuuucccuugcugauucuacucccauuuucucccguguuguuuccucccuccuuuauaauaaugguauccguuuuaauacuucuuucuucaucauuguuccccuaagauaaaguucuuccacuucagcaaagauacucugggccagacaaguuuaaagccccuauauuggcagcaucagccugcaugggacaaugauggugggaagugagucugacaccaaugauggagggagaugauuagacacggucuagacuuuuugcccaugugacuaugucuucuuugccaaaacaagcaaugcuucuggagacagugcauguguuuuaaaagcagcuauaggaauacugggaugagugacaaucaguacaacagguuuaauggcagguacaaauaccucuuucuacccugcuggaaaggaaucccccgagacaguauguggggcuaguuaucaacugcuacaagcacauuguuuuuagaacuuucaaaauguuacacuucaccucaaaaaaaaacacaagggccaggcgcuguggcucacgccuguaaucccaacacuuugggaggccgagguggguggaucgccugaggccaggaguuugagaccagccugaccaacauggugagacccugucucuacuaaaaauacaaaaauuagcugggugcggugaccugcaucuguagucccagcuacucgggagcuugaggcaggagaaucgcuugaauccaggagguggagguugcagugagcugagaucgugccacugcacuccagccggggcaacagagugagacucugucuccaaaaaaaaaaaaaaaaaaaaaaagaaaacacaaguucagagauacuaaacuuacuccuuuuaacuggaugcaguggcucacgcuugcaauccuagcacuuugaaaggcugaggcagguggaacacuugaauccaggaguucaagaccaaccuggacaacauggcaaaaccccaucuccaaagaaaauauuuagguuggugcaaaaguaacugcaguuuuuuagcuggccaugauggcagguuccuguagcccuagcuacuugggaggcugacaugggaggaucaucugaguucaacaggucgaggcuguggugagucaugacugugccacugcacuccugccuuggugacagagugagacccugucucaaaauuaaauuaaauuaaauuaauaaacuuacgccuuuucugucuugaacgauuugucacaugcugggcaguaaaggucaucauagagcucagcguccucggccucaucacugucuuuaccuaugacagggaagccuacaguaagaacccucuuugaucagagcacaaaucuaaaauaugcuaacaaauuagaaauuaaauuuuuuuauuucuuuaccuaaaaaaaaauaauccuaaggauuugaguuggcuuuuuaaaagcagcacuguacuauaaggaaaggcuccaaauaaagcaccuuaacuuucaaguucuuuuccuaagucuacuuagaagaagauauaaaacaucuuuaaagucuuggaugucagcuaaguuuaaaaaauuaaaucccacuuucauaguucuaccacgaagcaguuuuucaaaaaaggucuuuucuuaguuuaccucuugagcaagauuugguccaaacacauuuacaacugugacuuacucuuaaauacuuaauaaacuuaguuuauaaguuuauaacauuccaucacuguaagacggauaggccauaaguuaacauauuacauguaaaguuuaacauuauaaacuuuuuuuuaauaagcuuuuggcuuuauuacaacugaauaauuacuaucaguauaguccacaaaaaccaacugacuaaaaagcucaauugaaauuauuuucacaaauccguauucuauuuuugaagaaacaaacauguaaacugucauuugggauuuauuauaggaccaauaaauaucucaagguaucuuccauauucuacauguugguuauuuauaagugaugucaguaugauuuugaaggacugucucauugaaaucauaaaugaucaaaauauacccuaucuaguguuaauguuuaauauaugguguuaauuuuccauuaugguauuguagacuuucaauauaucauguaugugaaauuuuaauuaaucgaauaguuaacaauacuggauuugaagcaaaaacucuggaucuaaaaauggucauacauucucaggcacaucucauagcuucucagaguccuaguuuccacaacggcaaaacagagacgauuccaugagcaaaaccuccauguaagggggauugugugacgauccagugagagcuuguacgugaaaggacuuuauaaauuguaaaacucgauggaaauuaggccaccucacauuuauagagugauuuauaauuuucaaaguacuuucaaaaguauuacuucugauucauuaauaaaacgcuucacuuccuagucauuuugaauaaauaaaaguuuaucauuuuauuauuugggcuacgaaucugaaaaaucacauuuguagauaagguaaaacugggucaauuuuauagagacaguggggaaaaucagauauacagcuauucucaaaaaugccuaauccuugccuuuuaagguagucaaauaccugugcucuaaugauagcggcaaaaaaaaaacaacauuuuggcacaccaagaggagcccuucuauaaagucacaagggagaggaagaauuuauacacaacacauagauucucaugcaauaucagcuuuucuagaaauaguuacuauuaaaacuugaccuaucacuuaguugaauuuucuuuaauagucacacuuggccgggcgcgguggcucacgccuguaaucccagcacuuugggaggucgaggcggguggaucacgaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccaggaagcggagcuugcagugagccgagauugcgccacugcaguccgcaguccggccugggcgacagagcgagacuccgucucaaaaaaaaaaaaaaauagucacacuuguaaacauguccauuugucauauuaugcagcuagaaguacacacuguuuaggacauggucagaaaagaauuuguuaaucaaauuacuugaauuagacuagcucagccgacuaccuuuggcccauacaacauuauuuuuaauuauuugccacauuuaaaaauugggagaugucaaauaagcaaggagauuuccagcuucacuuaaaaaacaaaaaagauaaauaaaauaaaaauaauauuaccauccuccucaucuuugaguucauguucuuccauuucauuuucauccgauccaucuccaaacuccuucucguaccgugccuccaucuccuggagcucuuucuccaaauuggccauagucauccagcucuguucucuguacugcuccaccagucuagacacauacagcacagucucacagcgacaagcacgccucugcaugguuuucacuuacuacuuagguuuaaaauccauucccacuagagagcuugcucccaaccuauccacgcuuacaaacuuaaaaccugugcuuaguuaaaaccaaggcaaagucacuuaaaccuguuaccuguuguaugguuaauuuuaauugcuccaguaguagauaacagguuuugaaacaugaaacucagcaacuuauuaaaagucuucagaugauuuuaagucauguagguaaaguguuaauuuucaaaagaugagggugggaugaguagaauucuuaagaagugaauaauuuuuaaaaguaugcuauaaugcucuggacacaaugcauuuacaguaacuuuuuaauaacaaaacuuuagaggaacuaaaaugaacugaguaucucaggguacacugaccaaaaggcaguacugcacgguggcuaaagcaggaaagucuggagucagaauucucagguucaauuccugacucuaccauuuacuggcucugugaucucaggccugucagccuuguuuccucagaagaacaaggaggauaaguacuucacagcauugcugugaggaaggcacuuagaacguggccuugcacagaggaagaauucaauuaacgcuaguuauuaauuaaaauuauuaaguuuuacaaaagucuaaaggaucucucaaauguaaagggucucugaaggaaaauauccaauucaaauaaaaauuuuaggccaggcacuguggcucauaccuguaauuccagcacuuugggaggcugaggcgggcagaucgcuugaggccaagaguacgagaccagacuggccaacagggugaaaccucgucacuacuaaaaauacaaaaauuagcugggcaugguggcauauuacaccugcaaucccagcuacuugggaggcugagacaggagaaucacuugaaccuggaggcggagguugcagugagccgagaucgcaccauugcacuccagccugggugacagaaugacacugucccaaaaauaauaauaauuuuuacacaguagaugaaaaaacacuauccaaugccacaauuuaaaaaagaagaaaaagcaggauaaagccaggcugaugacugaacccaacaugaacauguaagguaccucuggugcugccucugacccccaccgauacugagaagagggccccacgcacgcuacgcacuuggccugcuuuagcuucugcugccgccucaucucuucggcuuuccucgccuucucugcauucuguucuuccacaaguuuucgaugcgccugcacucuuuuaucucuuuuacgaaugaaagcuaccagcugacggacaagcucauucuucucuuuccuugcuuugucccgaaucuuuuuguuuucuuuuuccauggcucguuuuucccagcgguuugaagccugucguguaucauauucuuccuuccaugcaaaauucuuuugagugcagaaacucugccaauaagcguagaaaggauggacuaccuagugacaaagaaaacagauuaacuucugcgcuuuaagauuuuuuuuuagaaaagcaguaaauauuacugaugcgaaacaucuuuuaccuuucuuuuuucauguauauaacacuucuaauaaucucuggagaagacaguacuuuuaaggcuuuccagaaaaaaucacucuucaaaauaaacuuaaugagaaaauaaaaauagccuuacuaaucacuagaugggaccauggugauuaguaaauaaucaguaaacaauuaguaaauuaaaagggaaaaguaggcaugguggcucacgccuguaaucccagcacuuuggaaggcugagguggguggaucaccugaggucaggaguuugaaaccagccuggccaacaugaugaaauccugucucuacuaaaaauacaaaaauuagcugagcaugguggugggagccuguaaucccagcuaccugggaggcugaggcaggagaaucgcuugaacccgggaggcugagguugcagugagcugagguggugccaaugcacuccagccugagcaacagaagugaaaugccaucucaaaaaaaauaaacaaauaaaauaaaaaauaaaaagggaaaaguaaagggggaagguugcaagagaucgaaaagcuacuucagaaaggaagagagacaaagagaggucaugggauagguucgagaacuagaaccaauuguuuuaaaacaaggaaaugagaagcugggagcuguggcucaugccuguaaucccaaucuuuugggaggccaaggagggaggccaggaguucaagaucagccugggaaacuuagcaagaccccaucucuacaaaacaauugacaaauuagcuagaugucguggcgcacacuuguguucccagcuacucaggaggcugagguaggaggauugcuuaagcccaggaguuugaggcugcugugagauaugaucauaccacugcacugcagccugggugacagagugagaccaucucaaaaaguaaaauaaaauuuaaaaaugacacagugauaaauacuaauuauagaacaaugcauuuuuauuuuaccguaucauagucacucugggagucuccaaaaguugggaaaucaucaaccucuuccucuaacacagauucuaguucuuccuuggcaaucauuucaaaaacauuacgauacaccguguaaaaucccuaaaaaacaguaacaaaaacaaauucuuaauacuuuugcagccugaucacagaaaaagauuuuaaaauacaaaaugaaaaauuuuaauguugaagaauuuugggacaaaguucagucccugcaauacauuuagauuucaacuagagguuuuuauacacugacagcuuaaacaugaaggcaaugcaucuucaguuuucaaaaugaacacugcuucacuuucuauuacagaauaguuuuaagaauucucuuuguaugugagucuuaaugaaguacuugaugagaaaucaagggugaguucauuuaucuuaccuuuucaucaucuccauaaccagaauaacagguaacggugaaauagcguagcaaaucuaagcugucaucuugauauucgccaucaaacccaccuuuaaguagggccucucuaugauuaucauaccugaaaaacaaaaauuagcaucauugugaaggcugaauaaguaagaauucaaaaggauuucuugcuccuuuugaauauuauuauuguacauuuuugguuguugauauguccaauccauaaccaaaaauuuuuaaugaaauauuaacaugaaaagaguucauaaucuuucacagaacuguuaauuauaacuaggccugcaacuucugauacauuauacaaugcuagcccacaugaacaggggaauuuaaaaagccaaggaauuuccaugacugucucugagucccguacuuccacaggaaagaaacauaaaacaggacauaggaaaucuggcccacagaaucauuacacaucugugauuuggaaauuuaccaagaugcacuggaauaagaaucuuccuaaauuuaugucaacuuaaucuaggagcuucacacacacacaauugcuucucauaauaacucuguaaaggcaguuauuaucuccaucugauauaaaaggaaauggaagcucagugauauuacauaauuugucauccauaauaauaaaaccaguaaccagcaaagucugaauucagaagcaggucuccuacauugggaagaccagcuccuagccacuacacgguacugcuuccagguaaaaagagaguuacuaggcaagagcuuugacuaaaaagacaaaggaaucccaaggaucagaaaacaacccaagaucuugagaagagaguaggcaaaaggaagucaggaaagaauuucaaaguucugggaagaaggcaaaagcaauucuaagaccagaucuccaaauuccuugaguagagaaauguucaggauccucucucugaguuucuuaugaaacacaauuuuguaagaauuuucuuugcagccuuucuuucuugacaaccaccugguuguacacuguuuaacagaaagaugacuugcacaguagcucuuuguaagagcaggaucuugcacaguuaugucaaagcuuaaaaccuauuuccuuguagcaaaaaguuaauugagaaucugaaaacucagaacuucaacauaguaauuuucaucuggaaauuauuuuaaaugaucacaccaucauuaguaauaucugucacagaugcagaagcuuaauucaauuucuucauauaaaguaguuuugaggauuaccauucuuguauuaaaacacuguauugguugagcacaguggcucauacuuguaauccuagcacuuugggaggucaaggcagguggauugcuugaggucaggaguuugagaccagccuggccaacaugcugaaaccccgucucuacuaaaaaaaaaaaaaaaauacaggugugugguggcacacaccuguagucccagcuacucaggaggcugaagcaggagaaucgcuugaaccugggaggcagagguugcagugagcugagauugcgccacugcacuccagccugggugacagagcaaaacugcgucucaaaaaaaaacaaaaaacgaaaaccuucuaccugucugauaucaguaaaucuaucauacaccaaaggguauuuaaugagaagucaccuaaaguaucaaaauuaaaacuauauaauaucaccaaacuuuguuucacccccuaugauaucagauaauuggagcaaucauuuccaagcuuccuucugacccaaacguuagauuuuaugugaugacuaggugacagauguuucagaacacaccaaaaaccauuuaauguacuaaauuugaaaaaacaaccaccuauauugauaacugcucccaacaucauaaacuaggaugggaaggacagcgugaugcucaccaugcucuuuccugagggucacucaacacaucauaugcugcuuggauuaauuuaaauuguucagcugcuucugcggcauuauccagauuuuuaucuguuaaagucacagaaauuuaagucaaucaaaaacguacaggacagaaucuaaauaagacauuuuccaucagaaaugccacaaacagaugagacgugcacaaaacaagaaacaaccagggccaagcagaaagacuccacguaacagucaauaaucaggauuuguuaaaagcaacaaucuaagcagaaauuucaggcuuuucccuaagccuugguacaucacuaaacagucaacugggcugggcgugauggcucacgcccacuguaaucccagcacuuuaggaggccgaagcagguggauuacuugaggucaggaguuugagaccagccugguggucaacauggugaaaccccguuucugcuaaaaauacaaaagauuagcccagugugguggcgcaugccuguagucccaacuacucgggaggcugaagugggagaaucacuugaacccaagaagcagagguuguagugagccuagauugcaccacugugcuccagcaagacuccaucucuaaaaugaauaaaauaaaauaaaauaaaaguaaaacaagucaacuggauauccacaaaaggaaaaaccugaguaguauaaauuuuacuuuuaaaaggaguaaaauaaauaaaaucaguucuagaaagacuuauuuuguacuagauuauguuuagugcugacauuguuuuuuucuuucucaucaauguauaucaaaagaaaucucauaaaguuuaaaaaauauacacuaauuaguuauuauuuccuuagcugugcuuccugaaccauggaauucagaaagcguccuugccucagggugguacccagcuugcaagacagcaccccgccuccuggcauucacaccuugugcagucccuucugugucagcaaggguagucugugugaccaacaggagauggcagaaguaaugguaccucacuuccgagaugagguuauaaaagacugcaguuucuaccuugggcuuucccucucucuugaucacucugggaguggccagcugccauagcaugagcaacucaggcugccuauggagaagcuggagaagcucauggggugaaggaggccaauagccggcagagcacugaggccugccacaaccacaugaguuggugguuggugagcuggugaguuggugagcuggaagcagguucuuucagacaaugagaaagccaaaaccaccuagcaaagccgcucccagauucucauccuuagaaacugugggaguccauauagucaacauaggcuugcuguuuuuguuguuuguugucuuaagcccugagguauugguaauuuguuacacagcaauagacaacuaauauauucagaacguaaagcauuuugaauugacuauggagaacacuaaaguucguuuuuuuuuuuuuuuuugagauggagucucgcucugucaccaggcuggagugcaguggcgcgaucuuggcucacugcaaccucugccuccuggguucaagcgauucuccugccucagccucccaaguggcugggaccacaggcgugcgccaccacgcccagcuaauuuuuguguuuuuaguagagacaggguuucaccauguuggccaggauggucuccaucuccugaccucaggugauccgcccaccucagccccucaaagugcugggauuacaggugugagucaccgcaccuggccggagcacacuaaaguucuuuaagcuacagcucaauacuucccuucuaagaaguuacaagaaaacaugacagcaaugucuuaucuacaaauaguuuugccgcccuagaacauggcucuucagggcuuccugcugcccauucucagauaccaucacacugaugccauaaauuaugaugauauuuagagaagauauuugcauucaguuccuaacagguuugguuucaaaggaguuaacugauacuuuagucauauuugcaugcuucuuccuagcacugauuucuaauuaaucaccaaaucuggucauuuuuccuucccaacaucuccuccccuugcgcuuucccccucccgcugaccccaagccuggcuugggcccuuaccugucuguccacugcggacucucccuaacuucugucuccagcccucuucaauccacuaaguugccuucauaguacucucccauggcagcuuaauaaaaccagccacaacucucccuuauuuagcgaagcaaauuucacaguccuugggcuaauauucaagauuacaagaaauacaaucugauuucaaacuacucuuguacucaagaaauacaaucugauuuaaaaucacucuucagaaaauuacauacgcuuuuggucacagcauucgcuacuucauuuacccuuucccaccuagaaagucaaggaauuccgaacuuccuucuaauuccuaacuugauuucuaacaguaacaacccaaacuccuaagaauaugcuucuacacuaacccaaacucuaagaauauacuucuacacuauuuuuacauuuauuaauuuuggcuguaucuucugacuuacugcuaugaugaacaucaguucauuuacuucugcucuucuaauauauuuauaaucacauuuuuucacgccucuguugguaagcauaacuuuaaguaacagacccacaccucuaucucucacuccaucaccauagccauucccuuuugacuuugggucccugaccuuuccuuccacuccucucauaaucccuauuuuucagaccugcaauacacaccaccuucagucaaacugucccccggaacaucuuuuguccuccaccaugcuauccuccauacuguugaguucacuuuuccaaauugcauuccucuacgauccaguccaaacuccucugagaaggggaagacucaauacaaaaugguaacucccucccugaauuccuggagcauauauuaguuguuccauuaaucuaaccaccaauuauguauguugcgauuuuuuucuggcaguuguauuuaacuuuucauuuguguaaggcagaaaguuguuuuccuaacaagacucuaagaccccugucucagcauuuccaaaucuacuuaguagagugcagugacuugcauauauuggauacucuguaaccguguuuacugaugaaugcuaauaugaaagccucuucauaugaaccucaaaaagcugaaagucaacuacucucuuaguuucccagccuggaagaucagauuacuucauaaaagucacacaggccuggauuacagaccaaugaaacauccaaaggaaggauacuucuaaguaaacauacaaacuuuacuggggaagccgccugauuaaaaccuuccccggcagaaucauguccaaagugaaguacaaggucugcuuaaacagcuuauuaaaagaaaaaaaaaacagcgaaaaaagcgcaucccuauugaaaagauauuuuacuagcucccgugucuuaacuucuuaacuaagaaacgaaaagagccauacaucagguugaaguaucugggauucccggacgagguggagggcagcggaggaaaaacaccgagaggcugcgcugcaagggacgcagggaaaagcaagccuggggcaggucugaguuccgaguucccgacugcucccucguggugucugcgacccgguagcgggagcaagugagguuguuggacugcaguuuucccccuacaguggcgaugcggggccggggucgcggguaugaggagauggggugugagccggggugcgccagggcagagcgcuucgcccaccgagacgggcagggcggcuccgggcacuggccgggcggggcaaggagcuccuaggccgccaggucccucucugcuggcuccgcggaguccgcccgggggaagggaaggucggggagggccgggcuucuccgaguggccgcgggggcugcgggacagguacuuacccgggugccauuucagggccagcuuccgauaggccuucuugagcuccuccucgcuggcgucgcgccgcacccccagcgccucauagugacacuucaucgcccgaccgggcgggcggccggcgcuggggcccgggacggggucggggcccgggcccgggccgaagcggcggcggcggcggcgcuggcaguccucuccggcgggaguccgccgcccgcaccgggccagccagcgagcccggcggcggcggcggcggcggcggugguguaggucagugaaggcgcgcgguggcggcagacgacgcaggcugcggcaagcgggagcgc

SEQ ID NO: 192533 - RNA, 21130 nt, Homo sapiens
ggggcguggcgccggggauugggagggcuucuugcaggcugcugggcuggggcuaagggcugcucaguuuccuucagcggggcacugggaagcgccauggcacugcagggcaucucggucguggagcuguccggccuggccccgggcccguucugugcuaugguccuggcugacuucggggcgcgugugguacgcguggaccggcccggcucccgcuacgacgugagccgcuugggccggggcaagcgcucgcuagugcuggaccugaagcagccgcggggagccgccgugcugcggcgucugugcaagcggucggaugugcugcuggagcccuuccgccgcggugagcccgggccccgcgggcugcucucgggaaguucccgcggaggggaggggccuggccguucgaucgaggcugcacccgccacaccuuugcccuguugccgcaagaacccuugucggccccagccuuccagauuuuugccuccuaggguauuguuagugaucauucuucccaaacuggauuguccaaaacuuggguucugagauacugcuguugcccgguuucuccuuuugccucucugacuccuucccaaauuccuccuuuuuuuucuaagaaacguuccguauuugccuuucuuaauuaauugagggucuugaacccugugagaaucuaaugaaagccauaggauucccuuccuggaaaacugcauauaggcggucauucggcuaccguuuuggagugcuguacccucaagccauccacgggcccaggcuaacgcuccucccugccugaaaugcuggcguucuaagucucagcaucugcucccugaagcccaguuacccauucccaucauuuucaccuuuuuguagacuucccccuuucagagcggcagacgcuggcauacacagguccugggcaucgccgucaaggcugcccgccaggcagcuuccacaaaucccaaaaugagccuuuccuucuuccuucuaaaacagcaucuccaccuucuguauuauuuauuucagugaaugccugaaucucaaacuuguacuucaucauggacuccagucuuccuuucacauccaauuucaaugaucaucaauacagucauuuugcuccuuagcccacucggacuauuucucuccauaccugcugcaacugccuugacacuggugugacagccuuuuaaaaacugguguuuggggcugguaucacuccaguggauucucagacagcugccagaauaacuuuguucaaguagaaauccaaagcauugccuggucuauagugggaaaucgguaaauggugaaugaaugaaugccuacggcacagccggcuuauuuaaaugcguuaacucauuuaacccucacagcuguauuugaggcuuguaacaauaaugauuuaauaauuaagauuauguaauaauuuaagaaugcuccauuuaagaugagggaggcuuguccaaggucuuguaauuaggaggaaggucggcugggaauacggauauagccuccgggugaggaguugugacugguguuuagguagaugacuagagguuuucugugauuuauuuuagccuuaggaagguaaagauagugaguuuauuauguaauuuugauuacuuuuaaucccaggaaauuucaggugcugguuaccugggguuugugcuauaaauacuauacuuguugauagcuuaaaaacucucaggugcuauugucacuaaccacucuuucuacagaugggugcuaaacuuuuucgugaagguacugaugcuaggcacuuuagcgccuguggaaacaucagguguaaauucugcaggaggagcucaugagcugauagggaagauaaguguaugcauguacaagcaagugcagcuaaggugggaugugguaaacacugaugcgguauagaaaaagagaaaagggauuuacuaaagggaugagacccugcucuggggauugaauaaauaggcuuggauaaaccuagagggaaacagagauguacugggagaaauuacauccugggaagaagccacacauuccagaaaugguggcuucacucuuugaguccuuaacugcuguaaacaugccauuagccuacagcaaauguuauuaauauuacuugcaauggugcuauuuuauguuugucucagagaagggauuaucuccauccucaauucauacucucuuaagaagaucguuacuuuucucuuaaggugucauggagaaacuccagcugggcccagagauucugcagcgggaaaauccaaggcuuauuuaugccaggcugaguggauuuggccagucaggaagcuucugccgguuagcuggccacgauaucaacuauuuggcuuugucagguauguugaaaaaaaauuuagucuacacuuuuaauuuauuccaucaagaucuacagguauguugauuaacaauaauuuguaaagguaaaaauuuaaacauuuaucagaaucaaucaagagagcauggguguucaaaauggaucgguuugagucuugaaacaaucauucucaaccuucccucaccccaucccuuaacagguuggaagguuaauacaugcccacuacuaucauuuauuuacuacauuuguugagucaauucucagacaaaccccugcuaggaauuaagaggcuuacuggguacuacggaugguugcucugugguuugaaaauguugacauaguuagauucugacagcuacuucucccccggaccccgaaaucuccacccaccauauugagaaucauugccugagucauuguuucagacuucuaugagcacuaaaaaaagcccaugguuuucagguccuaauaucacuuuauuagaguuuuugccugugacgacaugugagauaggccugauuccagaauucuaagaaccauguguuguugacuauaggacauuucagauuuucugugaguacacauuuaaaaguugaggaaagaaguggguauagaauugucucuucacaucuacuuaaaaauuaaauuccuuuuuuuucuugucugcaaguauuuucuuacauuucuuuaugcuaagaaugaaagugcauuuacuguuuuaaaaccacaaaauaaauaaucauuuucuuuuccaaaaguaagugaguaaaaacuuagcaauauuugaaaauguugguuggaauagguuuuagagaggaaaacaacaaaacaaggauccugucuugagggaaagccuguuuaugaguuuacugacuaagcucagauuuggaaaagugauguauacuagcuuucacuuagauuaucugcuggagagauugauuauuccucuaagaugcucacauauuuauuuuaagaagagauuaaauuuaaaagagacauuaaauuuguuuuuaaugauguagguguucucucaaaaauuggcagaaguggugagaauccguaugccccgcugaaucuccuggcugacuuugcuggugguggccuuaugugugcacugggcauuauaauggcucuuuuugaccgcacacgcacuggcaagggucaggucauugaugcaaauaugguaaguauuaauugggguagaugccugccacuugucccuaaguuuaagauauagcugcuuaaaauccuuuuuuugaagaagaagacaagagauaaaugacauuugaaguuucaagccagguuaccaaggauauccuuuucuuuuuaaaauagacuuaugucuuuuauauaucuguuagaaugucauauuuugaucaucuguccuuggagucaguucucugaacuuucugugacucaugugauuccuacguuguuuuagguuggugcaaaaguaauugcagguuuugccaaauauuugccaaccuaaauauuucaacaauuuuccccaaguaucucuugugcuuaguauaucauuuucaagcagucgucauucaaaaaaaguucaagaagucucccucagcugguagagaaaauucuuaggaaugcuaaggucaaauggaccucccugucuaaaccuuccugcugcguuuuauaggggaugcucugauaucauaacacuucuguuuguucacugucauccacugagugcuugccucauguucugcugagcacauucccugugugauuucuucuuauucucaaaacugcauuuggaauaccuuguuguuuuaaagaggagggaacggaagcauugccauuugcucaagaucucacagcuaguggguaagagagcccacuccagcaccaccacugcguguuugcauuuucacagacauuuggaggugggauggagaauggaucugaggagacaagacuggagguacagagaccaaugacuggguuauugcugaagagaucagggcaaguacuaaagcaguuaaugguagaguugguuugcauugaagggacauuugagguauaaaauugcugggaauugauaauggacugacagggagcgaagagggagaaguugaggcuggcucccagguuucuggcuuagaugaccugcuagugucuugagggaagacugcugaacacaguggucagagcauagaguggcagcugacuaccuccgucccagcucugccauuuacuagcucugugaucuugggcaaguuacuuaaccucucugugcuguaguuuccuuuguaaaauggagauaauaaugacauccaccucauagcauuguuaguugcuaugagaauucaaugaguucauccauuguucagugugggaacagugccuggcguacagugggcccucuguaaaaguuugucauugugguuauuuuuacuagaagaaaaggaacucaguuuuggucuuuucaguuuuaaagugccuuucagauauccaggugggauacuugagguuagggacuagaaacagauuucggaguuauuugggagccauaugagacuaugugauccacuaggaaaggggauagaacaccggcauuuaaggaaugcgugggcagaaaagagaagcaagggcugaggacagcuaaggagagaagcagaauggaguguugucauggaaaccaaagaaaggaguggucagagggucaaauguugguggauaccucaagaguuuagagacugagagugucaacuggauuggguccuggcugaucuucacaaaauccauuuucuaccagaaacccccucaucuccaaagcuucagccugcgcuuccuucuccuguucauggugaaucaugaccagcccuguacugagugugugccugugggacacugucaucagggcacaucucacacuuuccagugugcccucucugaaguguguaccagcagcaggggagugugguuuaucuuuugugggccagcucuuggcguacucauggcauagucgcugcaugagauagcagcaccggauuuauaccaguacccgccaaacucaagaccgguaccuuccacagggcuucugugauccacacaguucccugagggagacgugcuacuaucauuggcauugaagacuugaaggcuuggcgagguuaacugccuuccucuaaagcagaugacgggaaaggguccgaagcacugccccaggcaguuggacccuaaagccacugcuuucaacaacuuccccugcugccccaagagcauggucccugggguccaaaaggaaugaacuaagagcaaacauggagucuugggaguguuaaggagaauuugagccuagauacuucucuaguaauaauuugaauaauuuacugaagagaugcaauugauuaucaucaaauauaaauaaaaggugauugcugcuuucagcagaauguagcuaaucagaauuauauaaugauuagaagauaguaagguuggcugggcaugguggcucacgccuguaaucccagcacuuugggaggcugagguggguggaucaccugaggucaggaguucgagaccagccuggccaacauggugaaaccccaucucuacuaaaauacaaaaaaguagcugggcuuggugguacgcgucugcagucccagcucccugggaggcugaggcaugagaauugcuugaacccaggaggcagagguugcagugagccgagaccacacuacuacacuucagccugggugacagagugagaccguguuucaaaauaaauaaauuaaauaaagaagauaguaagguuuuaggguaugugaaaauguuguaaucuuucuucuggguucauauuuccauuaggggcuaguaaguguuugcuaauuacacaaggcuaaaagaaucaguaaaucauagucauuacuucaucacuaggaccccuugugacacaggcaauugcagaagcugauuaggggaaggcagauaccuucuaaugggccgaaaguuuucacaguguuuagcagcagaauuccagaccugggccugccugugaagagcuggaggcugccuuauuguagugcuguuuccuuggaaacuguaguuaagauaacucuggaauauggagugcguuuugcuguauuuacacucaaucugagcccacaugaugagcacagcguuguuaaauuaacuguagcauaaagcugcccccuuacguauuuuaaguuccaccuaaagguuucucuuacauaaugagcugugaccuaacuggauguguaaacagacuguaaccugcuuuuguaacaagcagcaagucucagccaaucacagcagccguacuucaacuaaucacaggcggccagcuguucaaaccauguucaaacaaggcaaaggcccacuuguaaccaauccggcuguuucuguaccucacuucuguuuucuguacaucauuuuccguccauaaguccucuuuggccccagggcuacacuagucgcucugaaccuagucugguuccacagacugcccaauucaugagucauucguugcucaguuaaacucuuaaauuaauucgucuaaaguuuuucuuuuaacaguaucaaagguugguggcaaauugaggcugcgguuucccugugucagggggcucuucacucgcaugcaugguauaugagugauggggcaagagaagccgugugccaggguagccacugccaggccuuaugaugagacgaggaggguuccugcuguauuucuuguccuguaccuccucugaugcuaaggauuagaccagagcuuguuuuuguccugaguggacccaacuggaucuguaacucuguuaacacgucuauuuuucagcagucucaucagggcguucaacauauaaaagagauuaaagggguauuuuauuagcauaaaacauuuuauguuuacauauucaauauuuauauauuauuuugucagaccaacgaagcuguucugcuaaacacaaacacuggaaguuagaguuuaugggugauugucucaucgcuuucaguauucaguuuauuacuguauuucauuuugacuggauguuaggaaaauccugaguuacagagauaaguuaaaaauauccauaguuuuuacgcaaaaauuagcugggugugguaggcaccuguaaucccgcuacucgggaaucugaggcaggagaaucgcuugaaccuuggagguggagguuacggugagcugagauugugccacugcacuccaaccugggcaacagagugacacuccauuucaaaaaaaaaaagacccuauauuuuuaaaaacuugcuuaaaauuucagauugcauuucauuuaugaugaagcagaacaaaaauacuuuguuucuaggucgacucacuacaguguguaaaaacuucucacauucuuuggccugaacaugaaagccagauaaacaguauucagaacucucugcuaaaacucucucuugcacuguaugacaagcuugcuuccaguucaucuauuaccgcccuauugauucggcguuaggcucugagagaaguaaagcuugagcggaaagcaggcacuugcuuauugaaggugcuaacuuguugguuuuguaugagucagcacaaauuaagaggagaggagaaccaugcagaacaaagguuuuccucaauaguguuucaaauacaagguaauauuuaugcaaaauuggaaggaaaagcuuuauuuuaaagucuagcaacaaauguuaaugaguugaggcucugaugagucagaauuugguauaggauacauuuaaauaugugcuuaaauaacauaaacauaaaauauauuuaaaauagugcgcauauacaugcauauguguauauauguguguguguguauguguauaaauguggaacucuaauaucucuguaauccagccucaaaaaaaggcacugccguaggccacuugcaugaacucagcuauuuggugacaauaaaugucacagccauaaauucagaugugcgugaaauuucaaguuaagagggaaaauuggauauauccaaagauacauuuugugguuguuccacagucaguaacugagaaauugcuagcaguuggaaugaggccugcucuauugguagcuuuugagacgaggaugcuuugaaggccuuccuccuggggugcuggagacauuaggcucauaaaaggcauaaaggucagaacaucaucuucuucaaauaguccagugccuucagccuuugaguuugagccuugugauaauuguacuuuauuguguaauuacuucaggacucagugggaagguggcgugaugagaugacuuuaggacucagugggaagguggcauucccaaaccaguuugccuggacucagaaaaugcacauaccugccauccauauuguuaguuuauuuuauaacuuucuagugauuaugaaauacauuaaauacucaaauacaguuuucuugggauuggaaucaagccagaauaagccaaauuuuacucuuaugugauuuaccuuuaaaaugugguaugguuuauacaucuguguguguuuauagguauggagaucagaagauggauuuuuaaaagcucuuuuaauuuuuaacuuuuuaucuuggcaguuuuuaacauuauaaaaaguagagagaauaguauagugaccuuccauguacccucaccuagcuaaaucacuagcauuuugccaaucuuauuugaaauggaaagcaaaggucauuucuucuaagucuuauaguauuuuuggaacugaauagugcagccaauuguuauuuuaacacaaacugcucuaacucacuuucuggaaauaccagagaaguuguguaauuagguagaaucuucguauacucuaagauaagaauuuuuacgcaaauuuuuuuuaacuugaaugggaggaauuauucaugcuuugacacuugaguuaucuggauuugucuuguauucuguuuucucaaagguggaaggaacagcauauuuaaguucuuuucuguggaaaacucagaaauugagucugugggaagcaccucgaggacagaacauguuggaugguggagcaccuuucuauacgacuuacaggacagcagauggggaauucauggcuguuggagcaauagaaccccaguucuacgagcugcugaucaaagguaagugaacuucacgcgucucccccaguuccccuuuugcuguggauguucuuugguucuauuuuaaagacuuuuggcaucuaggaugucuuuuauuauauagccacuuucuaauuaaccuaauuauagccaucaauauaauguggggcauuuuccauggcuuuuaaauugaccagcagucuuacuagucuauaaaauagcugaggguuuuaaaaauaauaaucccuuuuguaggauguucggugcuuuuauuacaguucacuccuuguguuggauaaucuugacccugugugcccagaucuuacucuucccuagaaaugaucucacauggguugcuuuccauucaauauucuaccagcuccuauuucuugguagaugucccuuauggcacuucaaugucagaagucaccagagcauggaaagauuuugccaaaugagauucuguuagaauauguuacuauaucacuaugccuuugcagaugaccugucuugcagauucuugccugcuuggcaaguugucauaaauuagcaagaaaauuugggaucucuucuucccuaauuaaauaauuggaugggagucguuuuguuccugagaaauguuugaauuuagaguucacucuauaaauaauguagaaucuaagaaguuuuagaauauacucugaagugaugugaaagcugaucacagugcauuuaccuuucuacuacaaguuuagaguuucauuguuacguuugguagcuuuucagaugcauauacuaaaaguuauuugcauauagcuggaaugacuuuuuuuaaauuuuccaaauuuuugauguguucuuaucugauggaguaauuguuuuugcaagcaucugagagcauuuuaugauuaaacauauuaacuucaccuauucaaauauaguuggaaaaacuauagaagaacacaaugguuuaucuagaucauaaaggguaccucucuguccagaaauuaaaaagcuugccuuuugucacugcuccaaauaaauuggaagcucuggcugcucaugaugcucugguggagcucuguggagccaugaacacugccaccugcagucugaugaagauagcaaaugauauucauuuucugaguucugguccuuggccaggucugggagaacugaucuugcugaaaauacaacaggaagcaguaucgugccaggcaaggcaaacccucgucagugugaagcaauggccaucguugcagcccaagucaugggguuuuguguggcaguaaccguuggaggcggcaauggccauuuugaguuggauguuuucaagccaaugaugauuaaaaauuuauguuacacucaggcugcugggggaugcuucaguuuccuucacagaaaacuaaauagugggaauccggaccaauaaagaaaggaucaagaagcuaaugaauuagucgcuaaugcuggugacagcucucaacccucauauaggguaugacaaaacagcagaauugcuaagacaacaccccaaaauggaucaaccuuaaaggaaacugccguugaacuuggcucucucacagcagagcaguuugaugaauggguaaaaccuaaggacaugcuggguccaaagugacuuaaauaaguuuuaaugaaaauaaacguguaaaauuaaaaaaaaauacuggacauuuuaaauaauuuaaugugacaacucccaggacuccucaggaucccucaguccugggcuuguuauuguugcuguuuguuuaaugauuuucuuaaauuaaaucuguauucuuuggcaugugcagccaccgaagucagcugaguuagcuucagcuaaugauuggacagaaauguccuuaaauaccuuuuuuuuuuguuugcuuguuuguuuuaaucuaggggacagggucucacucuguugccaaggcuggagugcaguggugugaucauagccuugaacucugcagccuugaacucugggguaccagugauucuccugcuucagucucccaaguagcugggacuauaggcaaaauuuuuuauuuuuggucgaaauagaaucuugcuauuuugcugaggcugaucuugaacuccugacuucaagcuauccuccugccucagcuucccaaaguacugggauuucaggcaugagccacugcgccuggcccuuaaaugccuugaaccaauaaaucucccaucuuuuucugaggcacuauaugccuuaacuucuugcuugugaagagccucaaggucagccagaggugagagacgagggccuuuacagaucucucccaggcauucauacugcccugcguguguacgugugcguugccuucucaggaguugcaaaaaaaauucucaggaauauguuggagcuuuucaaaguccccuauggauaucccauuccccaguuuauucuuuugaguuuuuuggucagcaucuuaugagcugcaauaaauaacaccaccuaagacagcugcgauaaaauauugccuuuuuuuuuuauuaaaucaacaauuuagggcuagagcaaagugagcucugagucagaaagacaagcccugagaauggagccuuucagggagcugccagacaggcuaaauaaugacaguucucuggggaugggauuuugggggaagcugcaaacuucuuuuccuccucucggggcuauucuccugcugguuuucagaacugaccagaguugagaggaaguuguuuuucaaggcuaccacagggagaggguugaaauuagcacaaguucuaacaccacaaagcucacugcucuuacugagauucagcuguuuuucuugaauaaaugcuccuuggcuugcugcaagcuuuuaauuuccagaauuaugaaaaaguuaauucugacaguuguuguuaguguucucauugcuuuaaugccgguuuuugaaggcugucauucugccacucuggaguuaacucccuuccuugguguauccuguuauuuuaaaacauauacaguaguccucucuuaucugugggggaugcauugcaagacccccagugggugccugaaacugcagauaguacugaaccugauugcggucaauuggaagauguuucuguuuaugucuuccacccacaaaguuaaugcguuuuccaucuuaauuaagcacuuaugcacuauggcuguaacuuuucagucugaguugugacagcaaaacuagcaugaauuucuuuuuccuucuccccuucuucacaaucucaugaauauaagauucauucuuaacagucgauuuuagcaaccuuggcuuaugaguuuuauucuucccuuaagcugagagcuuucaccuuuucacuuaagggaagcacguuaggcuucucuuuggcauauccacauugccagcaucaccuuugcuuacaaccuuuggggcccuuaggaaguaaaauaaggguuacuugaacacaagcacugcaauacugcagcagucaaccugacaaccuaguuggcugcuaagugacuaaugggcugauagccccacaguguggaugggauggacaugguucauguccaaggcaggauggagcaggaugaugugagguuucaucaugcaucaugcuacucagaacagcaugcaauuuaaauuuaugaauuguuuauuucuggaauuuuucauucaguauuuucagaccaugguugacuguggguaacugaaaccacagaaagccaaaccucggaugaagaagcacugcuguauguguggagugcucauuuuucauauccacacuucaccucaaugaaugagccuuccuggaaacacugaaaaugaaacaagacaacauuuuucuagcagggucauugcuccaaccccuuaacuccugaucaccuucuccuggguauucuucugcugaguuuaaacuuuguaacuccccugauuuuuuuacagcccccucuuuuugcauccauagccuuuuaugauauccuuaacccucaucucccuucauaguuuaccuaggauccuuagcugacagaugacuugugcuauaggagauagcauguuaaaccaccuuucaccuaaucuaccuaguccaugccaaaaugccucagcauucucuuucuuuuauaauauuuauuuacaaaaauaguacuuuuacuaaucacauauacauuucuucucucucaaguccuacuggacaaacccccacaucuguaguaauuuuuugagggccaggugcgauggcuaugccuguaaucccagcacuuugggaggccgaggcagguggaucacuugaggucaagaguucaagaccagccugggcaacauggugaaaccccgucucuacuaaagauacaaaaauuagucagguaugguggcgcgugucuguaaucccagcugcucgggaggcugaggcacgagaaucacuugaaccgggaggcagagguggcagugcacugagaucgcaucacugcccuccagccugggugacagagcgagacucugucucaaaacaacaacaauaauaguaauaauuuuugagguaguacuaauuacauaucuaauuuacuccccuuuguguuuuagaucuuugauaccauacuuuaaucuguaucuucaguuucugaacauaaguaugcaaaaucuuuuuaaggugcauacucugcugcgucccugcuauuuucuaggacaaaaauaaucugaaaacacugagaauuuuaugacauuuugagauagcaagucucuuauaguacaaucagguaagcaauagauaauuuucaaaagcuguuuuaucaguagauaauuuucaaaagcugggugaucucugucacccaggcuggagugcaguggcaugaucucggcucacuguaaccucugccucuuggauucaagugauucuccugccucagccuccugaguagcugggauuacaggugcccaccaccacgcccggcuaauuuuuguauuuuuaguagagacggaguuucaccauguugaccaggcuggucucgaacuccugaccucaagugaucugcccccacuuagccucccauagugcugggauuagaggagugagccaccacuccuggccuucaaacuauuauuucuaaaaaauacaaaauaacaaguguuggcaaggguguaaggaaacgaaacacuuguguauuaccaaugagaguguaaagugguguagccacugucaaaaacagcgugcauuuccucagaaaauuagacauagaauuguaugaucuagcaauuccacuucuaaguauauaaccaaaagaauuggaggcagugacucaaacauauauuuguauaucuguguucauagugacauuauucacaauagccaagagguagaagcaacucaaguguccaucaacagaugaauggaugaacaaaaugugguacagacauaaaauggaaugugauucagccugaaaaaaacaagaaaauuccaacacguuacaacagagaugaaucuugaagacauuaugcugagugaaauaagucagucaccaaagggcuaauacuguaugauucuacuacaugaaaugucuaaaguggucaaguucauagagacagaaaguagaauggugcuugccagaggcuguggggagguaggagcgggaguuaguguuuacuggguucagaguuucuguuugaaaaguugaaaaaguucaggaguugugugguacagauggaugguggugauagauguaaagcaguaugaguguacuuaaugcccuaguacuguacaccaaaaaauggcugaaaugguaaacuuuauguauauuuuaccacaauuuucaaaaaugaaauaacaauuuaaaauuauauguuugcuaggaaaaaaaaaagcaauacggauuuuaaaaaguaagaagggaaaauuuuccuuuguucuuacgguuugggaaaauaugggauguggccuucaagaauuuuuauuguacacauacaaaugcacaauuauucuauucuauuuuauuuuuuugagacaaggacuuacacuguugccuaggcuugagugcaguggcacaaacauggcuuccugcagucuugaccuccugggcuuaagcaauccuccugcuucagccucucguguagcugggaccacaggccugugccaccaggccuggcuaacuuuuugauuuuuuuguagagacagggacuuuacuaaguugcccagguuggucuugaacuccugggcucuagugauccuccugccucagccuuccaaagugcugggauuacaggcgugagccacuacacccagcaauuauuuucuguuuuacaauuuauaauuuauauauauaauuauauaaauuuauaauuuauagcuuuuuauacaacaauauagcaaagacauucuuucuugucuguacaaaagaucuucacccucacccauuugauauagcagccauaucauauuuuugaucugccuguacuaaaauuuauauaaccaauucccuaugcaaguucauuuacauuuuuuccaauuuuguauuauaaaaauaauuuuuauggccgggugugguggcucacaccuguaaucccagcacuuugggaggccgaggcgggcggaucacgagggcaggaguucgagaccagcccggccaacauagugaaaccccaucucuacuaaaaaauacaaaaaauuugccgggcaugguggcaggcaccugcaaucgcagcuacucgggaggcugaggcaggagaaucucuugaaccugggagguggagguugcagugagccgagaucgugccauugcacuccagcccaggcaauagugugagacucugucuuaaauaaauaaguaaacaaauaaauaaaaauagggaggcugagguggaagaauggcgugaaccugggaggcagagcuuggagugagccgagaucacaccaccgcacuccagccugggugacagagggagacuccgucucaaaaauaauaauaauaauaauaauaauaauaaaauaguguuuacaauugccauccuggacauauaucauugaauacuuacaacuugaauuuugacugcuuacuauauacuuaauauuauaaagcaguaaaguuuauggcauguacuuaaaagaauaagcauuuuguguaacguguguguguguguguaugguaguuauuuuuuggaaucaaaacaugcuuucccaaguuuuaaauggugucugaguccccaggcuaguuccugaaaaucuguuugacuuaaaaugccagaaauuucauagugauuguaccauaacagcuagccacaaucuauaacuguauuuauacaauuauggauucugagacuugggacuggauuccaaguuccauauuggagugucaggagcacagcaaacagcucaccuuaaaccauugguguuuaauccuguggccuuggucagggucaugggcaggaugggagauugugggcugugaagggaugguagacaaugggagaauugggguguuagaguuaggguaggaucugggggcuuuugauuucuaguauuuuucuagcauacaaacuaugaccuguguaaucucagcuauaaaguuaaagagagaacacauuggcucuagcuuuacuuaguguuaugauucugaucacauucugauaaaaagaaacuguuuuaaaagcaugugaagaucacuacuuuuugcucaaugcucauuuuaugugccuuucacucacagaguucagggcaaucaagaaagaacaucaagugaaagacauccuguagauuauagugauaaccugaaacuauggccucauauccguccugguauuugaaugggacuggugguuacagaagaaaauguacuuauaucccacaggaggcuguuuacaaaaaucuggaacuguguuaguucuuccuauuuccucauaguccucaaaaccuuaagaagaggcuucaguauuuaugucuucuuaccucuauagggacuuuaccaucuucagagcaauuuacaauuagccuugauugucaacaugcuacagaaggaagguauucuauaagugaggauuauucaauuaacuuggcuaaacuuacacacagugugaugcauaaagaaagggccuuucauuaucauucgacacuuagccaugcacuuuuaaaagcccgcuuauauggggaagaaaaaggacaauuuacaccaacuauuguaaagcagcccugcucuuuggguauaauuuaaucagaacuggaguuugggcaugucugcagggguagaaccacauagucaguaaaggaaacgcagauggggucaagagcuagagaggccaccuuuccuguuaaguccccagguagcugcugucauguccucugcacuguggucuugaugggcccuucaagucccuuucaugccggagaggaaagucugcaugccccacuguugacuggcggcuaauaaguuucuguuuuguuuauuauaggaacaauuugcuugagucuuugguuaccuuacaaguccuucauccuaguacaaagcccuuuugggcucuuuuauuuuaaaaauguauguauguuuguauggauggauggauggguggauggaugauggaugaugggggucuugcuguguugcucaggcugggccuugaacuccugggcucaagcaauccuccagccucagccucccgaguagcuugcaguauacucgugccaucacuccuggccauuccagcucuuuuauuuuaacaaaauaaagauaaaugaauguauuuaaaaaauugcaauccugaauuaaauaauuugucuucaggcuucuuccuuggaaacugagauggccaaauguaaaauuguuuauauuuuauuuuuuuauaagguuugaauacauuauagaaaauagggaguuauuuuagcucaguaugacugguaauaacacccuggggaaauuuuuuuucaaaaucuacucagagguaggaaaucaauuucuggaaaccagaccauugaaaacagacuacuuuugaugaaaugugaauaauaaaaucucaguagugacaagucugacuaccucugcccucucuagccuuuggcucuaaccuuaaacugauuuuacauuuuuuucucuugacucauuugagaagcccuuauagaacaucuuauuuugcauaguacagugggcucagcauucauuuuuauugauuauaauugcucuguucaaagcauaauaauuuaggaaauuguauuuuuccucaggacuuggacuaaagucugaugaacuucccaaucagaugagcauggaugauuggccagaaaugaagaagaaguuugcagauguauuugcagagaagacgaaggcagaguggugucaaaucuuugacggcacagaugccugugugacuccgguucugacuuuugaggagguuguucaucaugaucacaacaaggaacggggcucguuuaucaccagugaggagcaggacgugagcccccgcccugcaccucugcuguuaaacaccccagccaucccuucuuucaaaagggauccuuucauaggagaacacacugaggagauacuugaagaauuuggauucagccgcgaagagauuuaucagcuuaacucagauaaaaucauugaaaguaauaagguaaaagcuagucucuaacuuccaggcccacggcucaagugaauuugaauacugcauuuacaguguagaguaacacauaacauuguaugcauggaaacauggaggaacaguauuacaguguccuaccacucuaaucaagaaaagaauuacagacucugauucuacagugaugauugaauucuaaaaaugguuaucauuagggcuuuugauuuauaaaacuuuggguacuuauacuaaauuaugguaguuauucugccuuccaguuugcuugauauauuuguugauauuaagauucuugacuuauauuuugaauggguucuagugaaaaaggaaugauauauucuugaagacaucgauauacauuuauuuacacucuugauucuacaauguagaaaaugaggaaaugccacaaauuguauggugauaaaagucacgugaaacagagugauugguugcauccaggccuuuugucuugguguucaugaucucccucuaagcacauuccaaacuuuagcaacaguuaucacacuuuguaauuugcaaagaaaaguuucaccuguauugaaucagaaugccuucaacugaaaaaaacauauccaaaauaaugaggaaauguguuggcucacuacguagaguccagagggacagucaguuuuaggguugccuguauccaguaacucggggccuguuuccccgugggucucugggcugucagcuuuccuuucuccauguguuugauuucuccucaggcugguagcaaguucuggaucuuauacccaacacacagcaacauccagaaauaaagaucucaggaccccccagcaagucguuuugugucuccuuggacugaguuaaguuacaagccuuucuuauaccugucuuugacaaagaagacgggauugucuuuacauaaaaccagccugcuccuggagcuucccuggacucaacuuccuaaaggcaugugaggaagggguagauuccacaaucuaauccgggugccaucagaguagagggaguagagaauggauguuggguaggccaucaauaagguccauucugcgcaguaucucaacugccguucaacaaucgcaagaggaagguggagcagguuucuucaucuuacaguugagaaaacagagacucagaagggcuucuuaguucauguuucccuuagcgccucagugauuuuuucaugguggcuuaggccaaaagaaauaucuaaccauucaauuuauaaauaauuagguccccaacgaauuaaauauuauguccuaccaacuuauuagcugcuugaaaaauauaauacacauaaauaaaaaaauauauuuuucauuucuauuucauuguuaaucacaacuacuuacuaaggagauguaugcaccuauuggacacugugcaacuucucaccuggaaugagauuggacacugcugcccucauuuucugcuccauguugguguccauauaguacuugauuuuuuaucagauggccuggaaaacccagucucacaaaaauaugaaauuaucagaaggauuauagugcaaucuuauguugaaagaaugaacuaccucacuaguaguucacgugaugucugacagauguugaguuucauuguguuuguguguucaaauuuuuaaauauucugagauacucuugugaggucacucuaaugcccugggugccuuggcacaguuuuagaaauaccaguugaaaauauuugcucaggaauaugcaacuaggaaggggcagaaucagaauuuaagcuuucauauucuagccuucagucuuguucuucaaccauuuuuaggaacuuucccauaagguuauguuuuccagcccaggcauggaggaucacuugaggccaagaguucgagaccagccuggggaacuuggcuggaccuccguuucuacgaaauaaaaauaaaaaaauuauccagguaugguggugugugccuguaguccuaucuacucaaggguggggcaggaggaucacuugagcccaggaauuugaggccacagugaauuaggauugcaccacugcacucuagcccaggcaacagaacaagaaccugucucuaaauaaauaaauaaaaauaauaauaauaaaaaagauguuuucccuacaa

SEQ ID NO: 192534 - RNA, 49602 nt, Homo sapiens
auauuggaaaggcgccgccgccgccuccgccuuggagcucgggguguuucggggacugcggccacaggcaggaaggcgcuccucuccugccccgccgacgcccggccagcccgcuucgcccugaccuguuuccucaugacugcccccggcccugcugccgacggacgucgccccggcguccggauuuaacacggaaacccggaucggaggccgcgcggggaggaggagggcgacccggucgguccugcgacccucucggcccggcucggcgccucggcgggagccaugaccucgcugacccagcgcagcuccggccuggugcagcggcgcaccgaggccucccgcaacgccgccgacaaggagcgggcggcgggcggcggcgccggcagcagcgaggacgacgcgcagagccgccgcgacgagcaggacgacgacgacaagggcgacuccaaggaaacgcggcugacccugauggaggaagugcuccugcugggccucaaggaccgcgaggugcgggcgcggcgggcugggcggggggcggcggcgcggggcccgggcgccaggugagcuccagguaggugccaggugagcgcccgaggcuuccggcccgcgcaccugcccucgcuccgaaguccgcgccugguggcgcccagcugacgccgagcggugucggaguugguugacccccuggcgcggcuggugcuuucuggauccuccccguagagauggcuuggauuuuuccuuaccccuuucacagucgcuccuuucauuucgacacccuggcaguuuguauuucuucgucgccuuuuuuccgcguuuuuaacccguguagaccccagggugcaaauccaacccggagacugcccgggaaacuaacagcuggagccaccagcgccacgaacucuuuggguuuuugcaggcuuuaggaccugggaggggugcccggaucugcuugcuggggauguuuuuuuuuucuucuucuucaguuaaagcuuacuguugggaauuacgaaaaacguaggcgaagugguaauagagggaaaagcucuuuuacugaguaaaguuaaguuaaguuucucaugaaaccuccugguaaaugacuuucuaggugaacuuacauuaggugagagauuauuuuuaguaucgcuuuuauauuuuaucaguugaugaaucucaaagucuugccgucuuaagaaagggcuuuuucaucgagugcuugaaauguagguuugugaguugaucagaggccucaaagcuucagguggguugaaguugcaauagauaauucuuuguauucugacuuugaaagcguuuauuuucacuucaguguccaaaauuuucacacacagaaaaguugaaaaagugauagauacauaugcauauauacucuuucuagauucuaugacguuuugcuguauuuguuauauuugccuacaaaaaugauuauuuauuuauguggagacggaguuucgcucuuguugcccaggcuggagugcaaugccgcgaucucggcuuaccgaaaucuccgccucccggguucaagcgauucuccugccucagccuccugaggcaggcaugcgccaccaugcccggcuaauuuuguguuuuuguuuuguuuuguuuuugagacggagccucaguuugucgcccaggcuggagugcaguggcgcgaucuccacucacugcaaacuccgccucccggguucaagcgauuuuccugccucagccucccgaguagccgggacuacagacgugcgccgccaugcccagcuaauuuucauaccuuuaguagagacgggguuucaccauguuggccaggauggucucgaucucuugaccuagugauccgccugccucggccucccaaagugcugaaauuacaagcuugagccaccgcgcccaggccugauuuuaagaaaguuuuccaaauucaggaaggugggcaaaaaaaaaaaaaaagucuuacaaaacaacguaaucuuucuuggucacugaaacuuacuagauauaggcgaguuuuauauggaccguuuauggaccuuucuuauuuagaaaucuaaugaacuaacgguuagcuugauagauacgucuggggcauuugccauaucuugguuucccauuucucagguuuuaauaacaguaaccuugaaaaaaguugauguuccucuggcugugaaagggcugcuguaccuguuuaauuauugaguugugaugauaaagcaggcuguaugugcaguuccuuguucuuuggaugaaaaaguaaacuagggguauagcguccuaguaauguaauuuuuagaaaauauucaacuuuagguuucaaaauuggaaaucuugauuauaaacauuugucuuuuuuuuuuucuuuuuuuagacggaaucucgcucugucgcccaggccuggagugcaguggcgccaucugggcucacugcaaccucccccucccggguucaagcgauucuccugccucagccucccaaguagcugggauuacaggcaugcaccaccacgcccugcuaauguuuuuauuuuuaguagagacgggguuucaccauguuugucaggcugcuuuugaacuccugaccucaagugauccacuugccucggccucccaaagugcugagauuacagguuugagccaccacgcccggccauaaacauuuuucuuuuuggacaaaaauaacauuauuauagacauuuuagaaaauacaaaaaaaaagaaaagcaaaauuaaaacauauuccugagugaacauuuugguuuauaguuuuugagaguuuuccguguggauaaaacucgguggaaaacaaaaaccugaaaaaaaaaaaacuaaaaaauaagcuuuugguguucugagucacacugagaaauuauagugaggaaauaccuauuuguuuuuucaaguacauguuacucuaaaucaagcuuuuccaacccgcgggccaaauguggcccaggauggcuuuaaaugcggcccaacauaaauugguaaauuuucuuaaaacauuaugaaauuuuuuuugcaauuuuuuuuuuuuaaagcucaucagcuauugcuaguguuaguguauuuuauauauggcccaagacaguucuuccaguguggcccagggaagccaaaagguuggacacccuugcucuaaauguuuaaggugaagcauauuaacaugcuguuuuucggugauugggucuuaagaagauaaucuaaauaauuuguugaaguuuaaccauacucacauaauuuaaacaauuuaaaguuauuuggcggguaauugaaaccauguguucuguuuauuuugcaucaagagucacucauuauacuuugcuagucauggcuaagguccagaugcuugcuagcuuauugugagcauuucuuccugauuucagcaaccacauggggaaauuuuuucucuuuuuuuuuaggcaaguccagagaguugaggggugggguugagacuacugggauuuuguauugcuuuagguuuugguuuuagggauuagccuauauauuuuuuccuuucaucacaucuuuaaaauuuuuuuuuuuaagagauggaggucucaagauguugcccaggcugcacucaaacuccugggcucaagugauccgcccugaguagcugggaauacaaggugcaugccaucaagccaacucaucaugucuuuacacucuaauaaccagcccugucaacuuaucuguugguauguuuuucccuugggaggcucgccaccauguuuuuaaccuauaguacucuuuuuaggaggcaggaauugcugucuuacccugagcccaggcguuuaugcuaacucauugcuuuaacugauuuuuacuucagcauuuaucuuuuuaaugucuggauucuccuaagaacuuuaaaagcuaaacuuuacauuuaagcaaaucauuaauguuggaaauauuuuauauaugugagcuaauaaccuuaugugaauauacuuguuaaaccaguaccuagagcaagaaacagaagcccuagcccuccacuugaguaucuuuccagucacuacccauuccucagggguaaccacuggcuuaauauuagaauucagcauagauuaauuuugccuaguuuuuuguacuuugugucugcuuuuuguucaaugugagauucauccauaucgugugagauuguccuuuguucuuauugucuuaccaauuuauuuuuaacauguuuauaaucuauaauauuuaaaaaauuacuuugacauauucugagucaagucucccucucuuuuuugcugaacagaagguucaguuuuugaauaagcagauggucuggcuucagauuaccuguuaggagugagucuaaagucauugugauugauuuuuuuuuuuuucuuuacacauuucagauuuuuuuuuuuuaaccaaugauauuuguuuuuugcuuuuauaaaacagggauggcuaguccccucagaagauuuucaugcucacuugggcagagaaucagugcauaaguauuuaaguaacucuuuaaagaccacaguaaggauggcagauaguuuacaccuaaauucaacugccaaguaauuagcaguauuucuuuaauugacccaguguuugagggggagggacagcaaaagugccagguauuuuccuuucccuguguguguuuauucuauagaugcuuuccauagaauauuuucaggaugcuuuauugagaauuaccacaaauaacuggugucauauauguuugaaugucuucauugguggcaaaucuuagucuuuuaagguuagauuuaauuauuuucaguggccaaguauaauuuggaguaugccuauggaacagcagaagcagagagaggcucuauaguccuguccaaaguguauucuuuggcuuuuacauauaauuuaagccuucugagcuucaguguuuucauguauaauggaaaaguagucauuccauaugaugguucugauuguacugcuguggauguuuauuaacuccuccccaggucuucgcuuuauuuuguauuacuuuaggguuuccccauaguguguugccuguuuuugagacagggucuuucuuugucacccaggcuggagugcaguggugcgaucuuggcucacugcagccucaaccucuugggcuaaagugauccuccugccucagcuucccgaggagcuaggaccacaggcacacaccaccaugcccagcuaauuaaaaaaaaauuuuuuuuuuauaaagacagggauuucaccacauggcucaggcuggucuugaacuccugggaucaagugauccucccgcuucagucucccaaagugcagguauuagaggcaugagccaccgcaccuguuuuuuuuuuuguuguuguguuuuuugguuuuuguuuuaagacagauugugcugugucgccaggcuagaguacaguggcgagaucauagcucacugcagccucgaacuccuggccucaagugauccucccgccucagccucccaaaguguugggauuacugcgaccggcucuaggaugcacucuugaagcauauuauuccccugcuguuuugucaugcagccagacuuguccaaucauauguuuucuuucagggcuuuggaucuugagagaauaacgagcuguaggguuuuuuggagaccuuuccagagucaugucagcguguggaucagacuguucuuuggcaugguucuuugagcugcuuucucuggucuguuggcacuguuuuuuuccagucugauuuuccagucaucuuucaguguugugaguuucaacagccuuccaguaaaguugcuuuuuaaagauagccagagucaguuacuaauguuucuaaugcuuguagacaagaacuguaauacaguaacuuaacucuaugucuugaaaaauaaguagguacuugagguaaauaauauguaaugggguaaaauacuuaagauuaaccaaaaugauagaacugacuuuuguguggcuuuuacacaggcuccaaagauguuuuccauuuuuggaauaagguucccaaggucacuacuuugaaguauaauagugaugaagauguauaacuuaacaaaaauuguuuuccuuucuauacguguggugauguccaccaucucuacauaucaaaucuguaaaucagaaauucagucaacaaguauucagaauuuccagaugugcugaguuuuaguaauuuaaaauauaauaaaggcuucugaguuuuuaaugaauuuucguuguuucuaagacaaaugauauuuccuucauauuuuuugaaguuuugaauuuuuaucuauuuuuuucagguguuuaaacacagguaugagauauacaggaucucagaaauuacuuuugaaguucauuaaacuauuugauuguacuuuuuuucuuuugagacagggccuagcuuugucuuccagacuggagugugguggugugaucauggcucauugcaaccucgaccuccugaacucaagcaauccucccuccucagucuccugaauagcugggacuauaggcgcacccuaucaugcccagcuaauuaaaaaaaaaaauuuuuuuuuguagagacguggucucacuauguugccuagucucgaacuccuggccucaagcaaucuucccgccuuggccucccaaaguucugggauuacaggugugagccaccacgccuggucugcuuauuauaccuuuucaacaagauuuuauacuguugaaauuacuuuuuagugcuuugggauucuuuuacaauauggucaaaauauucacuaacucaucucauaaguuauacuaauauuugauauuuguuaauuuuggacuaccugagaguucuuguauggagcauuugaauuacguuuuagaauuguauuuugaaggcugggugcgguggcucacaccuguaaucccaguacuuugggaagccgagguggauggaucaccugaggucaggaguucaagacaagccuggccaacauggugaaccccugucucuauuaaaaauauaaaaauuagccagacaugguggcgagcaccuguaaucccagcuacucgggaggcugaggcaggagaaucacuugaaccugagaggcggagguugcagugagccaagauugcgccacugcacuccagccugggcgacaagaguggaacuccaucucaaaagacaaaacaaaacaaaagaauuguauuuugaaguuauuuugauagauuuugaaauauuugggggauuuuuuugauauuuaaagaaauacacuuuuauaauaucaucuuacauguaaaucuuaaauacccuggaggcaucaggcauuaugcuuguucugguacauaauguuaagcuuuuggcuguacacuuuuuuaugucuuugcaaacucccccccccuucuaacagcauaacuuuucuacugccauuaaucagauuaaauaguauaaaacuaugcuguagucuuuguuuagaggauuuaucuucauguugugagucucccuuugaagcagcacaaaaagacagugcuuguccuccuccugcuuuuuuuuuuuuuuuaagauggagucuugcuuuuaucacucgggcugaagugcaauggcaccgucuuggcccacugcaacuccgccuccuggguucaagugauucuccugccucagccucccaaguagcuaggauuacaggcgccugccaccaugcccagcuaauuuuuguauuuuuaguagagaugggguuucaccauguuggccaggcuggucucgaacucuugaccucaagugauccgcccaccucgccuucccaaaggucugggcaugagccacugugcccggccaugcugcugcuuuuuaguaaguguccugacaagugccaaaaguggaaaccuggcuucauuuugaaauugauguuuuuggcuucagguuucucuuaucaaagcugggaagacugcaaccuguuuuaauagcauuguacaguauuacaauguaaucuaguacauuuugagguuuuugacuuagguauuacaaauauauuuagaacauaggcuauuucucuucccguuugguaaaccucucaucugcaaaaacacaacuaauauuaaaguacaguguauugccaacaaggauguuucuggucacuuuuaagaauaacauuuuaaacaacaacaaaaaaauuuacuuauuuuuaaacuuaaugcauuguauuugauuuacauauuccuuuaauggagaaguucuuaaauuggagugaacagagcugagaaacuuugugaauucucugcaguuguguguuuucuuggggaaagaggacagaacuuucauuagauacucaaagcauuuagugaaucaggaagguuaaaaauuaccaaacaggaacuguuuguuuuagcuuaagguuuucgucuuuucuuuuuccuuccugaaaauuaacuacagaaaauuccagguuuccaggguuguagcgaguugaauuuuaagugauuugagauacgaaguccacauuucuguggccugucuagagguucucaucuugcuaaaugacauuuagaagcagcauaacugcuucuaaucuaggauuaccacacaucuaggauucuaacaguuuucauccauucaucaaauguuuacugagcacaugcucugugagaggcccuuuacuaaguacaaauucacugaagaacaugucugucuucaaguucauucauuuuaguucugugugucaaagcucauauaguaaacuacaaaacuaaauuauguugcuguucuagaauuuuuuuuuuuucucuucugagacagagucuugcucuguuacccaggcuggagugcaguggugcaaucuaugcucacuucaaccucugccuccuggguucaagcgauucuccugccucaaccuucugaguagcugggauuacaggcacucaccaccacacagggguacuuuuuguauuuuuaguagagacaagguuucgccauguuggccaggcuggucucaaacucaugaccucaugugauccacccacguuggccucccaaagugcugggauuacagacaugagccacccugccuggccuguucuauaauuuuuugaugucauauauuucaggcuggcauuuggcagucacucaguacaaugacauuacucacauuaagaauacauaauuuaccuaacccuggcaggugugguggcucaugccuauaaucccagcacuuugggaggcugaggcaaggggauuaccugaggcagggaguuagcgaccagccuggccaacauggugaaacuccaucucuacuaaaaauacaaaaauuagccaggcagggugguaugcaccugaaaucccagcuacucgggaggcugaggcaggagaaucacaugaacccaggagguggagguuacagugagcuaagaucaugccacugcacuccagccugggcaacagagcaagacuaucucaaaaaaaaaaaaaaaaaaagaauacauaauuuaccuuauuaaguaagcuaauauuauuuauuaaaguaaauuuacuuauuaaauaaauuuacuuaauacauuuacuguauuaauuaaguagauuacuggcuuuauuaaguaaauuauguauucccagugugguaaugucauugccaagggagugaaacuugguucugggcgugguagugaaagaaucguacucuuggccgggcgcgguagcucaccccuguaaucccaacacuuugggaguugaggcggguggaucacgaggucaggagauggagaccauccuggcuaacauggugaaagccugucuguacuaaaaaaauacaaagaaauuagcuuggcgugcuggcgggcuccuguagucccagcuacucgggaggcugaggcaggagaauggcgugaacccgggaggcggagcuugcagugagcccauaucgcgccacugcacuccagccugggcaacagagugagacuccgucucaaaaaaaaaaaaagaaucuuacuccucuuauguauaaaaaggcacacuuacaguguacaaacaaauauguauauuccaucauauuaaaauuucaugggggagaagauaaugaggaaaaaaucuggaaguacuucuuaagggaacagugaugaaauaaagggugagaaacauugaaauaagucacuauggaaaauuauaagcuugugcuuaguugagguuuagaaaucuuuuucucugauaggaauuuuuauugcaauagaauuuggcuuguaguucaguaggaagaggaacaauuuuagcauacugaacugcguguaggaacuuaugaguuaaaguuuuaagguaaaaguuauuuuuauugauaauauauaggcaaacuuuguauuccaccacuaccuucugggacagauuagaaauuaagaaacuguauguaaaaguugcuaaugguuauuuuuacucugguuucauuuucuaguuccaguuucuuaaauggaaaugcuaaacaguuuauaccguauuaacaaaauaaccucagaaauaacacuuaagaacuuaaauuucaguucagucacugaauggaguauaccauuuaauuuuugucuauaccauguuguguagcuaaagugaaauuagagguuauuuaguauuuauauguuccguuuaauccaaguauugaacagcuucucugugccauucauucccuuugccagaugcugggguuacaaagaaaaaaaauauauauauauauguauauauuuuugagaccaagucaugcucugucgccagacuggagugcaguggcaugaucuuggcucaugcaaccuccuccuccuggguucaagcaauccuugugucucagccucccaaguagcugggauuacaggcacaugccaccaugcccagcuaauuuuuguacuuuuaguaaagacgggguuucaccauguuggccaagcuggucuugaacuccuggccucccaaagugcugggaucacagaugugagccgcugugcccccggccacaaagaaaaauuuuuugcuuuuaaggagcauucagucugcauagaagacagauuugcgaaugauuucaauaaagugaauuauuaacuuuauccugccugccucuucugaguuacuaacuuuuaugggaguauguguuaggugcaguaaggauguacauagggaggaugcuuuggaucaggaccugcaagacugcuguguucuugacaccuagccuugcccuugaguaguugaaagaauuagaauaaauauuuugaauuuuagaaccuuaguuuucuccugggcaaaaugggccuacuuuuuuauuuuuuauuuuugagacggagucucgcucugucacccaggcuggagugcaguggugcaaucuuggcucacugcaagcucugccucccggguucacgccauucuccugccucagccucccgaguagcugggacuacaggcgccugccaccacacccggcuaauuuuuuguauuuuugguagagacgggguuucacuguguuagccaguauaaucuugaucuccugaccucgugauccgcccgccucugccucccaaagugcugggauuacaggcgugagccaccgcgcccggccaugggccuacuuuuguguucuguccgaaagccucuaaguuguagggauccaauguguuggcauaugugagugcuuugaaaaccacauggugcugaacaaaugcaaauggguaauuaccuagccuagagaaguaaguuaaaguuuauaguggucuugacaagugacaaguauuuaauauuuccauuauuuuuacuauuucuugauucucuugcacuuuauaugcugggcuuacugaacguuuuacucaaauucagaugcucaucuaugcguguauuuuuuuaaaaauuuuaauuuuuuuuuuuuuugagacggagucuugcucuguugccuaggcuggagugcaguggcccaaucucugcucaccgcaagcuccgccucccggguucaugccauucuccugccucagccuccugaguagcugggacuacaggcgccugccaccacgccuggcuaaauuuuuguauuuuuaguugagacgggguuucaucguguuagccaggauggucucuaucuccugaccucgugauccgcccaccuuggccucccaaagugcugggauuacaggcgugagccaccacgccuggccuuaaaaauuuuaauuuuuaugggcacauaguagguguauuuaucucuaccuuuguucugaaccucuggucaguuuccuuuuuguaauuccuggcaaaacugguuugggaaauuuggaaacuugaaguaccacuugacuucugauuuuuauuuuuuuauuuuuuauuuauuuauuuuucuuuuuugagacggagucucgcucugucgcccaggcuggagugcaguugugcgaucucggcucacugcaagcucugccucccggguucacgccauucuccugccucagccucccgaguagcuaggacuacaggcgcccgucaccaugcccugcuaauuuuuuguauuuuuaguagaggcggggucucaccguguuagccaggaugguuuugaucuccugaccucgugguccgcccgccucugccucccaaagugcugggauuacaggcgugagccaccgugccuggcccgacuucugauuuuuaggucaagcccagagucuuccuuaaagaauccuugggauugguuccaugauuccucuuuuccagauacugcuuagccuccagacguaucaguagccuccaagccuccaaaaugacuccagucacaauuaaauaaaauagcacauguaaagugccugauaguuggugcacaauaaauauuaaguuucauuacgccuugaugcuccaaaucagaaaacucaaaaggccuugaccucuuccagcccuuguggucagcaguucucuccaccuuuccauauucucagcuuugguuuuuuuuuuuuuuuuccucagcuuugguuuuuuuuuuuugagacaagguaugcucugucacccaggguggaguccaguggugugaucucugcucacugcagccucaaacuugcugggcucaggugauccucccaccucagccuuccaaguagccgggacuacaggcgugcgccacuauaccuggcuacuuuuuguauuuuuuguagagaugggguuuugcuguguugcccaaguuggucucaaauuccugggcucaagugauccucccuccucguccucccaaagugcugggauuacagaugugaaccaccgggcccagccucaccuuaucuuuuugaugccacccaauuuuuuuuuuuuuuuuuuuuuuuuuuugagacggagucucgcucugucacccaggcuggagugcaguggcgcgaucucggcucacugcaggcuccgccucccagguucacgccauucuccugccucagccucccgaguagcugggacuacaggcacccgccaccacgccuggcuaauuuuuuguauuuuuaguagcgacgggguuucacuguguuagccaggauggucucgaucuccugaccucgugguccgcccgccuuggccucccaaagugcugggauuacaggcgugagccaccgcgccuggcccaugauuacuuuuuuaggucuucauguuuguguuaguggauccuuauauguaaggcucugccuuuuucuaccuagcagccaauucuuaguuauuucuuacugccuagugagacucuucaccuuaaucuaacuucuuaguugcucucacauccuuuuugccuaccauuguaucucuagcaucuagcacaaugccuaguauugcacaaguguuugucuuuagaaugagugaggggacaccauuuuauuuauaucaguauuaugauaaucacauugaaauuguaauuauuauuucuuccuuuucauucuaugccuuuguauauuagucaucuuuaucaccucuguuuaguaaugucuuggcacucaguagaguuuauugaguuaaaauuauucuugaaauauauuacuuccagcuggguaugauggcucaugccuguaaucccagcacuuugggagaccaagauaggaggauugccugaguccaggaguucgagaccagccugggcaacacagcaauacccugucucuauuuuaauaauaaaaauguauauuaaacaaauagaaauuuauuacuuccaauaauuuuuuuuuccccagagucucauucugucacccaggcuagagugcaguuguauaaucauagcuuacugcagccuugaacuccugggcucaagugauccucccaccucagucuauuuugagaauuuaaauaauuacaguuuuugcuuuaugcagcauuaugccucagccucccaagugggaaugauuuucugcuuuuagaaaauaaugcagaggccaguaucuaauaaauguuauagugacuugauauaaaacuuacauaggacuugucaaaauguccucaacuuaaaauacuuacccacaguaugaugcaguaguaaaagugcuguaucuagagucacagcucuggggcucgagguaucacugcucuagagugugaauguagucauauuucuuacuuucucuaaaccucagauuuuucaaauguaaaaaggugaugauauuuuacuagguaauuguagaaccuagaugauaauuuauaaauggcuuugcaaacugaaauguuauucucuuguauuaaaaccuucguguuucuuacagaagaauaaagacuguagcuuauauuuaggucuuacuaacaagaugcuguuaaauauacuuuaaaaaaccacuagugaaaaacccuuaaaaauucauuugcuugagagggagugucugcucacacuuuguuuugugcucucugcugugaagugaucaguggcagguguggaaagaaaaaagugauaccagucaagcaccccagucugaaaaucugaaauuugaaaugguuccaaaauuugaaaccuuuucagugcugacaugauaucacaaguggaagauuccauaccuggcacacuuuguuucaugcucagaacuauuuaaaauauuguguaaaauuacauuuggcuauguguauaagguauaugugaaacacaaaugaauuuuguauuuagacuuaggucccaucccuaagguaucucauuauguauuugcaaauauuccaaaucuagaaucugaaacacuucgggucccaaguacagggauacucaaccuguacccucuucuguuucagggggcugaaaggaagcacaccuagaucaugcauuaaauaaacaggucuuggaaggcaagacagaaaaggagccagggcuuuggagccaggcagaccaauuucauucccugcuuugccacucagugcguggcagguccucugagccucaguuccauuaucuugugaaauuggaagaauagcaccuacuuuacaagguuuccuaagaauuagaaagaauguacacugaaugcuuaacacaguuuuaacagcauagauacucaguguauggcagaguaugacugugugcacuuuaaaaaaggauuuggaaggauacauuccaaauguuaauggagaguaucuugaagagggaaugugugagggauggaagcggaagagaaaguagagacuuuuaauuuucugucauguauuucuauuugaauuuuuuuugaaaauaagugagaguaccugagaagucuguguaaguggccaagagcacuccguuggaggaauaggcagcagaagaguaaccugacaaagagcccgagcaggagcugccagaagagggggauuguggagccagcaggaggaagagugaggaguaguggagauggacuugcugaugauaccuucgagucugcugugaauggaaaggagauagggcaggguugguccgggucugucucuuguaugaugguaacugugagaauauuugaaggccaauaggcaggugcuaguauacauguuagagauuuaagguauuuuaggagggcaggaguugugaacaaagggaaguaggagagaauggguaggauuagcuuuaggcagacugcacuguaacgagacaaaagaguggguauguaugaaauugaguuuauugaguugguuuguuuuugugaaguaaucugcugaaaaugagcugagcuuuagagguuuggggagaaugggguuuugaaauaucugauauggagagugguaagagcucugaguagggaaacugauuuugccguguguguguguguguguguguguguguguguguguguguguauuuuauuuauuuauuuauuuauuuauuuauuuauuuauuuugagacagaguuuaaagcugauuuugcccaguguguguguguguguguguguguguguguguguguguauuuuauuuauuuauuuauuuauuuauuuauuuauuuauuuauuuugagacagaguuuagcucuuguuacccaggcuggaguacaauggcgugaucucggcucacugcaaccuccuccuccuggguucaagcgauucuucugccuuagccucccaaguagcugggauuacaggcaugcaccaccaugcccggcuaauuuuguauuuuuaguagcgaugggguuucacuauauuggucaggcuggucucaaaucugcugaccuuaagugauccacccgccuuagccucccaaagugcugggauuagaggcgugagccacuaugcccaaccccaguaucauuaaagguuuaguuuaaguuggagacaguacauuuauauacugagauuucaauauuuuuuuacaucagcaguucagaaacacagguacagauauggaaaaagugacaguuggauugauccggggcuggaguuuugcuaguugaaugcagugggaaacaauggauguguuuaggaaacuaguaaggguguaguugaagguaguguacucuggcguuguuugcccaucuuugaauugggauugauaauaauagcacuuaguucagaagguuguugcgaagguugaaaugagcucccacaguacuuaguacucagaacagugcuuugcacaugguaugugcacaguaacuuauugugcuggguggggaugagggaaagaacggaggagacuggugggaaaaagggaggaaggcugaggauuggaauccccauaaggaugaugaaaaguuacuuguggauugaauuuccgaguuggauuugguucucaucaaaagguuguggguuuaaggaugcugauguccaaguucccagggaguggcagauaagaucccugguuuugagugaagaccaugagaauagaggcccugagggcccuggcuguuacuucugugaaaaaauacauucuguguuacaaauugcuuaaaagggaacuuuuaaaacguaaucauaacuugauuacuaccaguaacuuacacauguggauggcacccaaauccaaucauuauuuaguuacuuuacugguuuuguuaucugucuuaguuuauuugggcugcuguaaaauaccauagaccaaggaucucuaaucuccgggcuauggaccgguacuggucuguggccuguuaggaacuagguugcacagcaggaggugaggggcgggcaagcgagcauuacugccugagcuccgccuccugucagaucagcagcagccauuagauucucauaggaguaugaacccuguuaugagcugcgcaugugaugagggaucuaagguaggcgauccuuaugagaauuuuaacuaaugcccgauaggaucugagguggaacaggcucaucccaaaaccaucccccccgccgcuccaguccguggaaaaaauugucuuuccugaaaccagucccuggcaccaaaaagguugggacuaccacaauagacagugugacuuauaaacaacagauuuuuuuuuuuuuugagacagaaucucgcucugucacccaggcuggagugcaguggcgcagucuccauucacugcaaccgcugccucccagguucaagugauucucuugccucagccucccaaguagcugggauuacaggugcacacuaccauaccuggcucauuuucuauuuuuacuagagacaggguuuuaucauggcugagaccaccaggcuagucucaaacuccugaccucaggcgauccgcccaccucagccucccaaagugcugggauuacaggcaugagcuacugugcccagcuaacaacaggaauuuauuucucacaguucuggagucugggaaguucaagaacaagaaauuggugagggccugcuuccugguugucuucucauugcauccucacauggcagaagggcauagggacucucuggggccucuuuuauaagggcacuaauugcauucaugaggcuucugccuucaugacuuaaugaccuuccagagacccuguuggggguuagaaucuuuuuuuuuuuuuuuuuuuuuuuuuuuuuuuuuuuuuugagacaguguuucacucuuguugcccggcuggagugcaguggcucaauguugguucacggcaaccuccgccuccuggguucaagcaguucuccugccucagccucccaaguagcugggauuacaggcaugcgccaccaugccccacuaauuuuauauuuuuaguagagacaggguuucuccauguuggucaggcuggucucaaacucccgaccucaggugaucugccugccucggccucccaaagugcugagauuauaggcaugagccaccgcuuccggcuagaaucuuaacaugagaguuuuggggggacacaaacauguagucuauagccuuacucuuuugcuaauuaaaaaaaucagaaagcugagggcuuucuuuagucauuugaaaugcuuaaggggaguuuuuggcuuaguuuuuuugguaacagcuuuauugagauuuaauugacaauucacuuauuuaaacaguacaauccaggauuacaugccuguaauccuagcacuuuggaggagaccaaggcaggaggauugcuuaaagccaggaauuugagacuagccuggacaacguagugagaucccauugcuaaaaaaauaaaaauaaaaagccgagugugcuggugccugcuuauagucucagcuacucaggaggcugaggugggcagaucauuucagcccagcaguucaagguugcagugagcuaugaucaagccacugcacucuagccugggugacagaaugaaacccugucuuuaaaaaaacaaaguaaaagguaacaaugcagugacuuuuaguguauuuagaguuguguauccaucaccauaauacauuuuagaacguuaauuuuuuuuuuuuuuugagacagagucuugcucugucgcccaggcgggauugcaguggugcgaucuugggucacuguaaccucuguccacugcaaccuuugucucuuggguucaagugauucuucugucuuggccuaccaaguagcugggauuacaggcgcaugccaccacgccuggcuaauuuuuguauuuuuaguagugacaggguuucacccuguuggccaggcuggucucgaacuccugaccucgugaucugcccgccuuggccucccaaaguacugggauuacaggugugagccacugcacccagccaagaugacuucuuagauaauccuauguguuuucauguucauugcaucaggagucauccagugucugguuuuagaauuugaagaccagugaguucauuuggugacagaccuaucugccuguuggaaauuuccccuacuuuucaucuaauuuagggauucuuagcuuggggucacuguagaauucaggaaacauuugagaggggaaaaauuaauuuauuuuuagugaccuauaccugaaaguuaacaucuacaucaacuauaauuguaggccacaagccaaagaaguauuaauaguaucugugaguuugucaccacuagagagaccagagauacuuucauaucacaucacaguuauugcagauaucucagaauacugucuuugcucacuacuacauuggaauuauaauaguuauuagaucugccacuagaacuuguuuaaucugcuaauaaagcacauauaucacaaauucauuuuuaauauuuugaugacugauuugguuuccuuuauaauccugugcauuuuaugcacuuaaaaggcaggauaaacacuuaauuucauuuuaauuacuaaguuuuggguuaggaguuugugccuuagcuacuuccagugguaucuagugagguaugggcucuuuucuuuuuuaaaauuaugacuugcgguuuuauauauauucauuguguuucauucacuuauauuaauuacucuucuugauguuuaaauugucucacuuuuagccuaugggaguuauuuucuaaguugguuucaguguucuuugugauacagguuauuaaccuuugauaauuucuugcuuuuuggcaaggccaacacaauguccuggacucaacucguacauuuccuguuucagacuuauaaucagucauuccuucaaggaauccuguuuuccaucugguggggaauggaccacacucuggugugaguacacuggguguacucaguguuacugaguuguuacugcuuguaggacucuuucguauacagagauaggauauauuuuccucaagggacagagcuagcaaacauuuuagaggaaaaaaaaucuguuuacgugguuuuugguucaaguuuaacauuauagauuuuuauuuaacuuacuggguuuuauauuuaucuuuuuucuuacugaaaauuuugguucuucaaauauuugcauuggcuuaccgcuuguauuaaaacaguuucaaaauaaaaaugucaacauuacuacuaauugacuugaguuuggcuuacaauuucuuuguaguauuuuuauuaagaaugugcagucaaaauacuguauucuaaaguuaaaauagcuuuucuuuguggcucuaucacuaaguaguauacgguuguuuucauucuucaggaguuuuuuuuuuuuuucuguuuucagugcauauaauuauauugcaaguuauauucaaaagucucauuuccaucuuucuucuaccucauucuuuccuucccccauuaguaguucuugaaaaguuagaguuuaucuuucugauauuuuguuagcaaaacuauacguauauucauaucauugcuccucuccuucauauacaagguaauggacuacauacacugugugcaccuugcuuuuuacauguuauauucuaaagauuguucucuaucacuauuacuuagaaauauuuuaugguucuguaguauuccauuaugugguagauauaucuuuguauauucauccagucccuuauugauggauuuauggguuguuuccaaacuuuugcuccuacagauaauaucacaauaaccauaugcauauacuguugcauauuuauggggcuguuucuucauaguggauuccuuagaaguagaauugucaaguuaaaggguaaaucuaugugugauuuuucuagauccccaaauuucccucaguaaaaguggugucauuuugacauucccaucauaguuaugagaaugccuguuucccucauuuuugccaacuaugcugucaagcuuuuggguuuuuuuuuuguuuuuguuuuuguuuuuuuuuugagacugagucucacucucuugcccaggugggagugcaguggugugauccugguucacugcaaccuuggcuuccugaguucaagcgauucuccugccucagccuccuuaauagcugggauuacaggcacaugcaaccacgcccagcuaauuuuuguauuuuuaguagagacagcauuuugccacguuggccaggcuggucucgaacuccugaccucaagugauccgcccgccucgccucccgaagugcugggauuacaggugugagccacugcacccggccaagcuuuuggauuuuugccggucugauagguaagcaugauuucauguaguuuaaaaaaaaaaaaaaaggcuggggggggcaggcgcgguggcucauaccuguaaucccagcacuuugggaggcugaggugggcggaucacgcggucaggaguucgagaccagcuuggccaacguagugaaaccccaucuguacuaaaaauagaauaauuagccgggcaugguggcgcacgccuguagucccagcuacuugggaggcugaggcaggagaauuacuugaaccugggagguggagguugcaaugagcugagauugugccacugcacuccagccugggcaacagagugagacucugucucaaaaagaaaaaaaaaaagguaaaauaugcauaacaucaaguguaccauuuaaaacauuuuuaagugguacaguuuaguggcauuaaguagauucacacugugccgucaucaccacuaucccucuccagaacuucuccaucauuucauaccgaaacucuauccauuaaacaauagcuacuauuuccuucucuccacagucccugggaaccacugucucuaugaauuugacuauucuagguaccccauauauguggaaccauagaguauuuugucuuuucaugacuggcuaauuucacuuagcauaaugucuucagaguucauccauguuuuguagcuauguaucagaauuuuacauagaucuguguaucagaauuuuaauuuuuaagacugaauacuguuuucuuguaugcauauacuauauuuauccaaauucaugguuuguauauacauguuuugccuuuuuuugaauuagguggguuucuuuuugcuguuaaggucucauguauuuuaaauguauauuuuuauuaugaaugacaaagcaucuuuugguauguuuuagcaguuuccauuucuucugugaacuucaucaucuguuaccuuuuaaaaaauugaauauuucaaaauauauauuuuuuugagacaggaucuugcuuugucacccgguuagagugcguaagugcaauuauagcucauugcagccucaaccucccaggcucaaguccucccgaguagcuaggucuacaggcaugugcuaucgcacccagcuaauuuuaaaacauuuuuuguagagacagcucucgcuguguuaccaggcuggucugaaacuccuggccuaggugaucccccugccuuugccucccaaagugcugggauuacggguguaagccacugugccuggccucaaaauauuaaaaaaaaaaaaaaaagcaacuuuauuuuuaggaacuaauuguauacuagagauuuaucugugauauaagugacuuugcuaugauuuuuacccugcaaacuuuaccaaaaaaauggguagucucuuuuauugcuccuagauuuugagaauagcugggaaguuuuuucuuucacucccagauuauaaagguuuucacucuuauuuugucuucuaguacuuacguuauuucacuuuacauuucagccucugauccaucuggaauuuauauugauguauaauaaggaauugauccaauuauguuuuuccuaaugacuaucugguugucccaacacguuuguuuaaaauguucaucuuuccauguuacauugauuugugaugacauuuuuaucguguacagauugagaaucccaauuucgaaaaucugaaauuguaaaugcucuaguaucuaaaacuuuuucagcaccagcgugagaaucaaagaaaaugcucauuggagcauuuuggauuucagauuuucggauuuggguauaaugcaaauauuccaaaaugugaaaaaaaaucuuaacuccauaacauuuccagucacaagcauuuuggauaagggauacucaaucuguauuugauuucaguauguucuuggguuuguuucuggaauuuauucuguuggucugucuauucaugugccagugugacaucauuuuaauuuuagagacuuuuaaaucuauuuuaguaucuaguaggacagcuuucauuucuguucccuacauauguugcuaucuccccaaguuuuccuggcuauuuuuuuuuuuuuucuuuaggaacuuuuauuuguaacuuguauagcuccagggaaaaucuguugcuauuuuuauugggauauuacauuuauuaacuuaggaagaacuaauaauaaugcugagacuuuguauauaagaaugaaauaucuuucuauuauucaagucuauuuuuaagucuuucaagagacuuuaaacuuuucauauagguuuugccaugguauuuuuuguucuuuuuguugcuguuguaaaggucuuuucaauuauauuuuaacuuuuuaguauuuuaacauguguauuuuguuuguauaugacaacugguguuuaauuuuauauaaucuggcuacuuuacuaaacuccuaucuauaguaauuuuuccauuuacucuuaugaguuuuucuaaauauccaacaauaucaccagcaaaugcaguuuuacuacuuuuuuuuuuuuucuugagacaguuucacucuuuugcccaggcugaagugcaguggcucacugcagccucugccucccaggaucuagcgauucuccugccucagccucccgaguagcugcuauuacaggcaugagccaccacaccuggcuaauuuuuguauuuuuaguagagaugggguuuugccgccuuggccaggcuggucuugaacucgugaccucaggugaucugcccgccucggccucuuaaagugcugagauuacaggcgugagccacagugcccagccuuacuacuucuuuaacaguucuuauaucuguagauaccuuuucuugucuagucuuuuuaaucugcuuuuaccugaagucaccuucauucucuugauuaguuauuuuugucaagaacuuuuugauucuuaauuuuugacauaaucaaaauuucauguaagauuucagaagugacuuuauagaauguuuuuuuguaacagcucugagauaugauucauaugccauauaauugucauuugaaguguacaauucaagguuuucagauuuguacaaccaccaccauaaucaauuuuagaauauuuuuaucacuuccaaaagaaagcucauccccuuuagccauuaccucucccuuuucccauuuugccagcccugggcacccacuguauuaauuaucuuacugcauaacaaaacauagcagguuaaaacaacaaacaugcuauuccguguaugugccugucugccucucugucucuguaugucuugguuugccucacauugcauccucucucauuucuacucugcauuugucuucuguuuuccuuucuguuaccuucauucucugcauuuguacccaauggccaguagcuucugaauccacacagccaguacagcuccagugccaugcccauauaacugauucaguauggcaaguucagauacucaggagggagacuuaauuuguucauccugguccauuuagauuuggcaaguacaaucaccuuucuuuuuuucuuuuuuuuugagauggaguuucgcucuuguugcccaggcuggggugcaguggugcgaucucagcuuacugcaaccucugccucccagguucaagcaguucuccugccucaaccuccugaguagcugggauuacaggcaugcgccaccacgccuggguaauuuuguauuuuguauuuuuuauuuuuuuugagacagagucuugcucucuugcccaggcuggagugcauuggcgcgaucucgccucacugcaagcuccgccuccuggggucacguuauucuccugccucagccucccgaguagcugggacuacaggugcccaccaccacgcccagcuaauuuuuuauauuuuuaguagagaugggguuucaccguguuagccaggauggucucgaucuccugacaucgugaucugcccaccuuggccucccaaagugcugggauuacaggcgugagccaccauguggaccuggccuauauuucuauuagaaagccauuuccaaaacauuggucacaccagaauucaaccuuauauagaaaauauaguguuuuuagugauuucauuuugaaauauuuuguacauaaaaacaaaaugaaacuauuuugaguacuuuaugccuauacagacuacuaguaacugaacauucauauaacguaguauguuuuguaaaauguuuagcgguugcaaacugguuugccagauauguuuuguuuaguaaaacuugaguuguaauccuuucaaagauggaaguaauauauagaaacggacguuucugcccucuugaaaaagauguggcaagagcaggcccacauuuuacauggcaacaguugauaagggcuaagcugucuuccccagauagauggaagaggacauuguccagcuugcugcaauccacaccugggucucuuuauucagucauguucuuuguacuuucuaaguaacugaguuugcaguccuccauccccauuccauucuaauuguacauaauuaaguaauuacuaauugccagggguugugcuuuauauauauuauuuaaucuucacaacuuguuuuauaugaagaaaacuagucucagaaauuuaacuauauaguaugugguagagcuggaguugauuugaaucgccagguguuugugcggucugggcucuugagcacaguucuuuacuacuucacaaauauguuuuacuuugugguucauaguuauuuucauggagaguuuuuaguucuucuaguguuuugccucugucaaauuacugccacuaucauaacuauugccuuuuaagcuugaacaacuauaacuauaguugaucaguaaggaaaaccuuacuuaucuccuugccacgaguuuuccuuuacuauauacagaaaagccuaaagaaaauaaagaucaccauaaucaccagacauuacugcugcuaaaacuuuucuucuaaucucccuaaaaaaugggacuauuuucugucucucuacacacacacacacgauuucauaauaauuuuucauguuuuguaauaaccucugcaccaggauuucuuuucuuuuuuuuuuuguuugagaugaagucuugcucugucaccaggcuagagugcaguggugcaaucucggcucacugcagccuccgccuccugcaccaggauuuuuaaaacugauuuucauagaauuguaauauucuguaggcuguuaaaaguauacuguaaauuaaaaugcuucaaggucaggaaaguuugggaagugcugaguuuauucccuuuuuuuugcuuuuagauuguuuuuguguuuuacuaugauaaugaugugaucaauauauuuguacauauauuuuugugcacaguauuuucuaacuaaaggcccauaagaauugugucaaaggaugugaacauuuauaaguuuuuuuguaaauacaaaccuaugauauacauacguauuaauauuuauguaacuucaaaauaagauuacacuuuagaucaagcuuguccaacccguggccugugggccgcagguggccuacggcuuugaaucugguccagcacaaauuuguaaacuuuguuaaaacaugagguuuuuuuuuuuguuuucuuuagcucaucagcugucauuaguguuaguauauuuuaugugugggccaagauaauaauucuuccaguauggcccagggaagccaaaagauuggacacucugcuuuagauaauauaauuuuuuaucuguuucucauguagaauauauauuaugagcauuuucccauguuguaaauguuuuuaauaacauauaaggaaaaucuuauacuuccgguuauaucccuguuaugaucuuuauacaaaauauuuuuauuacauuucauuuuggguuaccaaccuuuugaguuccuucuuaacaaaaagcuucuggguaaguaggcaguugagagcagaacaguagcucuuaacuggaauggugagaacucuucucaguguuggcaguuuuaggggacuuaauaaacaauacccuuuucuaccauucaaauugagccacuugaaagaauaaagggaaucaggcagauggaggucugguaguguauggcccagccuacuuggggugucucuguccucucccauccuuauauuuuagaacauaggaacuaauuaugacuacagucauaagcugcuugaugcugccaguuacuaaccuuccccacauauuuuaucuuuuuuuuuuuuuugagauagggucuuacuccugucauccaggcuggagugcaguggcaugaucauggcucacugcagccucaaguuccugagcucaggugauucucccaccucagccuuccaaguagcugggaccacagacgggugccaccaugcccggcuaauuuuuguauuuuuuguagagaugggguuucaccauguugcccaggggucuggaauuccugggcucaagcaaucugcuugccucugccucccgaagugcugggauuacagguguaugucacugcgccuggccacccuaugguuaauuuuugauccugcuuuuaugacauggauuuuagcaggaggguaucaacauacuguacuuuucuguuguuuggugugucuuuguuggcuucauuuaucuuuggaauauugcugacgagucccagaagcugugguacagaacuguccguucccauucaucuacuuucccaugugaauccaauucuguuuaagcaugugucuuucagcgaugaugccuaaagccauucacuaaauuuagaucucugaagucuguuacuaaagaccccauuuugcuaauaucucuggguaugccauuacucuaggagcaauugagauugagacauauuuuaguucucugcugucaaauguaagccuccagguacuguucagcuggaguuugcaggcuguagggcuguucacguccauuauugcuuuaugagguguucucuguuguuuacaguuuguagaggcucauuuaggaacucugucuauauguccaggccagucaaagccagauaucuguaacuuuaauuucauguggaauucauucucaggcuuccuagggcuuuaauuucauggacacagaagccacgcauuuuaccuaaccucuauaaaguacugguauuauuagccacuuugcuaaaucucugguaaucuucauuugaucaggccccgacccuaaguuuaaagugacucccuaaaauccagucagugucugcuacuuacaccucacauuuaaauugaucucuuaacacugauguuuuuguuuauccgcuugugccuccuuuaaauuguuauuuucccaaaggucacauucucagaagugguagcuuggugaggcgaauuuaacuccuuguaucaaaaaugaaguuugauggaccucaauggucagucaucuucugaaacacaagcucacuacucuggccugacaaagugccaggauugaccuuggaaaagugccagaggugagggccaggccuuccuaauccugggcccuccauucuuuagagauucaguuggccuguucuccuaccaaaauuguguuacccuguucugagccuuaaugagaguuauuuauagcuucugcugucucaugagaacuggguaucuuaaauugauagcuggcaauccugcuggcaagauuuguggcuuuauaauuugaacaaccccaguuguuugcuguuaaaguguccugaccucaucuggugaugccugcuugaccaguaucccagaucucuagaugucuaucaaccuccuuaugucuggccguucuuccacuguggaugcugcccuuacauucucucuuggggccaaucugauuguuauacuguuuauuauugagaauuuuaggccuauagccauccauuuguuugugggcgcauguguguuuuucuaauaucuucuuacaaaauuaacaguguguguauuuaagagacaaugucgcacuguuuugcccaggcugcaguguguugguguaauuauugcucacuguagccuugaacucuuggacacagugguccuccugccuuagcuuccuggguagcugcgacuacaggugugcagcaccacaccuagcuaauuaauuuuuuuugguagaaacaggaucucacuauguuguccagucuggucucaaacuccugggcucaagccaucgucuuggcucagccucccaaagugcucggauuaaccuugugguuuuauccuaaacagcaauaaaugaaugguauucuaauucucugugaagcuaacuuggcuagguugucuuugccugagcuucuuaacuuguccacauaaauaaaucacuauaaucugggguuaacugaguauuccuuggaguuugcaggguucugaaagaaccuaauaaacacacagcuuggugaaaugugaguuauguuucuaaacuuaugaccucuaaaguuauuuguuguuuguauguaagaauaagugguggaaagauaagcccccgaaaauucucgauuaguaauuuauguuaauuguauuuuuucaguauauuauuauagaaagacaggaaagguaaaaggcaccaaauaugacuuuggcugauaauauuucuguuuuuuacucugaauucaagguaaauuagcuauuuuguuuuauuucuucuucuuuuuuuaauaggguuacacaucauuuuggaaugacuguauaucaucuggauuacguggcuguauguuaauugaauuagcauugagaggaagguuacaacuagaggcuuguggaaugagacguaaaagucuauuaacaagaaagguaagaggagugcugaguaacauucuuuuuaaagagguuguacugcuuaaaauguauguuuuuacuaguagccuucaaaaauuaaaguggaaguugauauuaaaguugucuuucuucaauuguauuuccauaucuuuuuugcauucuugguuuccugguucuuucaccuacaaugaguaauguaauugauuguuaagguaaccggccacuggaucuuacaaauucagaaagauucuagacuucauuugcagcuuuuauuuauuuauuuauuuuuaauuuuauuuuauuauuauuauuuuuuauugaucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugacucuuaaggagcaugcugccuucaagcaucuguuuaacaaagcacaucuugcaccgcccuuaauccauucaacccugaguggauacagcacauguuucagagagcacaggguuggguuuaaggucaccgaucaacaggaucccaaggcagaagaauuuuucuuaguguagaacaaaaugaaaagucucccaugucuaccucuuucuacacagacacggcaaccauccgauuucucaaucuuuuccccaccuuuccccacuuucuauuccacaaaaccgcccuugucaucauggcccguucucagugagcuguuggguacaccucccagacggggugguggccgggcagaggggcuccucacuucccaguaggcgcggccgggcagaggcgccccucaccucccggacggggcggcuggccgggcggggggcugaccccccccaccucccuccuggacggggcagcuggccggacagaggggcuccucacuucccaguaggggcggccgggcagaggcgccccucaccucccggacggggcggcuggccaggcggggggcugauccccccaccucccucccggacggggcggcuggccgggcuugggggcugacccccccaccucccucccggacggggcggcuggccgggcagggggcugacccccccaccucccucccggacagggcggcuggccgggcagaguggcuccucacuucccaguaggggcggccgggcagaggcgccccucaccucccggacggggcggcuggcuggguggggggcugacccccccaccucccucccggacgagguggcugccgggcggagacgcuccucacuucccggacgggguggcugcugggcggaggggcuccucacuucucagacggggcggcugccgggcggaggggcuccucacuucucagacggggcgguugccaggcagagggucuccucauuucucagacggggcguccgggcagagaugcuccucacaucccggacggggcggcagggcagaggugcuccccgcaucucagacgaugggcggccgggcagagacgcuccucacuucccagaugugauggcggccgggaagaggcgcuccucacuuccuagaugggauggcggccgggcagagacgcuccucacuuuccagacugggcagccaggcagaggggcuccucacaucccagacgaugggcagccaggcggagacgcuccucacuucccagacgggguggcggccgggcagaggcugcagucucggcacuuugggaggccaaggcaggcugcugggagguggagguuguagcgagccgagaucacgccacugcgcuccagccugggcaccauuuugagcacugagugaacgagacuccgucugcaaucccggcaccucgggaggccgaggcuggcggaucacucgcgguuaggagcuggagaccagcccggccaacacagcgaauccccgucuccaccaaaaaaauacgaaaaccagucaggcguggcggcgcgcgccugcaaucgcaggcacucggcuagcugaggcaggagaaucaggcagggagguugcagugagccgagauggcagcaguaccguccagcuuuggcucggcaucagagggagaccguggaaagagagggagaggagggagaccguggggagagggagagggagagggagagucauuugcagcuuuuaaaagccauaauuuugaaagacuugacauuaaaaacucagaaguguuauugugcaauuuacgcauaggcuauugaucuuuucaucagauuaugaauacuuuucagauaccugucuguugaaggucuguguaggugcuucucuuaauagagguaauauuggcuaguuuuuagaaauuuaacuucaaccucaaucucaaauauuuaauacuguuuuucuuccaguuuguuguuguguuucuugagcaugguguuucaaaacuaguuuuuuuccuaaaucaguguccuaaugaaucuaaaaguuuuagaucagagcggaaugcaucuugauuaauaagcuauagagaauaauaguucuguaggaaagaacaccauucauguaucuuuuuuuuuuuuuuuuuugagacugagucuugcucugucacccaggcuggagugcaguggcgugaucucggcucacugcaaccucugcuucccugguucaagugauuuacgugccucagccucccaaguagcugguacuacaggcgugugcugccacacccagcuaauuuuuguauguuuuguagagaugggguuuugcuauguugccugggcugcucucgaacuccugggcucaagugauccgcucgccuugggccucccaaagugcaaggauuacaggcgugagcuaucaugcccagcccacuguuuucuaguauacagaguugcgguaaagucuggugcccuucugauuuucuuuuccuuuuuuuuuuuuuuuuuggagacagagucucacuccauugccugggcaggagggugguugguaugaucuugguucacugcaaccucugcuuuccaaguagcugggacuacauagguauaugccaccaugucuggcuaauuuuuuuuuuuuuuuucugagacugagugucacucuaucacccaggcuggagugcaguuggugccaucucagcucacuguaaccuccgccucccuaucagccucaagcgauucuccugccucagccucccuaguagcugggacuacaggcaugcaccaccacacccggcuaauuuuuuuuuuuuuuauauguuuaguagagaugggguuucaccauauuggucaggcugguauugaacuccugaccccaaaugauccaccugccucccaaagugcugggauuauaggcguaagccacugugcccagccuccuggcuaauuuuuuuuguuguuuuauuuuuguuagagauaaggucuuacuuuauugcccaggcuggucuugaacgcuuggguucaagugauccucgugccuuguccucccaaagagcugggauuacagacgugagccacugugccgggccuccuucuguuuuuucaaucuuauuuuuuuuuuuuccucuagaagcauuugggaucuucuguuauccuuguugguuuucugaaauuguacgauaugccuuaaugugggucauuuuaaauucauuaugcauuaauuuuuucagucuagaaauguguauauuuugguuuugaaaacuuguauuucugauaucuuuugcccucuuuuucuagaacucuguaaauuggauacggacuucuuggcuacucuuaaagaguugucuucuaaccuuucuguugagauuuuauugugacucuccuguuuuugauuuccaugagcuuccuuuuuaaaaaucguaguuuguuuuauggauguaauaccuucuuuuagauuucugaggguaucacaccucuuuugaaaauuuccuuuaucuguauuauaucuguuucuucagaguucuuauuuucucuuuuugaucucuucuguguuggaagcuuucuuucacguuauccgugauugucuguuuauauuuaggaaugguucccguccccccaaaaaaagaagcuaaauaaaaaugauauguuuggauagaacauauuuauuugugaaccacacuuacuacugaauuuuugaaaggaauuuagaacuaacucgagucauugaaaaguuguaagcagaagcaguggaaugccaugguaagauuugucuguuagaaagaucagugaggagaauggauugaaaaggcuaaaacuuguuuagggaaauuaguuaagaggcuuaaauuaauccaagugaaaaacagccagauuaggcagacuagaauauaguuguuccucaguaucugugggcgauugguucuaggacuccccucaaauaucaaaaucuggaugcucaaguuucuuauauaaaauguuguaguguuugcauauaaccuaugcacauccucuucuauacuuuaugucacccccagauuacuuacaauaccuaauacaauguaaaugcuguauaaacaauuguuauacugcauuuuaaaauuuguauuauuuuuccuggauauuuuugauccucaauugguugaaucuauagauauggaaggccgacuauauuggcaagaugauggagaaaagugaaacauuucagaaagauuuagaggacagaacuucauaagaaaaagugauucacuauacccaggcucuggugucccugacauaagauccguugcaaacggaugugcgugggcgagcuuugaggccaaauugcaauaaauauaaagaaugagugggacguaagaagugguggcaauggccaccauauuuagauguaacuuuuucuccugaggcucugcuuucuuuauuuucuugugcucucucacccuucacugaaagcauggucuagaauagcacuguuugauggaacuuugaugaugaaaaugaucuguauguucaauaugguagcuacuagcuacauacaucuaugagccagacacuuaagcacuugaaguuuggcuacugcacauugacacaugguguuaguaaaaacauacacuggauacacuggauuuuuggucuuaguauggaaaaauauauuaaguaccucaauuuaaaaauacuuauuacauguuaauauuuugguuguauuugguuaaaucaaaauauuaaaauuaauuuugccuuuuuuucuuuuaaaauauaacuacuagaaaauuuaagagcggggagggauagcauuaggagauauaccuaaugcuaaaugacgaguuaaugggugcagcacaccaacauggcucauguauauauacguaacaaaccugcacguuguacacauguacccuaaaacuuaaaguauaauaauaauaaaauaaaauaaaauugaagaauagauuugugacuuguacugugguuuuuauauuucugcuggucaugaugucacagagauagauacuguauguauauauuuuuaauuuuuuauaagauugacaaaguaaaggacacuuugaggacaaguuuaagagaggacucucagcauuuuaaaagugauguuaaauugguggggcacgauggcucaugcuugcaaucccagcacuuugggaggccgagguggacagaucacaaggucaggaguucaagaccagccugcccaacuugaugaaacccugucucuacuaaaaauacaaaaauuacccggaugcgguggugugcaccuguaaucccagcuauuugggagucugaggcaggagaauugcuugaacccuggaggcggagguugcagugagcugagaucacgccauugcacucuaggcugggcaacagagugagacuccaucucaaaaaaaaaaaacaaaaaaaaccguaauguuaaauuuuaugacauuuaaauagcuaacauuauaaaauaauacaauacaauggauuuaauuuugauauuauggaauuuuaacuagaaacuuauagcuuagccaacaacgugaaugaaggcuauaggguucuaauacuugucuacagcgguguaacauuuucccucccaucucucccucuggauuuuuccacuuuuaaaauggauucuauaucucaauguagcuuucuguuuggaaacagauuuuugcucuugucgcccaggcuggagugcaaaggugcgaucucagcucacugcagccuccaccuccuggguucaagcaauucuccugccucagccucccaaguagcuggguuuacaggcaugcgccaccacaccuggcuaauuuuuguauuauuaguagagaccggguuucaccauguuggccaggcuggucucaaacucuugaccucaggugauccacccgccuuggccucccaaagugcugggauuauaggagugagccacugcauccagccucaguguagcuuuuuuuaaaaaaaaguugcaguauuuaaaaaauuuauguaaucaacgcuauugauaauuucuuuaagcuuucugcuagucgggacaauuuuaaaagaaaccuuucagggccaggugcaguggaucauuccugucaucccagcacuuugggaggccgagguggguggauuaccugaggucgggaguuugagaccagccugaccaacauggagaaaccccaucuuuacuaaaaauacaaaauuagccaggcgugguggcacacaccuguuauuccagcuacuuggaaggcugaggcaggagaauugcuuguaccggggagggcagagguuugcagugagccgagauugcgccacugcacuccagccugggugaugagcaaaacuccauuuccaaaaaagaaaaaaaagaaaccaagaaaccuuucuuaccucuauaauuuguuagcaaguuuuaaugacauuuguuuaaaaauuuguuucuucacugaugugaaauaccaccuuuauaauauaagauugaguauccuauaucugaaaugcuugguaacagaaauguuuaagauuuuggaauuuucuggauuuuggaauauuuguauuauacuuaagcauuccugacuucaaaauuuaaaauccagaauguuccaauggaugcauguuggugcucaaaaaguuucagauuuugaaggaguucggauuuucggauuagggacguucagccuguacugaauucuuaaauauaauuuagucuuauuucugggacuaauaauaaugcuuaaaugaauuucuggaucacauaguccaagguucggugaugagucagugaguauaaacuguccuaguauguugcuuuacuaauuauugcacaguagcuuuuuuuuuuuuuuuuaagucggaguuuugcucuuguugcccagucuggaaugcaguggcacaaucucggcccgcugcaaccucugccuccuggguucaagcaauucuccugccucagccuccagaguagcugggauuacaggcaccugccaccacgcccagcuaauuguuuguauuuuuaguagagaugggguuucaucauuuuggccaggcuggucuugaacuccugaccucaggugauccacccgccucggccucccaaggugcugggauuacaggagugagccaccaugcccggccaguagcuugcuuuucuuuucucuuugagauagucucacucuuucguccaggguggagugcagcggcgugaucuuggcuuccugcagccucugccuccuggguucaaaugauucucccaccucagcuacccgaguagcugggauuacaggcgugcaccaccacaccuggcuaauuuuuguauuuuuaguagagacaggguuuugccaugugggccgggcugguaucgaauuccuggcuucaagugaucugcuugccucagccucccccugggauucaggcaugagcuacugagucuagccaauuuucauucauuauuauaucuaaucugguuagguuaaauauuggauuuccuuaacauaaaaguaauuuaaaaucugaacuuugauacuacaugaaagcuugaggcuuuaagcauaaugaauuauuuauauaauuguuuguuuuucauuuaaugagaucaacucagaaaaggcauucguggauccuuucauucuuuuugcuuucuuuuuagguaaucuguaagucagaugcuccaacaggggauguucuucuugaugaagcucugaagcauguuaaggaaacucagccuccagaaacgguccagaacuggauugaauuacuuagugguaagcugcugugaauaaaccaaaaaccaacuucuguuuaaaagauugcgaaguuuaaauccuuuugaaaggaaccuacacaaaauagccagaagcuuguuuaguuauuuaggcaaacuugaaaguuaucagucauagaguggggaaguaaugguuuuuauaaaauuucauucucuuuaacaauacugaacagauauagaaugcgaagauaauacucuuagagcucccauguucuuuaucaaaauuaccacaugcuaccuuaaucuggauaggcuagguuaagcuguggugguaacaaaccccaaaaccucaguugcuuaaaacaaccauuuauuucucauucaggcuguaagucagucacaggcuaccucauccucacucuggcagccaggcagauggagccacugccaccuggagcaguaucagucacuauaauaaaaggaggaauaccauagcacaucacucuggcucuuaaguuucugcuuagaaaugacaugugguucauguuucauugaucagagcaaaucacacaaucuccccuaacuucaaggagacagggaagugcaaccuuagggaggagaacgugaaaaguuuggcugauagcauggaggacugugacguuuauauuaaaguuauuuguguauuaacaugaugugaguuuucuuacagauaagcagaauuuauaaaaguccuauuggauuauucuucugucaguaaaagagguuuuuuuagggguugggggacuagucaagugaaacagugggagugggagggaacaaaaaaaucuaacuugugaucaguuagcuguaaauaacugcuguacuuggaccagcugauuuuauuuauauguauacauaaauauuuuucuuuuuaagagacagggucucacucuguugcccaggcuggagugcaguggcaugauccuaacucacuauaaccuugaacuaaguccuggacucaagugauccacagccucugccucagccucuggaguagcuaagacuacaggugugugccaccaugccucgcugaguuuuuuuuuuuuuuuuuuauuuuauuuuuuggccaggcaugguggcucauuacuguaaucccaguacuuugggaggcugaggcgggugaaucuccugagcucaggaguucaagaccagccugggcaaccuggugaaacccuguuucuaccaaaaaacacaaaagaauuagccagacauaguggcacaugccuguggucccagcuacuuggaaagcugaggugggaggaucgcuugagccuaggagacggagguugcagugagccaagaucaugccacugcacuccaaccugggugacagagugagaccccgucucaagaaaaaaaauuuuuuguagagauaggaccuugcuguguugcucaggcuggucuugagcuccuggccuccaguggugcuucaucaaggcuuccuaaagcccugggacuauaagcaugaaucaccaugcucagucuauauuuauuuguuuauuuaaaaauuaaguacauacacuccauuuuuagcuaacggcaauaaugggcacuuuacacuuaaggcaagguucauuauuuuuucuuauugguaagaacguaaacguauucuugauaaauuugcauuuuuguuggauaacccucuucuaccucugauaauuuuccuuuuuaucucauugagaguaacucugacuuauacuuuccccccuuuaugcuuauuagaguugucuucaguuguaauuucuuuugcaagaaucuuuuaaaauugcuuugcccauuugaugagggcuuguuugguuaaaacuagauuauauuaucagcaaauucacuuaaucaucacaaauacccaucacauugucaaugcugucugaguuagccucccauguaugccugucagugacaugcagccaucuaacagagacucagggcauuaaugucaacucuauauguuaaauauuaguaaacauaauguuuuaaaauagaaauagaacugcuaauaacguuuauacugugauggaucauuuuguacauuguuuucagagcacuggcuuaaccagucuuuggaucuuucucauguugugcugccaguguuggcccaugacugcuucugguguugcaaauuagaauuuguaauuugguucccagcugaccaaaagaaggguuucucaaaguuguggugacuuuuuuuguuagauguguuacaguguuaaagauucuuuuuauggaauguagagugggcuuugccuucacuuuccuguuacugaaaugcaucuuacacuuaaccuguuaaguaacauuuuguaaaugaagcuuaucaauauaaaugcuaacugaacuugguucucaccuauggcugcuguugcacuguccccacuugauuaagcagugaaaagaugagaagucuaaaagcuuuucucacaaguauguaaacacaguuaggauuuuguaaagcacugucuguuuggauuagaaauuuggguaaaaugugaaacuaauacuuagcaagguuuuuuaaaaaacaauguccugugaguuuuagauuggcuguugaugccagaacauugccuguagcacuugaguugcuugcucuugacauacauugggaaugcugcugcuucagaauaaaggaagggaauccagagugggagaaggaggaaaaaggacuuuuuuuaaaguuaaaaaaauuaaaaaaaaucuccuggcaaauaacauguaaaaagaagaaaauaaaaaauaucuauuucccaccuaauugaaaguaucaagauaccagcuugcugauuuuuuaauuguaguaaaauauauauaauguaacuuuuaccauuuuuaccauuuuuaagcauacaguucuuuggcuagcuugcugauuuuuagauuuuuaaaaauuuucuguugcuucaauauaauaugugguaucaaacaccaguuauugcaccaauaaugacauaugugcuaugaaauuuaaaaugugcucucagacugaaagaaucuuaaaauccauuuggggaacaguuuuauacaucuaauaauuugauagaacagaugagaguuugacaguaugguucucugaaaguucaguaguucagagaaaagaaaaauccuugggaacuuuaguaguuacaagaggaaguggagcuuagauuaggccuuugaaggguaagaaugagaugcaaagaaagaaauauacuuguucagagggauuccuugccgugaagccaaggaauguuuuaauaaagaacaguuucuuuaccugggguggaggauacccaggggcucauuuuauuauuauuuauacuguacauguauacauguuaaaacucuugauaaauuuuaaacauuuucuaauaauuuaaaauuaguauacauaaguuugaggcaagucgagagacuacguauuuuguuuguuuuguuuugucuuugggacaaagucucgccaucacccaggcuguagugcaguggugcagucacagcucacugcagucuugaccucccaggcucaguugauccuccugccuuagccucccaaguagcugggacuacaggcaugugccaccacgcccagcuaauuuuuguauuuuuuuguagagaugggguuucaucauguugcccaggcuaagacuacuguuuaagaauaguuuuuagcuucugaaaucuuaaggcaugguugaucaguuuggucacaaggaaucacuacacugccaaauuuauggccaaagcugcuuuuaguuuuguaagaugaugucaaggaagauaaguguucuuugcagugaaaugauuuagguaccugucagcaugucauucuccaccaaagugauuguugggcaguggacaugaauaaucuuugaagaacuuuuccucuccguauuuacuucucacaauuuccuuuaccaaaaaaaguaaacuaugaauagauucauuacauuuuaaauuugcuuguauaacuuguaaagucuuuucacauauauggugaauaauuuagggacugaggacuaacagcauggaucgcaguaacgucuuuuaaucuagaauucaagaacuauucauuuaucaagcauuuauuucaaaguauuuaaaaaguauucacuuuuaaaaauugaaguagcuaaaucuuuagaagcuaaacuuuuauugcaucuucuccucagaaauccaucuauugucuuccuaucccacuuauacugaugucuuacuuacgcuaaacucaggugugacuuuauucuuuugauuuagcuuaguucuucgaaaauaaaaggcagaaauuccagaauaccaagauacuuugaccacuugguuauuacuuugugccuuuuuucuauaccacaaauacuauuaaacaacauuugggauauuuccucacaguuuuagccuucugcucgugagauuucuuuauuuuucucuaauacuugaggagaucugaauaaccgucuauuuguuggagugagcacacgggguuuacccucuucccagggaauugcuacaagagaagaugauagcugggucccuuuuuauugcuuccuuugagucagaaaugauugccaguaggaagggccagucauaaguggaauacuuuauuugaagguggucuguguuuaggcucuucuaauuuuuaguagaaacauuaaacuguaaguuaguauacuuuggaauugggaaauuuccacaggaacuucuguaaaauuuacuaagcauguauuuccacugguugcaauauguaaguuuuaacuaaggauaaggugaggauaaaccuuagcauaaguucaguauaagagacaguagucauaaacuauuaaucccacuuaauucccaugagaaaaaaaaauauuguagaacagcauuagagggauguguguauaggggaggggguguuuuuuuuggguggggaguggaaagcugcaaagagaaguuuaacuguagaucucucagaauaauucguuucuugacuuuuuuuuccccucuguuguuuggcaguagauguuguuuggcuaagaugucucuggaguauagaauuccuuccuauuugacuugggaagguaaaauaaaaauggauagcuugggagucauuuauucugcuauacuuagguuuugugacaacauaaacauauuaagucagugauaccaaauuagaguugauaggggauaauacuucuuugauaacaacaaauuauucuuuacauaauuaauuaaucuuaggauugaacuguaguuuuuuaaauaggcuuuuauguaaguuuggcuguuuauuauuuuauguugcauuaguuuaaauuucccuaagucguuuaacacaauaguuacccaauuccagccuagugucuuaggcugccuaacaccugccauugacauuagaaaaagcaaaacucauacuagugaaagaugcagcaguuauuuauuggugggacauuggguuuacacaauuauaaaaaaauggaaguggcugggugcgguggcucaugccuguaaucccagcauuuugggaggcccagguggguggaucacgaugucaggagaucgagaccauccuggcuaacacggugaaaccccaucucuacuaaaaauacaaaaaauuagcugggcaugguggcaggugccuguagucccagcuacuugggagggugaggcaggagaaugacgugaacccaggaggcggagcuugcagugagcccugaucacaccaccgcacuccagccugggcgacagagugagacuccgucucaaaaaaaaaaaaggguggaaguuacacacuuuugaaagaugugugccucuacuccagggcuuauucuauucugcugccuauguacuuuguuguuucuuuugccuggaauucaggcuucucucccuuucguaggauguggugaauccugcuggauuucgagauuuagcuugaagauucuuuuuuucuauaacuuuccuaugaaauaccccauaacauuaaaccagagucauuucuuacuccucuaggcacuuuguucauuuuguucuuauggcccuauucccauuuucuucuggccaguauaguuaguucuaauauguaauauauuaugaauguuauuuucacuugauuuuaaauuccuacaggguuagaaguauauccuaauguuuguauucucaguaccuaacaggauucuuagaacauuauaaauacuauaaauucugccagaauguuuauucugcacaugggcaaauaauagcuaacauuuacugagagcuuaccauguguuaggcuucguucuaagaacuugauauuuaauccucguaauagcccuaugagcuugauaaauuuguuacuuucacuuuauagaugaguaaauggagaaauagauuaagaugacuugcacuaggacacuaggguuuuuuugguuuuguuuuuuggggguuuuuuuguuuuuguuuuugagacagucuugugcuugucacccaggcuagagugcaguggugcaaucucggcucacugcaaccuccgccucccggguucaagcgauucuccugccucagccucccgaguagcugggauuacagccaccugcuaccaugccuggcuaauuuuuguauuuuuaguagagacaggguuucaccaucuuggcuucccaaagugcugggauuacaagcguaacccgccaugccuggccccggcuaacuuuuguauuuuuuguagagacgggauuucaccauguugcccaggcugggacuguuucuguugacuccccccuuaccccuaguuuuaggucacuuuuuugcugcuuugcaaguuuagugauuuuuuuuuuuuuuuaacuucgaugcuggacagugugaauguuaagugaugaauuuuauggucuuucuuuaaagaguguugaauuuugucuugguaggcagcuaaguuacuuguggaucaacuuguuuuuaauuuuuuguuuuuguuuuuaaauugugagauggaguuucacucuuguugccuagguuggagagcaauggcacgaucucggcucacugcaaccucugcccucccccgguuuaaaugauucuccugccucagccguccgaguagcugagauuacaggcaacugccacgaugcccggcuaauuuuuugcaguuguagaagagaugggguuucaccauguuggccaggcuagucucgaacuccugaccucaggugauccacccgucugggcuacccacagugcugggauuacagguuugagccaccgcgccuggccgcuuuuaaucuuuauuagggcaugucuaggguggucuauacucuaggacugguuuagcccuacuacuaagaugugaauuuucuaguauuccuucugaauguccugguuuuuagugaggcuuuugcucucuggcuaguuggcaaucacauuuuucccagcucuacugaacucuuagaauuguucacuuucugguagguguucuuugccuagcuuuguggaauuucucacccuaacacauguagcuuuagcuuucagcccaagacucaaggaacaccuugcagauuucuagaccucuuuaucuguguaggucccccuucuccaguagucugcuuugcacacugcagcugccuuagcuacccugaacucugaucucugcugccuuaacgugaugggacugcugugcucugcuuggguucuuccugccugcucugcugccugggacgugccucuaggugguaagcuuaggcaguugucaggcucacauaggcugcacucaagugucacaguucugggcugcuuuugacuagugucugaaaacaguuuuuucguauauuuuauggagauuucuaauuacaaugagagggcagcuuuaggaaugauuacuucaucauaggccuauguuguuuaguauuaaguauaggaaaauaauugugucucuguccaguugaaugguaauauauuuuaagacagcaacuuaaaauuuuaagauaguccgcuagaacuuucuuugaugaugaaaauguucuguuccugugggguguagccacuggccauacgucacuauuguauacgugaaauguggcuagugccacugaagagaugaauuuuuaaauuaauuuaaauagcucuauguggguaauggcuccuguaauggacaguguggcugaagguuuucucucaguauuagaaaaucucgaccuuacaacguuugcauuuaaaaaagaugccugugguugaucuuuaacauauucuaauuuagaaaaauauaguuuuuuuaaguauaaaaauaguugcauguucauuggagaucauuuggaaaaugcagaaagcacaaaaaaaguugagcacacauaaucccaaagauaaguaagauuaauauuuugguguauuuccuuccaguuuucuauaaagaagaacccacuuuagugaaaaaucguuugguuuuauuuuaaauauuucucucucaaaaggaaauauguauggauggcaagguuaaaauugugaaaauuuguauccuuccagaauuagcuuuauauuguuaucaaauaauagcauggccuaaacaggcuuuccuaccucuauaggcuguauauguguagcaguuucaggaauaacauauuaaucaggaagcuuuuuuuuuuagucuauuaguugcagacugguguuuaauagaaaacuuauuuggcuauuggcugcuuuuugacuucagcuggaaggaagcucaaacauaauauuuggcucauuuccacauaagacuaaggguuacugacucuggucugaagacugcuugcaguuuagucgucugagugacuccuguggcugaggaugugcugggugcuuagaauccaaaggucuggcuaggcuuaagggguucauggucuaguuagggagaaaaacauggcagauuuucuucuguuuuucuuggggcaaaaucagauuuuacuguuuaauaguacaaaauuuuugcaaaauuagcagauaauacucaucauuucuaacuucugaaaucuuuuguuuaggugagacauggaauccauuaaaauugcauuaucaguuaagaaauguacgggaacgauuagcuaaaaaccugguggaaaaggguguauugacaacagagaaacagaacuuccuacuuuuugacaugacaacacauccccucaccaauaacaacauuaagcagcgccucaucaagaaaguacaggaagccguucuugacaaaugggugaaugacccucaccgcauggacaggcgcuugcuggcccucauuuaccuggcucaugccucggacguccuggagaaugcuuuugcuccucuucuggacgagcaguaugauuuggcuaccaagagagugcggcagcuucucgacuuagacccugaaguggaaugucugaaggccaacaccaaugagguucugugggcggugguggcggcguucaccaaguaacucugcucggggugaaccauucuccuuucucucaaguaaaccaguaguuuuucuucuguugacuucugguuuucuguaauuuguacuuucccacacuauaauuggcuucuguuuuacaaaaugguggguggcuuuuucuuuuuuguacguguacaggauucugcugguacgagaggccuuccucuuucuguuuuuaaaaaaaguuuuacugccauauuggcauuccauucccuguugccauccucacuguuaccuguuuuggguuucuggucuacuuugacuuucaaaguaccuccagccuccucauacgcacagcuuuuggaugaccucagcuugaguuucuccauaugugcauguacaucuagcauucugccuacaguucagacagaagucacaaaaaggccuucaacucaccaaagguaaauaucuguaucuauuaggacauuuuuuacauagacuucaguugagauguauacuuagcaaaauuauuuuuaaauugaaacagcacaguaaauacuuaauauaaaaugucccuuggauuuugcuucccauguaaaucuauuguauuauuacacuuguuauaauuuuaacuauaaagguccaauuguuucacagagccaguuugggaugggcugcauuccauuuaugcuguauauaguuugaauuauauauaaauuaccccuucuucuggccaccccugcucccaucuuaguauuuugcaagaucuaaucaguuguacaccuggugccccucgcuugcuucaaucaugguuauuugauggcaaaaucgaccucuugucgcugaaggagagagaaaagaugugugucugauugguccugggauuuuuugagcugugccauuuaugguacucuuugccuaugcauccccuuguuagauuuuuuuuaaauuuuaucuuacuguuuuuauaauuucuauugggaagaggcuugugaccaguaccaaucuugaguuucuuuuucuguccacaaguaaauuaauaucugcucugaaaugucauuuaucuacucacacauucuuggggaaaaaaaucaaaugucaguccuagcagauguugcauguaaauugguagcaaguaaugauuacaacccagaggauuaagaauuuuguaacagaaagcucuauguuuuaauuuuuuauauacaauuaggauaauuagcauugucagacuauaaaccuuugcuuuuuaaaguuuauuuuuacuauuucuuuaucacuuuauuguaucaucaccauugguuucauaauguaaauacuauauguugaacaaauuaaaugucaaaauuuuuuauuaccauaguccauguuaauaguggggcuuucagguguuuagagauuuuuuuuguuguuguuaacauucauugcaaaaguacuagaugguguauaacucuagaguugaauuuuaagggauucccuaauauguauacuaucuuuuuaucugaaguaauaaauaaacaaugaucuugaaagugccug

SEQ ID NO: 192535 - RNA, 49602 nt, Homo sapiens
caggcacuuucaagaucauuguuuauuuauuacuucagauaaaaagauaguauacauauuagggaaucccuuaaaauucaacucuagaguuauacaccaucuaguacuuuugcaaugaauguuaacaacaacaaaaaaaaucucuaaacaccugaaagccccacuauuaacauggacuaugguaauaaaaaauuuugacauuuaauuuguucaacauauaguauuuacauuaugaaaccaauggugaugauacaauaaagugauaaagaaauaguaaaaauaaacuuuaaaaagcaaagguuuauagucugacaaugcuaauuauccuaauuguauauaaaaaauuaaaacauagagcuuucuguuacaaaauucuuaauccucuggguuguaaucauuacuugcuaccaauuuacaugcaacaucugcuaggacugacauuugauuuuuuuccccaagaaugugugaguagauaaaugacauuucagagcagauauuaauuuacuuguggacagaaaaagaaacucaagauugguacuggucacaagccucuucccaauagaaauuauaaaaacaguaagauaaaauuuaaaaaaaaucuaacaaggggaugcauaggcaaagaguaccauaaauggcacagcucaaaaaaucccaggaccaaucagacacacaucuuuucucucuccuucagcgacaagaggucgauuuugccaucaaauaaccaugauugaagcaagcgaggggcaccagguguacaacugauuagaucuugcaaaauacuaagaugggagcagggguggccagaagaagggguaauuuauauauaauucaaacuauauacagcauaaauggaaugcagcccaucccaaacuggcucugugaaacaauuggaccuuuauaguuaaaauuauaacaaguguaauaauacaauagauuuacaugggaagcaaaauccaagggacauuuuauauuaaguauuuacugugcuguuucaauuuaaaaauaauuuugcuaaguauacaucucaacugaagucuauguaaaaaauguccuaauagauacagauauuuaccuuuggugaguugaaggccuuuuugugacuucugucugaacuguaggcagaaugcuagauguacaugcacauauggagaaacucaagcugaggucauccaaaagcugugcguaugaggaggcuggagguacuuugaaagucaaaguagaccagaaacccaaaacagguaacagugaggauggcaacagggaauggaaugccaauauggcaguaaaacuuuuuuuaaaaacagaaagaggaaggccucucguaccagcagaauccuguacacguacaaaaaagaaaaagccacccaccauuuuguaaaacagaagccaauuauagugugggaaaguacaaauuacagaaaaccagaagucaacagaagaaaaacuacugguuuacuugagagaaaggagaaugguucaccccgagcagaguuacuuggugaacgccgccaccaccgcccacagaaccucauugguguuggccuucagacauuccacuucagggucuaagucgagaagcugccgcacucucuugguagccaaaucauacugcucguccagaagaggagcaaaagcauucuccaggacguccgaggcaugagccagguaaaugagggccagcaagcgccuguccaugcggugagggucauucacccauuugucaagaacggcuuccuguacuuucuugaugaggcgcugcuuaauguuguuauuggugaggggauguguugucaugucaaaaaguaggaaguucuguuucucuguugucaauacacccuuuuccaccagguuuuuagcuaaucguucccguacauuucuuaacugauaaugcaauuuuaauggauuccaugucucaccuaaacaaaagauuucagaaguuagaaaugaugaguauuaucugcuaauuuugcaaaaauuuuguacuauuaaacaguaaaaucugauuuugccccaagaaaaacagaagaaaaucugccauguuuuucucccuaacuagaccaugaaccccuuaagccuagccagaccuuuggauucuaagcacccagcacauccucagccacaggagucacucagacgacuaaacugcaagcagucuucagaccagagucaguaacccuuagucuuauguggaaaugagccaaauauuauguuugagcuuccuuccagcugaagucaaaaagcagccaauagccaaauaaguuuucuauuaaacaccagucugcaacuaauagacuaaaaaaaaaagcuuccugauuaauauguuauuccugaaacugcuacacauauacagccuauagagguaggaaagccuguuuaggccaugcuauuauuugauaacaauauaaagcuaauucuggaaggauacaaauuuucacaauuuuaaccuugccauccauacauauuuccuuuugagagagaaauauuuaaaauaaaaccaaacgauuuuucacuaaaguggguucuucuuuauagaaaacuggaaggaaauacaccaaaauauuaaucuuacuuaucuuugggauuaugugugcucaacuuuuuuugugcuuucugcauuuuccaaaugaucuccaaugaacaugcaacuauuuuuauacuuaaaaaaacuauauuuuucuaaauuagaauauguuaaagaucaaccacaggcaucuuuuuuaaaugcaaacguuguaaggucgagauuuucuaauacugagagaaaaccuucagccacacuguccauuacaggagccauuacccacauagagcuauuuaaauuaauuuaaaaauucaucucuucaguggcacuagccacauuucacguauacaauagugacguauggccaguggcuacaccccacaggaacagaacauuuucaucaucaaagaaaguucuagcggacuaucuuaaaauuuuaaguugcugucuuaaaauauauuaccauucaacuggacagagacacaauuauuuuccuauacuuaauacuaaacaacauaggccuaugaugaaguaaucauuccuaaagcugcccucucauuguaauuagaaaucuccauaaaauauacgaaaaaacuguuuucagacacuagucaaaagcagcccagaacugugacacuugagugcagccuaugugagccugacaacugccuaagcuuaccaccuagaggcacgucccaggcagcagagcaggcaggaagaacccaagcagagcacagcagucccaucacguuaaggcagcagagaucagaguucaggguagcuaaggcagcugcagugugcaaagcagacuacuggagaagggggaccuacacagauaaagaggucuagaaaucugcaagguguuccuugagucuugggcugaaagcuaaagcuacauguguuagggugagaaauuccacaaagcuaggcaaagaacaccuaccagaaagugaacaauucuaagaguucaguagagcugggaaaaaugugauugccaacuagccagagagcaaaagccucacuaaaaaccaggacauucagaaggaauacuagaaaauucacaucuuaguaguagggcuaaaccaguccuagaguauagaccacccuagacaugcccuaauaaagauuaaaagcggccaggcgcgguggcucaaaccuguaaucccagcacuguggguagcccagacggguggaucaccugaggucaggaguucgagacuagccuggccaacauggugaaaccccaucucuucuacaacugcaaaaaauuagccgggcaucguggcaguugccuguaaucucagcuacucggacggcugaggcaggagaaucauuuaaaccgggggagggcagagguugcagugagccgagaucgugccauugcucuccaaccuaggcaacaagagugaaacuccaucucacaauuuaaaaacaaaaacaaaaaauuaaaaacaaguugauccacaaguaacuuagcugccuaccaagacaaaauucaacacucuuuaaagaaagaccauaaaauucaucacuuaacauucacacuguccagcaucgaaguuaaaaaaaaaaaaaaaucacuaaacuugcaaagcagcaaaaaagugaccuaaaacuagggguaaggggggagucaacagaaacagucccagccugggcaacauggugaaaucccgucucuacaaaaaauacaaaaguuagccggggccaggcauggcggguuacgcuuguaaucccagcacuuugggaagccaagauggugaaacccugucucuacuaaaaauacaaaaauuagccaggcaugguagcagguggcuguaaucccagcuacucgggaggcugaggcaggagaaucgcuugaacccgggaggcggagguugcagugagccgagauugcaccacugcacucuagccugggugacaagcacaagacugucucaaaaacaaaaacaaaaaaacccccaaaaaacaaaaccaaaaaaacccuaguguccuagugcaagucaucuuaaucuauuucuccauuuacucaucuauaaagugaaaguaacaaauuuaucaagcucauagggcuauuacgaggauuaaauaucaaguucuuagaacgaagccuaacacaugguaagcucucaguaaauguuagcuauuauuugcccaugugcagaauaaacauucuggcagaauuuauaguauuuauaauguucuaagaauccuguuagguacugagaauacaaacauuaggauauacuucuaacccuguaggaauuuaaaaucaagugaaaauaacauucauaauauauuacauauuagaacuaacuauacuggccagaagaaaaugggaauagggccauaagaacaaaaugaacaaagugccuagaggaguaagaaaugacucugguuuaauguuaugggguauuucauaggaaaguuauagaaaaaaagaaucuucaagcuaaaucucgaaauccagcaggauucaccacauccuacgaaagggagagaagccugaauuccaggcaaaagaaacaacaaaguacauaggcagcagaauagaauaagcccuggaguagaggcacacaucuuucaaaaguguguaacuuccacccuuuuuuuuuuuugagacggagucucacucugucgcccaggcuggagugcgguggugugaucagggcucacugcaagcuccgccuccuggguucacgucauucuccugccucacccucccaaguagcugggacuacaggcaccugccaccaugcccagcuaauuuuuuguauuuuuaguagagaugggguuucaccguguuagccaggauggucucgaucuccugacaucgugauccacccaccugggccucccaaaaugcugggauuacaggcaugagccaccgcacccagccacuuccauuuuuuuauaauuguguaaacccaaugucccaccaauaaauaacugcugcaucuuucacuaguaugaguuuugcuuuuucuaaugucaauggcagguguuaggcagccuaagacacuaggcuggaauuggguaacuauuguguuaaacgacuuagggaaauuuaaacuaaugcaacauaaaauaauaaacagccaaacuuacauaaaagccuauuuaaaaaacuacaguucaauccuaagauuaauuaauuauguaaagaauaauuuguuguuaucaaagaaguauuauccccuaucaacucuaauuugguaucacugacuuaauauguuuauguugucacaaaaccuaaguauagcagaauaaaugacucccaagcuauccauuuuuauuuuaccuucccaagucaaauaggaaggaauucuauacuccagagacaucuuagccaaacaacaucuacugccaaacaacagaggggaaaaaaaagucaagaaacgaauuauucugagagaucuacaguuaaacuucucuuugcagcuuuccacuccccacccaaaaaaaacacccccuccccuauacacacaucccucuaaugcuguucuacaauauuuuuuuuucucaugggaauuaagugggauuaauaguuuaugacuacugucucuuauacugaacuuaugcuaagguuuauccucaccuuauccuuaguuaaaacuuacauauugcaaccaguggaaauacaugcuuaguaaauuuuacagaaguuccuguggaaauuucccaauuccaaaguauacuaacuuacaguuuaauguuucuacuaaaaauuagaagagccuaaacacagaccaccuucaaauaaaguauuccacuuaugacuggcccuuccuacuggcaaucauuucugacucaaaggaagcaauaaaaagggacccagcuaucaucuucucuuguagcaauucccugggaagaggguaaaccccgugugcucacuccaacaaauagacgguuauucagaucuccucaaguauuagagaaaaauaaagaaaucucacgagcagaaggcuaaaacugugaggaaauaucccaaauguuguuuaauaguauuugugguauagaaaaaaggcacaaaguaauaaccaaguggucaaaguaucuugguauucuggaauuucugccuuuuauuuucgaagaacuaagcuaaaucaaaagaauaaagucacaccugaguuuagcguaaguaagacaucaguauaagugggauaggaagacaauagauggauuucugaggagaagaugcaauaaaaguuuagcuucuaaagauuuagcuacuucaauuuuuaaaagugaauacuuuuuaaauacuuugaaauaaaugcuugauaaaugaauaguucuugaauucuagauuaaaagacguuacugcgauccaugcuguuaguccucagucccuaaauuauucaccauauaugugaaaagacuuuacaaguuauacaagcaaauuuaaaauguaaugaaucuauucauaguuuacuuuuuuugguaaaggaaauugugagaaguaaauacggagaggaaaaguucuucaaagauuauucauguccacugcccaacaaucacuuugguggagaaugacaugcugacagguaccuaaaucauuucacugcaaagaacacuuaucuuccuugacaucaucuuacaaaacuaaaagcagcuuuggccauaaauuuggcaguguagugauuccuugugaccaaacugaucaaccaugccuuaagauuucagaagcuaaaaacuauucuuaaacaguagucuuagccugggcaacaugaugaaaccccaucucuacaaaaaaauacaaaaauuagcugggcgugguggcacaugccuguagucccagcuacuugggaggcuaaggcaggaggaucaacugagccugggaggucaagacugcagugagcugugacugcaccacugcacuacagccugggugauggcgagacuuugucccaaagacaaaacaaaacaaacaaaauacguagucucucgacuugccucaaacuuauguauacuaauuuuaaauuauuagaaaauguuuaaaauuuaucaagaguuuuaacauguauacauguacaguauaaauaauaauaaaaugagccccuggguauccuccaccccagguaaagaaacuguucuuuauuaaaacauuccuuggcuucacggcaaggaaucccucugaacaaguauauuucuuucuuugcaucucauucuuacccuucaaaggccuaaucuaagcuccacuuccucuuguaacuacuaaaguucccaaggauuuuucuuuucucugaacuacugaacuuucagagaaccauacugucaaacucucaucuguucuaucaaauuauuagauguauaaaacuguuccccaaauggauuuuaagauucuuucagucugagagcacauuuuaaauuucauagcacauaugucauuauuggugcaauaacugguguuugauaccacauauuauauugaagcaacagaaaauuuuuaaaaaucuaaaaaucagcaagcuagccaaagaacuguaugcuuaaaaaugguaaaaaugguaaaaguuacauuauauauauuuuacuacaauuaaaaaaucagcaagcugguaucuugauacuuucaauuaggugggaaauagauauuuuuuauuuucuucuuuuuacauguuauuugccaggagauuuuuuuuaauuuuuuuaacuuuaaaaaaaguccuuuuuccuccuucucccacucuggauucccuuccuuuauucugaagcagcagcauucccaauguaugucaagagcaagcaacucaagugcuacaggcaauguucuggcaucaacagccaaucuaaaacucacaggacauuguuuuuuaaaaaaccuugcuaaguauuaguuucacauuuuacccaaauuucuaauccaaacagacagugcuuuacaaaauccuaacuguguuuacauacuugugagaaaagcuuuuagacuucucaucuuuucacugcuuaaucaaguggggacagugcaacagcagccauaggugagaaccaaguucaguuagcauuuauauugauaagcuucauuuacaaaauguuacuuaacagguuaaguguaagaugcauuucaguaacaggaaagugaaggcaaagcccacucuacauuccauaaaaagaaucuuuaacacuguaacacaucuaacaaaaaaagucaccacaacuuugagaaacccuucuuuuggucagcugggaaccaaauuacaaauucuaauuugcaacaccagaagcagucaugggccaacacuggcagcacaacaugagaaagauccaaagacugguuaagccagugcucugaaaacaauguacaaaaugauccaucacaguauaaacguuauuagcaguucuauuucuauuuuaaaacauuauguuuacuaauauuuaacauauagaguugacauuaaugcccugagucucuguuagauggcugcaugucacugacaggcauacaugggaggcuaacucagacagcauugacaaugugauggguauuugugaugauuaagugaauuugcugauaauauaaucuaguuuuaaccaaacaagcccucaucaaaugggcaaagcaauuuuaaaagauucuugcaaaagaaauuacaacugaagacaacucuaauaagcauaaaggggggaaaguauaagucagaguuacucucaaugagauaaaaaggaaaauuaucagagguagaagaggguuauccaacaaaaaugcaaauuuaucaagaauacguuuacguucuuaccaauaagaaaaaauaaugaaccuugccuuaaguguaaagugcccauuauugccguuagcuaaaaauggaguguauguacuuaauuuuuaaauaaacaaauaaauauagacugagcauggugauucaugcuuauagucccagggcuuuaggaagccuugaugaagcaccacuggaggccaggagcucaagaccagccugagcaacacagcaagguccuaucucuacaaaaaauuuuuuuucuugagacggggucucacucugucacccagguuggagugcaguggcaugaucuuggcucacugcaaccuccgucuccuaggcucaagcgauccucccaccucagcuuuccaaguagcugggaccacaggcaugugccacuaugucuggcuaauucuuuuguguuuuuugguagaaacaggguuucaccagguugcccaggcuggucuugaacuccugagcucaggagauucacccgccucagccucccaaaguacugggauuacaguaaugagccaccaugccuggccaaaaaauaaaauaaaaaaaaaaaaaaaaaacucagcgaggcaugguggcacacaccuguagucuuagcuacuccagaggcugaggcagaggcuguggaucacuugaguccaggacuuaguucaagguuauagugaguuaggaucaugccacugcacuccagccugggcaacagagugagacccugucucuuaaaaagaaaaauauuuauguauacauauaaauaaaaucagcugguccaaguacagcaguuauuuacagcuaacugaucacaaguuagauuuuuuuguucccucccacucccacuguuucacuugacuagucccccaaccccuaaaaaaaccucuuuuacugacagaagaauaauccaauaggacuuuuauaaauucugcuuaucuguaagaaaacucacaucauguuaauacacaaauaacuuuaauauaaacgucacaguccuccaugcuaucagccaaacuuuucacguucuccucccuaagguugcacuucccugucuccuugaaguuaggggagauugugugauuugcucugaucaaugaaacaugaaccacaugucauuucuaagcagaaacuuaagagccagagugaugugcuaugguauuccuccuuuuauuauagugacugauacugcuccagguggcaguggcuccaucugccuggcugccagagugaggaugagguagccugugacugacuuacagccugaaugagaaauaaaugguuguuuuaagcaacugagguuuugggguuuguuaccaccacagcuuaaccuagccuauccagauuaagguagcaugugguaauuuugauaaagaacaugggagcucuaagaguauuaucuucgcauucuauaucuguucaguauuguuaaagagaaugaaauuuuauaaaaaccauuacuuccccacucuaugacugauaacuuucaaguuugccuaaauaacuaaacaagcuucuggcuauuuuguguagguuccuuucaaaaggauuuaaacuucgcaaucuuuuaaacagaaguugguuuuugguuuauucacagcagcuuaccacuaaguaauucaauccaguucuggaccguuucuggaggcugaguuuccuuaacaugcuucagagcuucaucaagaagaacauccccuguuggagcaucugacuuacagauuaccuaaaaagaaagcaaaaagaaugaaaggauccacgaaugccuuuucugaguugaucucauuaaaugaaaaacaaacaauuauauaaauaauucauuaugcuuaaagccucaagcuuucauguaguaucaaaguucagauuuuaaauuacuuuuauguuaaggaaauccaauauuuaaccuaaccagauuagauauaauaaugaaugaaaauuggcuagacucaguagcucaugccugaaucccagggggaggcugaggcaagcagaucacuugaagccaggaauucgauaccagcccggcccacauggcaaaacccugucucuacuaaaaauacaaaaauuagccaggugugguggugcacgccuguaaucccagcuacucggguagcugaggugggagaaucauuugaacccaggaggcagaggcugcaggaagccaagaucacgccgcugcacuccacccuggacgaaagagugagacuaucucaaagagaaaagaaaagcaagcuacuggccgggcaugguggcucacuccuguaaucccagcaccuugggaggccgaggcggguggaucaccugaggucaggaguucaagaccagccuggccaaaaugaugaaaccccaucucuacuaaaaauacaaacaauuagcugggcgugguggcaggugccuguaaucccagcuacucuggaggcugaggcaggagaauugcuugaacccaggaggcagagguugcagcgggccgagauugugccacugcauuccagacugggcaacaagagcaaaacuccgacuuaaaaaaaaaaaaaaaagcuacugugcaauaauuaguaaagcaacauacuaggacaguuuauacucacugacucaucaccgaaccuuggacuaugugauccagaaauucauuuaagcauuauuauuagucccagaaauaagacuaaauuauauuuaagaauucaguacaggcugaacgucccuaauccgaaaauccgaacuccuucaaaaucugaaacuuuuugagcaccaacaugcauccauuggaacauucuggauuuuaaauuuugaagucaggaaugcuuaaguauaauacaaauauuccaaaauccagaaaauuccaaaaucuuaaacauuucuguuaccaagcauuucagauauaggauacucaaucuuauauuauaaaggugguauuucacaucagugaagaaacaaauuuuuaaacaaaugucauuaaaacuugcuaacaaauuauagagguaagaaagguuucuugguuucuuuuuuuucuuuuuuggaaauggaguuuugcucaucacccaggcuggagugcaguggcgcaaucucggcucacugcaaaccucugcccuccccgguacaagcaauucuccugccucagccuuccaaguagcuggaauaacaggugugugccaccacgccuggcuaauuuuguauuuuuaguaaagaugggguuucuccauguuggucaggcuggucucaaacucccgaccucagguaauccacccaccucggccucccaaagugcugggaugacaggaaugauccacugcaccuggcccugaaagguuucuuuuaaaauugucccgacuagcagaaagcuuaaagaaauuaucaauagcguugauuacauaaauuuuuuaaauacugcaacuuuuuuuuaaaaaaagcuacacugaggcuggaugcaguggcucacuccuauaaucccagcacuuugggaggccaaggcggguggaucaccugaggucaagaguuugagaccagccuggccaacauggugaaacccggucucuacuaauaauacaaaaauuagccaggugugguggcgcaugccuguaaacccagcuacuugggaggcugaggcaggagaauugcuugaacccaggagguggaggcugcagugagcugagaucgcaccuuugcacuccagccugggcgacaagagcaaaaaucuguuuccaaacagaaagcuacauugagauauagaauccauuuuaaaaguggaaaaauccagagggagagaugggagggaaaauguuacaccgcuguagacaaguauuagaacccuauagccuucauucacguuguuggcuaagcuauaaguuucuaguuaaaauuccauaauaucaaaauuaaauccauuguauuguauuauuuuauaauguuagcuauuuaaaugucauaaaauuuaacauuacgguuuuuuuuguuuuuuuuuuuugagauggagucucacucuguugcccagccuagagugcaauggcgugaucucagcucacugcaaccuccgccuccaggguucaagcaauucuccugccucagacucccaaauagcugggauuacaggugcacaccaccgcauccggguaauuuuuguauuuuuaguagagacaggguuucaucaaguugggcaggcuggucuugaacuccugaccuugugaucuguccaccucggccucccaaagugcugggauugcaagcaugagccaucgugccccaccaauuuaacaucacuuuuaaaaugcugagaguccucucuuaaacuuguccucaaaguguccuuuacuuugucaaucuuauaaaaaauuaaaaauauauacauacaguaucuaucucugugacaucaugaccagcagaaauauaaaaaccacaguacaagucacaaaucuauucuucaauuuuauuuuauuuuauuauuauuauacuuuaaguuuuaggguacauguguacaacgugcagguuuguuacguauauauacaugagccauguuggugugcugcacccauuaacucgucauuuagcauuagguauaucuccuaaugcuaucccuccccgcucuuaaauuuucuaguaguuauauuuuaaaagaaaaaaaggcaaaauuaauuuuaauauuuugauuuaaccaaauacaaccaaaauauuaacauguaauaaguauuuuuaaauugagguacuuaauauauuuuuccauacuaagaccaaaaauccaguguauccaguguauguuuuuacuaacaccaugugucaaugugcaguagccaaacuucaagugcuuaagugucuggcucauagauguauguagcuaguagcuaccauauugaacauacagaucauuuucaucaucaaaguuccaucaaacagugcuauucuagaccaugcuuucagugaagggugagagagcacaagaaaauaaagaaagcagagccucaggagaaaaaguuacaucuaaauaugguggccauugccaccacuucuuacgucccacucauucuuuauauuuauugcaauuuggccucaaagcucgcccacgcacauccguuugcaacggaucuuaugucagggacaccagagccuggguauagugaaucacuuuuucuuaugaaguucuguccucuaaaucuuucugaaauguuucacuuuucuccaucaucuugccaauauagucggccuuccauaucuauagauucaaccaauugaggaucaaaaauauccaggaaaaauaauacaaauuuuaaaaugcaguauaacaauuguuuauacagcauuuacauuguauuagguauuguaaguaaucugggggugacauaaaguauagaagaggaugugcauagguuauaugcaaacacuacaacauuuuauauaagaaacuugagcauccagauuuugauauuugaggggaguccuagaaccaaucgcccacagauacugaggaacaacuauauucuagucugccuaaucuggcuguuuuucacuuggauuaauuuaagccucuuaacuaauuucccuaaacaaguuuuagccuuuucaauccauucuccucacugaucuuucuaacagacaaaucuuaccauggcauuccacugcuucugcuuacaacuuuucaaugacucgaguuaguucuaaauuccuuucaaaaauucaguaguaagugugguucacaaauaaauauguucuauccaaacauaucauuuuuauuuagcuucuuuuuuuggggggacgggaaccauuccuaaauauaaacagacaaucacggauaacgugaaagaaagcuuccaacacagaagagaucaaaaagagaaaauaagaacucugaagaaacagauauaauacagauaaaggaaauuuucaaaagaggugugauacccucagaaaucuaaaagaagguauuacauccauaaaacaaacuacgauuuuuaaaaaggaagcucauggaaaucaaaaacaggagagucacaauaaaaucucaacagaaagguuagaagacaacucuuuaagaguagccaagaaguccguauccaauuuacagaguucuagaaaaagagggcaaaagauaucagaaauacaaguuuucaaaaccaaaauauacacauuucuagacugaaaaaauuaaugcauaaugaauuuaaaaugacccacauuaaggcauaucguacaauuucagaaaaccaacaaggauaacagaagaucccaaaugcuucuagaggaaaaaaaaaaaauaagauugaaaaaacagaaggaggcccggcacaguggcucacgucuguaaucccagcucuuugggaggacaaggcacgaggaucacuugaacccaagcguucaagaccagccugggcaauaaaguaagaccuuaucucuaacaaaaauaaaacaacaaaaaaaauuagccaggaggcugggcacaguggcuuacgccuauaaucccagcacuuugggaggcagguggaucauuuggggucaggaguucaauaccagccugaccaauauggugaaaccccaucucuacuaaacauauaaaaaaaaaaaaaauuagccgggugugguggugcaugccuguagucccagcuacuagggaggcugaggcaggagaaucgcuugaggcugauagggaggcggagguuacagugagcugagauggcaccaacugcacuccagccugggugauagagugacacucagucucagaaaaaaaaaaaaaaaauuagccagacaugguggcauauaccuauguagucccagcuacuuggaaagcagagguugcagugaaccaagaucauaccaaccacccuccugcccaggcaauggagugagacucugucuccaaaaaaaaaaaaaaaaaggaaaagaaaaucagaagggcaccagacuuuaccgcaacucuguauacuagaaaacagugggcugggcaugauagcucacgccuguaauccuugcacuuugggaggcccaaggcgagcggaucacuugagcccaggaguucgagagcagcccaggcaacauagcaaaaccccaucucuacaaaacauacaaaaauuagcuggguguggcagcacacgccuguaguaccagcuacuugggaggcugaggcacguaaaucacuugaaccagggaagcagagguugcagugagccgagaucacgccacugcacuccagccugggugacagagcaagacucagucucaaaaaaaaaaaaaaaaaagauacaugaaugguguucuuuccuacagaacuauuauucucuauagcuuauuaaucaagaugcauuccgcucugaucuaaaacuuuuagauucauuaggacacugauuuaggaaaaaaacuaguuuugaaacaccaugcucaagaaacacaacaacaaacuggaagaaaaacaguauuaaauauuugagauugagguugaaguuaaauuucuaaaaacuagccaauauuaccucuauuaagagaagcaccuacacagaccuucaacagacagguaucugaaaaguauucauaaucugaugaaaagaucaauagccuaugcguaaauugcacaauaacacuucugaguuuuuaaugucaagucuuucaaaauuauggcuuuuaaaagcugcaaaugacucucccucucccucucccucuccccacggucucccuccucucccucucuuuccacggucucccucugaugccgagccaaagcuggacgguacugcugccaucucggcucacugcaaccucccugccugauucuccugccucagcuagccgagugccugcgauugcaggcgcgcgccgccacgccugacugguuuucguauuuuuuugguggagacggggauucgcuguguuggccgggcuggucuccagcuccuaaccgcgagugauccgccagccucggccucccgaggugccgggauugcagacggagucucguucacucagugcucaaaauggugcccaggcuggagcgcaguggcgugaucucggcucgcuacaaccuccaccucccagcagccugccuuggccucccaaagugccgagacugcagccucugcccggccgccaccccgucugggaagugaggagcgucuccgccuggcugcccaucgucugggaugugaggagccccucugccuggcugcccagucuggaaagugaggagcgucucugcccggccgccaucccaucuaggaagugaggagcgccucuucccggccgccaucacaucugggaagugaggagcgucucugcccggccgcccaucgucugagaugcggggagcaccucugcccugccgccccguccgggaugugaggagcaucucugcccggacgccccgucugagaaaugaggagacccucugccuggcaaccgccccgucugagaagugaggagccccuccgcccggcagccgccccgucugagaagugaggagccccuccgcccagcagccaccccguccgggaagugaggagcgucuccgcccggcagccaccucguccgggagggaggugggggggucagccccccacccagccagccgccccguccgggaggugaggggcgccucugcccggccgccccuacugggaagugaggagccacucugcccggccagccgcccuguccgggagggaggugggggggucagcccccugcccggccagccgccccguccgggagggaggugggggggucagcccccaagcccggccagccgccccguccgggagggagguggggggaucagccccccgccuggccagccgccccguccgggaggugaggggcgccucugcccggccgccccuacugggaagugaggagccccucuguccggccagcugccccguccaggagggagguggggggggucagccccccgcccggccagccgccccguccgggaggugaggggcgccucugcccggccgcgccuacugggaagugaggagccccucugcccggccaccaccccgucugggagguguacccaacagcucacugagaacgggccaugaugacaagggcgguuuuguggaauagaaaguggggaaagguggggaaaagauugagaaaucggaugguugccgugucuguguagaaagagguagacaugggagacuuuucauuuuguucuacacuaagaaaaauucuucugccuugggauccuguugaucggugaccuuaaacccaacccugugcucucugaaacaugugcuguauccacucaggguugaauggauuaagggcggugcaagaugugcuuuguuaaacagaugcuugaaggcagcaugcuccuuaagagucaucaccacucccuaaucucaaguacccagggacacaaacacugcggaaggccgcaggguccucugccuaggaaaaccagagaccuuuguucacuuguuuaucugcugaccuucccuccacuauuguccugugacccugccaaaucccccucugcgagaaacacccaagaaugaucaauaaaaaauaauaauaauaaaauaaaauuaaaaauaaauaaauaaauaaaagcugcaaaugaagucuagaaucuuucugaauuuguaagauccaguggccgguuaccuuaacaaucaauuacauuacucauuguaggugaaagaaccaggaaaccaagaaugcaaaaaagauauggaaauacaauugaagaaagacaacuuuaauaucaacuuccacuuuaauuuuugaaggcuacuaguaaaaacauacauuuuaagcaguacaaccucuuuaaaaagaauguuacucagcacuccucuuaccuuucuuguuaauagacuuuuacgucucauuccacaagccucuaguuguaaccuuccucucaaugcuaauucaauuaacauacagccacguaauccagaugauauacagucauuccaaaaugauguguaacccuauuaaaaaaagaagaagaaauaaaacaaaauagcuaauuuaccuugaauucagaguaaaaaacagaaauauuaucagccaaagucauauuuggugccuuuuaccuuuccugucuuucuauaauaauauacugaaaaaauacaauuaacauaaauuacuaaucgagaauuuucgggggcuuaucuuuccaccacuuauucuuacauacaaacaacaaauaacuuuagaggucauaaguuuagaaacauaacucacauuucaccaagcuguguguuuauuagguucuuucagaacccugcaaacuccaaggaauacucaguuaaccccagauuauagugauuuauuuauguggacaaguuaagaagcucaggcaaagacaaccuagccaaguuagcuucacagagaauuagaauaccauucauuuauugcuguuuaggauaaaaccacaagguuaauccgagcacuuugggaggcugagccaagacgauggcuugagcccaggaguuugagaccagacuggacaacauagugagauccuguuucuaccaaaaaaaauuaauuagcuagguguggugcugcacaccuguagucgcagcuacccaggaagcuaaggcaggaggaccacuguguccaagaguucaaggcuacagugagcaauaauuacaccaacacacugcagccugggcaaaacagugcgacauugucucuuaaauacacacacuguuaauuuuguaagaagauauuagaaaaacacacaugcgcccacaaacaaauggauggcuauaggccuaaaauucucaauaauaaacaguauaacaaucagauuggccccaagagagaauguaagggcagcauccacaguggaagaacggccagacauaaggagguugauagacaucuagagaucugggauacuggucaagcaggcaucaccagaugaggucaggacacuuuaacagcaaacaacugggguuguucaaauuauaaagccacaaaucuugccagcaggauugccagcuaucaauuuaagauacccaguucucaugagacagcagaagcuauaaauaacucucauuaaggcucagaacaggguaacacaauuuugguaggagaacaggccaacugaaucucuaaagaauggagggcccaggauuaggaaggccuggcccucaccucuggcacuuuuccaaggucaauccuggcacuuugucaggccagaguagugagcuuguguuucagaagaugacugaccauugagguccaucaaacuucauuuuugauacaaggaguuaaauucgccucaccaagcuaccacuucugagaaugugaccuuugggaaaauaacaauuuaaaggaggcacaagcggauaaacaaaaacaucaguguuaagagaucaauuuaaaugugagguguaaguagcagacacugacuggauuuuagggagucacuuuaaacuuagggucggggccugaucaaaugaagauuaccagagauuuagcaaaguggcuaauaauaccaguacuuuauagagguuagguaaaaugcguggcuucuguguccaugaaauuaaagcccuaggaagccugagaaugaauuccacaugaaauuaaaguuacagauaucuggcuuugacuggccuggacauauagacagaguuccuaaaugagccucuacaaacuguaaacaacagagaacaccucauaaagcaauaauggacgugaacagcccuacagccugcaaacuccagcugaacaguaccuggaggcuuacauuugacagcagagaacuaaaauaugucucaaucucaauugcuccuagaguaauggcauacccagagauauuagcaaaauggggucuuuaguaacagacuucagagaucuaaauuuagugaauggcuuuaggcaucaucgcugaaagacacaugcuuaaacagaauuggauucacaugggaaaguagaugaaugggaacggacaguucuguaccacagcuucugggacucgucagcaauauuccaaagauaaaugaagccaacaaagacacaccaaacaacagaaaaguacaguauguugauacccuccugcuaaaauccaugucauaaaagcaggaucaaaaauuaaccauaggguggccaggcgcagugacauacaccuguaaucccagcacuucgggaggcagaggcaagcagauugcuugagcccaggaauuccagaccccugggcaacauggugaaaccccaucucuacaaaaaauacaaaaauuagccgggcaugguggcacccgucuguggucccagcuacuuggaaggcugaggugggagaaucaccugagcucaggaacuugaggcugcagugagccaugaucaugccacugcacuccagccuggaugacaggaguaagacccuaucucaaaaaaaaaaaaaagauaaaauauguggggaagguuaguaacuggcagcaucaagcagcuuaugacuguagucauaauuaguuccuauguucuaaaauauaaggaugggagaggacagagacaccccaaguaggcugggccauacacuaccagaccuccaucugccugauucccuuuauucuuucaaguggcucaauuugaaugguagaaaaggguauuguuuauuaaguccccuaaaacugccaacacugagaagaguucucaccauuccaguuaagagcuacuguucugcucucaacugccuacuuacccagaagcuuuuuguuaagaaggaacucaaaagguugguaacccaaaaugaaauguaauaaaaauauuuuguauaaagaucauaacagggauauaaccggaaguauaagauuuuccuuauauguuauuaaaaacauuuacaacaugggaaaaugcucauaauauauauucuacaugagaaacagauaaaaaauuauauuaucuaaagcagaguguccaaucuuuuggcuucccugggccauacuggaagaauuauuaucuuggcccacacauaaaauauacuaacacuaaugacagcugaugagcuaaagaaaacaaaaaaaaaaaccucauguuuuaacaaaguuuacaaauuugugcuggaccagauucaaagccguaggccaccugcggcccacaggccacggguuggacaagcuugaucuaaaguguaaucuuauuuugaaguuacauaaauauuaauacguauguauaucauagguuuguauuuacaaaaaaacuuauaaauguucacauccuuugacacaauucuuaugggccuuuaguuagaaaauacugugcacaaaaauauauguacaaauauauugaucacaucauuaucauaguaaaacacaaaaacaaucuaaaagcaaaaaaaagggaauaaacucagcacuucccaaacuuuccugaccuugaagcauuuuaauuuacaguauacuuuuaacagccuacagaauauuacaauucuaugaaaaucaguuuuaaaaauccuggugcaggaggcggaggcugcagugagccgagauugcaccacugcacucuagccuggugacagagcaagacuucaucucaaacaaaaaaaaaaagaaaagaaauccuggugcagagguuauuacaaaacaugaaaaauuauuaugaaaucguguguguguguguagagagacagaaaauagucccauuuuuuagggagauuagaagaaaaguuuuagcagcaguaaugucuggugauuauggugaucuuuauuuucuuuaggcuuuucuguauauaguaaaggaaaacucguggcaaggagauaaguaagguuuuccuuacugaucaacuauaguuauaguuguucaagcuuaaaaggcaauaguuaugauaguggcaguaauuugacagaggcaaaacacuagaagaacuaaaaacucuccaugaaaauaacuaugaaccacaaaguaaaacauauuugugaaguaguaaagaacugugcucaagagcccagaccgcacaaacaccuggcgauucaaaucaacuccagcucuaccacauacuauauaguuaaauuucugagacuaguuuucuucauauaaaacaaguugugaagauuaaauaauauauauaaagcacaaccccuggcaauuaguaauuacuuaauuauguacaauuagaauggaauggggauggaggacugcaaacucaguuacuuagaaaguacaaagaacaugacugaauaaagagacccagguguggauugcagcaagcuggacaauguccucuuccaucuaucuggggaagacagcuuagcccuuaucaacuguugccauguaaaaugugggccugcucuugccacaucuuuuucaagagggcagaaacguccguuucuauauauuacuuccaucuuugaaaggauuacaacucaaguuuuacuaaacaaaacauaucuggcaaaccaguuugcaaccgcuaaacauuuuacaaaacauacuacguuauaugaauguucaguuacuaguagucuguauaggcauaaaguacucaaaauaguuucauuuuguuuuuauguacaaaauauuucaaaaugaaaucacuaaaaacacuauauuuucuauauaagguugaauucuggugugaccaauguuuuggaaauggcuuucuaauagaaauauaggccagguccacaugguggcucacgccuguaaucccagcacuuugggaggccaaggugggcagaucacgaugucaggagaucgagaccauccuggcuaacacggugaaaccccaucucuacuaaaaauauaaaaaauuagcugggcgugguggugggcaccuguagucccagcuacucgggaggcugaggcaggagaauaacgugaccccaggaggcggagcuugcagugaggcgagaucgcgccaaugcacuccagccugggcaagagagcaagacucugucucaaaaaaaauaaaaaauacaaaauacaaaauuacccaggcgugguggcgcaugccuguaaucccagcuacucaggagguugaggcaggagaacugcuugaaccugggaggcagagguugcaguaagcugagaucgcaccacugcaccccagccugggcaacaagagcgaaacuccaucucaaaaaaaaagaaaaaaagaaaggugauuguacuugccaaaucuaaauggaccaggaugaacaaauuaagucucccuccugaguaucugaacuugccauacugaaucaguuauaugggcauggcacuggagcuguacuggcuguguggauucagaagcuacuggccauuggguacaaaugcagagaaugaagguaacagaaaggaaaacagaagacaaaugcagaguagaaaugagagaggaugcaaugugaggcaaaccaagacauacagagacagagaggcagacaggcacauacacggaauagcauguuuguuguuuuaaccugcuauguuuuguuaugcaguaagauaauuaauacagugggugcccagggcuggcaaaaugggaaaagggagagguaauggcuaaaggggaugagcuuucuuuuggaagugauaaaaauauucuaaaauugauuaugguggugguuguacaaaucugaaaaccuugaauuguacacuucaaaugacaauuauauggcauaugaaucauaucucagagcuguuacaaaaaaacauucuauaaagucacuucugaaaucuuacaugaaauuuugauuaugucaaaaauuaagaaucaaaaaguucuugacaaaaauaacuaaucaagagaaugaaggugacuucagguaaaagcagauuaaaaagacuagacaagaaaagguaucuacagauauaagaacuguuaaagaaguaguaaggcugggcacuguggcucacgccuguaaucucagcacuuuaagaggccgaggcgggcagaucaccugaggucacgaguucaagaccagccuggccaaggcggcaaaaccccaucucuacuaaaaauacaaaaauuagccaggugugguggcucaugccuguaauagcagcuacucgggaggcugaggcaggagaaucgcuagauccugggaggcagaggcugcagugagccacugcacuucagccugggcaaaagagugaaacugucucaagaaaaaaaaaaaaaguaguaaaacugcauuugcuggugauauuguuggauauuuagaaaaacucauaagaguaaauggaaaaauuacuauagauaggaguuuaguaaaguagccagauuauauaaaauuaaacaccaguugucauauacaaacaaaauacacauguuaaaauacuaaaaaguuaaaauauaauugaaaagaccuuuacaacagcaacaaaaagaacaaaaaauaccauggcaaaaccuauaugaaaaguuuaaagucucuugaaagacuuaaaaauagacuugaauaauagaaagauauuucauucuuauauacaaagucucagcauuauuauuaguucuuccuaaguuaauaaauguaauaucccaauaaaaauagcaacagauuuucccuggagcuauacaaguuacaaauaaaaguuccuaaagaaaaaaaaaaaaaauagccaggaaaacuuggggagauagcaacauauguagggaacagaaaugaaagcuguccuacuagauacuaaaauagauuuaaaagucucuaaaauuaaaaugaugucacacuggcacaugaauagacagaccaacagaauaaauuccagaaacaaacccaagaacauacugaaaucaaauacagauugaguaucccuuauccaaaaugcuugugacuggaaauguuauggaguuaagauuuuuuuucacauuuuggaauauuugcauuauacccaaauccgaaaaucugaaauccaaaaugcuccaaugagcauuuucuuugauucucacgcuggugcugaaaaaguuuuagauacuagagcauuuacaauuucagauuuucgaaauugggauucucaaucuguacacgauaaaaaugucaucacaaaucaauguaacauggaaagaugaacauuuuaaacaaacguguugggacaaccagauagucauuaggaaaaacauaauuggaucaauuccuuauuauacaucaauauaaauuccagauggaucagaggcugaaauguaaagugaaauaacguaaguacuagaagacaaaauaagagugaaaaccuuuauaaucugggagugaaagaaaaaacuucccagcuauucucaaaaucuaggagcaauaaaagagacuacccauuuuuuugguaaaguuugcaggguaaaaaucauagcaaagucacuuauaucacagauaaaucucuaguauacaauuaguuccuaaaaauaaaguugcuuuuuuuuuuuuuuuuaauauuuugaggccaggcacaguggcuuacacccguaaucccagcacuuugggaggcaaaggcagggggaucaccuaggccaggaguuucagaccagccugguaacacagcgagagcugucucuacaaaaaauguuuuaaaauuagcugggugcgauagcacaugccuguagaccuagcuacucgggaggacuugagccugggagguugaggcugcaaugagcuauaauugcacuuacgcacucuaaccgggugacaaagcaagauccugucucaaaaaaauauauauuuugaaauauucaauuuuuuaaaagguaacagaugaugaaguucacagaagaaauggaaacugcuaaaacauaccaaaagaugcuuugucauucauaauaaaaauauacauuuaaaauacaugagaccuuaacagcaaaaagaaacccaccuaauucaaaaaaaggcaaaacauguauauacaaaccaugaauuuggauaaauauaguauaugcauacaagaaaacaguauucagucuuaaaaauuaaaauucugauacacagaucuauguaaaauucugauacauagcuacaaaacauggaugaacucugaagacauuaugcuaagugaaauuagccagucaugaaaagacaaaauacucuaugguuccacauauaugggguaccuagaauagucaaauucauagagacagugguucccagggacuguggagagaaggaaauaguagcuauuguuuaauggauagaguuucgguaugaaaugauggagaaguucuggagagggauaguggugaugacggcacagugugaaucuacuuaaugccacuaaacuguaccacuuaaaaauguuuuaaaugguacacuugauguuaugcauauuuuaccuuuuuuuuuuucuuuuugagacagagucucacucuguugcccaggcuggagugcaguggcacaaucucagcucauugcaaccuccaccucccagguucaaguaauucuccugccucagccucccaaguagcugggacuacaggcgugcgccaccaugcccggcuaauuauucuauuuuuaguacagaugggguuucacuacguuggccaagcuggucucgaacuccugaccgcgugauccgcccaccucagccucccaaagugcugggauuacagguaugagccaccgcgccugccccccccagccuuuuuuuuuuuuuuuaaacuacaugaaaucaugcuuaccuaucagaccggcaaaaauccaaaagcuuggccgggugcaguggcucacaccuguaaucccagcacuucgggaggcgaggcgggcggaucacuugaggucaggaguucgagaccagccuggccaacguggcaaaaugcugucucuacuaaaaauacaaaaauuagcugggcgugguugcaugugccuguaaucccagcuauuaaggaggcugaggcaggagaaucgcuugaacucaggaagccaagguugcagugaaccaggaucacaccacugcacucccaccugggcaagagagugagacucagucucaaaaaaaaaacaaaaacaaaaacaaaaaaaaaacccaaaagcuugacagcauaguuggcaaaaaugagggaaacaggcauucucauaacuaugaugggaaugucaaaaugacaccacuuuuacugagggaaauuuggggaucuagaaaaaucacacauagauuuacccuuuaacuugacaauucuacuucuaaggaauccacuaugaagaaacagccccauaaauaugcaacaguauaugcauaugguuauugugauauuaucuguaggagcaaaaguuuggaaacaacccauaaauccaucaauaagggacuggaugaauauacaaagauauaucuaccacauaauggaauacuacagaaccauaaaauauuucuaaguaauagugauagagaacaaucuuuagaauauaacauguaaaaagcaaggugcacacaguguauguaguccauuaccuuguauaugaaggagaggagcaaugauaugaauauacguauaguuuugcuaacaaaauaucagaaagauaaacucuaacuuuucaagaacuacuaaugggggaaggaaagaaugagguagaagaaagauggaaaugagacuuuugaauauaacuugcaauauaauuauaugcacugaaaacagaaaaaaaaaaaaaacuccugaagaaugaaaacaaccguauacuacuuagugauagagccacaaagaaaagcuauuuuaacuuuagaauacaguauuuugacugcacauucuuaauaaaaauacuacaaagaaauuguaagccaaacucaagucaauuaguaguaauguugacauuuuuauuuugaaacuguuuuaauacaagcgguaagccaaugcaaauauuugaagaaccaaaauuuucaguaagaaaaaagauaaauauaaaacccaguaaguuaaauaaaaaucuauaauguuaaacuugaaccaaaaaccacguaaacagauuuuuuuuccucuaaaauguuugcuagcucugucccuugaggaaaauauauccuaucucuguauacgaaagaguccuacaagcaguaacaacucaguaacacugaguacacccaguguacucacaccagagugugguccauuccccaccagauggaaaacaggauuccuugaaggaaugacugauuauaagucugaaacaggaaauguacgaguugaguccaggacauuguguuggccuugccaaaaagcaagaaauuaucaaagguuaauaaccuguaucacaaagaacacugaaaccaacuuagaaaauaacucccauaggcuaaaagugagacaauuuaaacaucaagaagaguaauuaauauaagugaaugaaacacaaugaauauauauaaaaccgcaagucauaauuuuaaaaaagaaaagagcccauaccucacuagauaccacuggaaguagcuaaggcacaaacuccuaacccaaaacuuaguaauuaaaaugaaauuaaguguuuauccugccuuuuaagugcauaaaaugcacaggauuauaaaggaaaccaaaucagucaucaaaauauuaaaaaugaauuugugauauaugugcuuuauuagcagauuaaacaaguucuaguggcagaucuaauaacuauuauaauuccaauguaguagugagcaaagacaguauucugagauaucugcaauaacugugaugugauaugaaaguaucucuggucucucuaguggugacaaacucacagauacuauuaauacuucuuuggcuuguggccuacaauuauaguugauguagauguuaacuuucagguauaggucacuaaaaauaaauuaauuuuuccccucucaaauguuuccugaauucuacagugaccccaagcuaagaaucccuaaauuagaugaaaaguaggggaaauuuccaacaggcagauaggucugucaccaaaugaacucacuggucuucaaauucuaaaaccagacacuggaugacuccugaugcaaugaacaugaaaacacauaggauuaucuaagaagucaucuuggcugggugcaguggcucacaccuguaaucccaguacuuugggaggccaaggcgggcagaucacgaggucaggaguucgagaccagccuggccaacagggugaaacccugucacuacuaaaaauacaaaaauuagccaggcgugguggcaugcgccuguaaucccagcuacuugguaggccaagacagaagaaucacuugaacccaagagacaaagguugcaguggacagagguuacagugacccaagaucgcaccacugcaaucccgccugggcgacagagcaagacucugucucaaaaaaaaaaaaaaauuaacguucuaaaauguauuauggugauggauacacaacucuaaauacacuaaaagucacugcauuguuaccuuuuacuuuguuuuuuuaaagacaggguuucauucugucacccaggcuagagugcaguggcuugaucauagcucacugcaaccuugaacugcugggcugaaaugaucugcccaccucagccuccugaguagcugagacuauaagcaggcaccagcacacucggcuuuuuauuuuuauuuuuuuagcaaugggaucucacuacguuguccaggcuagucucaaauuccuggcuuuaagcaauccuccugccuuggucuccuccaaagugcuaggauuacaggcauguaauccuggauuguacuguuuaaauaagugaauugucaauuaaaucucaauaaagcuguuaccaaaaaaacuaagccaaaaacuccccuuaagcauuucaaaugacuaaagaaagcccucagcuuucugauuuuuuuaauuagcaaaagaguaaggcuauagacuacauguuuguguccccccaaaacucucauguuaagauucuagccggaagcgguggcucaugccuauaaucucagcacuuugggaggccgaggcaggcagaucaccugaggucgggaguuugagaccagccugaccaacauggagaaacccugucucuacuaaaaauauaaaauuaguggggcaugguggcgcaugccuguaaucccagcuacuugggaggcugaggcaggagaacugcuugaacccaggaggcggagguugccgugaaccaacauugagccacugcacuccagccgggcaacaagagugaaacacugucucaaaaaaaaaaaaaaaaaaaaaaaaaaaaaaaaaaaaaagauucuaacccccaacagggucucuggaaggucauuaagucaugaaggcagaagccucaugaaugcaauuagugcccuuauaaaagaggccccagagagucccuaugcccuucugccaugugaggaugcaaugagaagacaaccaggaagcaggcccucaccaauuucuuguucuugaacuucccagacuccagaacugugagaaauaaauuccuguuguuagcugggcacaguagcucaugccuguaaucccagcacuuugggaggcugaggugggcggaucgccugaggucaggaguuugagacuagccugguggucucagccaugauaaaacccugucucuaguaaaaauagaaaaugagccagguaugguagugugcaccuguaaucccagcuacuugggaggcugaggcaagagaaucacuugaaccugggaggcagcgguugcagugaauggagacugcgccacugcacuccagccugggugacagagcgagauucugucucaaaaaaaaaaaaaaucuguuguuuauaagucacacugucuauugugguagucccaaccuuuuuggugccagggacugguuucaggaaagacaauuuuuuccacggacuggagcggcgggggggaugguuuugggaugagccuguuccaccucagauccuaucgggcauuaguuaaaauucucauaaggaucgccuaccuuagaucccucaucacaugcgcagcucauaacaggguucauacuccuaugagaaucuaauggcugcugcugaucugacaggaggcggagcucaggcaguaaugcucgcuugcccgccccucaccuccugcugugcaaccuaguuccuaacaggccacagaccaguaccgguccauagcccggagauuagagauccuuggucuaugguauuuuacagcagcccaaauaaacuaagacagauaacaaaaccaguaaaguaacuaaauaaugauuggauuugggugccauccacauguguaaguuacugguaguaaucaaguuaugauuacguuuuaaaaguucccuuuuaagcaauuuguaacacagaauguauuuuuucacagaaguaacagccagggcccucagggccucuauucucauggucuucacucaaaaccagggaucuuaucugccacucccugggaacuuggacaucagcauccuuaaacccacaaccuuuugaugagaaccaaauccaacucggaaauucaauccacaaguaacuuuucaucauccuuauggggauuccaauccucagccuuccucccuuuuucccaccagucuccuccguucuuucccucauccccacccagcacaauaaguuacugugcacauaccaugugcaaagcacuguucugaguacuaaguacugugggagcucauuucaaccuucgcaacaaccuucugaacuaagugcuauuauuaucaaucccaauucaaagaugggcaaacaacgccagaguacacuaccuucaacuacacccuuacuaguuuccuaaacacauccauuguuucccacugcauucaacuagcaaaacuccagccccggaucaauccaacugucacuuuuuccauaucuguaccuguguuucugaacugcugauguaaaaaaauauugaaaucucaguauauaaauguacugucuccaacuuaaacuaaaccuuuaaugauacugggguugggcauaguggcucacgccucuaaucccagcacuuugggaggcuaaggcggguggaucacuuaaggucagcagauuugagaccagccugaccaauauagugaaaccccaucgcuacuaaaaauacaaaauuagccgggcaugguggugcaugccuguaaucccagcuacuugggaggcuaaggcagaagaaucgcuugaacccaggaggaggagguugcagugagccgagaucacgccauuguacuccagccuggguaacaagagcuaaacucugucucaaaauaaauaaauaaauaaauaaauaaauaaauaaauaaauaaaauacacacacacacacacacacacacacacacacacacacugggcaaaaucagcuuuaaacucugucucaaaauaaauaaauaaauaaauaaauaaauaaauaaauaaaauacacacacacacacacacacacacacacacacacacacacacggcaaaaucaguuucccuacucagagcucuuaccacucuccauaucagauauuucaaaaccccauucuccccaaaccucuaaagcucagcucauuuucagcagauuacuucacaaaaacaaaccaacucaauaaacucaauuucauacauacccacucuuuugucucguuacagugcagucugccuaaagcuaauccuacccauucucuccuacuucccuuuguucacaacuccugcccuccuaaaauaccuuaaaucucuaacauguauacuagcaccugccuauuggccuucaaauauucucacaguuaccaucauacaagagacagacccggaccaacccugcccuaucuccuuuccauucacagcagacucgaagguaucaucagcaaguccaucuccacuacuccucacucuuccuccugcuggcuccacaaucccccucuucuggcagcuccugcucgggcucuuugucagguuacucuucugcugccuauuccuccaacggagugcucuuggccacuuacacagacuucucagguacucucacuuauuuucaaaaaaaauucaaauagaaauacaugacagaaaauuaaaagucucuacuuucucuuccgcuuccaucccucacacauucccucuucaagauacucuccauuaacauuuggaauguauccuuccaaauccuuuuuuaaagugcacacagucauacucugccauacacugaguaucuaugcuguuaaaacuguguuaagcauucaguguacauucuuucuaauucuuaggaaaccuuguaaaguaggugcuauucuuccaauuucacaagauaauggaacugaggcucagaggaccugccacgcacugaguggcaaagcagggaaugaaauuggucugccuggcuccaaagcccuggcuccuuuucugucuugccuuccaagaccuguuuauuuaaugcaugaucuaggugugcuuccuuucagcccccugaaacagaagaggguacagguugaguaucccuguacuugggacccgaaguguuucagauucuagauuuggaauauuugcaaauacauaaugagauaccuuagggaugggaccuaagucuaaauacaaaauucauuuguguuucacauauaccuuauacacauagccaaauguaauuuuacacaauauuuuaaauaguucugagcaugaaacaaagugugccagguauggaaucuuccacuugugauaucaugucagcacugaaaagguuucaaauuuuggaaccauuucaaauuucagauuuucagacuggggugcuugacugguaucacuuuuuucuuuccacaccugccacugaucacuucacagcagagagcacaaaacaaagugugagcagacacucccucucaagcaaaugaauuuuuaaggguuuuucacuagugguuuuuuaaaguauauuuaacagcaucuuguuaguaagaccuaaauauaagcuacagucuuuauucuucuguaagaaacacgaagguuuuaauacaagagaauaacauuucaguuugcaaagccauuuauaaauuaucaucuagguucuacaauuaccuaguaaaauaucaucaccuuuuuacauuugaaaaaucugagguuuagagaaaguaagaaauaugacuacauucacacucuagagcagugauaccucgagccccagagcugugacucuagauacagcacuuuuacuacugcaucauacuguggguaaguauuuuaaguugaggacauuuugacaaguccuauguaaguuuuauaucaagucacuauaacauuuauuagauacuggccucugcauuauuuucuaaaagcagaaaaucauucccacuugggaggcugaggcauaaugcugcauaaagcaaaaacuguaauuauuuaaauucucaaaauagacugaggugggaggaucacuugagcccaggaguucaaggcugcaguaagcuaugauuauacaacugcacucuagccugggugacagaaugagacucuggggaaaaaaaaauuauuggaaguaauaaauuucuauuuguuuaauauacauuuuuauuauuaaaauagagacaggguauugcuguguugcccaggcuggucucgaacuccuggacucaggcaauccuccuaucuuggucucccaaagugcugggauuacaggcaugagccaucauacccagcuggaaguaauauauuucaagaauaauuuuaacucaauaaacucuacugagugccaagacauuacuaaacagaggugauaaagaugacuaauauacaaaggcauagaaugaaaaggaagaaauaauaauuacaauuucaaugugauuaucauaauacugauauaaauaaaaugguguccccucacucauucuaaagacaaacacuugugcaauacuaggcauugugcuagaugcuagagauacaaugguaggcaaaaaggaugugagagcaacuaagaaguuagauuaaggugaagagucucacuaggcaguaagaaauaacuaagaauuggcugcuagguagaaaaaggcagagccuuacauauaaggauccacuaacacaaacaugaagaccuaaaaaaguaaucaugggccaggcgcgguggcucacgccuguaaucccagcacuuugggaggccaaggcgggcggaccacgaggucaggagaucgagaccauccuggcuaacacagugaaaccccgucgcuacuaaaaauacaaaaaauuagccaggcgugguggcgggugccuguagucccagcuacucgggaggcugaggcaggagaauggcgugaaccugggaggcggagccugcagugagccgagaucgcgccacugcacuccagccugggugacagagcgagacuccgucucaaaaaaaaaaaaaaaaaaaaaaaaaaauuggguggcaucaaaaagauaaggugaggcugggcccggugguucacaucuguaaucccagcacuuugggaggacgaggagggaggaucacuugagcccaggaauuugagaccaacuugggcaacacagcaaaaccccaucucuacaaaaaauacaaaaaguagccagguauaguggcgcacgccuguagucccggcuacuuggaaggcugaggugggaggaucaccugagcccagcaaguuugaggcugcagugagcagagaucacaccacuggacuccacccugggugacagagcauaccuugucucaaaaaaaaaaaaccaaagcugaggaaaaaaaaaaaaaaaaccaaagcugagaauauggaaagguggagagaacugcugaccacaagggcuggaagaggucaaggccuuuugaguuuucugauuuggagcaucaaggcguaaugaaacuuaauauuuauugugcaccaacuaucaggcacuuuacaugugcuauuuuauuuaauugugacuggagucauuuuggaggcuuggaggcuacugauacgucuggaggcuaagcaguaucuggaaaagaggaaucauggaaccaaucccaaggauucuuuaaggaagacucugggcuugaccuaaaaaucagaagucgggccaggcacgguggcucacgccuguaaucccagcacuuugggaggcagaggcgggcggaccacgaggucaggagaucaaaaccauccuggcuaacacggugagaccccgccucuacuaaaaauacaaaaaauuagcagggcauggugacgggcgccuguaguccuagcuacucgggaggcugaggcaggagaauggcgugaacccgggaggcagagcuugcagugagccgagaucgcacaacugcacuccagccugggcgacagagcgagacuccgucucaaaaaagaaaaauaaauaaauaaaaaauaaaaaaauaaaaaucagaagucaagugguacuucaaguuuccaaauuucccaaaccaguuuugccaggaauuacaaaaaggaaacugaccagagguucagaacaaagguagagauaaauacaccuacuaugugcccauaaaaauuaaaauuuuuaaggccaggcgugguggcucacgccuguaaucccagcacuuugggaggccaaggugggcggaucacgaggucaggagauagagaccauccuggcuaacacgaugaaaccccgucucaacuaaaaauacaaaaauuuagccaggcgugguggcaggcgccuguagucccagcuacucaggaggcugaggcaggagaauggcaugaacccgggaggcggagcuugcggugagcagagauugggccacugcacuccagccuaggcaacagagcaagacuccgucucaaaaaaaaaaaaaauuaaaauuuuuaaaaaaauacacgcauagaugagcaucugaauuugaguaaaacguucaguaagcccagcauauaaagugcaagagaaucaagaaauaguaaaaauaauggaaauauuaaauacuugucacuugucaagaccacuauaaacuuuaacuuacuucucuaggcuagguaauuacccauuugcauuuguucagcaccaugugguuuucaaagcacucacauaugccaacacauuggaucccuacaacuuagaggcuuucggacagaacacaaaaguaggcccauggccgggcgcgguggcucacgccuguaaucccagcacuuugggaggcagaggcgggcggaucacgaggucaggagaucaagauuauacuggcuaacacagugaaaccccgucucuaccaaaaauacaaaaaauuagccgggugugguggcaggcgccuguagucccagcuacucgggaggcugaggcaggagaauggcgugaacccgggaggcagagcuugcagugagccaagauugcaccacugcacuccagccugggugacagagcgagacuccgucucaaaaauaaaaaauaaaaaaguaggcccauuuugcccaggagaaaacuaagguucuaaaauucaaaauauuuauucuaauucuuucaacuacucaagggcaaggcuaggugucaagaacacagcagucuugcagguccugauccaaagcauccucccuauguacauccuuacugcaccuaacacauacucccauaaaaguuaguaacucagaagaggcaggcaggauaaaguuaauaauucacuuuauugaaaucauucgcaaaucugucuucuaugcagacugaaugcuccuuaaaagcaaaaaauuuuucuuuguggccgggggcacagcggcucacaucugugaucccagcacuuugggaggccaggaguucaagaccagcuuggccaacauggugaaaccccgucuuuacuaaaaguacaaaaauuagcugggcaugguggcaugugccuguaaucccagcuacuugggaggcugagacacaaggauugcuugaacccaggaggaggagguugcaugagccaagaucaugccacugcacuccagucuggcgacagagcaugacuuggucucaaaaauauauacauauauauauauauuuuuuuucuuuguaaccccagcaucuggcaaagggaaugaauggcacagagaagcuguucaauacuuggauuaaacggaacauauaaauacuaaauaaccucuaauuucacuuuagcuacacaacaugguauagacaaaaauuaaaugguauacuccauucagugacugaacugaaauuuaaguucuuaaguguuauuucugagguuauuuuguuaauacgguauaaacuguuuagcauuuccauuuaagaaacuggaacuagaaaaugaaaccagaguaaaaauaaccauuagcaacuuuuacauacaguuucuuaauuucuaaucugucccagaagguagugguggaauacaaaguuugccuauauauuaucaauaaaaauaacuuuuaccuuaaaacuuuaacucauaaguuccuacacgcaguucaguaugcuaaaauuguuccucuuccuacugaacuacaagccaaauucuauugcaauaaaaauuccuaucagagaaaaagauuucuaaaccucaacuaagcacaagcuuauaauuuuccauagugacuuauuucaauguuucucacccuuuauuucaucacuguucccuuaagaaguacuuccagauuuuuuccucauuaucuucucccccaugaaauuuuaauaugauggaauauacauauuuguuuguacacuguaagugugccuuuuuauacauaagaggaguaagauucuuuuuuuuuuuuugagacggagucucacucuguugcccaggcuggagugcaguggcgcgauaugggcucacugcaagcuccgccucccggguucacgccauucuccugccucagccucccgaguagcugggacuacaggagcccgccagcacgccaagcuaauuucuuuguauuuuuuuaguacagacaggcuuucaccauguuagccaggauggucuccaucuccugaccucgugauccacccgccucaacucccaaaguguugggauuacaggggugagcuaccgcgcccggccaagaguacgauucuuucacuaccacgcccagaaccaaguuucacucccuuggcaaugacauuaccacacugggaauacauaauuuacuuaauaaagccaguaaucuacuuaauuaauacaguaaauguauuaaguaaauuuauuuaauaaguaaauuuacuuuaauaaauaauauuagcuuacuuaauaagguaaauuauguauucuuuuuuuuuuuuuuuuuuugagauagucuugcucuguugcccaggcuggagugcaguggcaugaucuuagcucacuguaaccuccaccuccuggguucaugugauucuccugccucagccucccgaguagcugggauuucaggugcauaccacccugccuggcuaauuuuuguauuuuuaguagagauggaguuucaccauguuggccaggcuggucgcuaacucccugccucagguaauccccuugccucagccucccaaagugcugggauuauaggcaugagccaccacaccugccaggguuagguaaauuauguauucuuaaugugaguaaugucauuguacugagugacugccaaaugccagccugaaauauaugacaucaaaaaauuauagaacaggccaggcaggguggcucaugucuguaaucccagcacuuugggaggccaacguggguggaucacaugaggucaugaguuugagaccagccuggccaacauggcgaaaccuugucucuacuaaaaauacaaaaaguaccccugugugguggugagugccuguaaucccagcuacucagaagguugaggcaggagaaucgcuugaacccaggaggcagagguugaagugagcauagauugcaccacugcacuccagccuggguaacagagcaagacucugucucagaagagaaaaaaaaaaaauucuagaacagcaacauaauuuaguuuuguaguuuacuauaugagcuuugacacacagaacuaaaaugaaugaacuugaagacagacauguucuucagugaauuuguacuuaguaaagggccucucacagagcaugugcucaguaaacauuugaugaauggaugaaaacuguuagaauccuagaugugugguaauccuagauuagaagcaguuaugcugcuucuaaaugucauuuagcaagaugagaaccucuagacaggccacagaaauguggacuucguaucucaaaucacuuaaaauucaacucgcuacaacccuggaaaccuggaauuuucuguaguuaauuuucaggaaggaaaaagaaaagacgaaaaccuuaagcuaaaacaaacaguuccuguuugguaauuuuuaaccuuccugauucacuaaaugcuuugaguaucuaaugaaaguucuguccucuuuccccaagaaaacacacaacugcagagaauucacaaaguuucucagcucuguucacuccaauuuaagaacuucuccauuaaaggaauauguaaaucaaauacaaugcauuaaguuuaaaaauaaguaaauuuuuuuguuguuguuuaaaauguuauucuuaaaagugaccagaaacauccuuguuggcaauacacuguacuuuaauauuaguuguguuuuugcagaugagagguuuaccaaacgggaagagaaauagccuauguucuaaauauauuuguaauaccuaagucaaaaaccucaaaauguacuagauuacauuguaauacuguacaaugcuauuaaaacagguugcagucuucccagcuuugauaagagaaaccugaagccaaaaacaucaauuucaaaaugaagccagguuuccacuuuuggcacuugucaggacacuuacuaaaaagcagcagcauggccgggcacaguggcucaugcccagaccuuugggaaggcgaggugggcggaucacuugaggucaagaguucgagaccagccuggccaacauggugaaaccccaucucuacuaaaaauacaaaaauuagcugggcaugguggcaggcgccuguaauccuagcuacuugggaggcugaggcaggagaaucacuugaacccaggaggcggaguugcagugggccaagacggugccauugcacuucagcccgagugauaaaagcaagacuccaucuuaaaaaaaaaaaaaaagcaggaggaggacaagcacugucuuuuugugcugcuucaaagggagacucacaacaugaagauaaauccucuaaacaaagacuacagcauaguuuuauacuauuuaaucugauuaauggcaguagaaaaguuaugcuguuagaagggggggggaguuugcaaagacauaaaaaaguguacagccaaaagcuuaacauuauguaccagaacaagcauaaugccugaugccuccaggguauuuaagauuuacauguaagaugauauuauaaaaguguauuucuuuaaauaucaaaaaaaucccccaaauauuucaaaaucuaucaaaauaacuucaaaauacaauucuuuuguuuuguuuugucuuuugagauggaguuccacucuugucgcccaggcuggagugcaguggcgcaaucuuggcucacugcaaccuccgccucucagguucaagugauucuccugccucagccucccgaguagcugggauuacaggugcucgccaccaugucuggcuaauuuuuauauuuuuaauagagacagggguucaccauguuggccaggcuugucuugaacuccugaccucaggugauccauccaccucggcuucccaaaguacugggauuacaggugugagccaccgcacccagccuucaaaauacaauucuaaaacguaauucaaaugcuccauacaagaacucucagguaguccaaaauuaacaaauaucaaauauuaguauaacuuaugagaugaguuagugaauauuuugaccauauuguaaaagaaucccaaagcacuaaaaaguaauuucaacaguauaaaaucuuguugaaaagguauaauaagcagaccaggcgugguggcucacaccuguaaucccagaacuuugggaggccaaggcgggaagauugcuugaggccaggaguucgagacuaggcaacauagugagaccacgucucuacaaaaaaaaauuuuuuuuuuuaauuagcugggcaugauagggugcgccuauagucccagcuauucaggagacugaggagggaggauugcuugaguucaggaggucgagguugcaaugagccaugaucacaccaccacacuccagucuggaagacaaagcuaggcccugucucaaaagaaaaaaaguacaaucaaauaguuuaaugaacuucaaaaguaauuucugagauccuguauaucucauaccuguguuuaaacaccugaaaaaaauagauaaaaauucaaaacuucaaaaaauaugaaggaaauaucauuugucuuagaaacaacgaaaauucauuaaaaacucagaagccuuuauuauauuuuaaauuacuaaaacucagcacaucuggaaauucugaauacuuguugacugaauuucugauuuacagauuugauauguagagaugguggacaucaccacacguauagaaaggaaaacaauuuuuguuaaguuauacaucuucaucacuauuauacuucaaaguagugaccuugggaaccuuauuccaaaaauggaaaacaucuuuggagccuguguaaaagccacacaaaagucaguucuaucauuuugguuaaucuuaaguauuuuaccccauuacauauuauuuaccucaaguaccuacuuauuuuucaagacauagaguuaaguuacuguauuacaguucuugucuacaagcauuagaaacauuaguaacugacucuggcuaucuuuaaaaagcaacuuuacuggaaggcuguugaaacucacaacacugaaagaugacuggaaaaucagacuggaaaaaaacagugccaacagaccagagaaagcagcucaaagaaccaugccaaagaacagucugauccacacgcugacaugacucuggaaaggucuccaaaaaacccuacagcucguuauucucucaagauccaaagcccugaaagaaaacauaugauuggacaagucuggcugcaugacaaaacagcaggggaauaauaugcuucaagagugcauccuagagccggucgcaguaaucccaacacuuugggaggcugaggcgggaggaucacuugaggccaggaguucgaggcugcagugagcuaugaucucgccacuguacucuagccuggcgacacagcacaaucugucuuaaaacaaaaaccaaaaaacacaacaacaaaaaaaaaaacaggugcgguggcucaugccucuaauaccugcacuuugggagacugaagcgggaggaucacuugaucccaggaguucaagaccagccugagccauguggugaaaucccugucuuuauaaaaaaaaaauuuuuuuuuaauuagcugggcaugguggugugugccugugguccuagcuccucgggaagcugaggcaggaggaucacuuuagcccaagagguugaggcugcagugagccaagaucgcaccacugcacuccagccugggugacaaagaaagacccugucucaaaaacaggcaacacacuauggggaaacccuaaaguaauacaaaauaaagcgaagaccuggggaggaguuaauaaacauccacagcaguacaaucagaaccaucauauggaaugacuacuuuuccauuauacaugaaaacacugaagcucagaaggcuuaaauuauauguaaaagccaaagaauacacuuuggacaggacuauagagccucucucugcuucugcuguuccauaggcauacuccaaauuauacuuggccacugaaaauaauuaaaucuaaccuuaaaagacuaagauuugccaccaaugaagacauucaaacauauaugacaccaguuauuugugguaauucucaauaaagcauccugaaaauauucuauggaaagcaucuauagaauaaacacacacagggaaaggaaaauaccuggcacuuuugcugucccucccccucaaacacugggucaauuaaagaaauacugcuaauuacuuggcaguugaauuuagguguaaacuaucugccauccuuacuguggucuuuaaagaguuacuuaaauacuuaugcacugauucucugcccaagugagcaugaaaaucuucugaggggacuagccaucccuguuuuauaaaagcaaaaaacaaauaucauugguuaaaaaaaaaaaaucugaaauguguaaagaaaaaaaaaaaaaucaaucacaaugacuuuagacucacuccuaacagguaaucugaagccagaccaucugcuuauucaaaaacugaaccuucuguucagcaaaaaagagagggagacuugacucagaauaugucaaaguaauuuuuuaaauauuauagauuauaaacauguuaaaaauaaauugguaagacaauaagaacaaaggacaaucucacacgauauggaugaaucucacauugaacaaaaagcagacacaaaguacaaaaaacuaggcaaaauuaaucuaugcugaauucuaauauuaagccagugguuaccccugaggaauggguagugacuggaaagauacucaaguggagggcuagggcuucuguuucuugcucuagguacugguuuaacaaguauauucacauaagguuauuagcucacauauauaaaauauuuccaacauuaaugauuugcuuaaauguaaaguuuagcuuuuaaaguucuuaggagaauccagacauuaaaaagauaaaugcugaaguaaaaaucaguuaaagcaaugaguuagcauaaacgccugggcucaggguaagacagcaauuccugccuccuaaaaagaguacuauagguuaaaaacaugguggcgagccucccaagggaaaaacauaccaacagauaaguugacagggcugguuauuagaguguaaagacaugaugaguuggcuugauggcaugcaccuuguauucccagcuacucagggcggaucacuugagcccaggaguuugagugcagccugggcaacaucuugagaccuccaucucuuaaaaaaaaaaauuuuaaagaugugaugaaaggaaaaaauauauaggcuaaucccuaaaaccaaaaccuaaagcaauacaaaaucccaguagucucaaccccaccccucaacucucuggacuugccuaaaaaaaaagagaaaaaauuuccccaugugguugcugaaaucaggaagaaaugcucacaauaagcuagcaagcaucuggaccuuagccaugacuagcaaaguauaaugagugacucuugaugcaaaauaaacagaacacaugguuucaauuacccgccaaauaacuuuaaauuguuuaaauuaugugaguaugguuaaacuucaacaaauuauuuagauuaucuucuuaagacccaaucaccgaaaaacagcauguuaauaugcuucaccuuaaacauuuagagcaaggguguccaaccuuuuggcuucccugggccacacuggaagaacugucuugggccauauauaaaauacacuaacacuagcaauagcugaugagcuuuaaaaaaaaaaaauugcaaaaaaaauuucauaauguuuuaagaaaauuuaccaauuuauguugggccgcauuuaaagccauccugggccacauuuggcccgcggguuggaaaagcuugauuuagaguaacauguacuugaaaaaacaaauagguauuuccucacuauaauuucucagugugacucagaacaccaaaagcuuauuuuuuaguuuuuuuuuuuucagguuuuuguuuuccaccgaguuuuauccacacggaaaacucucaaaaacuauaaaccaaaauguucacucaggaauauguuuuaauuuugcuuuucuuuuuuuuuguauuuucuaaaaugucuauaauaauguuauuuuuguccaaaaagaaaaauguuuauggccgggcgugguggcucaaaccuguaaucucagcacuuugggaggccgaggcaaguggaucacuugaggucaggaguucaaaagcagccugacaaacauggugaaaccccgucucuacuaaaaauaaaaacauuagcagggcgugguggugcaugccuguaaucccagcuacuugggaggcugaggcaggagaaucgcuugaacccgggagggggagguugcagugagcccagauggcgccacugcacuccaggccugggcgacagagcgagauuccgucuaaaaaaagaaaaaaaaaaagacaaauguuuauaaucaagauuuccaauuuugaaaccuaaaguugaauauuuucuaaaaauuacauuacuaggacgcuauaccccuaguuuacuuuuucauccaaagaacaaggaacugcacauacagccugcuuuaucaucacaacucaauaauuaaacagguacagcagcccuuucacagccagaggaacaucaacuuuuuucaagguuacuguuauuaaaaccugagaaaugggaaaccaagauauggcaaaugccccagacguaucuaucaagcuaaccguuaguucauuagauuucuaaauaagaaagguccauaaacgguccauauaaaacucgccuauaucuaguaaguuucagugaccaagaaagauuacguuguuuuguaagacuuuuuuuuuuuuuuugcccaccuuccugaauuuggaaaacuuucuuaaaaucaggccugggcgcgguggcucaagcuuguaauuucagcacuuugggaggccgaggcaggcggaucacuaggucaagagaucgagaccauccuggccaacauggugaaaccccgucucuacuaaagguaugaaaauuagcugggcauggcggcgcacgucuguagucccggcuacucgggaggcugaggcaggaaaaucgcuugaacccgggaggcggaguuugcagugaguggagaucgcgccacugcacuccagccugggcgacaaacugaggcuccgucucaaaaacaaaacaaaacaaaaacacaaaauuagccgggcaugguggcgcaugccugccucaggaggcugaggcaggagaaucgcuugaacccgggaggcggagauuucgguaagccgagaucgcggcauugcacuccagccugggcaacaagagcgaaacuccgucuccacauaaauaaauaaucauuuuuguaggcaaauauaacaaauacagcaaaacgucauagaaucuagaaagaguauauaugcauauguaucuaucacuuuuucaacuuuucugugugugaaaauuuuggacacugaagugaaaauaaacgcuuucaaagucagaauacaaagaauuaucuauugcaacuucaacccaccugaagcuuugaggccucugaucaacucacaaaccuacauuucaagcacucgaugaaaaagcccuuucuuaagacggcaagacuuugagauucaucaacugauaaaauauaaaagcgauacuaaaaauaaucucucaccuaauguaaguucaccuagaaagucauuuaccaggagguuucaugagaaacuuaacuuaacuuuacucaguaaaagagcuuuucccucuauuaccacuucgccuacguuuuucguaauucccaacaguaagcuuuaacugaagaagaagaaaaaaaaaacauccccagcaagcagauccgggcaccccucccagguccuaaagccugcaaaaacccaaagaguucguggcgcugguggcuccagcuguuaguuucccgggcagucuccggguuggauuugcacccuggggucuacacggguuaaaaacgcggaaaaaaggcgacgaagaaauacaaacugccagggugucgaaaugaaaggagcgacugugaaagggguaaggaaaaauccaagccaucucuacggggaggauccagaaagcaccagccgcgccagggggucaaccaacuccgacaccgcucggcgucagcugggcgccaccaggcgcggacuucggagcgagggcaggugcgcgggccggaagccucgggcgcucaccuggcaccuaccuggagcucaccuggcgcccgggccccgcgccgccgccccccgcccagcccgccgcgcccgcaccucgcgguccuugaggcccagcaggagcacuuccuccaucagggucagccgcguuuccuuggagucgcccuugucgucgucguccugcucgucgcggcggcucugcgcgucguccucgcugcugccggcgccgccgcccgccgcccgcuccuugucggcggcguugcgggaggccucggugcgccgcugcaccaggccggagcugcgcugggucagcgaggucauggcucccgccgaggcgccgagccgggccgagagggucgcaggaccgaccgggucgcccuccuccuccccgcgcggccuccgauccggguuuccguguuaaauccggacgccggggcgacguccgucggcagcagggccgggggcagucaugaggaaacaggucagggcgaagcgggcuggccgggcgucggcggggcaggagaggagcgccuuccugccuguggccgcaguccccgaaacaccccgagcuccaaggcggaggcggcggcggcgccuuuccaauau

SEQ ID NO: 192536 - RNA, 16220 nt, Homo sapiens
gauuccagaagauacugucuggcgugaaauuagucucaguagaaacauaagucccgcgcgucuugugcugcgcgugcgcaagcuuuugggcccucccgagaaagggaagugcauucucgcuuccguagcggucuccgccgguuggggggaaguaauuccgguuguugcaccauggcguccauggggacccucgccuucgaugaauaugggcgcccuuuccucaucaucaaggaucaggaccgcaagucccgucuuaugggacuugaggcccucaagguaauggcacagggaccugcucgcggugggcuaaggggagguggccgaggccguggcucugcgccugcgcgaguugaggagcggcucugccaugugcuccccggaaaggucgagaaucuccgucucccugcggucuccggccgcucagcccgcuuacugagcucgggagacgccggcgccuaauccugggcucggaaugugggggccagccaggcugggccgccagcgcccuucggagcuggguggggccgcucaguccggucgcccgcgggagcaaagcgggaccgccuccccgcccggcuccuccagccugacggccgcgugggacugcgcuccagugggagggcgccggggagaugcucugucaccugucgguuaaggcgcugcugcuuaaccuuucgcugguccacccgcaacggcccuuccguuuucuuugucacucguaaagguguggucacuuaacaggguauuucauuucugagugcuuuuuugcccacccuugaggaaaaauagcgaagagugaaaaacggacgcacauaaccguaauacaagguggugugcagugagaaggacagcuacggagagggugcacauaagcguggugcuggaggacagcuuuagaucggggugagagguagcauucuagggagaggaaacgguagaaguaaaggcuugggcaagaaugcgcauggcacguuguagaauggaagagccauccgguuuuaauggagcacugacuucuuuaacuuacaauaguucccgaagguggaagcuauugaaugcccaacauggaaaauacgacguuaucuuuggggaagaaggggagccauugaggggguuuugagcagaauuucaguagagcugcacuucaggcagcaaagcuugagauagaccgaagggaauaaggaagaccagagggguuaaagaaaccagggcaggggugcagguaagaaacaucugagcaccagacguugacagaaaaugcagaggaagggacacuccgagagggccuucaggguuuguuauaaagugaauucauaauagaccauuccacuaggucucucaggugucccuguucacuuagugucuuggagguuuacuuacgcaaaguuagaaacaauacaguuccccuauggacucuuuguuugacuuagugcuaguuacacaaccucgcggaaccuccuuuuccagggggaggugauaggccuccgucaagcugaagacuugacagugauauuaaauggagugacuuagaggggcugcacagugguugauccacgguaggcacucaguauuuguuuccuuucuagaaagaaaaaguuucaagcuaauuguauuauguauuccauuuuauuuuccacuuaacagggaccugcagagaaaauaacauccaauacacacaccugguguaacaacauaacuaaaacuagguuguuuugcaucagccauuuuguucaaacugcaugcauuugugcccagaagucgcacacucugagacaggguuauuuuacaaaacuggggacuugggcccagagcaguugagaaauuguucugaagagcaguugcuacuaaagagcauuaccauggucagggccaccgcugucagagucaaagccaguggucuagagcagcauucucaaguuuggcauauugacauucgaggucggaucauucuuugcugugggagcucauuuggacaguaaccuggguguuuaagucucuuaaaagaguuggaugcuguugguaggcauccugugaguguugaggcucagcaguuuagggauauacacuugcucccugaccucauagaacguccagcuaacuugaagaaccaaaauauauggaaauugaaggcaacgguaaaagaaauguauaggccaggacgugaacguuuuaaugguaauggucacaguucuuucucucuggucauuuagagccuuaaagguaauauguauuuuguugagauucuucacuuguuuaacacuuaacuguauaauauuucaccuuaaaaaugcaggcauugacugggcgcgguggcucacgccuguaaucccagaacuuugggaggcugaggcaggagaaucgcuggaaccugggaggcagagguugcggugagccgagaucacgccacugcacuccagccugggugacagagugagacuccgucucaaaaaaaaaaaaaaaaaggugcaggcauuaguuggcuuaggaaggaaucauauucuaaaauccuguaaccuaaaacagagcaggcuaaguuuccaggccagccagcauaauucuguuuuauccauaauauguauuaugccuugauguuugauacucuucccucuggaaacacacagaacuagcagaaggaagaaaaagguuuuuuccacguugccgagcaguagggcaaaauagaucucgggauuucgggaucucuccuauuugccaaauucuuuacauccuuuucuuucugccucuugcuuucuccuuaaaaauaauaauaauaauaauucuauuacucaauuugguagcuaaaugugaaaaaaaaaacagguaacuuuuuuauuaucacuuugacagcuacuuaccuuccuuaagagggccaguuucagccgggcgugguugcucaaaccuguaauccuggcacuuugggcagccaaggcagguggaucaccugaggucaggaguuaaagaccagccuggccaacauggcaaaacccuaucucuacugaaaauacaaaaaaaaaugagcagggcgucauggcgcgugccuguaaucccagcuacuggggggcugaggcaggaggaucgcuuaaacccgggaggcggagguugcagugagcugagaucaugccacugcacuccagccuuuuugagacacagcaagacugucucaaaaaaaaaaaggccagucaguaacuuugaucuauaaauauaauuauugggauuucagguggguggaggaagauuuuuaaagcaagagcaguuuuucuuuuuauuuuguaauggggucucgccauguuucccaggcugaucucaaacuccuggccucaagcaauccuccugccucagccucccaaguaggggggguugcaggcucuaguacugcauccagcucaaaagauuacaauucugcaguaaaucauagugugacaguaagguguuguauguuuacaguuggacuguuucucaugaguacaggccccuccuugucugcagauggggaacccgcagauguacaagccuagaugcaagggacuugagcaucugugaauuuggguauccucgggggcuccuggaaccuguuccccauggaugcucagggagaacuguggcuccuggaaccaauuccccauggaugcucagggaggacuguguugcacaguggucuugcaacgccuguaaggucauagucauacugucccucuucucagcuguaaaugggcugguaaaagaaucugucucauuaauguguugaaaauucagugagauaacacaaagcacuugguucucuuucuuuacguaagaauugcuuauuaaaacuggagucguaaauguuauaauacuuaaaccugucuguugccccuuaaauguagaagcuucuagacaauagaaacuaagucauaagugauuuuuguagucaucagaugugugcuuuuaaccauugaaauuauauguaacaguguuugcuuuuucuguuuguuucauuagucucauauaauggcagcaaaggcuguagcaaauacaaugagaacaucacuuggaccaaaugguaagaguccaccauuccguguuuuuuagcaaaagauuuaaauuauaaaacugucaauauaaaccucucuacagaaagguggaguauugaggggaggcaucuuacuuccuuaacacagccaaaauuuuuuaguguauuucagguuucuuaaacaugguuauaaucgugugcaauauuaggucggaccuuuuuuuuuuuuuuuuuagcauguaacaucauuucauuagcauuuuccaaaucauaguugucuuuugagauuaacauuauacuuaaugaugcuccauaauguuuugccaauuauguuagccaaucuaaaaaugccuucaugcagcuacuauuuuguguauguugcauuauuuguauauaauaaauugcacagauaagagcugggucaggaggucuuguuuuauaguuugugauauugguugccaguuuuuugcgcaaagccuacuaaacguuguuuuuuagggcuugauaagaugaugguggauaaggauggagaugugacuguaacuaaugauggggccaccaucuuaagcaugauggauguugaucaucagauugccaagcugaugguggaacuguccaagucucaggaugaugaaauuggagauggaaccacaggagugguugguaagaaaagacaaaacauccuuucucauuuaagagacgucauuuaagaccacagggcuaacaugccugcugagauuguugucucugaaucagagcaugaggagacagacaaauccaaguugaaaacaugcuacaaaacaaaugucggacuuucaaaacugacaguguuacaaaagaacagaaagagggcuggggauuguuaggcauggagaaauguguaaugauugauuggacacugauuuugcuugucuuuuaagcuauaaaggauguuugggaaacguggaagaauuugauuuuggaucauguacugcaaugcugaguuuccugagugaucugugaccauuauauugcagauguguaggagaaugcccuucuucucagcuguauaccuaaauacuuaggagugacaugucaugguuucuguaacuaauucucaaauaguugaacagaaacaguauguacauguagagaaaauguggcaaaauguuaauaaguaaacugguauucguuuuaguauuguaccuuuuuuuucugaagauuugaaaucuuuaaaaaguuggggagauugaagacaaaauaucaguaagguuaccuuuucugcagaugaaauuugaauucauucaacaaauauuuauuggauacuauuguaugccaagcacuguucucggugcgcuuggagagcuguagauuuaaacaaaauucaucuuugcgacccuaaaaugaggagaaaggaggauggggguggggggaauaaauaauaaacacguuuuagucucaucaccaggcugaauuucacugaguagacccuggcccaggaaacauaauagcuuuuuaccucuuagaaaaauguucuuuuuacauuauauucuuuaguuacguucuucacaucacugaggguugaauguucaucuguaaggggacacauguccuauucgaccuucgcuagaacuaaaacgaggcuuucuuuuaaaaauagagggcuucugccucuaagaugacuugcagcuuaauucuagaagcugcuucuuuccaugauagcaucuaacuugugcugauuauacuaaaagugaaguuuuguuguuugccugaacugauugucugcuggcuuauuugcaguccuggcuggugccuuguuagaagaagcggagcaauugcuagaccgaggcauucacccaaucagaauagccgauggcuaugagcaggcugcucguguugcuauugaacaccuggacaagaucagcgauagcguccuuguugacauaaaggacaccgaaccccugauucagacagcaaaaaccacgcugggcuccaaaguguacguuucaguagaugauaugauuacccauuuguagaggaggcaguuuguuugccauuucuuaaaggcaacacaaaaugaccacugguggauuuguaucgauuugauuauuuguuuugauuacuugguuuugcuuuguuuuuaauguagauguagacagaugcauuuuguauuuaaguugagaacugaauuucuaaguucagguauaaauccccuugacaauauuugcaaaauauaguuauuuuaauuuagcagaauagguuguguuaaaaaucagcuaaggcuggaugcaguggcucauacuuguaaucucagcacuuuaggaggccaaagcaguagcuugcuugagcucaggaauugaagaccagccagggcaauguagugggaccccaucgcuacaaaacaaaaaacuagccaggcaugguagcacacacuucagcaacuccagaggcugaggugagaggucgaggcugcagcaagccaugaucaugccacugcacuccagcuugagcaacagagcgagacccugucucaaaaaaaaaaaaaagucaacuagaaaggguccuaccuggaggauaugugaauuuucuuaacacuucuuucuauaauuucuuugcuggggagccauuggggguggguuccacuuuuuauucagcaaauugccgauccaaaauuauaauuuaguaaagagagucuugaaagcgacuugucucugguguuuucagcguucguguaauguccguuugccaggcuuacugccaggucuuaugggcacuaagacacagcucuucucccaggagacucuaagcaaccucagccaaggggugcgcugauuauguacaaugccaaagacuuaaggucuguugccguaauauaacauaaaaauccaguguaagcugcuuuauuacauuauauuaaaucagugagagauguuuucaauugugugcuuguggugguuuuagcaaaaaggaaugagggaucuucuaaacucagaguagucagggaaaaugcaggaaaagugucugcuucuguugccuuuuccccugagcaaagccuauguuagagcagaagccuucagcaaugccugcuguccuccucuaaccacagaucucagcagagacuagcucccuaggcaagagugaguacccuagggguagccucuugucacaaguauaacacuuauuuucucaugaaaggaggacaucaucauuacuugaaguguacaaaucaguuuucuuguugcuuuauaaguuggccuuguucuguuugcaaguauuaagucaucuacuuaagauacaacauguuuacuuucaugguucucuuuuauagauaaccugugauuucagacauuauuucaagugcuagguuucccuaguuguuuuucuuggcucaaaaauuaauuuauugaacugucuauucacauguuucaaagcuuucaaaaagguaacacccuccaucuauaauggauguuguggugaauucuuggaaaguuuaaaugcccuguccaguccuuucaguuccugguuagugcuacacuucauugagauaagagugacucuuccugagugauuacuuaccuuucccauucuguucugaacuuguaaaauaguaacaguauucuguaaaagugcugcauucuaagaagaccuuaauucaugccagacuacagugguuucuugaguacauucauaauggaaggaaauaguaaauuucagaguuagcgaaaauaaagauguaauuuuuuccuaucuaaguauacaguccccuuuagggcccauggaucacagguuaagaaucugccccagacuguugaaaaugcagguugagauggcauuccccucuagaagacucaaaacaucguuugauuuauaucuuugaguaacauuguguuauguggccugcuuugguugcaguaauugugaaaccaaugaaguuuguuuugugguguuuuccucagggucaacaguugucaccgacagauggcugagauugcugugaaugccguccucacuguagcagauauggagcggagagacguugacuuugagcuuaucaaaguagaaggcaaagugggcggcaggcuggaggacacuaaacugauuaagggcgugauuguggacaaggauuucagucacccacagaugccaaaagugagccauugcaucucacagcuucgcacuguugguuaacucuuaauuccaccaauuaaaaugucuuuauguucccccauagaaaguggaagaugcgaagauugcaauucucacauguccauuugaaccacccaaaccaaaaacaaagcauaagcuggaugugaccucugucgaagauuauaaagcccuucagaaauacgaaaaggagaaauuugaagagaugauucaacaaguaagucuuaccagaguccucaguggaauuuaaacucccaaaggguacaguuaguuagguuugguuaguaaauauguguagucuuucuucaguucuaaaacauacacaggaaaaaaccaaauugcauagaaaggcauaaacagggaagaauucuaauuuugucuuaaaaugguagcguguucaggccaggugcaguggccaugccuauaaucccagcacuuugggaggcuaaggcaggcagaucgugagaucaucgagaccaucugacuaacacggugaaacgccauuucuacuaaaaacacaaaaaauuagccaggcaugguggcaggcaccuauaguccuagcuacucaggaggcugagacaggagaaucgcuugaacccaggaggcagagguugcagugagcugagcuugcaccacuacacuccagccugggcgacagagcaagacucugucucaaaaaaaaugguaguguguucaggguccugaaagaagugacccuguuaccuaaagccgugcuuucaauuguacauauuauauuugccguccuggacaaauuuaacuuagcuuaccuugccuuuaagauuucugacuauaccuuuuaggcaagaguuaaugaguaacuggaguuaaaccagaaugcacucauaguaaucccaguucuuugcucaguuaagucuaguuuggguucaugaauaccuuagcguaggugugcuuucucucugacauagcaacuccucuuugggggcugcguccuugggaguugaaaacaccaguacucaagaagacaggaacguggguugguuaggguauuauuuaucauagcaaaccaacuagagacuauuuucaugucuguucuugggaaaguuguugaauguacucauugaugauacgguucuuggugccuacgacauaccaggcucuguuguaggcacuaaagguacagcagggaaugaagccaagcucgugcucuugagacacagauaagagaaagguggguacagcuccauuacagacacuggucagagaggugaccuguaaggagaggccaacauagggugagagcagugccccugggggaggagcauuccaggcugaggacagauggggaugcuccugagccaggaacauuguuggcuuguacaaggaagagccagccucagggauugaagcaugcuggcgggagcuuauaaauaaaaggccaucaucugggccggugggacaguuuucaugagaauggugccucagcugugcuggggggccacagauaaauugagaggccagggauguuacuggaucgugcuggugaggcgcagguugcugagaaugagaagggaaugacgauggggcuagauaguaaaauguuaaagaaugagaggcagggacccaaagaggaacacugcaggugacugaggagcaagaaggacccucuccuguucugagcaugugagagggaaagcagcugccaucugaggaggguugcaggggcagguugguuuuccgggguugugacggagagauuguauaaggaggcugcuguucuggacugaguuccagagggucagggaaggaagagagggagagccaggcaguagcagguagccugggaggccugauggagacagguaagccagaguuguggggcacgguguggcagucccaggugagcaccagagguggggugggcagccugaucguugcccuccuaauugggaaaagugacuuugccauuugcaggucggggugagggugcuucuuacuggaagcaggguugccucugugagugcccgaauuaguuuauggauccacugaggauuguccacucaggugagacagucaaguugcaagugguucauaacauuguuuguuuaaaacauacucaggugaaacuacucuguagguguuugugacaggacagagcuguuagccauuuccccaugguuggggaaggguguuagcuuuguugacguuucuguggguuuugccucacuguaacaauaggguucagcagaauuacugcuugugguuuuuaaagcauaaacaaugaggugauccccauugauaaaauauucacuauuuagaauuuggaacugacagaaaaguggacacuugucuauuuccuuccuucucuuuccuuugcuuuuguguuugagugcaccugccuuacacccaacugugccucuccuuuuuucaaacauuguaaugaagaauaaauacccacuuucucuuaauacgauuguggugguucuuuucccagauuaaagagacuggugcuaaccuagcaauuugucaguggggcuuugaugaugaagcaaaucacuuacuucuucagaacaacuugccugcgguucgcuggguaggaggaccugaaauugagguaggauguuccacgugaagagacuuugagaaguagggguucaucuuauguguugagggguguuuugauagcccugccuuaaauaacugcaucacaccaaggcuggcagaugaggggagggugagcugggagagaggaaagcgcuggaaucuuuguuacuguuuggauaacagugcuguguguuucugguguucccuggcauuuugaaauucucucccuguguugucucacuuggcccugucguugacuuacuaaggcuggaagaccuggucucauccaaauacuaauggcagucccaggcaacggugccucggugguucucacugcagcgcagugcaaggaacaugcaggcuggguucccagagugagggagggcugcacagaugggagaugaggguaugagcuuaggggacgggcgccgggugauagaucugggcagcaccaaagccccaaucaagacguccagcucaagagccuuguuaccuagcaaggugcuuuggguugaacuggagaugucucggucaaaguggggcagcaguucuagugaacaaguuggucuuagaucaaguuuugcucauuuguggcccaguuuugaaaguuaacuucaccaguacugucuucauccuucucccugaccaccccaauuagcugauugccaucgcaacaggagggcggaucguccccagguucucagagcucacagccgagaagcugggcuuugcuggucuuguacaggagaucucauuugggacaacuaaggauaaaaugcuggucaucgagcaguguaagaacuccagagcuguaaccauuuuuauuagaggaggaaauaagauggugagaauucaacuauuuguccuauacuguugcuuauuuugcuucauggucuggcuuuuuugccuguguguauuuaacagagacacagucaccauaagaaaaauaaucgugguucucaaacaaugacguaucaugguguaaaauuacugaagaccauguuaaauuguuaauuucacaaggcacauuugccuuucugcugucccuuagaguauacaauauacacuaugagauuuuuauaucuuuuuaaauacuuaaacacaguuuaaauauucaaguccuggauuuuagaauguuugauacaguuacauuagggguugguuaaacugcuagcccuagcaacauaagacucauuuuaauuacaauaugguauuauuaccaaggaugacuuacaucugucccuuagguagaaaaagggaacccaagugaauaaccauugacgaucucuguucuuugagaaugaguuuuuagcacauugugauaaaucuuugcgaguuuugucaguuuuugacucuugcuugaccguguauccuagaaugagucacuggccgccucugccucuugaauuuuguuaacuacauugcaggaaggaaagcuagaaagauaaauauuauccgauaguggaggccaucuaaauauuagagcacagccucucugucuuuaaaaaggugccagauacuuggcucuaaauugacuagaucuugaucacauuaauucaggcaaagcuguuuuccuuagaucauugaggaggcgaaacgaucccuucacgaugcuuugugugucauccggaaccucauccgcgauaaucgugugguguauggaggaggggcugcugagauauccugugcccuggcaguuagccaagaggcggauaagguaagggaucugugcagacuuagugaaagauucaggccucgcugaugguggagacugugaagcugcggaacagcgaggugcuggaugcaaaacaagcaucgugagcuguguguaggugacagguguuuuaaucuaaguuaauucccacguuccuguauucagauucugguuaccauaaccuagcauuucucagcuguuuucagccaguucguccuugaaauaauaaaucuauagucuuuuaauguuauuugaaauucaaaauuaauauuauaacuuaaaaauaaagccauaagagcugcuguauuuugagacaucucucacauguauguauacccucugccuguauucuguggugacauuauaauauucugauagauacaaaaauaaagacagccuguucuuacaauucuuugugagcugacuuuucaaaguaugugauacaguuguguuuucacggugccgcuggguuguuuuguuucgccaagugcacucaccauacuucuguaccuuuccagugccccaccuuagaacaguaugccaugagagcguuugccgacgcacuggaggucauccccauggcccucucugaaaacaguggcaugaaucccauccagacuaugaccgaaguccgagccagacaggugaaggagaugaacccugcucuuggcaucgacuguuugcacaaggggacaaauggugaggagcugucacgccucugcguggagggggggggaugucugauuuaaacugaauaaucauccacuguaugugcugugagaugauggugucuuuuuaaauauguaagcccacuucagguguucaaguccugaauuuuagaauguuugauugccguaggaauugguuagacuacuagaccuagcaacaugagacucauuguaauaacaguaaagugcauaugguacuaucaccaaagaugacuuagguuuuaaucucugguuuuugggaaguaaugccuuauugcuguuuuuacacagaugucugucagugggcagcauauauauaacagcucugaagugggcuuuaguucacaguucacugugugguuaauccugcacacuguggaguguuuucuaaauguaauauauaaccucuguagccacuuguguagcucggcucccaaaaagauaugguggcuguagcuuguugaaacaguggucucaggcauuucuguacuaaaucaggccaugucuguaauccauccacagaaugacagcuuuugcuuaaagguauagguacauucugcuuuccaugcucaaauuccaaggguuucaauaguagcaacucuuugugaggcaaacauuuaauguuucuaacuugaaugccugguugugcucaaauuuagcauuucuagggccgggcgcagugacucaugucuguaaucccagcacuuuaggaggccaagccggguggaucaccugaggucaggaguuugacaccagccugaccaacauggugaaacaccaucucuacaaaaaauacaaaauuagccaggccuggucagggcaggcaccuguaaucccagcuacucgggaggcugaggcaggagaaucgcuugaacccgggacgcagagguuccagugagcugagaucgcacuguuguauuccagccugggugacaccugucuccaaaaaaaaaauuagcauuucuagaucuuucuuggaaauaucuuacauuucagcuguggucagauggacuuacuuuagauuuccuaaguuaggguauggauacuuugugggauaagauguuccugaaaaaugucacccuguagcuagucauugaagacagugcccucccaacagcucucuuuaccaggugcgaguuccagaguguccuuggaaguaaugaaauuacauucaucugaaaaugaaauauaacugaaauuaguggcuuccugcuuggcuuccaggaguuuguauuucuuaagucuuacugugauucccuaaaucagaaagaguugguuauugauaguuuauuguaugcuauuuuaggauaaucaguguccuuguauuuuucagauaugaagcaacagcaugucauagaaaccuugauuggcaaaaagcaacagauaucucuugcaacacaaaugguuagaaugauuuugaagauugaugacauucguaagccuggagaaucugaagaaugaagacauugagaaaacuauguagcaagauccacuucugugauuaaguaaauggaugucucgugaugcaucuacaguuauuuauuguuacauccuuuuccagacacuguagaugcuauaauaaaaauagcuguuugguaaccauaguuucacuuguucaaagcuguguaaucguggggguaccaucucaacugcuuuuguauucauuguauuaaaagaaucuguuuaaacaaccuuuaucuucucuucggguuuaagaaacguuuauuguaacaguaauuaaaugcugccuuaauugaagggguuuggguggauuuuuuuuucucaaaauaagcuguagggacuauuuuaacagcuuaaacaggagcucucaagaugcacuuucauauugagaggaauaugggcuugauccucuuccuaucuaaaugggugggccauuugauuguagaggguccaccacagaauuaugggaugccuuaagugcuguuacuagguugcucacagccuaaccuggcguguuguuuagggcugauggagacccaugugagccuuugcuuuccucuggccccggccccacccugaacacagcucauacacagaaucaggaccagcaugugcagagcuggccaccagcacaggcuuagggcaguucagaacccacuuguuucccuaucagagggacacagugaaguggagguuaaaguaaauuacaggaaauaagggagaaaucuugcaguuaccauguucagauagagugacugaaauuaauuguacuuacuaaaguauuaacuagcuaacagugaugggccaagacgcuccgagaacucuaccgggauugucuguucugacaacccagugaggcagauacacuuucuuacugcucacaucuuacaggugaguacucauaauuggccagcaucucaccaccagcaaguaguagggccaggucaaucccaggcagucugaccccagaguggcccagcucauccccuacucuguuauuugcuuguuaaugauucucuagauuuucuaaaauaauguuucuuagcauugugaugauaaagcucaugaugaacuuuaucacuaguuaugccaccuuaacuagucagauuuccuagaauuaggaaauggugacucuugucuaaauuugguuaagugaugaauuuggguuaccgucucaugugaaccuggagauucaccagucuuaacuuuugggucauuguguuuucucuacauucaugcauuggauguuuugcuaaauaacuccuguggauuuaggaaugugugcuaauagcaaucuuccuaauuuucauguuuauauggaacuaugcaguugaguauugaaagcuuuaaacugaguuuauuuacaaggacugagucuagccuacagagaacauacagcagccuucuuuggaccacagucuuauccgaggggucugugguuguaucagaagagccacuaaaccaaucccccuuuccaaaauugaaccucacagacguuccuguuuuuugugauugagaaacuggucaaugaacaggaagacuuagagauguuucacaagccuuugauuuuuguuucauuuauuuguaauaaaccucuuccacguga

SEQ ID NO: 192537 - RNA, 77022 nt, Homo sapiens
gaaucucgacccuugaauggaguuacacgaacggccagaugaaagaaggaaggcccggaccuccacucagggccgacuaggggacuggcggagggugcacgcugauggauuuacucaccgggugcuuggagcuccagcagcuggcuggagcccgcgaugacgucacggacucgggucacauggccaaguccgccccgcccccuccccguccccgccgcugcagcggucgccuucggagcgaaggguaccgacccggcagaagcucggagcucucgggguaucgaggaggcaggcccgcgggcgcacgggcgagcgggccgggagccggagcggcggaggagccggcagcagcggcgcggcgggcuccaggcgaggcggucgacgcuccugaaaacuugcgcgcgcgcucgcgccacugcgcccggagcgaugaagauggucgcgcccuggacgcgguucuacuccaacagcugcugcuugugcugccauguccgcaccggcaccauccugcucggcgucugguaucuggugagcgcggcgcgcccggcccgggacccugcguugcuuccgcgccccuagcugggcuucuggcccggccucgcgguggggugaggcgugcgcucauccgccuaaaguuguauuauuagaaacuuaauucuccgggugccgcguccgcacuucccccggcugggccagcgccgacugggggaggccaggaguuuggggcgaugggggaggccaggggcgcggggcggagggccgcacucgacccuuggcgcccagguggugugggucgccgaucuccagccuccgcgcagccccgcggccucgcguagggcgcaccggggcagacaaacugagcuuaucugccgagcacguguuuccuuucuucuuaaagcccgugggcuuuguguuucgacggcugcggacggagcggucgcggaggugacggcgcauauuuugcagcucugugguuaggguugcggauuugucaaugcucguucucccuggccgcgucuccgcuaggguggccugcgcuuucacgccgucgcacguucggaucccgaguugaagugguugggaguucuuggcauccucuugugaaugggucccccccccgauguuuuaaagcccuuacuccaggaagggaugugagugugauuuacugcguuuccaucugcccggggaagccauuuuccacccacauuuuuccugcccguggacaguuggucuucagaccuuuucuugacagacucagcgggcaaaucuggcauuuuuuuuccugguuggaacuuuugaagucuuuuuuuguaugaggagcagugauuuucagagcuagugaggaaaccugauggagucuugcccgcaccugcccugcguugguugguggcaccccuagacugcaccagcacugagucggauuccgcugcauuuuggguuuugugacaucaugauggagaguuagaccagaguugcuuugcagugaauaccacugcaucgcgagaaaaugcccugaaaaugguagacaaauagcauauauaacuuuuuucagugagguuuuuuuuuuuuuuuuuuuuuuuuuuugagacagagucucacucuguggcccgggcuggagugcaauggcaugaucucugcucacugcagccuucgccucccagguucaagcgauucuccuuccucagcuucccgaguagcugggauugcaggcgcccgccacuaugccuagcuaauuuuuuguauuuuuaguagagacaggguuucaccauguuggccaggcuggucucgaacugcugaccucgugauucgcccgccuuggacucccaaagugcugagauuacaggcgugagugagccaccgcgcccggccgagaaaaauucuuaucucuuuaaugaguuggggugugugugugugguuuguuuauugggcccauuuuuggguagaauauggacuuuuugucuaacugugaaccccuuccuuguaccauuuuaagcaaaacauuucaccccaggcauaugguauucacugugcuauuuauaguuucaaguuuccuuuagucagugccuaucauggccacacaauauaaauuuuuggcgugaaaguauuucaaacagauauuuagcguguguggguucuuacugugcaguguaaauacagauggaacaucagcauauuagcuaaacuucgacuuugguaaaagccaagaaauucuuuacugaaauugaaaauuauagcaaaaggauaguagguggcucaaaauaguuggugcuuuuauugaugaucaagacagccuguuuuauacaagugucugccuuccuugaaaauguucaaaucugccgacuugcaaguacaucagagaacguaauuuguaaaaucuagggcauugcauuaggcaaauguacuacgugauccacaggaaagauaaauccuacuugagcccuguuggcuguaauccaaccagacaguguaggugugauaaaaggagaguacucagcaugcuuugucuacuguuugagcacgcucucuguggaaaguaguuauugguguguuugucuuaacguuuggaaauaaauggccuuuugaaagguaauuagaaagcuuucuagcagaugugaauaaaaauguugcuuuagguaaacccuauuucugggaaaccuggcuuaaguacugguaaucuuuauaaauagucuuuugcauuucacaaggcaauguaagccuuuuucuuuucuuucuuuuuuuuuuuuaaaguagugauuuucacucagaccuuugaauauaauuuugugauacccuaccuuguuuuaaccugaauugacucucccuuagcuaagagccagacaagacuccaucuuggcuccuucacuugcagccccuuacccacccgcuuccucaaggacuuaacuugugcaagcugacucccagcacauccaagaaugcaauuaacugauaagauacuguggcaagcuauauccgcaguucccaggaauucgcccgguuaauaguacccagagcccccgcguuuguguccgguugauaacacccaaagccccgcgucugucaccuugugauagauuuaaagccccugcaccuggaacuguuuacuuuccuguaaccauuuguccuuuuaacuuuuugccuacuuuguuuuaacuagacucucccccuccccuuucugaacaaaaguauaaaagaaaaucuagccccuucuuuagggccaagagaauuuugagcacuagccgucucugggucgccggcuaauaaaggacuccugaauucgucucagagugugguuucucuauaaguugcucgguuacaacaauuugguuguccaaaacuuugauuuucuugaacuuuuuuaagagaguuuguguggcuagggagcaggaccacuguaaaacgaggcaccuucccugguuuguccuaacccuuucucucagccagccaucuggauggaauggagucaauuaucagaaaguggagaguuaagaauuagccaggugugguggcucacaccuguagucccagcuugagucccaggaguucgaagcugcagugagcugugauugcaccccuacacuccagccugggcaaccagagugagcacugucucuuaacagaggccaagugcgguggcucacgcuuguaaucccagcauuuugggaggcugaggcgggcagaucauuggaggucaggaguucgagaccagccugaccaaccauggccagugugguaaaaccccaucucuacuaaaaguacaaauuaggugcggugguguaggccuauaaucccagcuacuugggagacugaggcaggagaauugcuugaaccugggaggcauagguugcagugagccaagauugugccacugcacucuagccugggugacagugagacucugucucaaaaaaagaaaaaaaaagagaaagaggccuggugcagaggcucacgccuguaagcacuuugggcggccgagguaggcggaucacuugaggucaggaguucuagaccagccugggcaacauggcaagaucccgucucuaauaaaaauacaaaaauuauucggucgugguggcaugcgccuguaaucccagcuacucaggaggcugaggcaugagaauugcuugaacucuggagguggaaaguccagccugggugacagcaagacucuuaucuaaaaaaaaaaaaaaaaaaguuggguguggguggcucacgccuauaaucccagcacuuugggaggccgaggugaguggaucuugaggucaggaguucaaaaccagucuggccaagguggugaaaccucaucucuacuaaaacuacaaaauuagucgggcgcaguggcaggcaccuguaaucucagcugcuggggaggcagaggcaggagaaucccuugaacccagguggcagagguugccgugagccgagaucacgccacugcacuccagcuugggcaacagagugagacucugucucaaaaaaaaaaaaaaaaaagaaaaguaaaauaaagaauaauaauaauaaagcggagaguuuucagacaaggcagauauuuaaauaagaguccaggccggguacgguggcucauaccuguaaucccagcacuuucggagacugaggcggguggaucaccugaggucaggaguuuugagaccagccuggcuaacaugaugaaacccuguuucuauuaaaaauauaaaaaauuaguggggcgugguggcacgugccuguaaccccagcuacuugggaagcugagagaagaaucauuugaacccaggaggcggagguugcagugagcugagaucgugcgauugcacuccagcuugggcaacaaaagcgaaacucugucucaaaauaaauaaauaaauaaaacaaaaaguaagaguccacaauaagggcucauuuaaguaauuuccuguuuugcaagauagguaaaguggaucuuuuuuauauguuuucuuauuguugauuccuaccaauaccguuuacuaaggcuccaagugucauguacuuuacuagauacuuugcauaagguuaauuuuuacauauuccuggugagguagauuuucuuauucccauuuuacagaugagaaaacugaggcuuagagaacuuuggugauuuacuugagagcuuaaaaucccaugguugguuuaugaucugagugauguuuuaaucuguucuguuuccacuguuuuacuuuuaaaaguugugcauguguuuugguuuugucuuggaauaauaaaaguuuuccuucaguccugaaguaaaguauauugacuucagguauuuauuauuauuauuacuauuuuuaaaauucugggccacgcuaacuuugggagacuucagguauuuauucuagagaucauuuuuuguuugucucuuuuuuuuucuuuuauugaguugugauuuauguacuacaauuuuuuuuuuuugagaccgagucucgcucugacgcccaggcuggagugcaguggcgugaucucggcucaccacaaccuccgccuccuggguucaagcgauucuccugcucagccuccugaguagcugggauuacaggugagcuccgggcuaauuuuuguauuuuuaguagagaugggguuuccccauguuguucaggcuggucuugaacuccugaccuugugauccauccgccuuggccucccaaagugcugagauuacaggcgugagccacugugcccggccuuuuuuuuuuuuuuuuuuuuugaggaguuuugcucuuauugcucaggccgaagugcaguggugcaaucucagcucacugcaaccuucgccuccuggguucaagugauuccugccucagccucccaaguagcugguauuacaggcacccaccacugcgcuuggcuaauuuuuguuuuccuaguagagacaggguuucauuauguuggccaggcuggucuugaacuccugaccucaggugauccgcccgccucggccucccacagugcugggauuacaggcgugagccaccgugcccggcaaaauucacaguuaaauguaguuuauugaguugacaaaugccucuguaauguaacccacauuccuugagaacauuuccaaacuuucagcaaguucccuugugcuguuucccaguuaaucccugccauauccccaaucacuguagguaaguuuugcuuauucauguaaaauggaauuaugcuguguguacccuucuguaucuagcuucuuucacuuagcauaacuucuuuuagauucauucaucuucuuggaguguugcuuuuuauugcugaguauuguuuuuauuguauuaauauaccacaauuuguuuauccauuugccagauauuggacauuuggguuauuuccaauuuggggcuauuauaaauaaagcugcacugaacauucuugcacaagacuuuggggacuuuuuuuuuuuuuuuugagacagaguuuagcucuuguugcccaggcuggagugcaauggugcgaucucggcucaccgcaaccuccgacucccagguucaagcaauucuccugccucagccucccuaguagcugggauuacaggcaugcgccaccacaccuguuuaauuuuguauuuuuaguagauaacaggauuucuccauguuggucaggcuggucucgaacucccgaccucuggugaucugcuccccucagccucccaaagugcugggauuacaggccugagccaccaugcccagcuuuuuuuuuuuuuuuuuuuuuuuuuuugugacaagaucucacucuauugcccaggcuggaguggcucaaugcagccuugucuucccuggcucaagcagccuugccauuucagccucccaaguagcugggacuacaggcucacaccaccacuccacaccacuccaggcuuuuguuuuugagacagagccucacucuguuguccaggcuggagugcaguggcgcagucucagcucacugcaacgucugccucccggguucaagcgauucuccugccucagucuccugaguagcugguacuacaggcaugcgccaccaucccuggcuaauuuuuuauuuuugguagagacgggguuucaccauguuggucaggcuugucucgaacuccugaccuccugauccaccugcuucggccucccaaagugcugggauuacgggcgugagccaccguccccagccuuuuuuuuuuucugagacggagucucgcucuuguugcccaggcuggagugcaguggugcagucucggcucacugcagccuccgccucuuggguucaagugauucuccugcuucagccuccaaaguagcugggauugcaggcaugcaccaccauaccuggcuaauuuuguauuuuauuuauuuauuuauuuauuuauuuauuuauuuauuuauuuuuuaguagagacgggguuucuccauguuagucaagcuggucucaaacucccgaccucaggugaucugcccgccuuggccucccaaaguguugggauuacaagugugagccaccgcgcccggccuuuuuuuuuuuuuuuuuuuaaauauccuuguucaguuauuuuuuaggaacuuagacacagcaaauacauaccaaaugccucugugccagacacuguucacaggguaguuagccauauaucagauuauaaaggauaaaagaggucagaguagcugcuucauuggcuuuaugaccuggucuuucuuuuuaauuuucuuucuuucuuuuucuuuuguuuuuuaauuauacuuuaaguucugggauacaagugcagaccuggucuuucaaagaauccacuuguucacauagaaacucacaguuuccuuguuuacucaaguaaaggaaaccagaauaucucacccaaaauauaccucuuugguauauuucaagauaguauuagagaaacugcaaacaagaauagcucugaaaagcugcuguuuguggagauuugcaucuuuagggaaaaucugcauuagugaaauaaacagccaggcuuucucugagcacaccuccccaccccaucccccauguucagaccuuggaaagauuaaccgagagauugagagucugacaccuuugaaggucuaauagagaaguuuaccacauaccacaggcuaccaaguaucuuuucucaagccuucuaccuguggggucucauuugcauaacaagaccaccuucccuagccaggccuuuccgucccucccucccauaaccuguuuugccgugaucuaaaccccuauucuuucuguaacuucagaaagacauuaaaacuuaaaccaucuggcccuuccuuugaguuuucuuauuucugugacucccacguaugcgugugcacguaauacauuuguaugccguuucuugcuguugaucuauuaucaguuuguuuauuagacucaaaugaucaaaccuucagaaguuguagaagggggagaauuuucuucaccccuucacaagccugauagauuuucuuuguauucugagaaguucaacaacuauugauuugucugaguacaggauaguaagaccaacauccuguauuuguagagugauugauagcuuucggugggcauucacauuuguucuuauuuagaccucaaagcaacccugggucacgcaugauagguggugauauguucuuuuaagauuaauagcuucuuuccaacugucagauucugugacuuggcccguaauuucaggauagaauaacggacugauuuguggcaauugugucaucuuuauugccugguguuuuccccacuauguuagauuguaaaagacuaaauaguaggcuaaagaguuuggauuuuauucuguaggcaguggggaaccauugaagaauuaugaacaggagcgauaugaugaaagcaguuuuuuuugguuguuguuuuuguuuuguuuuguuuuuugagacggagucucgcucugucacccaggcuggagugcaguggugggaucuccacucacugcaagcucugccucccggguucaagccauucuccugccucagccucucgaguagcugggacuacaggcgcccaccaccacaccccgcugauuuuuuuauuuuuaauagagaugagguuucaacgugguagccaggaugaucucaaucuccugacuucgugaucugcccaccucagccucccaaaguguugggauuacaggcaugagccaccacgccuggccaaugaaagcaguuuuuaaguuagauuaaaauggcaggcuguuucagauggcuggaaaaccaggcaguauguuauauauagcucucuagauacaaacuauaguggguaucagcucuuagugguaugaauaagauggauaggaauuuuuaccaguuagugagugauacaagucucucuuucuaccuagguuuucuccaucugauuuaaggaauugaacagauuuagauagggaaggacauuggauuuuuaaaguacagguuuccccucaucuaauaaaggaucaagggcaguucuauagaacauugguugguggagauuucagugguauucaauaucuuuuuaagcuuuuaucacacuuuuuuuuuuuuugaggcaguuucauucugucacccaugauggagugcaguggugccaucucgguucccugcaaccuccaccucccggguucaagcccuucucuugccucagccucccgaguacaugggauuacaggcgcaggccaccacgccuggcuuaauuuaguagagaugggguuucaccauguugaccaggcuggucuagaacucuugaccucaggugauccgcccgccucccaaagugcugggauugcaggccugagccucuuaucacacuuuuaugguaaauguucauuagaauguuuuacagacaagguggccaauaaauaaagauugcuaucaaaacuguuuauuaauaccaaucacucucggauucacuuuaaauauauuuaacuucgaccuaaaaggaagaagcugaggcaaaauuaauguaaguagagaguuuauuugggccaggcuugaggauugcaaccccagaauauagacugacguugcccugacuguacacacagauuagcagcaguuauaagugcauuuuuaaagacugaaagggggaacagggaguguacugauacaaaguuguuugucaggaauuguccuugauuuacagaaacaacauugguucgugauuggcuauccauuguugagcuaugcauuauuagguuaauuugcagcugcuuguggcaauagcaaucaguuucaacaguugaagacauagcucaaaagggagggggaguagaaagugauugcuguaucguuuuaaugucucucugggccugauaauaaagacuugcaucccucagauaaaaguuauuuucucaguaacuuagcauaaaguauuaaguuaacaugaguuuugucguacaauguguauuauguuugaaugaguaauauauuuguuuugucaauuuaacuuugaaucuuggcccugaaggaagaggccacaguugucccauucugccccaccaccuuuugggcugauuugucauuggucaaaggaaugcuaguggaaauaaugugugagcccuagcaacucuccuuuuccuccucccaguucuugagacucuuaguagagcuuuuggagacugaaugagaguuguugaguuauugguuaacucauugugcuugacggaaaguaaaaagcaaacaaagaccacacuucuucaguugcuccuaacguuuuaagaguuucgaguugccucuuugcaguugcagcuuccaagggaaauuguuucucaggaaaauaugugggagguuaaaaaaaaaugcuugaggaaauguaauuucaaauuauuaguaaacauaacauugaacuuaaaaaaaaaacaaggccgggugugguggcucacgccuguaaucccagcacuuugggaggccgaggcgggcaaaucaugagguuccgaguucgagaccagccugaccaacauagugaaacuccaucucuacuaaaaauacaaaaaaauaggcaugguggcacgugccuguagucccagcuacuccagaggcugagcccggagaaucacgugaaccugggaggcggagguuguggugagcugagaucgugccgcuacacuccagcccgggcaacagagcgagacucccgucucagaaaaaaaaaaaaaaaaccauuaaccuugagcuacuaaaauuacacagccaguugguuccauggugcagagauggugaaguaguaacccuuagcauguaguagguacuuagauuuguguugacuaacaguagugggccuggggguugcaaaacugaaggugagccaguuaugcuauagauaaaguugcuauaacaaagaaacgcaaaacugcaggaagguagaaguuuauuucuuuccuguuaacaguucagggaguguuggccaacauuguuccuugaggccauccagagacccaggcugggggguggggguguagcuccaccaucccaaauauugugcauggauuccuucucuggguucuaaggaggcugccuccuuuauguuugucuucaugguggagacauuaccagcaccauguuuguguccuggccugcuguaagggagaaagggguaucuggaggacaaggagcuuuauuuuuuuaaggaugugaaauggaaaaugcacacaucacuuucacuuacaucccaguaaccaaaaacaagacaugugacuuagcugugagggaggcuaggagauguuucuuucuuuuuuuuuuuuuuuugagacugagucuggcucuguugcccaggcuggagugcaguggugcaaucucggcucacugcaagcuccgccucccagguucacgccauucuccugccucagccucccgaguagcugggacuacaggcacccgccaccaggcccagcuaauuuuuguauuuuuaguagagacaggguuucaccauguuagccaggauggucucgaucuccugaccucaugauccauccgccucggccucccaaagugcugggauuacaggcaugaaccauugugcuuggccgauuucuuuuaacagauacaccuaacuuauuaaagucugggguuaauaauaucuuugucuuucuuuuaaagaauacaaguccuuuaacuccagucguuucucucuuguauuuuaguguccuuuucuaaguucccaaacacaucaauuuacaauuaauguuuguuuagaauuacccgcauguuugcaucccucuuucuccauuacuccuuuuuucuuuuuguaaccacuauaauucuuacuuaaaaaugauuuauuuauuuauuuuuuuagacagagucucacuuugucgcccaggcuggagagcgcacuggcaugaucucggcucacugcaaccucuucucccagguucaagugauucuccugcgccagccucccaaguagcugagauuauaggcaccugccaacaugcccagcuaauuuuuguauuucuuuuuuaaaauaaaaggucucauauuuaugaccgaacccagccaaccaacacauucauaaugauucagagagaaaaaauauauucccaauaaaacguccaacuguccagaugguggcgccauuuucagcuugcugugggaagauggugauggccuugacacaguguaaauaugugucaucuuguguguaauuccuuauagauccagcuagcuucuucuccagugucuccuuuuggaguuguaccugauuucauuaccaguuguuaaucugaauccacuggggaaugggacauuuuugcuuuuguuucuuggccaggaaacaauccugaaagucuugugagaagacauggcaagaagcggagucaggcacacaccacgaugguggagaaaggaagagauaacuaauuuucuauuuuuaguagagaugagguuucacuauguugaccaggcuggucuccaacuccugaccucaagugaucaccugccuuggccucccagaagugcugagguuaacagguaugagccaccacgccuggucaaaaaugaauauuuuaacacccaaaguacacagcccaucauuuucuuuugcaccucagaucugcugucuaggaucauuauuccuuuguaugaaauauauauucuaaaauuuccuuuguuaagggucuguuggcugcaacuucugacagccauuuuuuuuuuuugagaugaagucuagcucuguugcccagguuggagugcaguggcucaagcuuggcucacugcaaccuccaccucccggguucaagcgaaucuucugccucagccuccugaguagcugagacuacgggugucugucaccacguccggcuaauuuuuuguauuuuuaguacagacgggguuucaccauguugaccagguuggucucgaacuccugaccucgugauccgcccaccucagccucccaaagugcuggguuuacaggcgugagcuacagcgcccagcccugacagccauuuuuuuggaaaacaucuucauuuggugcucacucuuuauuuauuuauuuauuuauuuauuuauuuauuuauuuauuuauuuauuuugagacggaguuuugcucuuguugcccaggcuggagugcaguggugugaucucgacuuacugcaaccuccgccucccagguucaagcgauuguccugccucagccucccaaguagcugggauuacaggcaagugccaccacgcccggcuaauuuuuuguauuuuuaguagagaugggguuucaccauguuggccaggcuggucuugaaucccuaccuuaggugauccgcccaccuuggccucccaaagugcugggauuacaagugugagccaccacgccuggccuguuuuuuugagguagagucucucuugcccaggcuggagcgcaguggugugaccauggcucacugcagccuugacauccuaggcucaaaugauccucccuccucagccucugaaguagguggaaccugacauacccuaccauaccuggcuaauuuuuuuuuuuuuuuuugagagacggagauuuggucuuauuguccaggcuggagugcaauggugugaucucggcucaucgcaaccccugccucccggguucaagcaauucuucucccgaguagcugggauuacaggcaugcaccaucauaccuggcuaauuuuuuuuguauuuuuaguagagaugggauuucuccauguuggucaggcuggucucgaacuccugaccucaggugaucugccugccucggccucccaaagugcugggauuacaggcaugagccaccuugcccggcccucuuuccaccuuuuuguacccauuaaccuucugccucgucacuccccacuacccuucccagccucugguaaccauccuucuacucucuagcuacgugaguucaaugguuuaaaguuuuagcucccacaaauaugugaaaacaugcaaaguuugguuuccugugccuggcuuauuucacuuuacauaaugaccuccaguuccauccauguuguugcaaaugacaagaucucauuauggcugaauaguacuccauucuguauauguaacacaguuucuuuauccauucaccuguugacagacauuuagguugcuuacaaaucuuggcuauugugaauagugcugcaguaaaaugggagugcagcuauuuuuuuuuugauaagcuuauuuccuuucuuuugaguauauaccuaggugugggauugcugcauuguaugauagcucuauuuuuaguuuuuugaggaaccuccaaacuguucuccauagugguuguauaauuuuuuuuuuuuuuuuagacagagucucacucugucgccaggcuggaguacaguggcgugauccuggcucacugcaaccuccaccuccuggguucaagcaauucuccugccucagcuuccugaguagcugggacuaaaggcacauaccaccaugccuggcuaauuuuuguauuuuuaguagagauggaguuucacuauguuggccaggcuggucucgaacucccgaccuugugaucugcccgccucacucuccuaaagugcugggauccaggcaugagccaccgugccuggccuuaauuuuuguauuuuuaguggaaaugggguuucaccacauuggccaggguagucucaaacuccugaucucaaguuaucugcccgccucagcuucucaaaguguuggacuaugggcgugagccacugcgcccagcugguuuuguguuuugagacaaagucuggcucuauugcccaggcuggagugcaguggcacagucuuggcucaccgcaacuuucgccuccuggguucaagcaguucucgugucucaacuucccgaguagcugggauuacaggugugugccacugagcccguccuagcuuuuuguuuuuuugagacaggggucucacuuuauuucccagguuggagugcaguggugcaaucacgccucauugcaaccucggaccuuucagcucaaguaguuuucccaccucagccucccgaguagcugggaccacaggcacacaccacacccagcuauuuuuacaaauuauuguuuguagaaacagggucuugcuuguuugcccagucuggucucgagcuucuggguucaagcgagccacuugccuuggccucccaaagugcugggauuacaggcaugagccaccaugccugguugauacuuuuuugugcacagaguuuaggucuccauuguccauccugaacucggcucugggcugggccucucucuucauauucaaauauuuaaaauguucuuuaagacaugaaagggagcacagucauuuucugccuccacacccugucccuccaugucucccaguaggucuuugccucuucugggggccauccuuugccuucuguccauugucuagacauccuucuuguuaauuacgugcacccuguguucuuugaguacguaauggugucuuagccugagaaugaacaccagaaccgacugaaguucacucagagaaauugggauugcuucugcugguguggcagaucguuuugcacgcuagccccuugucagauugggagugcugucuggagcacucccuugaaaggaauuuugagcuugcugccagggauugguuuagcagaguuggccagggccugugaauggggugugguggcuucuugggaggaaccuggguuacugguaagagcguauauggcauuuguaaucaaagcaccaacaauugaaugucaguugaaaacuuuaugcaccuguauuuuaugaacaugguaugugcauauuucccugaagucugaguccucaucuguagaaugguguaguaaugaucagacuugauagggaggcagcacuguuuuuauaauauaaaauggugcauauggggauggugguuucuuaguuuaguucaucaccuaugaggaagacguccuaaaaggaugguacuguugacugaacuggugaaucagaaagaccugguugaauuuggggggaaaaacuuccauaauauauuaaaaaauuauaucuguugaaaugaggcucuaauaaaagauacaacauccauuuuacuccuuaaacuuuuucccucagagucuauaaccaaagagaccauccuuugacuuagaaguucagcaacuuacaacauggccgccauuauaguccaacuccaaggauugccaagaguggcucauuuuccugcuugugugcuguagaguuuuucuuaacaguugguucuuuuuuauuuuuauuuuuuugauacaagaucacaguuugucacccaggcuggagugcaguggcaccaucuccacucacuacauccuugaccuccugggcuccaggucccugccaccccagcuccccaggcagcugggacuacaggugcgagccaccacaaccagcuaauuauuuguauuuuuuguagauauggguuucaccauguuguucaggcuggucucaaacuccugagcucaaaugauccaccucccuuggccucccaaagugcugggauuacaggugugagccgccgugccuagccuaacagucaauuuuuuuuuuauuuuuuauuuuuuuccuuuuuugagacuaaaucucucucuguagcgcaggcugcauugcaguggcacgaucucggcucacugcaaccucugccucccagguccaagugauucuucuguuucagccucccaaguagcugggauuacaggcuccuggcaccacacguggcuguuuuguauuuuuaguagagagaggauuucaccauguuggccaggcugguuucgaacuccugaccucaagugauccgcccuccucagucuuccaaagugcugggauuacaggcgugagccauugcgcccagcauaacagucaauuagucacuuaaucugauacccuaaaauuguuugugcuauaauuuuucucucucaggauguuuaggucuguuacuuucugguguuaauagugucaccucagaaaucauacaaaggauacaacagauuugaaaauaauaacuagaaacucuagaaugaaaaaaaaauacuguuguugauaagguaacagaauuuguguucacucugaauagaacauccaauuuauuauuuuccccacuagauaauaggcugccuugagggcuuugccauaauauauaugugaugcuuagcauugugccuggcauauauuuguggcacaauagauuaauuuuugaauaacugaaugaaugaguuaaugaauguuauagcguuuauucuacauuuuacuuggcuguugauguauguuucuuccacuggacuaauguugggcacagggaccgugucuuuuuuuuaaaccauuuuucuguucagaaaaaaaaagguuuagcucgcccccagcacucauuuaauuuuguauaaacacccuaugaggcugaagcaaaucugagugauuuucauuguaaaauaaaauaaaaauuguucuuggaauuauuucuaaacagaauaucaguauugucuauuucagaaaaaucggauuguucaaaugaaucuucggccaacagcuguucaagagugaugucaacaucauccauaggaaugcuguuuuguaggauuugacacuucagcgauagagaauuaguauauuuuguacauggaaauaccaccauuaaaaaugaaugcuguaaacagaaugucuaucguuucccaaauugauauacuagaagaaugugaaaauaauaauaaaagcaagauuuuuguggcaaacuuaucucaggauaaacacugcagcugcuagggcugcuggcaaguauucuugggacuaaugggacaaggguuaagaguugggguucuugcucugucgcccaggcuggggagcaguggcaccaucauagcucacugcagccuugaacucaugggcucaagaauuaacucucaccccagccugccaaguagcuaggacugcaggcauacaccaccaaacccagcuaauuguuuuuuguuuuuuguuuuuuuugacagaaucuugcucuguugcccaggcuggaaugcaauggugcagucuugccucacugcagccucugccuucuggguucaaacuguucuccugccucagccucccaaguagcugggauuaccagcaccugccaucacaccuggcuaauuuuuguauuuuuaguagagaugagguuucaccauguuagccaggcugaucuugaacuccugagcucaggugaaccgcccgccuuggccucccaaaguggugggauuacaggugugagccacugcacccggcccaaaccuagcuaauuuaaaauuuuuuaauaaauauaaaaauuagcucaucuugaacuuuuggccucuagcaguccucccacuucagccuccgaaagugcugggauugcaagcgugaaccaccaugaccagcuugggaccaugucuuaaucauuuuuguacaacccaguuucaaucagaauguugggcacauaguaggugaacuaauuuuagugaauuucuuaggcaaauaggauuuuacaauaaaucuaauuuccccccagaauauauuuaccauauuuauuugaauugaaauaacaagcaugggaagaaguuuauuuugauaucagaacaggaccauagugagagucugauugaaacuucccuuugauuugcccauugaaauugaguccaaaugagaggcauaccugccauuaauagcuuuuauuuuauuuuaauuuuauuuauuuauuuugagauggagucucgcucugucacccacgcuggagugcaauggcgugaucuuggcucacugcaaccuccaccucccauguucaagugauucuccugccucagccuccugaguagcugggauuacaggcacccgccaccaugcccggcuaauuuuuguauuuuuaagagacaagguuugaccauguugugcagguuggucucaaacuccugaccucaggugauccaccugccucagccucccaaagugcugggauuacaggcgugagccgccaugcccagccccauuaauaacuuuuagaaaaaauuuccaaauacuggaauauagaaauuagccaaguaucagaaaacagcaaaucagauuauaauguuuauuuauuauuauuuuuugagacagaaucucacuuugucacucagagugcagugugguagcaugaucauagcucacuggagccgcaaccuccugagcuuaggcaaucuaccugcgucagccuccagaguagcugggaccacaggugccuaccaccacaccuggcuaaauauuauuauuauuugucucauuauguugcccaggcuagucuugaacuccuggucucaguggauccuuacucuucagccugucaaaaauugcugggauuacaggaguaagccacccacaccuggccuauuuuuuaaauugugaaucauuuuuacugauuauuguacguuuacauaaaaggacguaaaauauaaacagcuaagcuaucacuaagcaaagaccccuguaucuuaucacucaagacuuucuauuaaugguuugccguagaguuuauauaucuuugacuuuuaagaaagucuaacacuggcugggcgugguggcucacaccuguaaucccagcaucuuggggggcugagguggguggaucgcuugaggucaggaguuugagaccagccuggccaacauggugaaacccugucucuacuaaaaauagaaaaauuagcugagugugguggcacuugccuguagucccagcuacucuggaggcugaggugggagaauugcuugaaccccagaggccgagauugccccacugcacuccagccucagcgacaaagugagacucugucuuuaaaaaaaaaaaaaaaaaaaaaagaucuaacacuaauugguacuuuugaucucuuccuagacaaugcaaggaccuuagcuuaguucauuuccaaucacaccuccucuugauuuauuugcuguuuuccccacucaccuuuguugcccaggcuggagugcagaggcgcagucuuagcuuaccgcagccucaaccucccgggcucaagcgauccucuugccuuggcccccccaguagcugggacuacaggcaugcgccacccuauccgcuuaguuuuuguguguuuugguagagauggggauucaccguguuggccaggcuggucuccgauuccugaccucaagugaucuaccugccucgagcucccaaagugcugggauuauaagcaccagccaguuauuucuugauuauaugcuaaacaaugaguggauuauucaugagucuaauuuuuauggagauggagucuuacuauguuguccaggcugaucuccuggacucaagcagucauccugccugggcuuccuuaaguguugggauuacaaguaugagccacugugcuuguccggauccuugaauuaauauuauuucacucugauguuucucccuuguuauaucuauuuccagguuugauuugaaugccuggacagauuuguuuauuauugaucauugucuuagcauguuaguuguuauuuuaugcuuacauuaugcuuacauuagacaauuugggggaaaaaaggaccuaguuuauaaucauuguauguuguagugcuuuuuaccuaugauuuauacaugugagcacauuacagauagaaauguccgggcacguccgggcgcagugacucauuccuguaaucccagcacuuugggaggcuguggugggcagaucaccugaggucaggaguucgagaccagucuggccaacaugguaaaaccccuucucuacuaaaaauacaaaaauuagcuggaugugguagccggcacuuguaaucccagcuacucaggaggcugaggcaggagauucgcuugaacccaggaggcagagguugcagugagcugagauugugccauugcacuccagcuugcgugacagagugagacucuaucucaauaaauaaauaaaucucaauaaauaauaaaauaaagaaauggccggguacaauggcucaugcuugugaucccagcacuuugggaggcuucugugggagcaucgcuuaaacccaggaguuugagaccaggucgaguaauauagugagauccugucucaaauaaaaaacuagauauuaauaauaaaauuggaauuacaacuuuuuuuuuuuuugagaugaaguuuuguucuuauugcgcaggcuggagugcaacggugcgaccucggcucacugaaaccucugcuucccagguugaagcgauucuccugccucagccuuccgaguagcugggauuacagacaugcgccaccacgcacggcuaauuuucuauuuuaguagagaagagguuucuccauguugguuagccuggucucgaacucccgaccucaggugcuccuccugccucauccucccaaagugcugggauuacaggagugagccaccgcgcccggcuggaauuacaacuuuuuaauacugugcuuuucauuuagugugauucugugaacauuuucuugucauuaacauuuuaaaaaauaagauuuuaaugcuuguauaggauucuguuacuuggcuuuaauauucagucauucuacuuuuguuucaaguuuucacuauuauacauaagucugcagugaucauuuuuggauacaaccuguguaaauuucugaucguuguuuaauuacuguaucaguggguuugaauguucauaaggauuuuuuuuauugaggcuuuuaaaaaggagagcugacaauuacauuuucaguuguuuagauucaagcugcaagucucuuauuugggaucugauagaugacuuaugggugaaaaggacuuugaauuccuggaacauauucaggggccuaacaccacuuuagaaauuggacagaaguuggauuuauuuacauguggaaguaaucauuguuaagaacaaggaaaaauaugugacaucacaggaucaguuuguaaauagaacaggaacaguuugcucauaacauaaaaaaacagacaaugaaaacccaaauauaagugagcauuagcugaauuagagcauaaguguguccccucuuuugcauuuagaucaacugugggcauuauguauucugcuccuggcaagccugagcgucgucuugguucucauuugugguguuuuauucuugguuagaauggaugauugagugauugccauuuucgcucuuucaggaaguucuuacccaguguuguuggggcuuugacucauguuugaccuuuucuaucugucuggguuuaguagcuaccauggcuaauccuacccccaaccccuuugcacagacauagguccucauggcuccccauuuucuauucacaucauucauggugugccagauucccauccaacaauugagguuuuauauaauaauaauacaguagauauguggugguucacagaccuucuuauauuaggaaaauuccacacugauuaaaagucacaguggugagucauuugugauguguaaugagcuuaccugucauaucuuuguuuuaucuguguccccucuaucuggacggccucgcgaagaaccagggcaccuggacagggacuuggucccccgagagaaagaacacagggcuagagguagagugggugauaauaguuacugcagcauuuaugacacuggcagguuuaggacccaggacccacucuggaguaagaaggacacacugagccagcagccaggacucuguugucagauaccaugugauguguuacagagauggagcaggagagggcagaaaggcauguaaguaucugacagcaucaggcugucagaacuccaguagcaaacagaaaaacagggcacacaugaauaccacagggcaaguacaaagagaaggguuagaggccagauggauaagcuaaaaauaggauuaucuggacauccugcaguacuuucagcacaguguaucuaaaaucgacgucgucauaguccuuccacugaccuuuuccauuucugauaaugacaagauacauccugucaccaggcuugaagucuuaggucuucuuugcuucuuuuucuguguucuuugcuuguagucaguuacuguaucucuaguaauucugccuccauguggaaaggucuugggguuccaaccuuggcucucccacacauaggcccuaagauaaagucacuaaaccucaccaccuaacauggaagaagaccaucucacaggguugucaugagaauuggagaugaaaugcccuauuacuucuuagccagacuauuguagguguuuccagggucaaaggagaaaaauuacaacaauuuaguuuuaagaucuuaauuggcuuucuagaauugggcaacacuucaucucauaaaauagaguauccugugagcuaagcagaggagcuuggcuuuuuagagagaaaugggcugaagaaaccagaaacaaagaacuaaaagcagaugagucguuucaaagggacuuuucuuuuaaggcaggggcaggaagacagaacaauacaaaaauaacaugguuagcaucaggugacuucagguuaucugaaccugagcacggugacugcauuuugguuuguagucuaguauguugaggcccuauugugcaggagcucaaucugcaacaauggccgccuauaauuuuuauuugacaccagauuggauuccugccucuaauuuagccuucccacuucugccaguuuguucuuucuaacaacauagcucugaucaugucauauccuuccucaaaaccuuuauggcauuuucauuaacuauuagaauuccuguccuaguuucgaggccucuucaccaccuggccccauccuacauuuuugguucuauccucuaacauuuccuuuuauacccccugacccuggcguuccagccacauugaacuugcugucuugaggagauguccuugucucaguggcauugcucauacuuggaauuguucuuuuccacaccucucaggcuccaaaucuucaucuuuugaguuccuguucaaaugcucccaucucuguugcaggucccugcaaccccugacuguaacucuccuuaacuuccaugauucuuucucggagcucuugucacauucauugcuuuaugcuuuuuguuuuuuggguacaugauguauuuaacuucauguucugaguccuagggaguucuuccuaagcacuuagcaaauauguguuguaggcaauuaguagcuauauaugaucaguagacuccacgggggaauaauaagcggauuaagaguugacaggucccuagggacugagagugcggggaaagcacaggcguaaagcaggugucuuaacacuggcuuuagaagaucuagaaaacuaguaaccaagagcuuuuaacaugguucuuguuaagaugugaagagguaagauaacuaauuugaguggcuauuguaugccagucaccggucuagguauuuuauguauauucacucauuugaacucuggccagaugacauucuucccuucuguaauauuaccccuugaccucuuuuuuuuuuuuuuuuuuuuuuuuuuuggagauggaguuuucgcuuuuguugcccaggcuagagugcaacgaugcaaucucggcucacgguaaccuccgccucccggguucaagcaauucuccugccucagcuuccggaguagcugggauuacaggcaugcaccaccaugcccggcuaauuuuguauuuuuaguggagacgggguuucuucauguuggucaggcucaucuuaaacuccugacuuauggugaucugcccgccuuggccucccaaagugcuaggauuacaggcaugagccacugugcccagccccguugacuucuuguuacacuuagaauaaaauacaaagucaggugguggcucgcgcauuuaaucccaggacuucgggaggccggggcaggaggaucacuugagccugagaguucaagaccagucugggcaacauagugacacaccccaucucuaauuaaaaaaaacaaaacaagacuccauaaguagcccuacgggaccccagacucacacuguacgacuuccucaccuuuccaucuucucugaccagcuccuuaccucugcucccuccucuaaagcuuuuugcccaugaaucccaaauuuauguuuuuucauuucagcuuuaaaacccuacccuguuaugauaacaauaauggaguacauugcccuugugugguucuucauacuuuuuuuuuuuuuuuugagauggaguuucgcucuuguugcccaggcuggagugcaauggugccaucucagcucacugccaucuccgccccccacuggguucaagcgauucuccugccuuggccuccggagcagcugggauuacaggcacacacuaacauguccagcuaauuuuucuauuuuuagcagagaugggguuucaccacguuggccaaacuggucucaaacuccugaccucaggugauccaucugccucggccuccuaaagugcuaggauuacaggccaccaugcccagcucuucauaauuuuucaaagcacauucuucuuauuucguuugauccuauuucaguccacaauuuuccacauaccuuuucucaaaaauaagaguauagaagaguugggugcaguggcucacaccuguaaucccagcacuuugggagucugaggcaggcggaucacuugagaccagccuggcuaauauggugaaacgcugucucuaauaaaaauacaaaaaauuagccaggugugguggcaggugucuguaaucgcagcuacaggcuccuacugaggcgggagaaucacuugaaccugggugguggagguugcggugagccgagcuugcgccacugcacuccagccugggcgacagugcgaaacuccaucucaaaaaaaaaaaaaaaaaaguauagagggauugaaaugccaagaaaacuugacaguuuaucaaauaacaucuuugccauaaaucuuaaugccaguugugggacuggccuguggcuccuuuaagccuuggaguuguaacagaaaguuuucuucagauaguuuuguuaaucacacuguuuaaaaugugcuaugaaauuucuuggaucuuuggagagaaacaagauacuguuauaauaauuacuguggagaugucacuggaaaggggauccagaccccaagagaggguucuuggaccucgugcaagaaauaauucagauugaguccauagaguaaagugaguguaaguuuauuaaguaaagaaacaaaagaaugguuacuccauaggcagagcaguagcuuggacugcucgacugauaauacuauaauuauuuauucauuauaugcuaaacaagggguggauuauucaugaguuuuccaggaaaggggugggcaauucccggaaaugagaguuccuccccauuucaggccauauaggguaacuaccugacguugccauggcauuuguaaauugucauggcgcuggugggagugucuuuuagcaugcaugcuaauguauuauaacuagugcauaaugagaaauaaggacagccagagcucacuuuugucaccaucuugguuuugauggguuuuggccggcgucuuuaccaucaccuguuuuaucggcauggucuuugcgaccuguaccuugcaccgaccuccuaucucauccugugacuuagaaggccuaaccuccuggaagugcagcccagugggucuuagccacauuuuaccaagccccuguucauaauggagucgcuuugguucagaugccuuugacggagaagguaacuuuucacuauauauucuuuguacaguucagguguuugguuaaacacaugcuuguaguaucuguuuaaauuaguuauauguauauguauacucugggaaguggcucuucucauuauuacaauuuuuuucgaaaagcaaucagcuuuuauuugacaauuuggaaaauacaggaagaaaaaaaguuauuccggccaggcacggugccucacgccuauaauccuagcacuuugggaggccgaggcggguggaucacgagaucaggaguucaagaccagccugaccaagacggugaaaccccaucucuacuaaaaauacaaaaauuagccgggugugguggcaggcacuuguaaccccagcuacucgagaggcugaggcaggagaaucgcuugaaccuggcagguggagguuguagugagccgagaucgugccacuacacuccagccugggugacagagugagacuccgucucaaaaaaaaaagaaaaaaaguuacuucgaauccuacaauaauccugaaauaaccaauugggauugucauuuaaaaaugaacuuuuuuuuuucuuccccugagacagggucucacucuuucacccaggcuggagggcaguggcacgaucucagcucacuggaaccucugccucccugguugaagugauucuccugccucagccuccugaauagcugggauuacaggcauccaccaccaugcccaacuaauuugcauuuuaagaaauaggguuucaccauguuggccaggcuggucucgaacuccuaaucucaaguaauccacccaccuuggcuucccaaaguggugggauuacaggugugagccaccgugccgggccaaaaauaaacucuugaauggauguucuguaaaacauuuacacuuccuuuaaacagguauuuccaaguauguggauuuuuguuuauuugguuuugagggaaggucuuacuauguugcucagguuggagugcaguggcgcaucagcucacuguagccucaaacuccugggcucaggcgauccucccaccucagccuccugaguagcugggacuacaggcaugcaccacugugccuggcucauuuucuuguuuguugagauggggucucacuguguugcccaggcuugucuugaacuccugggcucaacugaucuucccaccucagccucccaaagugcugggauuacagacaugagccacuguguucaacccaaauaugauuuuugugguaggauaugccauuaguuaguguuguuaguaagaggcuuuucucuguguaucuucacuccauuugagaagaguaaaacauagaacugugccauaaguuucugaacuuagaauaguaaagaaguaacaagccagucuuggccuggcccagugaugcgcaccuguaggcccagcuacuuggaaggcagaggugggaggauugcuugagcccaggaguuugaggccagccugggcaauauagacaccuugucucucagcagacaacaacccagucuuagcuggugccucacuuaaacucugcaauccuugcuaccccagccccaucaaaguuaauauguguguguauuguccagcagugacaggaagaauaaaggaaauagaaaugaagagguagaaugaucaggauuuugcaguugguugagugugcaggauaaagaugguaaacucagaugaucaaguuucguauauggacaggagacuuguagagguuagguuuuggaaccuaaauuccuggauucaaaucccaucucuacagcuugguaguuguuuguuccugggcaguguuuuuuaaccucugagccucaguuugcuauguauaacaugggaauaauuuaguacccacuucguuagguuauugcagggcuuaagagagauuccacauaaagcacuuagcauagugccugaauguuuuucauuaauuauuaauagcgaggccauuuuuuaaauuagagaacaaauaaggagggcagaagugggagauguuaaagaaggugauugucauuuagaggagcugaguuuaaaguagccaagggcaguacucagaagacaggacuacuggccuggccuggccuggccuggccuggaaaggguuauugcagaaggaugauccuggauccacuauguagcuuugcauucauucucugaaacugcuuccuagauggcuucaaagcucucaaagcuccacuaguuugaaccuguaaaauguuugauuaacugagacaacuuggguugcuuaccuuuagcucuagaguguagcugacucacuggaaaguuuuugugcuuuuucaaccacuggcgccagggcugaugccuguguuuguguguguuguucacugcucuauggugccugggccagggggaaugagguaaaauccugcuguugucuucacuccaagccuugugcacuuggcugcaacugaaugggcuggcagcauuucugccuugggaauguuuaucugcucccuccauggguggggcuuaguguugagagucaagccacugaagaaguugccuguggccagccugacuccauguggucaguguaauuuucuauuauaaggauugcauccugggguuacuuaaauucuuuuuuuuuuuuuuuuuucuuguugcagaucaucaaugcugugguacuguugauuuuauugagugcccuggcugauccggaucaguauaacuuuucaaguucugaacugggaggugacuuugaguucauggaugaugccaguaaguaguagauauuuggguauuuucaagggcagggaaucugacugccagcacuuccuauuaaauuacaaauauagacucgugaguucauuugagcugauauauaacuugucauugcaaaucaacgaauauuugugugcgucuaacauucugucuucuaggugcaagagucuaaauaagaucuauuuucaucuuauguuaacuuacccacuuaaaaaugauugcauuaucauagacuuucuacccugggccuuuuggccuuuuuugagaggaagggguauaaaugccaggaaggaaggugaaaaggcuugugcuuaucuccuugugucuucuauuauguuucaguauuuauuuuuauucuaggagugauccuuuuccauucuagaaaugauguugcagauuauuugggggaauuuagggccuuuucccagugaauggaaauauguacagggauguggaugugggguaagcagggaggaagcuaggcucccagcuugaagaucacugcagccucaucauuuuauaaucauuaugccgaguccaugccaaaggagaggaguagugcugugcauaaucuccagcagaagauaguacagauuuauuucucauuggcuucggagaacuucaagugaguuuuucuuaaaaaguguuggagcaaaguaagagaggagagaguggcucaacaugcaguuuuagagaucggaagcauucgaaagacauggugagggcucuuuguuucuccaaguaagaaaaagcuguucagugguuuuaacuaaaugcaugaacugauauaugcauuuaagaucccuuuugcugcugaguaggguacugggugugugagcacagagccugggagagugguauuggggauaccaccuaggcugcacuggggauagagaacagggaaggauuuggcaacuugcuguuuugggcagcgaaggagacggaggaaucaaagaugacuucugcuuuccaguuuuaggagaugaccugcaucuuaacugagcugagaaaguccggagucaggaggugggaacagaccugggggagaaaaauagacuuuaauuucaguaacuagcugagcacaguuguuuggaauugauaugguuuggcuguguccccacccaaaucucgaauuguaucuccuagaauuccccuguauugugggagggacccagggggagguaauugaauugugggagcugcucuuucccuugcuauucuugugauagugaguaagucucaugagauugaggccgaggcuggcagaucagcugaggccaggaguucgagaccagccuggccaaggugacaauaccucaucucuacuaaaaauagaaaaauuagcccagugugguggugagugccuguaaucccagcuacuugggaggcugaggcaggagaauugcuugaaccccagguggcggagguugcagugagccgagaucgcgccagugcacuucagccugggcaacaggucacuuuugcuuuuucuucauucugucuugucaccgccauguaagaagucccuuucacccuuugccaugauucugaggccuccccagccauguggaacuguaaguccaguuaaaccucuuuuucuucccagucucggguaugucuuuaucagcagcaugaaaacagacuaauacagguguaggcuccgaagccagaagaggucaguuugaguucugacaccgccguguguugaagaugcuaaacuugagcuagugacuuaucauugugugccucaauuucccccucugcaagauaggagugacuuuauaaccacaugauuuaaacgauagaaaguaauuacagacuggccacgguggcucacaccuguaaucccagcauuuugggagccugggagggugguggggaucacuugagaucaggaguucaagaccagccuggucaacguggcaaaacaccaucucuacuaaaaucuacuugccucagaguuguugugaggauuaaaugaguuagugcguaaaacaugcuuagaauggggccuggcccauaggaagugcucaguaccuuuugcuguuucagcuacuauuaucuagauuguuauggcuggaacaugugaaccaucuuaaaguggagagguuacaaaggucaggcaugggagucuguggcccagaggaaauauuuggacugagauuacagauuugaggauaucagccuaaaaacugaauuucuguuagggaaagaguaaaaagaaaaggcaacggggcccagaacugagcccugaaggagcuccaacuguaagaggccaggaggaagaaugagagaguaacuaacugguagugaaguaaacagagaaccaagagaugcuuucuagccaucaucuuccaccacuguuguuucauaacauggauuaagaaguuggggcauuaaaguuacugcagagauaacuuaaaaaaaaaaaaaaaaaaaaggaaaaguuggcauuauauuauccugggauuugagauccugauuagcugggauuauagguaugugccaucacauggcuaauuuuuguguuuuuuguagagaugggguuucgccauguugcguaggcuggucuggaacucuugagcucaagugguccaccuaccuuggccucccaaagugcugggauuauaggcaugagccaccacaacuggccaauuuucauaauuuucaagcacaauuugaaguaauuaauuauucaggcugggcucaguggcucaugccuguaauuccagcacuuugggaggccaaggcaggcagaucaccugaggucaggaguugcgagaucagccuguccaacauggcaaaaccccaucucuacuaaaaacacaaaaauuagcugggcaugauagacaccugguaaucccagcuacucaggaggcugaggcaggagaauugcuugaaccugggaggggggaguuugcagugagccgagaucgcgccauugcacucuagccugggugacagagugagacuacauuucaaaauuaaaauaaaauuaaauaauccaucucaaggauuacuaauccuguccacacaugaguuaaauauggaaagcuguguccaauaaccuuuggccuaugagcuuauuuauuaaaggagaccaaaacacauauaaaagaaguuuaaaaaaacagauucaggugaauauccacuuuucuguaccuuuauaaccacgugauuuaaaugauggaaaguaauuacagacugggugcgguggcucacaccuguaaucccagcacuuugggaggcugggggcggugguggguggaucacuugagaccaggaguucaagaccagccuggccaacauggcaaaacccugucucuacuaaaaauacaaaaaaaguagccaggugugguggcgugugucuguggucccagcuacuugggaggcugaggcaggagaaucgcuuuaacccgggaggcagaggcugcagugagccgagaucaugccacuacacuccagccugggcgacagagcaagacugcaucucagaaagaaaaagaaaaaagaaaguaauuacaaacuauucauucaguccuuucaaauauauaaaauaggagagaaaccacaaaggcacuggaauuaacauccaggacauuauaaaacaauuacuauuuuaaagucuuaaguaccagcaagccuuucaggguagcuaaauuaagccuaucaugucagauaguuauuacccagcuuaaucucuggugauuagaauaaggcaugcaguguugcuaccagauccagauagaaccauagcauuaucauuuacaacuucuuuuccuaaccucgauugccuuagaaaaggaaucccgcuacuggaauuguguagcuuuaaucugaggggaaagaaagcagagugacaugaauuuaacauuaauuaaauauuuuuucuggaagaguucauaugaguauaaugggguuauucagaauagacagaguaagaaauguuagaccaggugcgguagcucacauauguaaucccagcacuuugggaggccaaaguggguggauugcuugagcucaggaguucgagaucagccugggcaacacagcaaaacccugucucaaccaaaaauauaaaaauuagucgggugugauggugcguaccuguaaucccagcuacuuggaaggcugaggugggaggaucacuugagccuggguggcagagguugcagugagccaagauugugucacugcacuccagccugggugacagagccagacccugucucaaauuaaaaaauuacgaaaauuaauauagcaauuuuaucuugauaucuuuuuacauuggugacagcuaucugaagauuucauccagccagacagagcagaacucuuucucacuuuugcaggugauccuuuccaugaucugguagaagaaagcuaaauuccuauuuauauugaaaugaggcauauaggagaaucuacuggaauaaagaaagaaaauauaagaaaaugaguuuaaaaauuuauuuuugaggcugggucccacucugucaccaggcuggagugcagugucgcacacaaucugggcuuacugcaaucccuaccucuugggcucaagcgauucucccaccuuagccucccaaguagcuguaacuagaggcaugagccaccaugccuggcuaauuuuuuguagagaugggguuuugucauguugcccaggcuggucucaaacuccugagcucaagcaauucgucauucucgacgucccaaagugcuaggauuacaggcaugagccacccuacccgcccucaauuuuuucaguguuauaaaaauugacuauacugggaaagaauguggaacuggcauagauuggaggagacacaauuaaaugcacugugggauccuggauuagauucuggaaaagaaaaaggacauugaaggggaacagguaaaauucaaauuaguuguacaguuuaauuaacaguguuguaccaauguuaauuuccugguuuugguaguuaugcuacagcuagguaaauuguuaauaggggaagcagggugaaggguauacgugaauucugcuguguuuguaacuuuccuauaugucuaaaaugacaucagaauaaaaagguaaagcacagguaguucaguccacugaccuagaagcucaaagaguaauguuugaaaagcauguauguguggcauauuguguuacacacucauagcccugaguagaaguagacuucauggaauuuuauuugugaaauuuuguuuggcaaagaauuauaacaucaagugucuguacuaugcauaauaugaaacaggaguucauccauauuucuaauuaauuuugugguagauuugucuuucuggucaaacuuacuuucuucacugggcagacaaauuuagccugaagaaagaaauggccagauaaguugucaagaaaugauggcuacuuauauauacagucaccugauuuaggcuaaagacaccacuacauuuauuggagaaaggauggucuuuucaauaaaugguucugggugaaauugauaagagaaagacagacaccucacaaaagaagauauccauaagagaauauucuccacauugcaaguuauagggaauugcaaauuacagcuacaguaguaaauuaccgugccccuucaaaaugaccaacauuaacgcaguuaacaguaccaccuauugguaucgaugccaaacagcuggaacucucaaaucacggcugggaauguaaaucacgccaaccacuuuggaaaacuaaagcuaaauauacaucuacccuauggcccugcauuccacuccuugauauacguacacuccaggagugaaggcuacacaacucaguccuagauauauacccuagggaaacaggugcuucauaaaucugucgucagccauguauaaaaauggucauaguagcuuuauuuaugauagccaaaaguuggaaacaauccagauuuccaauggcagaaugggcaaaaaugaagcaaucagagaugaaaugauauaagcaaaaugggugaugagaauuaacuguacuguguguaugcuuauauauguaugugcauguuuugaaguuuugauaaugaaaacugagaaauaggaaacagcaacaaaaaagaaugaugaaccugaggagggccgccuuuccugauggcucucaacaucacaaacuaaggcucaucuugcucuggcauuuggaaagggcccuuggcugccuaccugcccucuucacauaccgcagacuaacuuggcagucugcacagcuugccggcuugugcauaaagauccugacagccuugaggaaauagaacuacagcagcaggggaagcugagccaggggaaccauccuggcccuuuauuuucuuuacuuuuguauuuuauuuuuugagacagggucuugcucugucgcccaggcuggaguacaguagcacaaucuuggcucacugcaaccucugccucaugggcucaagcaguucucccaccucagucuccugaguagcugggaccauaggugcguaccaccaugccuggcuaauuuuuguauuuuuaguagagacgggguuuugccauguuucccaaguuggucuugaacuccugggcucaagcgauccauccaccuuggccuccaaaaguccugggauugcaggagugagccaccgcgcccggccuggcucuuuauuuucaucaaucugcccucccauccuuucaaaaaaaguagcauacucuacaucuugacuuuuuuuuaaaggauaaguaaauuaauuauuuguuuuuuuuuuguuguuuuuuguuuuuuuuuugagucggagucugacucugucacccaggcuggaguacagugcugcuaucuuggcucacugcaaccuccaccucccagguucaagugauucuccugccuuggccucccgaguagcugggauuacaggcaugcaccaccuuuuguguuuuuaguagagacaggguuucaccauguuggacagucuguucuugaacuccugaccucaagugauccaccugcgucggccucccagagugcugggauuacaggcaugaacgacugcgcccguccuaaauguuuauuuucaaggagacuuuuugcaaaaguacgccuuuguauguaugagaagaccacuagaguuggugaagucacuuggaucaucuaggcuagccauuuuacuauucuucucuagaauugaagaauggauggaaagccaugguuauuggaguugggaaugagucaccuagauuuaaccuaugugaggagcagugacauuuggacuaggacuaccaccaacccaagacaaccucagagugggaggcacccucacucuacuucccucuuugugaucucauucccucaccagagggcggagggcaaaagagcuguauguugauagcccaaacaaaucacugccuguggcagagaacagggcguugaagaauggauuuggaacagcaccagaagccagcugguagagccacuccccuacuuaccuugauguuccaccuaaccaaacuguguacauuucccuacuuugccuacaagaauacuauaaaaagcucugcuagugucuuacugaaaucguaggauguuauauuagucaggguucccuagagggacagaacuaaugggauauauuuaaggaaguuuauuaaggaggauugacuuauaugaccacaagguaaagucccaugauaggccaucugcaaguugaggagcaaggaagccagugauggaucaguccaagucccaaaaccucaaaaguagggaagcugacagugcagccuucaguuuguggccaaaggccggagagccccuggaaaaccacugguguaaguccaggaguccaaaagcggaagaaucuggugucugauguucgagggcaagaagcauccagcacgggagaaagauggaagccggaagacucagcaagucugcucuucaucuucuccuaccugcuuuauucuagccaggcuggcagcugguuagaugguacccauacagauugagggugggucuucgucucccaguccacugacugaaauguuaaucuccuuuggcaacgcccucacaggcacacccaggaacaauacuuugcauccuucaguccagucaaguugacacuccagaugcauuaagccuacagaauccccuggaucuguugagguccuguuugccacuggcuaagaaggaguuagaucagcucugguguccaguauuccuccuuucaugcucuuaacgugcucaccggcugcuucuccaaugcauuuuauuguuguuguuuacauuuuaauguuuuugaaaucaggaugugauuugcaauuuaguagagauuuaguaugcagauuauguuuuccccucuagaucucugucgaaaaaaugcaaagcuuuuagagaaguugcauguacaaugaaaaccaauauuauuuuucucauugacaauaauuuguucugccagaucuaggaaaagcaguuuaaaaaaaccaauaguuugggguucauuuuuauaaaauuauuucuuauuaaauauugaguagguauaaaagaauauuuauaaaauauuuauuacccguagcaaauaauggugcuacaagcaguuguguaccugccaaguugguuuaagauauuuuuguccgggugcggugacuuaugccuauaaucccauagugacaaugcccaggcaauugaagcugcaaugagccaugaucacaccacugcaacuccagauugggagaccaaacaagacuccuuauuuaccagagauugacuaaaggaaaaaagaaguugaaggccaggcaugguggcucacgccuguaaucccagaacuuugggaggccgaggcuggcagaucauuugaagucaggaguucgagaccagccuggccaacauggugaaacccccgucucuacuaaaaauauaaaaauuggcaugguggagcacaccuguagucucagguaccuagggggugaggugggagacuugcuugagccugggagacuugcuugagccugggaugcggaauuugcauugagccaauguugucccacugcauuccagccugggcgacagagugagacucugucucaaaaaaauaaaaagaaaaaagaaaaaauaaauaaaauagaaugaaccagaugauauggcugucuuagagcaagcaagagagugggacaaggugaggcgagauuagagagguagacugcucuggaauaaagaggaacaucaaggccuugauaagaaaugaagguuuuauuuuuauuuauuuauuuuuuugagauggagucucgcucuaucgcccagaccggagugcaguggcgcgaucucggcucacugcaagcucugucucccagguucaugccauucuucugccucagccucccaaguagcugggucagcaggugcccaccaccacgcccggcuaauuuuuuguauuuuuaguacacaugggguuucacuguguuaaccaggauggucucaaucuccugaccucgugaucgcccuccucggccucccaaaguguugggauuauaggugugagccaccgcaccuggccggaguuuuuauuuuaaauaagaucggaagcuaugaaggcuuucauuagagcuuugaggcacacaugaguuuacaaaauagaaguuagacaccuauauaucuauaaaguaauaccuaauucauuauuuauauaauccaguggaccagaagaacaaacauuaaaaaaaucuguaaaccaauaucccuuuuucuauuuugaaauaaucucuuaguauaaaguauuuacuaacuuuaugcuaguuuauuuacaaaaugccuuugagaagagacugaaaguauucaguggauccacuacugauugucuuuuuuaaagaaauucuuuuuaaucuuucggcagacaugugcauugccauugcgauuucucuucucaugauccugauaugugcuauggcuacuuacggagcguacaagguaagccgcuugcaguaagaugcuggccuuuuccuuggucucuuacauguguaaucugugcugcugucuauagugagaagugacuuuccaguuuucuguuaagaaucucuguuuaaaucucucguuuguauuaugugguacuaggaaaaccaauauuauacuggaaauuuuuuuuuuuuugggaagacggggucucacucugucacacaggcuggaguagaguggugugaucuuagcucacugcaaucuccgccucccaaguucaagugauucucccaccucagccuccagaguagcugggacuacaggugugugccaccacaccuugcugauuuuuguauuuuuuaguagagacgugauuucaccauguugggcaggcuagucucgaacuccugaccuuaagugauccacccaccucagccucccaaaaugcugggauuacaggugugagacaccacacacagccaguccuggaaauguucacugaagcuuauuuguugacugcuuauauuuggcauacugguuuccaccaugaccuggguuaaugaauuccaauuuuuccauuuccuuucagauuaauaaaauacuuugaauuuaagaaaaauauuguuuuauaauauugaacacauuaacuuucuauuuucuguucuguuuagcaacgcgcagccuggaucaucccauucuucuguuaccagaucuuugacuuugcccugaacauguugguugcaaucacugugcuuauuuauccaaacuccauucaggaauacauacggcaacugguacguggaccucuuacugcuccuuuucauuaauucuuuucauuagggaagcugguuaaguaagggauguguagagauacacagacauuaauuucaggauuuuuagcuugcagcugaguuacucauaggaaauuucuuuuuucuuuuuuuugagguggagucuugcucucgucacccaggcuggagugcagugaugcgaucucggcucacugcaaccucugccuccagggucucagccucccagcuagcugggauuauaggcauguaccaacauaccuggcuaauuuuguauuuuuaguagagaugggguuucacuguguuggucaggcuggucuugaacuccugaccucaggugauccacccaucuuggccucccaaagugcugggauuaugggugugagccacugugccuggccugauaaaguuuugagggccgggguuaugauugguggcagugaugguggugguugaugugccuaccuaaauuauaguccaguuacuaauagucguauuugguaaaauguaguuuucucaguuaucaacaaaggauagcuuuuugccuuugcuaguguguugaaagugggacucugcucaaaaacaaacaaaauaauuagcugggagagguggcacacgccugugacccuagccacucgggaggcugaggcaggagaauugcuugaaccugggagguggaggcugcagugagccaagaucacgccacugcacuccagccugggcaauagagugagaucucaucuaaaaaaaaagaaaaaucaaaagaaaguggaaagaaaguggaacacugcuguauacuagcucccaaauuuguuugaccauagaaucccuuucucaagcaucauuuugggacuaguuuacgguuaaauguccuuugugaccauaugagugaauauugguggcaggguauuaagaagcuuauaauggcuaugagguuggaauaacuuuauuuauuuuugggacagggucucugucacccaggcuggagugcaguggugugauuauggcuugcugcagcguugaccucccaggcucccgugauccucccaucucaaccucuugaguagcuggcacuauaggcaugcaccaccaugcccaccuaauuuuucuuuuuguaucuuauguagagaugggguuucaccauguugcccaggcuugucucaaacuccuagacucaagugauccuccagccuuggccucccaaagugcuggcauuauagaugugacucacuguaccaggccaacuuuacuuuuuuuuuuuuuuuuuuuugagacagagucucacucuaucaccuaggcuggagugcaguguugugaucucggcucacugcaaccuccgccucccuggguucaagccauucuccugccucagucuccugaguagcugggauuacaggcacccgcuaccaagccuggcuaauuuuuuguauuuuuaguagagaugggguuucaccaucuuuuccaggcuggucucaaacauuuagccucagaggauccacccucaucggccucccagagugcuaggaauacaggcgcccacuaccaugccuggcuaauuuuuguauuuuuuuuuuaguagaggugggguuuugccauguugaccaggcuggucucgaacuccugaccucaggugauccgcccaccuuggccucccaaagugcugagauuacaggcgugagccaccaugcccagccugcaaccucaaucuucugggcucaagugauccuuccaccuuagccucccaaguaguuuggacuacagacaugcaccaccaugcccggcuaaauuuguauuuuuaguagagaugggguuugacuauguuguccaggcuggucucaaacaccugcacucaagcaaucugccugccucagccucccaaagugcugaaauuacaggcaugagccacugugcuuggccaaguuauuuuauuaauaaaagaguaaaguugcaugaucugaucacaaagaaugacgauuuuauuucuuagauauuuugucccaagugaaaggagacugaaaaccauuaggugguguucacccuggugagcaggagccaagcccaugagucaugggccuucuccauguucuuccucaacauuggaaacaacuuuguuuuggaauauugcucgugaggaauccaaacacauaguguugaauggugaagggagauaaaagaugagauagcacaguaggcugccuucccauucacuugccuaggccagugauguaggcguugaucaaugcugugugaguguucuguggggaaaguccggcaacucccucuaaccauaguagcagacuuugauccuccugaaaagguucccuuugaccugguuguuaagcauuguggaugguagugcuugauuauuuccccccacccuggaaguacuugcuaguauaagagaauaugcugucuugggagaaguaccaucaacaaaaaugcucuuugcaaagaagaccucauuuuaguagguuucugucccuugcccugcauaugcccuuuagaaugguucagaacuuuugagacauggucuggcucugucgcccgggcggcuggagugcaguggcaugaucucgcucacugcaaccuccaccaccagggcucaagugauuugcucaccccagccucccaaguagcugagcugggcgacagagagaaacuccaucucaaaaaagaaaaaaaaaaaaaaaaggaaugguucagaacuugcagagaauacaaauuucagagaucccuggauauacaaaaugucccuggauaccgaucacugacgucuuuuauaugguaagagggcagagucaggcuagaaauuuuguauugguucuaaauaauagcugucugcuuuaaucaguugcuuucugauaagcaugucugaauuggugcccaaggaauacugucuggaaugauuaaugagauuugcuaaugaggcccuuuucuuuugcagccuccuaauuuucccuacagagaugaugucaugucagugaauccuaccuguuugguccuuauuauucuucuguuuauuagcauuaucuugacuuuuaagguaagcaugaagauuuuacuuauagucuaaaaauauuaaguguauuccugaauaccaaauaaguaaacaaacuuuggucaguuuauugucuuucuuuggacauccaaauugcuuuuugauuuccuaagauuacaauucuuuaugcugucuauguuggagguaaacacuaaucaaaauuccacaguuugaucaaggaguccaaaauauauuuggacagagauaaguuaacauaauguuauacauuacauaguauaugauauugcaacgucuguuacaaggucuguguaauggauauucuuuuguaauuuuuugcuaaaaguguaauauuuucugaauauuguucuaucucaauccauuauaugaauaucauuauuuaauaaauuacuugaugagcauugagacauuuuuuacuuuuucacuuaauagggcuguagugaauauauuuaaguacauccuuauauuuaugcauuuaucucaagauaaauuuccuuuuuuuuuuuuuuuuuuuuuuuuugagauggagucucgcucugucgcccagguuggagugcaguggcgcaaccucggcuuacugcgagcuucgccucccggcuucacgccauuaucuugccucagccuccccaguaggugggaccacagauacccgccaccaugcccagcaaauuuuuuuguauuuuuaguagagaugggguuucacuguguuagccaggauggucucgaucuccugaccucaugauccgcccaccucggccucccaaagcugggauuacaggcaugagccacugugcccggcuucaagauaaauuucuuaaaaucaggguguucaugguuggaaagccuuugauagguugucaaauugaugucccccaaaguuaaaugacuucuacuuccugcagcagugccucacccuuaucaaucaauugcugcaaauucuuuuucaucuuggucaaucuguuuauaaaaccaucauuauaacuugugcuuaugagcuacuaauggguagaaaacucucauggcucuuuaugcuuucaacuuuuuucuuuuuuuauuuauuuuucuuucuuucuuuuuuuuuuuuuuuugagguagggucucucccuguagucuaggcugccuccugccuugguuucccaaaguuuugggauuacaggugugaaccacugcacccagcauacuuugaauuuuugaaucucaaugccuuucauugucuuaauuuuggcauaaaauuaugucauucuucaaaaaucaugccucaguaaacuugggaaagcugcauugaggcagaaaauucauauagguacugugaugaaaaggaguagaaagaaagugguucauuggaaaccaguuggccaggugaaauggcucacaccugugaucccaacacuuugggaggcugaagugagaagauuguuugagcugggagugugaggcuguagugugcuaugauagcagcacuguacuucagccugggugacagagugagaccccgucuuguuguuguuguuguugagacagagucucacucugucaccuaggcuggagugcagaggugcgaucucggcucacugcaaccucugccuccuagguucaagcaauucuccugccucagucucacgaguagcugggacuacaggcgccuguuaccacacccagcuaauuuuuguauuuuaguagagacggguuucaccauguuggccaugcuggugucaaacuccugaccucaggugauuugccugccucggccucccaaagugcuggaauuacaggcauaagucaccacaccuggcuggggacaccgucucuuaaaaaauaaauaaggccgggugugguggcucaugccuguaaucccagcacuuugggaggccaagacggguggaucacgagaucaggagaucgagaccauccuggcuaacauggugaaacccugucucuauaaaaauacaaaaaauuaguugggcaugguggcgggcgccuguagucccagcuacuugggaggcugaggcaggagaauggcaugaacccaggaggcagagcuugcagugagaugagaucgagcuacugcacuccagccugggcgacuccaucucaaaaaaaaauagugaaauguuggggugaucagacccaacaccaggucguggggguugugaaguccggcggagucagaggaaugagacaagacaagaguacauagaguggguccagggguccagugccaguuuggaggcugcgaaggcccugagcucugggaguccacacuauuuauugguaaucaaacaaagaagcagguagugaggacguguggauguagggguggacaggugaggacgugaggauagaaagguaguggugcaucaagcguagcugugacgguuuugcauaugcucugcuacuugagauaagggagaacagguucuucuaauucgagaugcaaucaauuugugaucuugggagagcaaggagcaaggggccagcgagucuggauauauuccacaggcuacaagggguuuuaugcucugggcuuagauuguagugcggcagggcagccuuccacccuuuggcacagagcuugguguuccauaggccacaagggguuauagacccuggacccaggacauguuccaagacacuuuuaccuuaugucagaagcccugccucagcuuuucugccaacauaaauaaaaaaauaaaaacaaaaauaaauaaauaaauaaugaaagaaaaugaauugagucuaaauuuccaucauaaaacaccaugauuucaugugucauucagcaguuaaggaugggagugaauuuuacacacggauguugggccuuacugccuugcagcuccagcuccuccgcuccaguuucuuggcugguauuuggccccacauguuguccucugaccuccaagccugugaggcuagggcugccuaccauccaggcugcaggcagggcuggcagugcccccuggugaaaggccacagacucacaucucacucauuguaguucgucuuugaaggguagacuccccuuuugacuucugcuuguuuuuggucagucucccaugacuuaaaauuugugugugugaguaauuuuucuagauuuuauaaaucuuaccugcaggaagguuagucugaccaagcuaacucugccauuaccagaaacucgaagcuaggaccucacaauuaucuuuaaaaagacuuuuuaaaucuuuuaaacauuuucacuuguacuuauuugaaaugcccacaucacauuuugagucagaggaccuaggguuagcuucugucaguaugacuucuauuuuauuuauuuauuuauuuauuuauuuauuuauuuauuuauuaaggcacaaccauguucaucauuacuagucauauggucuaaauuagcaaaaccauagcagaauaaaauauacuacucauugauguauuuauacagacauuaaaagauauuuuugaaugcacuuaauuuuuuaaaaaaauuuuguggguacauaccaaguguauauauuuaugggguauaugagauauuuugauacagugcagaauaaucacaucauggaaaaucggguguccauccccuuaagcauuuagucauacucuuuuaguuauuuuuuuuauuuauuuuuuuugagacaagagugucacucugucacccaggcuggagugcaguggugugaucccggcucacugcaaccucugcuucccggguucaagcaauuguccugccucagccucccgaguaguugggacuacaggcgccugccaccaugcccggcuaguuuuuuguauuuuuacuagagacaggguuucaucgcguuagccaggguggucucuaucuccugacuuugugauccgcccaccucggccuccuaaaguacugggauuacaggugugagccacaaugcccggcccacuaaauaguucuaauucaauauugcagaagugugaaauaagaaauaaggucaaugaaagaaguaccugggcuuuucaagacagcaggucgagguuuuuccccuuuuggaguguguaguaggugaaugcauguggccuugcaaaggcccuugagaaugccuauucugggcauuccaugcgaauacaaucaucauacaauaugguuuuuuuuuuuguuuuuuuuuuguuguuguuguuguuguuguuuuuuugagacggagucucacucugucacccaggcuggagugcaguggcgcaaucucggcucacugcaaccuccaccucccagguucacuugauucuccugccucagccucccacauagcugggauuacaggcaugcaucccaaugcccggcuaauuuuuguauuuuuaguggagacgggguuucacuguguuggccaggcuggucucaaacucuuggguucaagugauccacccaccucggccucccaaagugcugggauuacaggugugagccaucgugcccagucccauuauuauuauuauuuauuuaguuuuuuuuuuuuuuucggagauggagucucgcucugucacccaggguggaaugcaguggcacgaucuuggcucacugcaacugccaccucccggguucaagcaauucucccgccucagccuccugaguagcugggacuacaggcgcacgcugccacacccagcuaauguuuuuguauuuuaguagagauggaguuucacuguguugcccaggcuguucucuaaacuccugaacucagguaauccaccagccucggccucccaaaguguuagaauuacagacgugagccaccuugccuggccccgccccauuauuuuuauuguuguuaauaccacauuguauggauggugccacauuuugucuauccauucaucaguugagggacauuuggguugcuucuacuuuuuggcuauuaugaauaaugcugcugugaacauucaaguuuuuguguggauguauauuuucauuuuauucgguauauauuauauauauacuauauguagaauaccuaggaguggaauugcuggguccuguuguaacucuguuuaaccuuucgaacugccggacuuuuccagaguggcugcaaccauuuuacauucucauaagcaacguauuuccuggauuuuagcaaucuaguuucucuauguguuuaaacuucuuuuaaucaaagaauuuuaauguuaagggauuuugaaauccuuuaguucuaauccaauuacacaugauggaaugaaaguacagaguucauagcuuaaacaucucccgugaacucauguuucauuucuaagcaguauuuauguuggacauuaauuuuaaguaucgucgucggauauuucguuaauaaaggggaaauguuuuagugaauuuuauugacugugagauaaauuuauaugcuaugaaauuuuuaaaaaaaucgacuuguguaauaaaaucacagauaaucauauagaagaaaaauuuccaaagaagcaguuaaacuguggcaauaaaugaguuaauacauucgauuguucugugaauucaggagcgauaauguuaauugugugcuuguucuuuccagacacuuauucuuagaaauuucucauucaacucucaucccuccccucucccaacuucccccaguaccacccccauacccccauugguguaauagaauacggcuccaguagcacauugugccaagaaguuacuauacccaacauuuguacuuucagggacuuuugguuuaguagagcuguuauaauaugugcauuuauugcuuaugucaauaaaaguuuuauaauauggcuuuaucugugugguauucuaaauuaccugcaguuugaaaauuaaaaaucugauaaucacuccucauuuucaggguuacuugauuagcuguguuuggaacugcuaccgauacaucaaugguaggaacuccucugauguccugguuuauguuaccagcaaugacacuacgguagguaugaugucacuuaugguagagaucucgcccacaccuuuacuguaugcugaucuuuaaguguuucuaguguuugcuacauuuuuauuguuacugaaacauacucaugagcugcuuaguuaucaaaagauucaucuuaguuaucaaaauacucauuuaacuaugaaguuaaauguauuuuguuuuucuuacaggauauuaaaauguagauggcucaacucugguuuauuuuaaaauguauuacagauagauaauauauguaccuuacuguaauuauuuaucuuaaaccugcauuguuaaaccaugguguauaauucuagauaucgcuucugcauuguaugacauuauauuaacucacuuuauaugugaaguuaaaccaagaugcgauguuuacagguagguaaaaaagaacugcaaaguuacuaugucuuuguaauuuaucuuauguauguauucuuaguaaaauaauuuagaugaucucuguucugcuacuaguugcucauacuuuaaaauugcaaaccugucauaaaagauuuuugaaaacaugucuucacuggaagaguccaugaaaacauaugcacuuuauguaaauuaucuugaaauuuccuggcucaugguaagaugaagguauaaguccucauggugucucugucgucacugccugauguaaugcacaguaccaggaagugcuccaugcaugguuagugaaaacgauggggauggaugacauguaacuguguggcaugggacaggaugggugggucaaaacggauaggauuggacuggacgggugaaaggaacacauaaaugguaggacgucaaauuuauacuagaguagaguuuuguguuuuugguuuuuuaguuugcuuguuuuuuucuggugacuugcucacucugaccuuaccgaaauaauccagccuguuccuuacuuuacuuucuuguguauaaaaugagacuaaaacaguuacagacuuuguauuaaauauauggguguaggcuacuguauuacugagaacucugugugauagcuaaagcauguuauacacugacaguuuuccuaaaugcucaccacacauuucuugaguucaaucaaauaugcaugagcagugguuuaauagacagccaugaccagaugcacaaaaccuggcauacccaggugcugaggaggcucguuuugggagucugcagaauucuguguauugauuacaguaaucacguguucugcucaaccccuuuaaaauaucacuccugggucuguaacucucuuugaaagaaauaucuauucaaaauuuucgugauuuugauaaaauuacuggcuuaagaauuuuuuuccuuuucucugaguuguuggguauuuuuucauuuguuuuacccauuaacuuuuuuuguucgcccaggcuggaaugaaguggugugaucucgucucacugcagccuccacccccuggguucaagugauucuccugccucagccugccgaguagcugggauuauaggugcccaccaccacgcccggcuaauuuuuguauuuucaguagagauaggguguugccauguuggccagauuggucucgaacuccugacuucaggugauccaccugccuuggccucccaaagugccaggauuacagaugugagccacugugcccggccuguuuuacccauuaacuuuugcagaaggcaaguuguuguuuagccaucuauaaauuuuuucuuuuucuuaaaacaaauaaaaaguccauaauuaguguucuacugaacuaaugaaaaauguaagcaagguuugagauuuuuaaguuugaagaaccaguaaaguuguuacacaagauacaucagaaccucuuuguaaauuucauggcacauagggcuuauaaagccaccaucuuuuagaaguaucucagagcagagaauaauacccauauugcaugugcuuguuuugauauggugguguuaugaaagaggaggcgauacauagguuuucauccacaguuccuggcucuuaacucuucauagccauuguuagucuuugguuauuacccuaggugugucaggucuuagggaaucucugacuuacuucugcacuaaggcaggauucuaaucuucccccuuccuuucuaacugugggucuuaagaccuucccuaaagaggguccagccucguacccugagggaaggaaugcugacuguccuuaggaaugcugaagcuuccuuagggauagcugaacuccuggagguuccuugagggugguacacccaggaagggcuuggaagcuccauguuccuucccccauaucuaugaaucucuucaucuguaucccuuguauccuuauaauaagccaguaaaccucaguaaguguuucugaguccaaaauguuaugggaaccucaacuugaaggcugguuggucagaagcuccugaggcccagacuugcagaguguuggaguggggaggggacacuuuuggggauugagcccuuaaccugugggaucugacacuguuuccagguagauaguauuaugugcgcaucuaagcgaagagacaaccugaaaaggcuaagugugagcaacaaggcuguuuauucacucaggugcgagcgggcugaguccgaaaaagagagucagcgaaggguggugggauuggagcuaguuuuauagguuagggguaagcaguggaaaguuacaguuaggggccguuuauugcgggcaggggaaggggucacaggcgggaagggucacagggcacaaugucacaagguugaucgaucaguuaggguagagucuguuacaaugguagaauguugcaagguuggcuaauaagcuaagacggcagcuagcuguuuuucuucuuuugugguuuuccuguuguccuagacuuucuggcuccaggaggccuucuggauguauacgugugggucacagagguuacaauggcuugaccauggugcagcuuucucagaagaccucacauuccuggcuuuuuauauuaauaauggaaaaacaaaaaugagaaagaguagugaaguauggagaaaauuuaugguguaaauuuugggggugguauggagggaugaugggagauuuuucucagcgcugcuucaagcgggauuagggguggcguggguaccuaaagugagagagaaagguuaaauugaagggagacccuggggcagggggugacauugucgaguuguuaaaaggagcauaugucgaauuuagugauuaguaauagcuuggaugcuguuuuguaugaacagagagauuagccugaaaagacaagguccgaauaagagaaggagaaggaugagugcuaaagggccuguuagugggaggagccaugaagcuaagcuagagaauggccaaguagguccaguauaacuaucugccugauuagugaguuuuugagcucugucuuuaaguuuuuugauauugucguauacaaggccugauugauuuacguaaaagcagcauucuucauuuaagaauaggcagaguccuccuuuuucagcaguaagcagauugaggccucagcgauuuuggaggacaacugcggcuaaggaaucgacuugggauuggaggacagaaagugaguuauaucgguaaggcuagcggagaagucauuggagagacugcgaaauguggugauagaaguugcaaggccugcuacuccuguuccgauugcggcaguggaaacuccuaauccuauaagcaagggaauucaucgaaugacucuuuuuugucuuguuggaguuauaaggggaauggggaguugcucgcuuccguuugcaaacuggguuuugggaguaaggaagauuuaaagugcaggugccuguccgguuagcagggaggcacauguagguggaagagcugcagaggaaaaagaguccuugaggcaggcagaacuggaaaugcagaguaaaaagguaagaguguguucuggaagugggguccugcacccagaccccuagggauccagcaaggguagcagcuguuagagguuguagcgggguuugguaggggagcugcguggagggagagguucuauuuucaugguguauaagaaagcgcuugguaucuacaaguagccauucacuguuauuuauaagacuagguauaagcaggcaagaagaaggacuuggaggggaaucuguugaacgggggaggguagccaaagaucgagcaagugagcgguaagcgucuuucuagacaaaaguugcuaccaauguuuuaaagacuguuugugaugagagugggacuggaaugcuccaauuuucugguugaugugaguguuggggcuuuggaggugaagaguaaaggaacauaaggaagacgggagguuaccuaagggaauuccaguagguaauuguugggagaugcauaagggagcagcaauggggauaguugucuguguagcgagguguccaagaacaggggguguggaauugauguagggagauagaccucguagguagguagggagaagagcagcagccuguuaguaugagauauugggggaguuuuugcugaauuuuucuuuucuuucuucuuuuuuuuuuuugagacaagagucuugcucuguagcccaagcuggaaugcaguggcacaaccucgcucacugcugccucuaccucccagguccugguucaagcaauucuccugccucagccuccugaguagcugggauuauaggcacgcaccaccauucccagcuaauuuuuguauuuuugguagagaugggguuucaccauguuggccaggcuggucuugaacuccugaccucgugauccaccugccucggccuccuaaugugcugggauuacaggcaugagccaccgcgcccagccccugcugaauuuuccagaaagugaagaagauguucgggaggguaaaggugugggggucacugaaagagguuuggagguguaaggagaugggggagguugccuagucagcuaguagggcagggacagcuguguaguaggaggaagagagggaaaugcauagccaacaauuuuuugcuaagaaaggauuagagacggugaggagagagugggugggugagguugaugguauguuggagauaauuagggagggguagaggguagcaggagaacgggagugagacccaaagugaguagaaaagaacuucaucgagguggaagaauuggagagugccuugccacacaaggucaccuauccacucuaggagagaguuaaggguggcaccuugagggugagaccaggagaugucaguuacaaugguccagaggaaaagcgugagccggcaauguagacaaaagcagggcauuuagaaguaggcaagaauggugauuagggaccuagguagacauuaaguagugggguggcuauguaaaggccuauuguaaaugaaagauacaaagggcuguuguucuuuuucaggaaugcgaguaaguugaagagaagugggggagaguacuugcgacuuccagaaggagguagaggaguuaggcugguggucagaugggcacaguuuuauccuggagcgaugaacccaguggggaagguucuguagacggaccgugguuggagugcuguaaacaaccugguaggguuccuguccaccgagguuguagaguuugagggguuaguucuuaacaagaacugaccgucgggcuaggaugucuuuauauggcuggguaucuggaguggguaaaaggaaauuggcagcucagcggauuucaugucuagcuuguugaaggacuggaagauaguuaccaagagggcuggugucuggaaugagguugggcccauguaaaaaugugcggccauauaggagaucaaaggggcuauacccuguggguucuugaaggguggcucaaauuuggaggagagcaaaggguagaagaauuguccagucuuuuuugcguuggagggugaguuugguaagauguguuuuuaaacgacuguuggccuuuucuacuuuuccugaggauugaggaugauaagggucauggagauuccacugaauacugagggcuugggaaacugcuugggugaucugacuaaugaaggcuggacuguuaccagauuguacggagguaggaagaccaaauugaggaauuaugucaguuaggcaagaaaugccugcaguggcuuuuucugucccuguaggaaaggcuucaacccaucugguaaagguaucaacccagacuaggaggguuugaauuugcagacucggaacauaggugugaaaucuauuugccaaucuuuuguggggguaaauccucgggcuuggugugugggaaagggaggggauuuuaggaagccuuggggaguaguagaguggcagauagaacagugagaugugcuuguuuugagaauguauuuccauaaugggaaauaaaugagggguucuaaaagacaggugagagguuuguguccuacauggaaguggucaugaaaggaagaaaggauagagugggcuugugaggcagggagaaggaauuuuccauggucuaagaaccacuugccuugaguuggaaaggacugguagaacagguuuucagaagaagaauaggugggagugauagaugagaaagacaaguauuggcugucuggagcggagacuggaacgugugcaggcgcugaggcugccucuuucgcuguuuugugggcgcagacguuuccuugggcaguggggucagauguuuuuuggugcccuuugcaguggauuacucuggcuuuggcuguaaggagggcaguuuuaaggagagccuuuauuagacccagcuggugccugcugcuuguuggugggagaaacccccacgccuuuggucacaggagccuucugcuuugauuguugugguaugagagcagaggaaaaacacagcuugagagcuuuccccaaaacaaauauacuucuaguuguuuuuuuccaguagaaauuuuauagaaauuagggugcuuagagaauuuaagaaccaugaguaagucccccaaaugcauccuacuagcuuuuuggagaaaacuucuauuuuuccccuuugaaagacacaaagguauggaauaacagguuuguuuauuuaggcuuaguuauaaaauuuaucaaaauagcuacacuuuucaacugcacguucccaccucuucuaacagugugccucuuuucuucagaagggcuaccaggugggcaguaguuugugguagcuacauuugggggccauggucgaaugccagcugcguuuguuuccugguguguugacauacaugccgggaaauugcuugguagcgguuggucagucucugucauuuuguaacaacuugccauuuuuaagaugaggaaacugagguacugauaauguuacuauuuucccacaguucccaaugagccauuuuuuaaaauuuucuucugaaagaauuauauuccuggaaaagguagauuuaucuuuucucuuaacauaguuguauugauauaauccacuccgaaauaucaggguagaccaccaguugaagucucagcuuucugacgauauuuuuuauuuauuuauuuuuauuuuauuuuauuuuauuuuauuuuuauuuuauuuuauuuuuuugagacagagucuugcucugucaucaaggcuggagugcacuggcgcgaucuuggcucacugcaaccucugccucccagguucaagcgauucuccugccgcagccuucugaguagcugggauuacaggugcgcaccgccacgccuggcugauuuuuuguuuuuaguagcaaagggguuucaccauguuggccaggcuggucucgaacuccugaccucaagugauccacccaccucugccucccaaagugcugggguuacaggugugagccaccgcuccugaccuucucugacaauauuuuguuaaaagauauuuacaaaaacaaaauggggccaggcacaguggcucacaccuguaaucccagcacuucgggaggccgagguggguggaucacuugaggucgggaguuugagaccagccuggccaacacggugaaaacccguuacuccuaaaaauagaaaaguuagccgggcgugguggcacaugccuguaaucccagcuacuugggaggcuggggcaggagaaucgcuugaaccugggagguucacuugaaccugggaggcagagguugcagugagcugagauugcgccauugcauuccagcccaggaaauagcagcgaaacuccaucucaaucaauuaaucacucaauaacaaaaugguauuguuauuuuuuaauuguuauuuuuuaaagaguuauuauuuuaccuaaaauaauaaguuucuaaucccauaaaauauccaguaagugcucagguuuccaguugugucauaaagggauaauuuucuagcacuuuauuugaaacaggauauaugggucaauauguaguuugucuuuauaauuuuuuguugaagaaauuagguugucccacagucuagaugauucugauugcaugccucucauguagucuucugcauuaccagcgaauuauuuggaucuagaggcuuuuuguguucagauuugccuguuuguuuugcaagacuacuucauaggugacgauuuuuucuuccauuaggaagcaaauaaugucugguuaaccaucuuuuuggaagucaagaaccauugauacuuaauaccuagauuuauugaucauuaggguugcaauaugaucuauaauuccuauuucauuuauuaguuagaauauuuguauaaagagaagcuuucccucauguacuauuuggcuacccauuguauuugugacauggauaaauauacgugguuuuguucucuuugucaguuuucaaaauaaugaacucauuccucauucucuaguggugaccaguaagguuguuuuaaaguaauaaaugaaccgaugaaaacucgcaguggcucacgccuguaauucuagugcuuugggaggaucacuggaggccaggaguuugagaccagucuggucaacauagugagaccccugucucuacagaaaaaaaaaaaaaauccagguggcaugugccuguaguucuagcuacuugggaggcugaggugggaggauugcuugagccugggacuuagcuggaagcugcagugagcugugaucgugccacugcacuccagccuaggugacacagcaagacucuuuaaaaaauaaaaaagggagcgcuauuaauguuauguugaaaaguacaaccauuuugauaaaguuuauaaguacgccuaaauaaaauuuguuacuccguaccuguuuucagucuuucaaagaagaaaaauaaacuuucucugaacagcugauauauaauaguuaauauaauuaaugcucaaguugugcuaucuuuggccacuuggagucucuucaaguugguuucugagucuuuugacaugucccugguuguguguguguguguguguguuuauguguguguguuugaagagacagggucucacucuuuuacccuggcuggagugcaguggugugaucaugcaccugggccucaaacuuaagcaauccuccugccucagccuccugaguagcugggacuacaggugugagcuacugagaccacccuaguagucuuugauugcuuucuuauugucugguaugacaagaugcucuaggcucaucuuguacauuucuugccccaaauguggaaugagccauuucuccaggcagcccugccuauguuuuguaggaaaugacaucuggagaccauaaucuggauuucugggguuagaggacaggcuuuuuguuuugguuucggcuuuuuaaagcagggcucugcauguuuaaagauuguuuagaacuaaaggaguuaauguuaccauuaucaauuaagaaaaccaaaguuacugaagccucccucugagacucuaauggggguuggaaugaucuagaucugucauuuucccuggucuccauagcuguguuaagaacuucaccauguguaauaauguauguuucucuuuuguucacaucuuuguugggaauccacauuuacauaauaacaugucaugucuugcuuucacuuauuccagauacuaggccagauagcuuuucucccaggcugaauaguuucagguugaccucuguggaaagauacugggggcucuugcugguagaaaaugaaugugguuuuuccuccucuucucuaaaacaguauacauauuauuauccagaugugcucuuucccaaaauucuucucagagggaggauagagaagaguugcuagauauuggagaucauucccuggguuaaucucuccuccaguuucccagcuaaaccaaaccacauacuuugaaaggaaugcguaacgcagaaggucacaaacucuguucauaaugcuuuagagucaucccgcccccagcacccuuaggccauugagauaaguaacauaacuguggauuuuauugaguagucauguccaaaugacuuaauaguggucauuggggcaguaucuaacaagugcuggcacauuuuccuugaaaauuuaaaauauaacaagguguccuuuuuugagucugcagcucccuugggcgggccugcugguggugccuuggagcccccuuucuuuuagggcaguguuaugaaaaucacaugguggguguauauuguguaauaccacacucuccacugcugccaaaauuugguuauaagaggaaaagauuuaaauacaaauccuguagaucagggguccccaagccccgggcugcacagcaggaggugagcagcgggcgcgggcaagcaagcauuacaaccugagcaccacuuacaagauuagcaacagcauuacauuuucauaggagcacagacccuauugugaacugcacaugcaacggaucuaggcugcaugcuccuuuugagaaucuaaugcuugaucugggguggaagaguuucaucccgaaaccaucaucacacagcccccucacccccucaucaaccccuuagcaaaguugucuuccaugaaaccagggacugccgauguagauuaugguaauagguuucuuucacauuaagcuuuauucaaauuaaguuuuguuuuguuuuguuuuuugagucucgcucugucaggcuggaauacauaggagugauacaucagcucacugcaaccuccacccccuggguucaagggauucuccucccucagccuccugaguagcugggacuacaggcacaugccaccaugccuggcuaauuuuuguauuuucaguagagacaggguuucaccauauugaucaggcuggucucgaacuccugaccucaggugauccaccugccuuggccucccaaagugcugggauuacaggcgcgagcuacugugcccggccauaaauuaagguuuuaaaaaguauuucuuaaaccuaugugaccuuguuuacuaauacuaauaaaggcccggauggugauaagagccaguauuauguuaaaucuaaauguagggaaccugauuccucuggaguuguggcacucaaaaagcagugagguugauauuuagccaaaaugguauauaagaauucugauugcagauaaaagaaucauagucuuggcuaauguaggaaaauuccuauuuagggaaaaacaggaaaauuguuaacuccauaguauuuauuaugccaugucauauuguaggcucuuauccagauuaacauuauaugcaaacuuauuguuuuaacuucaaaaaguauuuugcuaugugggggccuucuuuugcaucuaacugcuugaaaaacgcaauugaagaaaggugaguguggcuucuuugguuucagaaaauaaguauaaagagaaaaaaaaauauauauauauaacauauaaggugagugaugacuggggcaaaggccagauuaucuucucaguguccuuuucucaauaaauucucuuugaagcaccugagauuaauuaaggcugaccuuggguugucaaaaagccacaaaacagguauugccugacuaagggggaaugggaguggagucagauuuaguagugguugcaaugacuuucaaaaauugugcaugaaaaauuugauguuuuuccuccugccacuuuuuuuuuuuuuuuuggagacagagucucugucgcccaggcuguggagugcgugggugugaucuuggcucacugcagccucugcuucccagguucacguuauucuccugucucagccuccugaguagcugggacuacaggcacaugccacuaugccuggcuaauuuuuguauguuuauuagagacaggguuucaccacguuggccaggcuggucugaaacuccugaccucaggugauccaccugccuuggccacccgaagugcuccugccacuuuuaaaagcagguuauuacuuccgaguauaguuuggauaugguuagaaacaaguucuugacugcauaaugaguucuguuuuuuuuuucccuucauaaaagucauaauuaacuuuccaaaaugguuugaagaaggcuuugccuaagcguaguuacuagguuggcuauuaauuuagcauccuuuucaguccuguacgcaccaaauucagguacauuaaaagcagcucacaacgaaacaguuuuuaccacugucaucugcguaaaugaaccagagggcccaggggacggugaggguagaaggggagagaaagaagauucuucaggaauuggacuggaagaguuugaaacucuagccugucauuauuggcuuucaagcuucuugccuacuaaguuuagaagagagaucuuauuacuaauaucucaauuuuagguaucacuuuucccuuauaauuuaguaauuuauauaaucucuccaagcauuuucuuuucuuuugauuuuaaaagcccaaaacaaaagugacagguugauauggaauagauuugguaaaauugcaaauaagcugagagagcacuaagagacuguuuccagaggcaggguuagaggcagugaaggucuggcccagggcaggagugcugggagugagccaggcagaugggagagcugucagagguaguuaauaguagaucauugagggaacuggaaugacaggagcuuucuugugugugacugucacuuaacauauacaaucacacacuugcaggguaggguaacaccuugaacgucaucuggcccagccaucauuugaugcccucauuuccucaacagugugcccaccaguuccauccagugaggguugagugacugcauugaugcuguacuccucucugcaucucuuagaccucccuacucuuguguuuguaucauagguuucuccgcagacauguggcaguugccgcccaucaggccuugugccgagugcuuuacauagauuaacucaaucacacaagaguccuucacguacuagguccuauuaauuccuguguugcaaaagaggaaacugaggcaccaagaggguaacuucccgaggucacccugcuagucgaguggcaggagggggacuacaaccugaucagccuggcugcaggcuguucugacccacucaccuccuccuaacuguuguccaguugggacugcagcuggggccaaguguucucaccgccgugucuggcuguauugcccaggaugaggagugaaacauguggacacuuuuucauucagacaguucuucucgaguacagucagaaacuuuaaaagcagugggauuuucugguuuguuguucguuugcuaguuuuuaccuuuucacacaguggaagggagggguggguaacucagaaaaggggcggaagaaaaagaaaggguaaaaguaaauuuugcauaccagggcagcugcuuaucuauauaguugugcuacacaguccugcuucccauaccccagucccugcauucucccgauguugucauaugcgcauacagcuucagauagacuuaccuguugguuccaauaucaaagcaucaugggugagauuggacuacaugcuccugagauuuuucucccaaaaccuuuuccuuggcuguaauucugagguucaggcugacaguaugugacauuaacucggcuccuauuucuuuccuucugcauaauauucuuccaacaauuuuuuuuguuuuguuuuguuuuuggugagauggaguuuuacucuuguugcccaggcuggagugcaauggcgcgaucucggcucacugcauccuccaccucccaguucaagcgauucuccugccucagccucccgaguagcugggauuacaggcauguguuaccaugccuggcuaauuuuguauuuuuaguagagacgggguuucaccauguugcccaggccgaucucgaacuccugaccucaggugauccgccugccucggccucccaaagugcugggauuacaggcgugaaccacugcgcccggccaccaacaauaaaauuuuaaaugucccggucugcuggaaauuaucuccgagccauauaacuuuccaguuguuucaucccagagcaacauucgagaagacuacacgagcacuuguaaacguuaggaggcuuugcaucugggggaucucagaguguguuugagaggacaucuagagcagucagaucaacacauggauguuugaaaccuaaaguucuuaaagcuccaaacaaaccuaguuuucguugugaaccauuuuacuauaaaacacacacacaacuuauuuaauaacgugccucagaguccauauugauuuuacucuagggacaaauaaggcaaggaauuuuauauuuuuacauuguaggaaagguuucugggaauguauuucccuuuccauuauugcaagggagguggcagggaaggauguggaguaggggaggcaggugaaaugggagucugagauccaaggucaugagcagucccugcaucccuccuuuuucagcccauguucuguggcagcagcugggcauggugggauuguaucccccuggaacgguuguugucgugaaggagauguguacaguagguggcguagcacauucaggcuucaggaacaugcagaggcagcugcugagaugccuuugauaggauuaccgaggugauagcacacugcuuauuucauuuccucaauauuuaaauauccaguauuuacuuaacuauuauacuucaguguguagaaccauuuuaacuuucaguuugggccacuguauugguauuuuauaauuuuuggacccaacugaaaauauuugcggugugaauucuguauuuugaguacaaucuguaucaaauaauucagauagcuccuuugcugagaauuaaggauaauaauggcucccuccuauuaugaagugaagaaaacagaguaguuuugcaguaaauugaggauaaaaaucuaccucuaucuuguuugccuuuggaaacaauuccuugcucuaggugagaggagaguuucucauuagaacucccaaaaauguguuuauauucucaucucccgaugucuuagguucacugaagacaagauguuaucacuugucaauagcacuauuauuuuagguaccucuuacugugagguacuguuacaaggcacagccaaaauuauuauuauuuuuuaaaauuaaaagguaaacuuuaauguugaaaaugcaaacuuggggaagacagaaaagaucacacacaaggcugucacuucacacuuagaagguugcacagcggccgggcagaggugcuccucacuucccagacgguggggcggccgggcagaggcgcuccucacuucccagaugguggggcggccgggcagaggcgcuccucacuucccagacgguggguagcugggcagaggcgcuucucacaucccagaugggguggcagccgggcggaggcccucaucacuucuagacaguugguggccaagcagaggugcuccucacuucccagacgguggggagcuggguagaggcgcuccuuacaucccagauggggcggcggcugggcagaggcacuccucacuucccagacaguggggagcuggguagaggugcuccucacaucccagauggggcagcagccgggcagaggggcuccucacuucccagucaggguggcugggcagaggcgcuccucacuucccagacggggcggcacagccaaaauucugagauguuaagauguacgaaaauguauacuuuagaauaaaagguacagaguugugugucuguguuuacuuauaguauauaucauagguggggcauuuaaaaaguuuggaaaaauuauucuagauaucuuucucuuuuuuuugagauggaguuucacucuugucacccgggcuggagugcaauggcacgaucuuggcuuacugcaaccuccaccuccuggguucaagugauucuccugccucagccucccgaguagcugggauuacaggcgccugccaucacgcccagcuaauuuuuguaguuuuaguagaggugggguuucaccauguuggcuaggcuggucuugaacuucugaccucaggugauccaccugccucagccucccaaagugcugggauuacaggcgugagccacugcgaccagauaucuuaaagauaagcccagacuuuguauuucugauuauucgaucccaaaugcccaaauaacucugugaguuauuccaguuacucacagagguucauaauucacuuaucuccccuucccuguuuggcuuaaguaaaggaaucucacaucaaaacaggcaaauguggcgugaccaauuuaagauaaauauuugauguaaacacugcacauuuuaaacaagaugcauuauaggugauuggggguuuuacaugguggaaaagaaaacauauuuuggcuacuugggauuaauugaaauggaccuuuggaagacuuaagugcccuuaaauaaugagacugcuuggagacuguacuuucucaucugacaucacaucuuccaagguuacaauuaagggcagcgcuuuuccuuagugcaggcaaaggcaaacuuauauuucagguuuugggggccauauagucucuaucgcaaguauuugacuuucugaugaagcuggaaagcagcuguagacaguauaugugaaugaauguggcuaagucccgauaaagcuuuacuuacaaacacugaauuuugaauuucauaugauuuucacaugucgcaaaacauuuuucuuuugaauuuuuuuuuccuucaaccaugaaaugacauuuaaaaacuucuuagcucccaggccauacaauaaaauggugacaggcccuauuuggcccacauaguuuaccaaccccagccuuacuagaaauuuaggcugaguuuucuaggcaacuguaggacagcuaucugaaacauuccagauuguucaguagccccugcuuuuggcuuggauagaucugaauugaacuauucccuccugcaggagggccggcaaacaggaguaccuaaucuuuguuuuuuuguuguuguuuuuguuuuuguuuuugagacagagucuugcucuguugcccaggcuggagugcacuggcgcgaucucagcucacuacaagcuccgccucuuggguucaagcauuucuccugccucagccuccagaguaguugggacuacaggcgcccgccaccacgccuagcuaauuuuuguauuuuuaguagagacggaguuucaccauauuggccaggcugguuucuaacuccugaccuugugaucugcccgccucagccucccaaagugcugggacuacaggcgugagccaccgcgccuggccuaaucuuugggguuuuuguaaggauaucuuuuuccugcagaaguuuuagugcucccuuauauaauaucuuuuuuuuuuuaaagacagagucucacgcucucacccaggcuggagugugguggugcaaacuuggcuuacugcaaccuccaccuccuggguucaagcaauucccaugccucagccuccucaguagcugggacuacaggcauaugccaucacacuuggcuaaauuuuauauuuuguauuuagagacaagguuucauuaucuuggccaggcuggucucuaccuuuugaccucaagcaauucucccggcucugccucccaaaguguuaggauuacaggcgugagccaccgcgcccgcccuuacguaauaucugaauuaaaauuuacauuuggccgggccauccgagaccauccuggccaacauggugaaaccccgucucuacuaaaauacaaaaaauuagcuggcuaugguggugugugccuguagucccagcuacucaggaggcugaggcaggggaaucacuugauccuggggggcagagauugcagugagccaagauugcgccauuggacugagacuccgucucaaacccacaaaaaacaaaacaacacaacaacaaaaacccaaaacuuauauuuaacaaacuauaguggaaaauaaauaaaucauuugcuggccaggcacaguggcucacaccuguaaucccagcguuuggggaggcugaagcgagcaggucaccugagguuaggaguuugagagaccagccuggccaacacggugaaacucugucucuacuagaaauacaaaaauuagccaggugugguggcaggugcauguaaucccagcuacuugggaggccgaggcaggagaaugccuugaacccaggagacagagguugcaugagccaagauugcagcauugcacuccagccuggggcaacaagagcgaaacuccaucucaaauaaauaaauaaauaaauaaauaaauaaauaaaucauuugcuuacaaaacaguugcuaaagucuugaagaauaguagcugaagcuguuauuuauauagaauguuaccugcugucauuuauacaaagauccauucuauaaauuccuauuuuaguuuacuaccagaaaagaaacugacaucuccucuuucccuuuuugucuaucuguguauauguagaaauaaaaaccuuauaacccaauaaauuuccauuuugccuuauuucugggugauuuuaacacucaguugucuuauuuugcgugaugauuuuuggggguggggggagcaggauggggagaggggggucucugucauacuggcuggagugcaguggcaugaucaugacucauugcagccucaacccuccagggcucaagugauccuccuaccccagucucccaaguagcugggauuacaugcacguaccaccacacccagcuaauuuuucuuuuuuguuguuguugagauggggucuugcuauguugccuaggcugguccugaacuccugggcuuaaacgaucugccugccuuggccucccaaagugcugggauuacaaaugugagcuucugcaucccgccaaugcuguucuaaugcuagaacucauuucacaagcaaagaaguucagcagugagcucaugcuuguggaauucauugguguuaacauguucccaccauccugaaacagcuugcauccuaggucuguaguuuccauugggguuuuggguacuucuagauuacgucucauuguggaggugggguuucacaagacuggaagacuucuguaugaaaacaugucagcuccaaggcaaugacuucaaacagcaugguacucccccuugcuuuacuuagugucuauacugcacguguucaggcccuacuuccuuguguugaaagucgccucuuugacaaguuggguuguuucccaggccuuugcagaagcucauagguaaaagcuugcaacucaucugccagcugggaaggccgaaggaauggguagucuuugccugcccacauccucaggcugaaagcuuccccaugaugacugacuuccucuuuccauuuugacugccaugauuaucuuuuuauuuuuaaaauguugcuuuuaacaccauauugcacacacaucccuaaaaaucauagaaucaaaagguuuuuuaaucgucccgucacucccucccccauccuccacuuuuucaccccagcagaaagcacccucaacucuuucacucauuucuucuguacuuaccuucauauuuaaaaguaauagucugcuuugcuaguugcugaugaucaaugugagaugccuuuugaauaggauguaacucucacucuuccauuuucuccgcugcuuuauccuccucguguaguuucaucacauuuugccugcaucaucagcuaguguuuacuuugccuuugcgaauuuaugauauuguucagugcagaguucuguaguguacauucccuuucucauacaacucuugauuuucccaaacuaacacuugcuuuguuuuuuuuugauccuaaguuguuuuuuuuuuuaaacuuuuaccuagucccaggcuuuucuaaguggcuaucaaaccugucaguuuauuaauauuaacuauuaauaaugcuauuuuccaaagguuugauucuauaagacacuucaucaguucucuuuccugagacuucuccucaccccguuccaggccagacaaggggccacacaguugucaucugggcauugauuuccuuauagcuuuaccucacccuucuuaggaccuugaacagacuuauggugcaauuaccuugugcuuuauacugcccccacacccaguguuagaccucaaaaucuccaaggaugguucuuugagggucucauggaagcucuagacacccuccccaggaaaauaaacacauagauggaaaauuuggccugcaauuucaggggacugguagauccuugcagucccuuuguggauccccaagaacccaugaucacaaucagcauaucuuuuuuuuucuuucuuuucucuuuuccuuccuuuuccuuuuccccccccuuccacuccccuccccuccccuccccuccccuccccuccccuucccuucgacagggucuugcucugucacccagguuggagugcagugguacgaucguguuucacugcagccucaacuccuugggcucagucuucccaccuuagccuccuaaggcuaauuuuuguauuuuuuguagagacagggucuugcuauguuguccacacuguucuggaacuccugaggucaagcaauccuccugcuuuggcuuccaaaaguguuggaguuacaggugugagccaccgcaccaacacaaucauaucuuuuaacguuuugugauauauuuuuaugaaugucugaagacccuuguguaauuuauacuucauauuuugggaaauguaaugcuagcaacaguagaauucuaaauaagccuauagugacuuaacuaauauuacaguaaaaguucaguucuaaccagaguauccaauuuuuuuuuuuuuuuuuugagauggaguuucgcucuuguugcccaggcuggagugcaaugcgcgaucucagcucaccacagccaccgccucccggguucaagcaauccuacugcgucagccucccgaguagcugggauuacaggcaugcgccaccacgcccagcuaacuuuguauuuuuaguagaaacgggguuucuccauguuagucaggcuggucuugaacucucgaccucaggugaucugcccaccucagucucccagaguacuggaauuacaggcgugagccacugugucaggccuaaauauuuucuauuuuuaccaauaaauaguucuucccuccugagcauuuuguuauuuauuauuauuugauggagugcauucauuuuucccaaaaauauuuuaaaauuuaaauagagauggagucuugcuauuuugcccaggguagucuggaacucauggguucaaacauagacccaccucacucaacuucccagacuguugggauuauaggcaugagcuacuguacccagccaguuuccccaaauuauuaaugucuuguggauuuuugccuaguuggaaucacuuuuauucuaggaugucagauuuugcaaccuuugauuuauuucuccccccaacuguucuauauguugauguagcugagaagaaugaaguuaccucugguaacacucugaaucuuuguuaaguugaauugaaaugaaugaugaguuucuuucccacauguuauguaggcugucaccuagcaugacaacuucaauagaagagacauuauauauagauagagagcagucuuccuaaugaacuucugaggucauuagcaagagggauuuuuccuuuuguguggaagagaguuccacugucauucagccauuccguagcugaacucauguuaaaaccaacuggaagaaacugaacuuagauuagaauuugguuguauuaagcauugcuugaccuaaagcagucugugguugcgguuuuaaacucuugaguauguuuaucuaggugcuccuugaguagcugcugcuugucaggaagugacuucagaaauaggacaugaccuauauucuuaguucucagagauuauuuuuggucauucauugugaaugguuaaguuuuuaaaacaaaaagagugguuuuaacuaacaccagcuuccacaaaugucaaaauaauagaguugucaccaguuuuguucuauggcaucuugaugggcacaucccauguucauugaucuccuauaguuauuuucucagauuuuaguauacuugacugauccuuguagaaaagaaaaauagcaaguguuuguagugaauauacugcaguagaaacuguggcaaugcuuccuucaccaacccuucuaauaauaucagcaucacuuagauacaaagaugaugcugccccuacaaggauuuaaaacuagucccacguggagaaccuuugaaaguaguccaaaggcgucaucuggagaauauuuugcaaucaguauuuaguauguguugaaggaaaagugaaaacaagggagggugucagaaacuuuaaugaaaggagaaauucuucuccaggcaucuuaagcuuuggauuaaggguccaaggcaauagaauauuugaaagaaaagacuaucaagauauuaaaguacuggcugggcaugguggcucaugccuauaaucccuguacuuugggaggcugaggcagucggaucaccugagggcagaaguucuggaccagccuggccaacguggcaaaaccccaucacuacuaaaacuaaaaauuagccggguguaguggcgcaugucuguaaucccagcuacuugggaggcugaggcaggagaaucgcuugaacccaggagguggagguugcacucagccgagaucgcgccacugcacuccagccugggugacagagcaagacucucucgaaacaaaacaaaaccaaagauuuaaaauguugauuuaaaaugaaacuuuaaaacgaguuugaagaugaauaauaagaaauagugacagaccgccaaauguaaugugaaaguuuuauuuugacaaaaggcagauuugcagcaccauuuuuuuuuucaagaauaucuuauguuaaucuucugugaacauuuuggagauuuugauuugaauauuguguuuugccuagaaaaaaaaauggugggugugauagcugauuuuuaccuuuuaaguagcucuacaggucggccacaguggcucaugccuguaaucccaacacuuugggaggcugaagugggaggaucacuugaggccaagaguucuacaccagccugggcaacguggcaagaccccaucucuauguuuuaaacauuuaaguaacucuacuguguuuuaggauaauuuaucuaaagauaaguauaugaaucaguuaauuguuuaaugcagugguggggcauuguggugaagcucagucuugcuaaaauuaauauuucuggugcggucacagcuguuuccacuuguuauaaguugcuguaucuaaugcacacacacguaugugcgcugggggcucaguccuaaagucaaauaugcacacgcagagaagacagcuguugcuuuguuuuagagaauacuuuuuucuucccgcagcucaagcugacacuuuuggaauugcuaguggagaugcuguuguuagauacuggcuagaacuugucaaggucgaccaugaggcucucuucaugugcugaccugugccuaucuuuccaacuucaucucugcaacauucucccuucaguguucacuguagcaaacaccuugcaguucccagaaagugcccuguguccugcuuuccucuuaacucccuacuggaaugucauccucuuuacugcacaccuggucauccuacugagaggccuuccuugacucccuagccuaaauugguuguccuugucuguucuuuccuaacuugucugcauccacacauugcucauguugaguuuuaccugugucugccuucugcuagauugcaggccccugaacagacagugacauguuuucagguucaagucgcugugacugaguucccuggacaccuaggugcucagugggugcugguuuguuggacuuaguuuccugcugugcuuccuuaccucaggcauguguucuguacugaguguaucuugccuacuccauuccuuuuccacgugggcaacgcugaacauuugccccagacucuguaucuugguuaauaccugacauauaaaguauuuagcacauaggcaaagaucacuaccucuuucaggaacaaaggccggcuggcgggugcgacucuggcgcauugccuuugccuguguguugcuggccaguuaucggcuucuugcaucacagcuccagagucccauuuagcuugacaugggcugggccuugcagauacuccuccuucaccuccugacccuguucagccaggccaguagggggcacuggaggaggaaagccgccacccccccuccuccaccccccugcccgccugcccgcccccgguuccuguguguuucugcaguguucagaucuugcuggcagugcuccccagggcccagugcgagcggagacagcgguggcagcgccucucaggcgguuuccagagcgggccguggcucccgggaacggcuucccgcaggugauucugugcacacuggccucuaccugguucagcgggaagccucuccacuguccaaugggcuucagccacacccucccuagccgugucucagcccagccuuggggaccucuguucuagcuuguuccgucccugagugccguacuucaaucuucuuauccauuagugcucuuuccccgccaugagucaguucccgguuccucagucuccuguuaauaauucuucaugaaacuauauucacaucacuguguggcuucuguguucugacuggacccuagccaguacaggugcccucugccuaggcagcugaaggaaccauacaggcuuuucgggggccggccuaaguggcaccuccgucacuccgcaaacaucugaguuccugcugucggauaggcacuggcccacccucgaggaagugagaccuggcuucagccccacaggagcuccaagacugggaggagagaaguaaugaaguguguagagcuggagaggagggguguguguguguguguguguguguuugggagagugcaaugugacaaaaacuuaacaaaauuuuagugugguucuaguaggagcuaaagggacagauaaaugaaaauuaacaaaauugaugaauaccacuuuaagcauaagugauaucccugauagaaaaucuaaccaagugugguuuuguuugugaauagucuuucccuuuccacaaaucacuugaggugggugagguuuuguuuugucuucucaucucugaacuccuaaagggcagggacugucuuuugucucaauuaucuuauacucacaaugacuauuacauacuagaugcauaauaaauguuaguuuacugaaugaagggugauauaacuauucuguauuccauuuucuacuccaagaaagccgaaaucagccaguguauagaccgccaacucugagguauccuuauuucauagacauggaaacugauguuaaggaacuuacccaaggcuacgcugauaaaaugugacugacccaggcuuugaauccaggcugauaccaaaagcuuggcguuuucacugcacuuugcaguucucaccaugagugguuacuguagucaaucaagugccugcccuauuugugugugcacauggacacacucaccuaggggucuuuuuuccucuucagagccaucaccauuucuuuuagagucaccgaccucuggccauccagcuacacauggacaggguuagaaaaacucaaggcuugagagucgcucuccauuugcuccuuuaaggauucaaaaagucuuuuaaugaaguguauccacuugcuagaaaauugaacuugguacaaguuguggaacauguuuaguugcauaaaaguucaguaaaagcuaaaccucggggaacgugugugcucuucaaacauuaacucuugccgucccucuuucuucucaggugcugcuacccccguaugaugaugccacugugaauggugcugccaaggagccaccgccaccuuacgugucugccuaagccuucaagugggcggagcugagggcagcagcuugacuuugcagacaucugagcaauaguucuguuauuucacuuuugccaugagccucucugagcuuguuuguugcugaaaugcuacuuuuuaaaauuuagauguuagauugaaaacuguaguuuucaacauaugcuuugcuggaacacugugauagauuaacuguagaauucuuccuguacgauuggggauauaaugggcuucacuaaccuucccuaggcauugaaacuucccccaaaucugauggaccuagaagucugcuuuuguaccugcugggccccaaaguugggcauuuuucucucuguucccucucuuuugaaaauguaaaauaaaaccaaaaauagacaacuuuuucuucagccauuccagcauagagaacaaaaccuuauggaaacaggaaugucaauuguguaaucauuguucuaauuagguaaauagaaguccuuauguauguguuacaagaauuucccccacaacauccuuuaugacugaaguucaaugacaguuuguguuuggugguaaaggauuuucuccauggccugaauuaagaccauuagaaagcaccaggccgugggagcagugaccaucugcugacuguucuuguggaucuuguguccagggacauggggugacaugccucguauguguuagaggguggaauggauguguuuggcgcugcaugggaucuggugccccucuucuccuggauucacauccccacccagggcccgcuuuuacuaaguguucugcccuagauugguucaaggaggucauccaacugacuuuaucaaguggaauugggauauauuugauauacuucugccuaacaacauggaaaaggguuuucuuuucccugcaagcuacauccuacugcuuugaacuuccaaguaugucuagucaccuuuuaaaauguaaacauuuucagaaaaaugaggauugccuuccuuguaugcgcuuuuuaccuugacuaccugaauugcaagggauuuuuauauauucauauguuacaaagucagcaacucuccuguugguucauuauugaaugugcuguaaauuaaguuguuugcaauuaaaacaagguuugcccacauccaaga

SEQ ID NO: 192538 - RNA, 3881 nt, Homo sapiens
aguuccggcucugccgugaagagcuuugcauugugggaagucuuuccuuucucguuccccggccaucuuagcggcugcuguuggugagugggcuccuaccgaccgagguuuaggcagcgcggggagcuuugcggguugccauuuguaacuccggauccuaaaauuccuguccuguucucugucucuucuagguugggggccgucccgcuccuaaggcaggaagaugguggccgcaaagaagacggugagugaggcgggccaggcccggaagacgauucacguggagagaugucuuggccagggcgggcagaugugagcccacgggggugacagcaugccugcuggcauuuggagggccccagaaggaaucccaguggcccucucaaugacuugggguccucgacuucggaaguuuaaggggcucggcuucaaaaagcuggguccgguuuugaggcgguugcaggcgaggcccuuagguccguauuuaauguuugcuuuguagaaaaagucgcuggagucgaucaacucuaggcuccaacucguuaugaaaagugggaaguacguccugggguacaagcagacucugaagaugaucagacaaggcaaagcgaaauuggucauucucgcuaacaacugcccagcuuugagguaaucgaagagacugaacgggcuucgccuaccgcgaauucaucgugaacgaauauacaggaguguaaacuuguaaucugaguaccaugaacucgaacacuugcaggauaauuacgguagcgauugugguguuuggcccuucauucccgucuccccgacccacccccaaaucgugugcuccccuucugugagcuuauuuuuggaggagaaauguguguguguggcaggagugaaaacagaacaucgagguuuaauggaaacacagacacauuacuguuuuuuccauguauuuuguguccugcuuuuuugguucuuuuagcuuugaggugcuuuaaugaugcuucauugugugaacuuguuuuagugucaaaaaacuagguaagaaaaguugaggcugggcuauggaguugcaggcuaucauagaaucaccuaguuuagcccgcuaaaucaguucugagucaagauuuaugcuugacucacuguuuugaaauugaacuuaggggguguuguaaauaagccaaacaaacuuggaccuugcagaguauaagcuaugugagcaaauuuucuguggugaugcauaagcugcuuacagcauuuuauauagggugucuguaguuaccgucaaagccuggagggcccuuucugucuugucccauggguucggcuuuucccuaaccauucuuugaaacuuucuuuaaagccugucuucuauaguagugcuucugaaacaugacugugcaaaggagucacaugggugauguuaaaaugcaaguucugauuucauuggaucugggauggggcccgaggugccauuuauuauuuuauuuuuuuuaagacagaguuuugcucuugucaccccggcuggagugcaauggcacaaucuaagcucacugcaaccucugccucccagguucaagcaauucugccucacccucccgaguagaugggauuacaggcaccugccaccaugccuggcuaauuuuuguauuuuuaguagagaugggguuucgccaugcuggccaggcuggucucggacuccugaccuuaggugauccacccaccucggccucccaaacugcugagauuacaggugugagcuaccgugcccggcuugagguguuuuuuuaacuaauacauuguagcacuauugcugguauguggauucacauaauugaguggcaagauaguauaggacuccuuuccgauuccuaaaaccauuaguaucuacuaauuugacgcugaaauuuuguauuuuuaguagagacaagguuucaccauguuggccaggcuggucugacgcuccugacuucaagugauccggccucccaaagugcugggauuacacgcgugaggccagaaauuuuaacucuaaaacgguaucacuucccaucuggaauucugggcacugaggggauggugauagaaauggcuuaucuuuuaaagguuuagauucuggauccuccacuuacuauucuguggcucaguuucauuagauuaaaaaaaaaaaaaaagaauagggcugugugccguggcucacaccuguaaucccagcacuuugggaggcugaggcgggcggaucccuugaggucaggaguucgagaccagccuggccaacauggugaaaccccaucuaccaaaaauauaaaaaauuagcugggugugguggugcacgccuguaaucccagcuacuugagaggcugaggcaggagaaucacuugaacucgggagguggaaguugcagugagcugagaucgugccacugcacgauccgccugagcgacagaaugagauuccaucucaaaaaaaaaaguacauaauaccuacuuuagagauugucauggaaauauaaaguaugugguccuuacuaaugcuagauaaugcuuugcuuucuuuuauuugcaucuuacccucuuccgugaguauugauacugucuuaaacauaguagggguugauuagauauuugcugguugccccuucacuugcaagggauacauacaaauguugguuuguauuggauaaugaauaugauguuuuuaagaguaauaugugauuuuguuacuuuuugaaggccuuaacaacauuaacacuaguaaaagaaguaguaacauuuagucugucagucacuugguaucgcauuuauuuauuugcccauuuugguucccaaaggaaaucugaaauagaguacuaugcuauguuggcuaaaacugguguccaucacuacaguggcaauaauauugaacugggcacagcaugcggaaaauacuacagagugugcacacuggcuaucauugauccagguaugcuuuuuaaaucauaaagucuuuuuuuuuuuugccuuucuaauguaaugucuggacaaguauuucuuacuacgcaaaugucuuugguuccuaaauucagauagaauauggaucuagcaaggcauaucguguaguuguauuuuguagagaauugguaaugaaugccaauacauuauaauuggcuuuauuauaaguuaaaauuuuuacugucagauaaugaauuucauuugaugaaguaccuaugaaauaaugacauagauuugguaaaaggugaaauuauaaggagagaauaaucuggcaaaacagaagaaaguaauucuugcuucuugagaacagacauguaaaauuagcuugagaaaaaaaaaagugccaaaaaaucuacaucauucuguuuuccaauugugaaucuuugauucauagaauacugcgaauauucucgcuguucugauuuuguaauagucaggacaggcuaaacauucgcuauauuaagaccaugcauguguccccaaaccuaguucuuucccuaggucugguuuuauaaaugcuggugauaaaccaauuuuauuauaugaucauuuuaugugauuauauaauggcugugauucuagguuaucuuuggucaaccuuaagaaaaaugacaguacagcuaaugugauaacuuuugcaaaaagucagugcuaauuugcagaccauugucuacagaagggauaaccaaagguagagaaauuuuaugguaccaguugcuauuaaaugaauuguaaaauuacuguuuuuuuauuuuuauuuuuuaggugacucugacaucauuagaagcaugccagaacagacuggugaaaaguaaaccuuuucaccuacaaaauuucaccugcaaaccuuaaaccugcaaaauuuuccuuuaauaaaauuugcuuguuuuaaaaacauuguaucua

SEQ ID NO: 192539 - RNA, 3392 nt, Homo sapiens
gcacugugcgucauguaccagcgccggaaguuggucucgacaccuggacuagccggguuguauuuggaaacgcggagugaguuuuuccgugcuguguagguaagcgaauuggcggguugggguuugugguggauauuugggccaaaacuggaaagacacuugggguaaaaagguccgguauggggguagaguugagaguggcuggggauacgguccaugcuaucgcucuuuucccuauuuucuuuuaguuuagauguuuagccaguaggaguuauuucauuguucuucccucggugagccuguuccccuguugagggauauaauuuuuuuuggcuaacuucugcuagaguuugggaaaauagaacuuguguuaaacgagaacgcgagcuuuacagucagaucuguaucccuuugacuuuuaguagcugagugauccugcggaaauuaacaugucuaaguaucgguugcguccucuguaaaacaagagugaugucuccuaggauuguuaugaagauuauaauggccuaacacguaugaaguaguuauuauguccaguuugggguaaacgcucaauacuuguguguaugcguuucguccuugagaccuaacccauaggauuuggggaaaggaacagauuaggaauuggaucuuuguagcuuuuccugagaaaaaugggcccggauggacuugugagaagcccuuuugagauauucaguauuugagucugugauuucaggggcuaacaauggacacccagaaggacguucaaccuccaaagcagcaaccaaugauauauaucuguggagguaagaguagcacuuaccuaaaguaagaauauuuuauuuaaguuuuuuugaaauuguuacauuuauucuuugcuuaaaugaguuacuggucuucagaguuauaaaguagaacacuuuagcaaccauaaaaaaaaucguugaggucaguagaccuggguucguccuuggucuucuguuuacuaacagaaaaaaacaaagcucguugagauuucauucucucuccuggaaauaugcauggccuacaaccuuuuucuuuccuauuuaauauauuuaauaaaagcagcagacccuugagauugaguauauuuuaguguuuuggauugccuuagguaaauaauacauuuaagauaauuugucuguaauauuuuccucuuaggcauugaguaaauuuuuuuuuuuaauucuagagugucacacagaaaaugaaauaaaaucuagggauccaaucagaugcagagaauguggauacagaauaauguacaagaaaaggacuaaaagauguauccuuuuaacgaugcuuucuaaauaugaguuaggaggaaaugaauaaugcugggguugauaaagauuaauuucugguuaaaaugauaacuuucuggauuacaguacuuaaaaaacaaacaugauuagcauuuucauggaccaaugcauaggcucuaaauaaucuaaauaaugcuaguugauuuugguucucauaaauuuauuuuuuagggauucugugcagucaagcuugaggauagggauacauucugagaauuguguccuuaagcaauuucaucauuccuacagaaaccuagaccguauauccuacuauacauacacaucuaggcuauaugguauagcuuauugcugcuaggcuacacaccuguacagcaugcuauuguacugaauagacaauuguaacacaauguuuuuguauaucugaacauagaaaagguacagcaaaaauagaguauaaucuuaugcgaccacuguuuauaugugcuccaucuuugaccaaaacgucauuaugggugcaugacuacauuuauauaaguauucauucuugagcuucaguuuauggacaagcuaaaguucacgaggagaaauacaaauauuguguauacuaccuaauggaaaaaguugggcauacaaauuguucaaauacugagaguaggcccagcaugguugcucacaccuauaaucccagcacuuugggaggcugcaggaguucaagaccagccugggcaacauagugugacccccauguggaaaaauaaaauacagaguaaauuguuaugauacaacuaacacacauuguaaaucgacggauuauccgcuuuaacauuacuuuaguguuuuuuuuuguuuguuuuuuguuuuuuuuugagacggagucucgcucugucacccaggcuggugugcagugacgcaaucucggcucacauugcaagcucugccuuccggguucauggcauucuccugccucagccuccugaguagcugggacuacaggcacccgccaccaugcccggcuaauuuuuuuuauuuuuuaguaaagaugggguuucaccauguuagccaggauggucucgaucuccugaccucgugauccgcccaccucagccucccaaaguacugggauuacaggcgugagccacugcgccuggccugcuuuaguguuuuuugauacauuuuauggaaaaggugguaauaaaaauugaaaguguuuuuaguuuauuuaaaaaccaguugucauaguaaauagugaauuccauucuuuuuugcauuuuaaguuaaauaacaaaccagcuuauugcaaagagaaagugacuuugaaaccuucagucuuaauaauguuuaaguaccguuuuuguccuuaacucaaauuaauacaguggucguuuuugaugcucgaugaaugcugggaauucagaggaaugucuucacuuauacuuggauuugcucucuucccauuucugauuguuguauagcuuucgauuuugcuuacaguaguucccccuuaucuucgggagauacauuccaaggcccccagugaacuccugaaaccucaaacaguaccaaaccuuuauacacuguuuuuuccauauauauauaccuaugauaaaguauaauguauaaauuaagcauagcaagagauuaauaauaauguaauagaacaaugauaacauacuauaauaaaaguuaugugaaugugguuggucucucuugcuuucaaaauaucuucuuguacaguacucaccuauuuuagaaugugguugacuacagguaaccaaaaccacagaaagggaaacuuuggaugaggggggcacuacuguacuuaggaauacaacuauauacauaugauuuuauuuuuaagaccauauuauauuuggguaucuacuaauauuuuguauaaagcaauuuuuuguuccauuacgugacuuuuuguuuuauuguauauguaauuuaacacacaauaaaggguaaaguugcuuccccaaaccacacuuuuaaucaaaaccuagaaucaucugcaguccuuguuaaaaaugcagguuucuagaacccucugaaguucugauuaaauaaauuuauugcaaacca

SEQ ID NO: 192540 - RNA, 34331 nt, Homo sapiens
augagguaaauguugcuguugcgucuucccccucaccgcagucacgccagcccguuagauugcaaguugcaggaccgcuguaggaaauguuauucgccgcggucaggacaggccuguccgcccgcccucgccgcagccuggcuucgucguugcgagcgccggggaggccguccccggggagggcggaggaaggagcugacuuuggguuugcgucccgcucgcugcucugccccggggccagccaaggacgacgcuuggaggccucaggccggggugagacuuaccccugcguuuauccgccucacgcucucccacccuccuucccuguuuuggagcccuggccagggaaaccgaggcaaggaaagaggacuguggcggcucugcuggagaggugcauaccauuugggauggugacaaggaguuggagaacgcguguggaaauugacacagguggcuggggugaagaugacagguagaaggggacacgaaauccucaugaccuccucccagugaaaaaaucaggguaggaggccaguuuugcucaggcccggcuccuuaacuaacugaaucuucggggugucacuuucuuccuuuauacaauggaagugauacuucagagagaauuaaguaaaaugcuuuaugcaaagugccacgaaaauuguaggugcuuaauaagcccaaguuguucauccaaguuguuuaugcugauaaaaguaccuaaaauaaauaaaccagaauuuguuagacuguaggauuguaugguaguuuaaacuguugcuguauaauuuucaaacacugucauuuugcaaauacuucuaagcccuuuguggacaagagaaaugcuuuuuguacuacuggaaccuguugcugugguaucuuugauuuaauacugugaagauuugggggaaacaaacguuuccaccccaagagauucaugcuuggcccuacauuucuuuagaaaguuguagauuccagguuugagauuuuauuuuauuuaacuugauuuuuguaagcauuuaguaacuaacuguaaauaucccucaagcuuuuucuuccuguuuugaaacaaaugcguuuaguaccaacuucccuacucaaaggggaaaauucagacugcuguuuaugcuaauggcaccagcagugauucaggcuuaacaccuggauauuacauuuuauuuauuacuccuaucucaaugauacagacccgcaaggacagacagaauuuuagauucagaaugaauuuuagugguccaaaaguuuuuaacuugagaugcuggguugccugaagcacuuuguuuuucuagaugccagagugcauaauaggagaccugcaucagagucacuuggaguauuuuguaaaaaauguaaauugcuggaccaacaccccaaacauagugaaucaaaaucucuugagaucugcauuuuuaacaaguacuucaggugauccugguacacauauuaaaacaaaaacaaaaaaccccccacugucuuaaaggguccauagauagacuagaaggggcuuuauaaaucuccugaagugauauguagauuuuguaugugcagaugugaaucuucugagaaagggguccauaguuauugucaauuucucagaguuaacuauugcuaaucuaauucauagucuauugucaagguaaaguuuaggccagaaaacauuaaauggcaugcccaggacucaguagaggagcuaaauuuaaaaccaaguucuugcaccugggcggguaucccauugguuccgucagacuuugugggaauagaagugaaaauaauacuuacaaguaguguaugacuaugacaacauacagcuauuuuacagaaguagaagagacauaaaggcaaagaaacggaagugguggaauuggggcuggauaggagguaagagccugguaugaugccagccuagauuggggcaucguaagugcuugcugggaaaucuugaccuaaauuguuguccugacaugcccaggcaugucuuccaacugggugaccagaaauugagucagucggaaacuggaaguaccauucuggaaaaaacagcagaaugucacuaaggaaugccuacugcuaaacuuuauuucaaauucucaucacuuuacaccugugcggcuauaauaauuuuguuguuucucuaucuccuaucuuaccugccauucaauccuaauuaccauugccaaguuaauccuucauuagaccagugccucagugucacugacccugugucccccaaaaaacucccaaaagagucucaauuccuaccaaaaagccuggccaacaccucaggcuggugaagucuuguugaagcugcuuuuuucaugcuaacugccacaucuuaauucaaguccucauuuccaucuuugaaauugguuccuuaguugcuugcaaaaucuaguuuuuuaucaauuaauccuauacgugguuuucugauuagucuuccuaaugccaccucuauucauguuaauucccauucagaaacucuccaugacuauuuguacccccaaaucugugggguacagauuuucaaacuguacccugcuaugaacgccagcaccugggguugggggcaaauggggagaauuggaguaugagccuucuagaccuccgauguuugaagaucuuuggccacaaaauugauuccuaaccucuuagucugauuuaucuuaagagucuagauccuuugcuuuagccaaaucacaucauuccuacuuuugcuuuuccuuguccugcauccauuucagccuguuuuaaucucagcuggcuucucuucuuucaucugcccuuuaaauaucagcauucucuaagacuguauccucaguugucuugcugcucuauauguucucucuggauaaucacauccauucccuuggcaaccacuaaugggaucuccaucacucguguucugcaguguuauauuuuuaacugcuuacuggacaucuugaaacugaauucauuaucuuuucuauucuuuuuuuuuugagacggagucucacucugucaccaggcuggaguacauacaguggcacaaucucggcucacugcaaccucugccucuuggguucaagugauucuccugccucagccucccgaguaguugggaguacaggcguacgccaccacgcccggcuaauuuuuguauuuuuaguagagacgggguuucaccauguuggccaggauggucucaaucucuugaccuugugauccgcccgccucggccuccgaaagugcugggauuacaggcgugaggcaccacgccgggccugaauucauuaucucuucuaaugaccuaguugacuuugugaggauauuguguuuguaacuuuguuguugucgccuggcuuggugggaggaguuaaauuaaacuuccguuaaacaucuaaugugagaagcaaaauuuuugucugauuuauuuauuuauucuccagguacugagcaccuugugugugccuuuuagaucuuguuaucacccaguuacuggagcuggaaacaucaagggcaucuuuaacuguucuugccccuugucccaaauucaaauuuuuaggaagaauaauucauucuacuucugaauaucacuuaaaucaauuuuuguguguguuucuaguucaggcaagagauggguaguacaauaaucuuuucauuguucuuucugccucuaauuucucuucuaaucuagcaauguuucuagaaaagcgaucuuaaaagauauaucugauuauguuauuugccuuauuaaaaaccuucaguggcucccaauagcauacaucuuagaguuauuagaugccaaaguguuuuauaucaaagcagaccacuuuaaccuccaaaauuuuuuaaaaaucagauuacuacuaaccaauuuugcucuuuuauuaacccuguaaaaauauagauacccaugagcuuugaaauuucuaugucuaguaggcugcucucucaugcacccauauauuucuuuuuguuuuguuuuguuuuuugagauggagucuugcucugucaccaggccugagugcaguggcgugaucucagcucacugcaaucucugccuucuggguucaagugauucuccugccucagccucccgaguagcugggacuacagguacgcgccaccacacccagcuaauuuuuguauuuuuaguagugacaggguuucaccauguuggccaggauggucucgaucucuugaccuuaugauccgcccgccucggccucccaaagugcugggauuacaggcgugagccaccgcgcccugcccaucauaucuuuuuucacauuuuuuuuuucuucuaaaauauggguucuuagauuagguccacagaggguacuguggagagccuagaguuucaagaugcaugaacuuucugaaauuguauucaaauguauguuugugcacguuucuaagcauuaugaaauaauacgucaucucuagcccagcucaaagguugauguugguuaaccuccuucucuucacauugcaaaaucccucauaauacacuccuaauccagcuacuccucuuaauagucuacagguuaucaggauagaacaggagaauguguauacaaaugugacuuucauucuaacuuaaagguacuagucuucagcagaucaguuauuuaucaucauuuaaaaacuucauucaucgucagggcauuuggugcugaagagugacugcuugugauguccuucccaacuuccaguaacaaaaguauagaaguucccaacuuucauacuuugaguauaucccaaauuucaguaauaaaaauaacaaaggccaggaguuugagaccagccggggcaacauagcaugacccccaucucuacaaaaaauuuaaaaauuauccagguguggugacgugugcacauaguccuagcuacuugggaggcugagacaggaggauugcuugagcacaggaguuugagacugcagugaucuaugaucacacuacucugaucuaugcacucuagccugggugacggagcaagacccagucuuaaaaaaaaauugcucaaauauuuguggaaugaguaccaacuaagugccagguacugugcuaagcacaagggauucuacaagggugaaaauggauuuuacuuucaagaagcacaggaaauuagagacaauuaacagggaauuaaauugcagugagcuauguacuuauaucuggaaccuaacccagaccuuuggggugaugugaagaggggaaaaugugauugauuuuaaugguuauuggguugucucacugauguauugugguccuauguuaaauuaaaauuuucuaaagguaccuagaaaucugaguacaggaagaagagaaauuagcagcccauuuacuuagcuaacaugcuugacacgauacuaagcucugggaacaucacaacaaauaaaaauugguuccucuucuccagggcucaagugcuguaucugaggaggcccauaccuuuaaacaaguaguuaaaaucaagaccaucuguacugugauggcaguagguauaaagcacgcaagccccccuguauuugcauagccguaugcuuguauuuugggcuuucuucuugcuaagccuuagccuccucugcuauaacaguugcuuuggcgaggugacaauggguggacgcuggaguaaggaacauaacgggccugucacaguagagagagagacaguuuuggauaggagucuagaaguuguauguguucuaauccugguuuauacacguuuagcuuauuuguauguccuuuguuuauacucauucucacacaugugcgacucuucugauucucuucugauguucccgcuauuuuaaaaauauaugcauggcaccauuugcucuuagagugccaucguguuuugaagcagugugaauacagguauguguuucucacuuuauucacaaagcuuugagacagcccacagugagaucauaugcaguaauguuagaauguaaauagcaguaacaaauuggaguaucagaaggcuaagaugaacaaagguuaaguuguagguaaugaguuuucagauaaguauuauauuauuucagugaagaguagaaagaaaaaacauuaaaguagcuuauaccaguagcuuauucauuccagcaaucuuaucagagaggcucuaaagggacauuuuguucacaaacuuagaaauuugcccaucaugaugacauuuaugggucuagcuuuguacuuauccucaaacuagcaauaauuacaauaauuuuugagugcuuacuauauaccaggcuuuguuuaaagcacuuuuaaucaucagaauaaaccuaugagguaggaauuauuuuacagcugaggagacugaggguuagagaaguuaagcagcuuucuauggucacacacgcacuuccuaacaguauuagucagcuaccagguaacaguaaggauucaacccaggcagacaggcucucaaaccaaugccgucucccugacuuccuuagauguauguuuagguaugaauaaagaagaaaugucuauauaaaaggcguguuuguacuuuauuuuucaaagagaucaucuucagacaccaacgaaagugaaauaaagucaaaugaagagccacuccuaagaaagaguucucgccgguuugucaucuuuccaauccaguacccugauauuuggaaaauguauaaacaggcacaggcuuccuucuggacagcagaagagguacguggcauugccuccaagagcauucacauccuauagugcaguguuccuucuuguuuuacaggauauugaauaacuuuaacuuauacauugaagaagaucaguuguagaagauaaguguuggaauuacugagacuaaauaugauguucucaauguuuuaguuuagauuacuaucuauaaacaaguuuucugcugcaacaauggcaucuaauucugccagauuuuuauuuccaauauauuagaacauuuuuuuucuuuuucuuuuuuuuuuuuuuuuuugagacagagucucacucugucacccaggcuagagugcaguggcgcgaucucagcucacugcaaacuccaccucccggguucaagcgauucuccugccucagcuuccugaguaguugggauuacaggcgccagccaccacgcccagcuaauuuuuguauuuuuaguagagaugggguuucaccacauuggccaggcuggucucaaacuccugaccuugugauccaccugccucagccucccaaagugcugggauuacaggcaugagccaccacgcccagccaacauuuucuauuuuuaaacagacuuuuaguuugauauggccaaguaagacuugucugacuagucuuacaaggucagcagaauaaguaaaauugcagcuguagucaaaaaaugagugaaagcuguagcaacucugcuuucaauugagagauuuaucugauuguacaaaaugagccgcugcaugaagaguuugauccucuaggcuguggacucacucccgagucagccagguggaacucacagugcugcucccaguuuggcccugcccucagcuacaucaaacgugacagaguugccacuaauagaucagcuguagaaagcuuuuuguuaauuccaccugggagaucaguugaacacagcaaacuagaaaauauuugcugguugguaaggacaguggucaugaaaaugauugcccuguagucuaacugaacaaauaguuauugucuugaucuuuaaauauaaugggugauaccuauacagcacucuuguucuguauauguuuguauauguaucucuauagauagauguaucuauuuggauagauagauuugaaucuauuuuucaagacauuaauucuauaaauguuaaacacaugcuguuaagaaugcaggcuauggggucagacugccuagguacaaauccugugccacuacuuacuagcuauggaacugggaaaguuacauaaccucucuguguauccucaucaguaaauuaggcuaauuguacuuggcuauuuguguuguuaugaggauuuaugagauauuuaaaaugguaguugacacuuaguaggcacuaaauaaauguaaacuauuauuuuaugcacagaagggggaaaauuuaaccuagaaaucagaaggcaccaguguuugaagcuucuauuacacuaauuuuacccacuuacccaucuuuguuauauuguaguguuauauugucaacaucuuuguuauauuauaguugacauauagagcaaaaaaccaaaccacacaaaaacaaacacccaauauuuucauacguggucauaaugcuugacacaccugacugucccuaacugucugugguuuuuagaaagguuuuuuguuagauacgguucagagaacgaguggaauacgcagguggcuuuuucguucauuauguuaaaaagguacuuaggauucuuaggauucuugaaauucauuuggaaauuaacuugcaucuuuuagcaaagguaauaugugaccuguaacaaagcaacacuaauuuuuaaaaacugaaaucuacagguugguacguguucuguagcuaauuauaggacgauucaaauacauauuuugaagauaaaucaaacacauuuuuaguuccacauauuuuucauuuacaaauuauguaaguuaccauuuagucagcuuaaaugguugagcuuaauucuuaaauauggcugaucaacagaaacccugaucaaaagacaaaagucugggguuugggacuuuuuucuuuaaagccacucaggcaguuaugauaauugucuaguuuggaaucaguauuuaaaugaugaaauugagaauuugcucaaauaagaaaaagcuaggcaggaagggaauauuuccaauguaguguaaauaaaauuuagaagaccuuugaaacugaguguucaaagaaauaauuuuaauauuuaagaggaagcaucuuacaauauuaacauuuaauaucaaauauauaauauauaagaggucgagcaugguggcucacaccuguaauccaagcacuuugggaggcuaaagugggcagaucacuugaggucaggaguuugagaccaaccuggacaacaugguaaaacccugucucuaguaaaaauacaaaaauuagccaggcguggcagcaggugccuguaaucccagcuacucaggagguugaggcaggagaaucgcuugagcccagguagcagaggcugcagugagcccagaucaugccacuguauuccagccugggcaacagagugagacugucuccgaaaaaaaaccugagggguuauaauauauaugaaugaagaagauguccuucaguuaaaccugaguugagcuuuuaauagaacagaacuugauuuuuagguugcauauuuuaaaagaugaagacaaauauuuccuccacccugcuccguuguauccccagugcuuagcacggugucaggugugcaguaagugcucagcaaacacuuaaagaauaaauuagugggaaaaaggauuuggaaaauagcaugugauuaaaagauugggacauuaguccuuuuuggaaaggucaaagagauugaggcuugaggcuuuguggguuuuuuuuuuuuuguuguuguuguuguuuuguuuuugagacagaguugcacucuguugccaggcuggagugcaauggcacgaucuuggcucacugcaaccuccuccuccuggguucaagcgauucuccugccucagccucccaaguagcugggacuacaggcaugcgccaccaugccuagcuaauuuuguauuuuuaguagagacaggguuucacuauguugaccagguuggucucaaucucuugaccucaugauccacucaccuuggccucccaaagugcugggauuacaggcgugagcuaccgugcccagccgaggguuuguuagaguaaauaaaagaaaggcaaaagacaaagacaauuacauauuucaacuguucaugaaguuaauuaugaaaaauauuuaaaagauuuuuucugacaaaauugaagcaggauaguuucuccgaucccuucgugggugggaacuggaaugcgcaugcuggagcuagcuggcugcuuuggcgcuggcaggggcaaacuccacucacuugaacccauugcgcucagccccuugagggagggagcaugcaggugagcaggugcaggagcuugggugaauucuuuugggcaccggcaggagcaaaacuccaugcaggccucauggcagcaucugugaggaguacccacaacccuugaagccccagaaggaauguguuauaguuaacucucuuuuagcuuuugcuguccgcagauggcuuaaguuuuaacggcucagugggcccucugccuuuucacauggggcaguuggucuccaccagugagggcagagggucagugugacagcuuuuagcauccacaccuguggcacccacgcucuuguucagcauccaggaaaaaucagaucacaugaacaaaucgaaggguggugaauacagaggauuuuguugccaaugaaaguggcucucagugggaagaggagcuggaaaggggauggaguggaaaaauaaucuucuccuggagucugucuggccguccccagcugacuccucuccaaaggaaugcugucaagcugucccucugaaguuaagcugcuucucuccgacauccaaccguagucucugacauccagcugcuucuccucuucuccucuccucuucucugcugguagagccugggguuuuuaugggcacaggguaggggaguggggccaugggugguuuuggaaagggcaacauuauagugggaaaacaggaauacaugucacuuugggcugcaguuccaggauugaggguggaguccucgcuggggaccaucuucuucugcccagaauuucccugccuccugucccuaucaaaaugaugucuauauaugcugugugaugguauuuggagguggagccuugggagguaauuaggucauguggguggagcccucaugaauaggauuagugcccuuaagagacaugagagauaugaucucucucucucugcuaugucaggauacagcaagaagguggccaucuguaaaucaguaagagggccuucaccaauaacccaaccaugcugacauccugaucuugggcuuucagcuuccagaaauguucaaaaagaaaaauaaaaguaugcuguuuaagcaacccagucaaugguaauuuguuauagcccccagaacugacuaagggaagguacauuuaaagacaauuuuuggcugggugcaguggcucaggccuguacucccagcacuuugggagguugaggcgggcagaucacuugagcucaggaguucaaaaccagccugggcaauauggcaaaacccugucacuaccaaaaauacaaaaaauuagccaggcaugguuuugugugccuguggucccaccugugccucuggaggcugaggugggaggauugcuugagccuaggaggcagagacuguagugagcugagauugugccaccgcacuccagacugggugacggagugaaaccccaucucaaaaauuaaaaaaauaaacaauuuuuaaauuguagguuucaccaaauucuaaaguacgucucccuuaauuccaaagacuaauucuaaugaacauuuucaaaaauauuuccauucccaauggaagccauaccuauguauaaacugcuuuaaaaaaaaaacuggguuguuggccaccugugauggcucacaccuguaaucccaacacuuugagaggcugagguaggaggauugcuugaggccaggagauugagaccagccugggcaacauagugagaccccaucucuuuaaaaaaacaaaacaaggccagcugugguggcucgugccuguaaucccagcacuuugggaggccgaggcaaacagaucaugaggucaagagauugagaccauccuggccaacauggugaaacuccgucucuacuaaaaaauacaaauaauuagcugggcaugguggcgccugccuguagucccagcuacucgggaggcugaggcaggaggauugcuugaaccugggaggcgaagguugcagugagccaagaucaugccacugcacucuagccuggcgacagagcgagacuucaucucaaaacaaaacaaaacucagguuguuaccugccuggcauuacuucuggauguaaaaguagacugauuaccuggcaguaaaguagcagcuacaguugguuaauaggugccuaauuaucuaacaccauagcacauauuauauaaaauguuaaagcagugacuguugagauucauuaguuuauuuacuucagugccuucuugacuaguuuuuacucuccccccuccccuuuuagcccuucuuucauuugcuucagugccacuagauuauguuaauuugaauauuuuuaaaguacauccuggccagcuucuuaauuagccagaaaauucgauuccaucuuaauuuuuuaaagauaaauuuuauuguguauguuuaagguguaugacaugauguuauauauauauauauauaauaaaaugguuacccauuauguaacaaauuaauauuuccuuugccucacauaguuuagcuguucacccccccaccaagaauagcuguaaucuacucauuuaacaaaaauccugaauauaauacacuuguuaacauaacuuuuuuuuuuauuucuuugcagugcuaacaucuuucuuuuuccauaguuuacugguagugggauauuccuacuuaacaauagaaguuaguuucccaaacacuuugagaagaacuuaacuccaaauuaaaauuuuugaaaaucuuuuuauuccaggucgacuuaucaaaggaucucccucacuggaacaagcuuaaagcagaugagaaguacuucaucucucacaucuuagccuuuuuugcagccagugauggaauuguaaaugaaaauuugguaagauuuuugcuugauuuaacuuuuguucuccuuuagcaguuaaaugaugauaaugucaguaagauuauuaaauucagccaaagacaagaugucuaaaaaaugaacuagaugaagcuuaacucuuuaaauguuuuucugaugaauugcuuauccuuugaccagcaaacuauuauuaaaucaagcauaaaugauaugaaucaaaacuauuuacagugcauuaacaugaguuugauuuuuacucucagauaguaagcuuaauagagaaccugcaccuuaaccuuuggagcucuguaauagaacacuggauucuggcuccccauuuuaaaacuugauuaugguugaucaggaggcauaauuucuuuuuaaaaagaauuagaaagauaggccggguacgguggcucauaccuguaaucccagcacuuugggaggcugaggugggcggaucacgaggucaagagauugagaccauccuggccaacauggugaaaacccauuucuacuaaaaauacaaaaauuagcugggcguguuggcgcaugccuguagccccagcuauuugggaggcugaagcaggagaauuucuugaaccugggaggcagagguugcagugagccaagauggcgccacuguacuccagccuggugacagaucgagacuccaucucaaaaaaaaaaaaaaaaaaaaaaaagaauauacuaugcaaauaauuuaccauggagaauugauggauaaacaguacugccuaggauacugcuuaaaauaauccauaaggucuuucugaccuguuuguuacaugacaggcaguuuuuaagcgauaaugcugauguccagauucugauuugcaguguuuaaugagagccuauagaacuggauauaucuauuuuccuuaucuucuuagguggagcgcuuuagucaggaggugcagguuccagaggcucgcuguuucuauggcuuucaaauucucaucgagaauguucacucagagauguacaguuugcugauagacacuuacaucagagaucccaagaaaagguauuguugggauuuuauuuacaaaauauugcuuacggcuugguuauguucagaucagaauuuauuccaaaacucaauguuaaggaaagauuauucaaguauggaaguuucugagcauaauauuuucuauugcuuaauaauguauuggguuuuaaaaaaaacuuguuauagaaccaguuaaccuuuagauauuuuaucuuuaagaacuguucaguagcaucuucuguuuagaaauugaauacucaaauuuagcugguuuuguaugagaccagauucaaaccaauaauuugaguuuuauuucuguucuauggacauguaaaaauguauaaaaacuacagaucugguagcauaccguagaguuacaauuauuaucucugauuaaguuuaguccaauuaagaaaaacaagugaggccaaggcaugguggcucauggcuguaaucccagcaccuugggaggccgaagcagguggaucacgaggucaggagauugagaccauccuggcuaacacagugaaaccacgucucuacuaaaaauacuagccgggcgugguggcgggcaccugucguccuagcuacucgggaggcugaggcaggagaauggcaugaacccgggagguggagcuugcagugagccgagaucgugccacugcacuccagccugggcaacagagcgagacucugucucaaaaaaaaaaaaagaaaaacaagugaauaacuuugcuguucauucuuuuguuuuuacagggaauuuuuauuuaaugcaauugaaaccaugcccuauguuaagaaaaaagcagauugggccuugcgauggauagcagauagaaaaucuacuuuugguauguggcucuaauuuauguaugaucagauuugccuaaggugauaugacaguauuuuauguggugugacuauccaguacgaaucaaaguuacagcauggaaaaggaguacaaaugucucaaaugcaccuuuaccaaaaucauuauuccuaauaauuaauuagaaaguggugauaaagcuguuaccuauucuacuuaauaaguuggaaguugaaaaguuaagauguuagugcauaauuacaguuaaacaggagucagucacauagcaauaacaagaguauuauagcaauucacaguuuguaucuggcuuuuaaguuuauuuuaggaauuuuuuuuuuuuuuuuuuuuuuugagacggagucucgcucugucaccuaggcuggagugugguggcgugauccuggcucacugcaacugcugccuuccaaguucaagcaauucucccugccucagccuccugaguagcugggauuacaggcaccuaccaccacgcucagcuuauuuuuguauuuuuuaauagagauggggguuuugccauguuggccagacuagucuugaacucuugaucucaggugacccgcccaccuuggccucccaaagugcugggacugcaggcaugagccacugugccuggccuauuuuagaaauuuaaagcaagugaaaucuuaacauuuuucaggaaacaaauaucuaguuucucaaaaacuaaagauuaguguaaucaacuaggacaaaaccaauuuguaauaacaggcuuauuuuucauagguaagcuaaaugcaaacacccuucuggcugaguugagaucccauagcauuuuuuuaaggaaguguaucauauuaugucuuauacauaguaguugcucaauaaauacuuacuaaauuuaauuaaaauauuuauauauuucauuuggauagcucuaaguacccaucucauucuuaucuauuuuuaauugguguucuuuacuuucugguuuuauucuuuaugugaggaagcaagucucaaaauuuuuggucucaggccccuuuguacucuuaaaaauuauugagcacuccaaagugccuuuauuuggguagguuauggguauuguuauuuuugcauuagaaauuaacauugagauaauuuaaaaauauuuauuagugcauucuaagauagcaauaaucaacccauuauauuuuaauacagauaacacuuuuauauaaguuucuauauuuuccaaaaaaaagaauagcaugcuuuuaaauuucuguaacucuuuuaaaugucugacuuaauaggaaacaguuggaguaccauaucugccuuugcauucgauuuguugcaguguauauguauauaguauaugccucauuuaaauauguauuauaguuagaaaagggaggaauauuuuauuuagcuuuucagauuauuacggauaugucauguagccucuagaaaauaccauuguaaaguaugagagacugguaguuaaaaaaaaauaaugccuuaauguuauuaugaaaauaguuuugaccucacaggucuccugggucuguggaucucucagggacucuuggaccacacugaagaaccagugauauagugcguauaugggccagcauguaguauaccagggaugaagcagauauguuugccuccuugccuucaguucauuucaagaaugagaaaagcagccaggcaugguggcucacgccuguaaucccagugcuuuggaagacugagacaggugaucacuugaggccagcaguugaagaccagucugggcaacaaagcaaggcccccaucucuacaacaaauuuaaaaacuagccaggugugguggcaugcaccuguauacccugcuacuugggaggcugagagaggaggaccacuuaagcccagguguuugaggcuacagugagcuaugauccacugugcugcagccugggugacagagcaagacccagacucuaaaaaaaaaaaaaaaauuuaaauaggaaugagaaaaucacugguucucaauauauguaaaagucaucuggagaauuuguggaaaaacuuuuaagaauccugccaaaacugauguaggaggcccaggugggacugaggaaucugcauuuuguauucagcugauucccucacaaggagcuucagaaacacuuugggaaaugcuggcuuuagagaaaaaagaagggaagaggcagaguguuccauauacgcugaaaauauuaguauggguagguagugaugaaaaaugaugagcaggcccacggaaagcauguauuucaugaacuacccaagaaggacaaccuagaaauagagaacacagagaaggcuggcagucaccauguaacuacaugaggacuccagcuagauucuccauauugcuuaaucucaagggaaacuccauuucagguucuaauauagggucucagaggaaagaacauguucuaaaauuguggaggggaguugaauggguguagaguggaacagggaaagaggaaagagugaagagugcauugguggcucuccuuuuugggaguggagcuaaaagacaguaacauggaaauauugccuugcuuugcugcacacugcuacuuuccuuuaaccagcugaggaagugcuguuucaugaacugauuuggcuaccugcaccauuaguagcucuaaguugaaaagggcagcucuuucaccuggcuuaggguuuugccuaacauuuuuggugaccuucuuagugccuuuugcacuaagauccagcguagcaacuauucuuuccuuauauccagacucuuauaagccuuuauuuuuagcuaaagagaaacuaagaauauuucuuuaaaaauuauuagcuuggaaguuuauguuauaaggagauucaauuccuauagagcaaaaauuuuccuaauuauauaucugcauagauuuuuaaaaauugagacauccuguuuaauuuuuaaaauaucuuuaaauaacuucaaaacaaauauacagauuaaaacuuaauauauguaaugaaauuucauuucaagccucaaaaaauauuagcuacacaaucuuaguacauugccaucauagaggucagcuguaucuuaaaaauguauccgacuuuccccucucuaaaaugaaucaugaggccuuuacauucacuauaguuuuuaggagaaauguuccggaacccucuuuuuauuucacauauguucucaaaaaauuguaaaauguaccacuuauaauccuuuaaucuucuccaaaaaagaauagccuucuauaacuauguuaugauuuucauucuuuaguauucacauuaauguauagcaugguuacaauaccaauuuuccacuaggcacaguggcuugugccuauaaucccagcuacuugugaggcugagaugagaggauggcuugagccagaaguucaaaccagccagggcaacguagagagaccuuagcucuaaagaaauaaaaaaauuagccaggcauggugacgcacgccuguagucccagcuacgucagaggcuaaggugggagcauuguuugagcccaggaguuugagacuguuugaauuauuaaugcaccauugcacuacagccugggugacaagagcaagaccccauacugucucuaacaaaaauuaaaauaucaauuuuucuuuuauucacguuuguauuuaauuauagucuacuuuccugacagauaauuauccuuaugauguuaccuuaaugucaauuaaaaacguaucaauaaguuaucuuaauaguaagauaaaagauacaguaaguuauauguuaaacuaaugacaagccucaucuuaagaauagugaugaugaugaugauuuuugagaugggcucacucugucgcccagcuggagugcaguggugugaucauagcgcacugcagccuugaccuccugggcucaagcauuccucccacaucaaccucccagguagcugugacuacaggugcgcaccaccacacccagcuaauuuuuaaauuuuuuguagagaugggguuuugcuauguugcccaggcuggucucuaacuccugcauucaagugauccuccuuccucggucuaccaaagugcugguauuacagaugugagccacugcagcacuuggccuagaauggauuuuaaugucuucucucaucuaguacuuauauagguuccauugagucaguucaggacuuguuuauuaagugacuucuuugggugugguccugugacauguacugagguauaaaccgugaugucaccuaugaaaacgguuuguagugcacucaagcacucagcugccuguaucucaccgucuuauagaccaaaccuuuuuccuuagacauauauaaauacuuuucucaggcauaugcaguguggugacauaagcaccuugugaaugaccuuuuggguuacagcucugaucauccugcauaauguuacagauaugaugccacuguagacaauuuauuaauaggagauggauuucuacgaaguccuugccuaacaaugaguaaccuuuaaaauuggccauuuuguauuuagcagaaaacaguauuuuugcuuauguuauggggacauuuuaucuaauagauauauuuauuauccucaguuggguuuaucuauuuuuuuuaaauugcagauacacgccagugguuuuugaaauguuugcagauggucuguaagauaccauagguuucuaaaaauauaaacuuaagcaaccucuccuccuuucagaggaagacacuugucauaaagucuaccuucuacucuccaguacacacacacacauauguauacauacugcacacaugugcauguaccugcacucauagucauguguggugcacacguaaaucaccucuuguuuugaguauggaagguccuucuuuguccaacgccaagaccuacagaaguccaucgucugacagaggauuugaaggaggcauaccuuucugcuccaguagguagagguggcgcauuuucuccuauggagaucuuuggccauggcacuaacuuguguauuuuguuucuuugcaaacaguugugguauuuauuguuauauauguguauauauauauaugcaaauguuugcaguauauuucaaaaauugaaacgauuuuaugucucccaggggaaagagugguggccuuugcugcuguagaaggaguuuucuucucaggaucuuuugcugcuauauucuggcuaaagaagagaggucuuaugccaggacucacuuuuuccaaugaacucaucagcagagaugaaguaaggaauggaauguuuuucuaguuauauuuguauucauauuugauguucaucuauuuuucuuuuccaucuuuuuuuuuuuuuuuuugagacaggaucucacucugucacccaggcuggcauacaguggcacgaucauggcuugcugcagccucgacuucccugggcucaagcauuccucccaucucagccuccauuguugcugggacagcaggcauauaccacuacaccuggccuaauuuugguaucuuuaguuuuuuuagagacagggcuucaccacguugcccaggcuggucuugaacuccuggccucaagcgaucugccugccucagccuuccaaagugcugggauuacaggcaugaauuacuguacccagccuauuuauuuuucuuucuccugaaaaaugcuguggugacaugaguauccugguaauuaaaauaggaagucacgucaucuugcuuuuaagacacugcauuuuccuccugugucucuuaccauuucuccucggucuccuggucauucuuaauaucaguguccuccuagguucccgcacuggccuugcuccuucacuauauaugcccuccuggcugaucuuguuuacuguaauggaaucagcuaccaucuaaaugcucauaacuccgaaaaccuacccuuugucccagauauucuuuccuaagugccaaacccauguaugcuagugcauguuagacauuuucuccuuuaaguucccccagguaucucaaaccuguuauuucagaaaucaaacucaucaucuuucuccaaaaauuuguuguuccuucuguuuuuccuauuucauugagugucucuauccuucuuuuccaaucaucuaauuuaaauuuaggaaucauuuuagauugcuucuucuuuuucagccacauccgaucaguaaguaagccuggucucccucugccugcuauacccuuucuacccuuuccaucuuucuuaccaccccuuuuuuuuuuuuuaaaccuuuuuggauuaccuucucagaagagacaucucaaaacuuuccugaucaauuaggugaaacuggccacucuuuccuuuauguauccauuugaaaccugaaccuguccaugucuuggaguccauagcauguauuguacuucuucuuucucucuucugcuagacuuuaagcuccuuagugcagggacuuuguuuuauuuaucuuucuguucucaauguuuuggcuauuauagccauucaguuaacauuuauugccuacacuaauccuuaacuucucugaaccuugguuucuucaacuauaaaacuuaaccguuuuguuagaaugcaaugaaauaguguaugugaaaguauuuuuuuaaaugccauaaaaugcuucauauaauuacuuuuugcuuuuucauggcuuuaaauuuuuaauaacuuuuauuagaaaugucauauaggauuguuauagagaauugagagaauaaaaaauuaaucucaacacagagagaacuacauuuacuguuuuguugaaguauuucuuuauagacuuuuuuucuacauuuaauucuauuuagauauauaaacauauuuuaaucauucauauauuuaggaguugagauguucuuuuuccacuuggcaaaauacugcaaucauuuuucuguggcauuaagcaccuuuugaaaauaguaguuuuguuaaauguauaaucuaaugaaugaaucauuuauuugacuuuuauaauuagaaauuuagauuauuuccagguuuuuuguuuuacuauaguauaaaaugaauaccuuuacauauauauaagcuuuguccucccuuuauauuauuuuccuaagcuugaucacaaaaaguagaauuacuaaguuauaaagcauucauacauacuuacuugcagauuuuuuuuccaguaauuuuauaacaauuuucagccccaucuagcaauguaugaacauuuucuaccauacucucaccagaauuuagauuaauuugcuaaauguuuggcaaauuugauaggguuaauugguaucucauuauugguuuuauuugcauuguuuaauuauuacuuagauugaacacuuuuuucauaaugauauuagugauuuguauuuuuucuguaguugccuacuuuuaucuuuugccuuuauuacuggugcaauauuaacauuuuuguuauuuaacucugagugcucucacuauuuuaagguuauuucuucaguagucuauuauacuuaaaggaaggggucaugcuugcuuguucauugguuuauucccaauguacagugacugauuggguccuuucaacaaguacaccuuuauagcauuuguuauauuuauagcacaaauauaauauaaaauacaaauuugcuuauauuuauuucacauauuuucccaauuuauccuuugcuuuuuaauuuuuguucuuuuaacauacaaaaccuuaaauuuuauguaauccacuuccagagauaaauuaauuacacauuuuuuuucuugguuuuuuaaccuuuaagucuguaaugcaauuggaauuuguaaaguaggauuuagcauaaauauaauaaagaauaaguuagaauuuaauuuuauuuuaaacacucuugggaaguuuuuccaauuugccuuguuaaguaauccaucauccuuucuucauugacuugcgcugucuucuuuauuaucuauuaagguuuuauuagacuaaaaucgguuucauggcuauuuuuacuuccuuauugaccuaucagauuuuauucuauaacaaaccauuuuaauuauuauaguuucauauauuuuaauaauuuguaggauaaauaucgaaacuuuucuuuugaaaguguucuuacaagauucuguccguuuauucuauucuuuuuuuuuuuuuuuuuuuuuugagacagggucuuucucugucacccaggcugagugcaagugguaugauccuggcucacuguagcuuugaccuccugggcucaagcaguccucccaccucagccuccuuaaguagcuggaacuacaugcauguaccaccacauccaguuaauuaaaaaaguuuuguagacgcagggucucacuguguugcccaggcuggucuggaacuccuggguucaagugauuucccaacuuggccucccaaagugcugggauuacaggcaugagcccccgugcccagccuuccagauuaacuuuugaauuaaaaacaaucccauuuagguacuugaccucugugcccgcuugggacucuuugaaguguacuuuucuuucuuuucugcucuaaagccuuuuaaaauaaauuacaaacacacacacaccaauuccauugggauuuugauugguauugcuuucuguaauaaguuaccugucaguuuucaucaacacuuuaacaucuuucagccuugaugguaauuucuucuuucuuccuuuuuuuuuuuugaaacagucucacugucacccaggcuggagugcaguggcgugaucucagcucacugcagccuugaccucccagguucaagcaaucuuccugcuucagccuccugaguagcugggacuacaggugugcaccaugccugacuaauuuuuguauuuuuugcagagaugggguuuugccagguugcccaggcuggucucgaauuccugaacucaaggaaucugcccaccuuagccucccaaagugcuguauuacagacaugagccaccaugcccagccugggaauuccaucuuucuauauccgaccucucucuuuuuucauguugaauuuuugaaauuuucuuuuuuuuuuuuuuuuuuuuuuuaauauuuagcucuauacuaucuauucuguguuuuggaguccugauuauuguagguugacucuccuucaccuauucuccaauuacuuaagauucuauugcauuuguauaaccauacucggguauuucacaaguuuauuuucauuuuugguugaguuaucuguaagaucauaucugcuuuguauggcuucaggcgauauucaucauuguucaguuuccauuuucuuauuuauuuauugguauuuuuuauuuacuucuauuuauuuauuuauuuauuuauuuuuuauuuuuuuuuguagagauuggguuuugccauguugcccaggcuggucuugaacuccuggacucaagcagucugcccaccuugaccucccaaagugcugagauuacaggcaugagccaccgagccccaccucaguuuccauuuucauuagaacugaauucauuuuuaucuugagccuuucuuauuuaauuauaaauguauuuuugaaaucugaguuucaucuguuauuuaaauacuaauuauuuuucaaucauuccuuaauuauuuuugaaauuuaaaaauuaaugaauuuucauuucaggcuuucuugcuuuauuuuccuuuccaaaaugcuuuuauuugcagauuuuguuuguucauaaauuaauuuuucuauaauguugaugaacuaagauuugcuggcauugaaaauuuuuauuauagguuauuguauuggcauuuaaugagauuugaaagaaggaaguuccuaguccuauuaaccccucuuccauuuuccagaaguucuguguuauauuccuagaaccacuuuauacaaugcuugacccaucaccauaugcaaauagcugauuaaaaguuauuugacaaugacauuuuucuucccuuuuagggacuucacugugacuuugcuugccugauguuccaauacuuaguaaauaagccuucagaagaaagggucagggagaucauuguugaugcugucaaaauugagcagguaaaccgggaaguuuguguaauuagcacaucucucuuucucugauguuuguaccacuauuauauugacucauaagaaauucuguaggucaauaaaaauaccagcaauuuuauucuggucagccugacaauaccaauacaugauauauuacaauuauuaugucaguuuacaauuugcuuuaguaagucagucuuuauuauauauuaagguuuuauguauacuaaaaccuguuucagggcuauuuuucugucuuauugaucucugucaaauuuuaugccaugaucagcuaauuauaguagcuuuuuuuuuuacauuuuuagugacuggagaacagugaugauuuuuuauuuguuuuguauuuuuaauaacguagcaagguaccuagcuugaagcauacacaaauuuuuauagaaugaauaaguaaguuaaugaaaaguaacaauuaaguuaggguauguacggauuucuuacuagaaagagcuagaugcgcuacuuaggauguguuuuuaucauucugaaauugcuuuuguuuugguaacacugcguaguuuaacaggcguaguuuguauauugaaagaggaaaaaggcauaacagguacuuugguaucuuuaaucauuuugagaacuaaauccaagugguuaauauauuuuuauuuuuccucuauuaacgcuuuaccacuauauagucuuucaguaugguuggagcuauuuuaucucccaacccccaaaucuguuuguuucuuuuuucucauuuucuuuguuaauugaguuuuucuuucuuucccagcucccuuccauagucauguucuucaugaugaucaucuuugaaucuuuuuccagauauuuuagaacaaaguaucuuuuuuuucuauugagaaagcauacgaauccgagucuuauaucugcuacuucaagaaauccaguaauuugguaguucguuuccauuuauuuuggcucuucgaaaacaugaaaaaaugugaauaguuaauaccccaaauguuuuuaaauauacggacaucauuugccacauugaaagaauuuauccuaauauacuuuccuuggacaaaaucagucuuagaaauaaaacgaaaguccucuuucuauuuggaaaauacauauuuauaguuuuguuuguacuuuauucuguuuuuguuuucaucccaggaguuuuuaacagaagccuugccaguuggccucauuggaaugaauugcauuuugaugaaacaguacauugaguuuguagcugacagauuacuuguggaacuuggauucucaaagguaauguguuuaaaaauguguuacuacuaguuaaaauauuauaggaaagcaaggacccuaaaguauaauuuacugaaagcauuuguaacauacuauucuauuuuuuaaaugucaaugacagagacuuguuuuguaugaacaagguuuugcaaaauccuuugaaauuuaaaauuaauaacugaaguaggaggcugguaaaauauuagaacuaauaagcucaauaaauuauuuugcaauaauuguagcuguauauuuaauaggauuauuuucaaggaguuagguuuaauaugcauauauauauucacccucauauaaaucgccaugugucuauauugugguuugggaguuaauacuuuuaaauagggaauaguuauuaggaagacauuaacugucacaauauaacucuuugaacagaguuauucaaguuauuuuugucauuuaucagagauaauguaccugaauuucaucagugcgguuuucccauuacuuaagacauggagccugcagccacacuaucuggguuugaauccugguuccaccacuuucuagcugugugaccuuuggcagguugcuuaacuaucucaguuuccucaucuauaaauuagagauaguaauaauauuuacuacaaaggauuguugaugaguugauacacuuaaagcacuuaaaauaauauuagacacauaauaaacucacacuagauggucacuuuguacuuaagugaaacacagaaauucacuauguacuauaccaugguaauuagaaauacagauuuugauuucuugucaugaaaauguaaguucaaauuaucuuuaaugagaauccuuaugaaaucuaugaugcugugguaaucauuaccuaucuugcuaauguuguauuagcagauauagcagaauuauauucugauaaccacccagguacuuaaugaaaaagucaaguggggcguagguuuuuuugguaagauaaacuacauuuuaacauuuuaguugcaagauccucucuguguuuacuaauuaaugagaaaucaagauuauaacuauauuaauauaaucucuuaaacuuauaaacuauguauauuaaaagaaauuguguuuguucauaacuuuuaccaauauuuuuguuauuagaaaaugaauuugcuuauuuaagccuuacagugaauucgcuauucuuuaacccauuaccauauccucacauccacacguucauguucugcugcuuauuagaaaacugcugacccuugggucuaauuuuccuuuugggaacuugcuaacuguagguauguaaaacaugccaccuccugcaggagaaggucuaaacacaauguaaaacuuuguuuuuccacaggcuucaaaauaucugaguaaauucuaaaaagcagaaauuauagaggccuuagauuuuuaaugcaaugaaaguagaaacugauuuaaaaauugccaaaaagcuuaaucuacuuagagauuaaaaauauauccguuaggccaggugcgguggcucacaccucuaaucccagaacucugggaggcugagguggaagaaucacuugagucuaggaguuugagaccagccuaggcaacauggcgaaauccuacaaaaaauuagccaggccugguggcaugccuguagucccaguuacuugggaagcugagcugggaggaucacuugagccugggaggcagagguugcagugagcugagauugugccacggcacuccagccugagcaacagagugagacccuuucucucucgcucucucucucucucucucugcauauacauguaucuccuuuaaaaugagauuuaaaaugaaaauaaaaauuaauugaaaauauaaaguaaaugacaauaugauuacuauguaucaaaacuuguaggagcugggccuuguggcugacuccuauaaucccagcacuucggaggccaaggcaggaggauugcucgaccccaggaguuccacacuaguuucagcaauauagcaagacccuaucucuacaaauaaaaauaauaauaaggcugggcacaguggcucaugccuguaaucccaaaauuuugggaagcugaggcagguggaucaccugaggucaggaguucaagaccagccuggccaacauggugaaacccugucucuacuaaaaauacaacaauuagcugggcaugguggugggugccuguaauccuagcuacucgggaggcugaggcgagagaaucgcuugaacccaggaggcagagguugcagugagccgagauugugccauugcacuccagccugggcaaaaagaccgaaacucugugucaaaaaaaaaacccaccaaaaacaagccacuuaauuuaguuuguuuuuuuggucuugguuacuuuguccaugccaugaaugacuuagaucuaauuuuuugaaaagucuucaguucuaacaucuagugagucuauggcuauugguucagugcccuuucacuguaucuugcuguauauuacagcuccaauauucccucacuuuuuacacacaauuucugauggagaauuucauagaauuucacucagccacacccagcauaugaguuuuuggaaaaaagauacauaaauauuuaaagcuuuauuuaaagauuaagucacauagcaugcaauucacccauuuaaaauguacaauucaauaguuuuuaguguagucacagaguuguacaaccaucauaacaaccuauuuuagaacauuuuuaucaccccauaaagaaacuguaucccuauuagcagucagucacuccucuuuccuccccuuacccaccuugccuuaggcaaccacuaaucuaauuuuugugucuguagauuugccuauucugcgucuguagauuugccuauucugcauauucuauuucauacaaauggaaucauauaauauguggccuuuugugguucucuucuuuccuuaguguguuuucauggugcauucauguuguagcauguaucagugcuuuauuccuuuauaugaccaaauaaauaauauuccacuguauggauauaccaaauuuuauuuauccauucgauggacauuuaaguuguuuccucuuuugaucuauugugaauaaugcuacuaugaacguucauuuacacauuuuuguguggacauguuuucauaucucuuaaguauacaccuaggagugaaauugcuggaucauaugguaacuccauguuuaaucauuagaagaacuaccagacuguuuucuaaagcagcugcacaauuuuauauucccacccuguaugaggguucuaauuucuccacauccgcaccaacacuuauuaccuguuuuuuaaaaaauuauagccauccgaguaggugggaagugguaucucauugugaucuugauuugcaugucucuaauggauaaggaugcugagcaucuuuucauuuuguauaucuucuuuaaagaaguaucaguuugucuauuuagacacucugcccauauuuaaaauuggguuacuugaauauauguuuaucuguaguguucauauuuuuugcugggauacuccuaaauugagaaauccucuuuuguuacuccuugugaaucacugaaauaucccacaguuuccaucaagcuguaucuccaagucugcuucuugaauucuuuuuuuuuugaaauggagucuuacucuguugcccaggcuacagugcaauggcaugaucuuggcucacugcaaccucugccucucagguucaagcaauucuccugccucagccucuugaguagcuuggauuacaggcaucugcuaccacgcccagcuaauuuuuguacuuuuaguagagacaggguuucaccaugucagucaggcuggucucaaacuccugacuucaggugaucccaccuaccucggccucccaaagugcugagauuacaggcaugagccaccaugcucggccuuguuucuugaauucugaagcaguaaaaaagcuucuuguuagcauagucccccuuuuuguuuggagacaucuagucacuauggauaacauuuauucugucuucccugaucauguucccuuaaugacaauuuguugauuaucuguucucuuauaaacuaagaaacauacuuagaaccacaguggauuguugcuaauuuaacauuuuauaguaucauguaugucugacuaauaguaauaucuaugaaaaaugcucaugguguauuggauaucucaagcugugagaacauuuucuauugguuaguauuaaauauuucaauuccugaaauaguuguguuuuuuuuucuauuuauuagaauaccagagaugcuaguacaguuucuugaggagauuagugguugaucuugggucaucuuaaaauuugucagccuugaguaccuccagggucuuaggggaaugauaugaucuuguagcugacuagauagguuuugagaaaccugaccucuguuuuggucaucuuugcucuuauuguggauguaauuugaucucuucagaaugucuaauaauauuucuuuccuuuuuagguuuuucaggcagaaaauccuuuugauuuuauggaaaacauuucuuuagaaggaaaaacaaauuucuuugagaaacgaguuucagaguaucagcguuuugcaguuauggcagaaaccacagauaacgucuucaccuuggaugcagauuuuuaaaaaaccucuuguuuuaaaacucuauaaacuugucauugguaaauaguagucuauuuuccucugcuuaaaaaaaauuuuaaguauauccuuuaaaggacuggggguuugcucaaaaggaaauccaaaaccuauucuaaacaauuugcauuuauauaauuuuccuguuuaacaacaagagugugaccuaaaugcuuuugucuugucacugaaauaaaagauggcauuaugugguuaagagcauggggcgaggggucagacaugagucuaagguucugcccuuacuccagugugugacccuuggcaagucaguuaaucuugguaaaccucgguguacuuaucuuuaaaaugggaguaauaguagguccuaaauucauagaguggauauuaggauuaggaugcaaaaauaaaugcuuaaccaacacuacuacuguuagcaccacuacuaauuaucauucauugauaauauuaauugcaaugauguuguaauaaaauacucucauuuccuuaaaauaauugugauucuagguccuaggaucuagaauuagaucuuuguauuuuuaaugcuuaggggaagaauauaaguaucuccuuaaaaagaacauaauucucauucacgcaagaauaaguucuuugaauuccuuaguauguagugaagaaaauuuaguuguuaguugcuuugggaagccuacuuauggaguggaaaccaggagguuaucaugguaguugaccuuauaagaaaaaugauucuucuucagaaauuaaaaacauaacuauugccagauuuagcucuggaauguuuagaaucaggcuagaauagcauuuuccaaagaauauucuaagagcuauuagcuccucuagauauuuuuuugggggaaaaaggggauucuguggucagaugaguuugggaaaugcugaacacuucauucuucuuuagcaaguacagucaguacaucaaagacugagcaguucagugguacauaaauuuaucucgcccugcauauucccaacauacuuaacacagauguuuuuuaccuguuaacaucucacccagcuaguguuccucagaacaaagauuggaaaaagcuggccgagaaccauuuauacauagaggaagggcuuauggacugagaaagggagaacaugguagggauuauugaaucauuucaaauuuauaccagccugaauaguguaccagcaauugacuuaggcuguguuucuuuaugguuuuaaaacucuugagcuguuauaagagauaguucuuuuaaugugacuaugcaacaugauagccaauggugagggaaaaggagguuucucuagaagagucugaugaaaggccgggaaccaagguuuuugagaagucugccccuauuuauuuuuaguaaguaucaagagguagccugagccuaguuagaguuagaccugucuuuggaugaagaagucuuaauacugaaauacugaauuuuuaauacauuauuauuugguauucuguauaccccuucaagcaguuguuucccauucccaacaaacuguacuuuauacaauucuggaugcuaaaacuuagagauuuucucuuugcauaaauuuuggcuccauucuuuccauaacaaucuaaucaaaacugggaguucucaagugaaugcaaaaggagcaggccauaacuuuauuuguuagauacacugucagaaacuugagaucuuuuggccuaugauaauaccauuaauuuuugcauugcuucaguuugccaaguguuuuuacaucaucucauuugaucucaaaacagcuugacagagcaacuguuauugaaauauuacagauggaaagaaugaggcucagggaaguuaaaugacuuggccaagaucugcucaucgucacugucuguacaguauuuuuuuuuagagguuguaaugucucagauuuaguccuuuaccaucuauguugauuugcuuuugucuauuuccucauuaauugaauauacuuuaaauauauauauuaaaguaucaaaauauagagagacauuugaacuguauucagguaauauguuuaaagauauuuauauauugccauacaaaaacuuaacauuuaaaacugauaauaucuguaaugacaucagaaugaaagaaaaaaaauuguacaguguauauuccuuuguuuugaauccaaaucuuuuucauagguaaugacagaugccuuaaugugaagcuuauuuauaauagcaauaaaccuaacuggauuuggaugaagaagucuuaauacugacauacuggauuuuuaaugcacugguuuguuauuugguauucuaucucuuuuuccaggccuccagguugcacauuuauuuauuauguucaauacuuugguucuuaguucuuaaagaaucaagaaguuguguaaucuuuuaaaaauauuaucuugcagauaaagaaaaaaauuaagaguguguuuacaacuguuuucucuuuuuuacaguacauguauuuaaaucauugcuauaauaaaguuaaguucauuaggaauauaaaaacuugcaguucuaugauagauugcauuuauuaaaaauguuucauuguaucacauagaaauauggccaggaaggacuugagaagacaguuugauccauugcuuuuagacaggacuggguuuugcuguccaauuauauacaauaauaguuuuucuuacaacuaagcuggccccagccuugucuugauauuaauacaugaaauuuuuauaauugucucauugucucauuuagaaacauccauauuuuucugcuuuuucuauugccauuuuuuauuugugcaugaauugauuauugagaaaauguagcaguuugcauauuuaaaaauuaaucauuuugcauuuuacauuuaaauaugcuaacaucacugucauagaauucccaaauuucauuuguagauacugaacuaagggcuaaugucaggagcugauuuuuaaugauaaagcugcagaugggcuaaauaaaagccaaauuaauccuacaaucagguauuauguuuuuaaaccaaguugagugaauugguaguggacuugggaaaucuuccccagcagaaucuggaugaauggcacagaauugaaaucucuuuguuucccaccauuucccuuuaagugcucugcuccuuuguaaaaaguuaaagauuugaaagagaaucucauauucccgaggcauuaggaagaaaggauuuaaucccuucaauuuggggcuuaaucuuguuuaaaaaaauguaagugaagauggaaggcuggagagaaugauugcuuuuuguacaguuaaauaaggucacaauauucuuacauacuuuguuuuacaacuguguuuucauuuuuucaaaugucuggccauuuagcaaaguuauuuacuauuuacuguguacauagaaagcuuuauuaugugugguguaucuaaauuuuuuuugcugaaauacauuauggucaaucaagccaagccugcauguacagaauuuguuuuuuuuucaaauaaauuaguuguuuucuuauuuuuuuggcuuaguauguugaaauaaacuaugguaucuucaucauuuuguacauuuccuuuuugaggaagguuucuuuauaagugcaagggcuacccuaauaaaggaauguauauacuuacu

SEQ ID NO: 192541 - RNA, 52038 nt, Homo sapiens
uggagcuugguaaugagcauuuuuauuaaauuccccaaguacaagccccgguguacacaauaagcaauuucaguuuugaguaacugccagggaaggaaugucccccuuucuguuuguugacugccuucugauuuguuugaaagcuuuuuucuucuugcauuaucuugaccauuccugguaugaaggauguugucuuguuucuccucaguuucaucuucugcagaagaagaaaccaugccaggcggcagucucuuacuguucauggcuuccauggcuuuacucuguucccuuuuucucucacaagucaucagcucagaucuaaaaauacucuaaggguaaauccacuggugaauaaaaugguuccaaugugccauauuccuuucuuuagaaagcaagaauuaccuccauauaugaaucuaaagaaucaauuguuaucuaugcuagaaaaauaaagaccauuaauaagugcaauauugaaaugggugaacaucaauuuagagacaaguacuaaacuagcaaaguuuuugcuagguuuccuccagaacauaauaccauuuauagaccuucuaggacaaaccaucuuuuauugacauuaacagaagaagauaaucacauuuuuuauaaaggcaggcaagguuuucauuauaagcuguucuauaguauuuguauaugugguuuuuaaccuugugcauaugcuacuuugauuucuucgacagcugagaaugaaggagaaaaaccucauaucuagaucaaugucuuauauuuuauuuccaacauuuuggacuaauuuugaaguaagagcaaauaaaguuucacauuugcugaguauuuguuauguacaaaguguuacuuuaaagguacuacuggauaugcacucauucaaaaagcuggaauauguuccacaaagauugguuccacaaauaucuuuuguuccacgaagauuucaaaguguggaauguguuccacaaagauuuucugcugaagagcaacuucagcaggguaguaaagagguagaaaaaucuccuagguugaauaacugaggcuacugaaauuggcaugcaaacaacuagacacauuaucuaacccaucauagaugaaauguucuggacucuggguuccugccaaauauaauagcaacacaggccaggcgugguggcuuaugccuguaacaccagcacuuugggaggcugaggcgggaggaucccuugagcucaggaguucgagaccagcccgggcaacauagugagaccucaucugugcuaaaauuuaaaaaauuggccaggcgugguagcacgcaccuguaggcccagcuacuugggggcugaggugggaggauugcuugagcccaggaaaucgagggugaggcugcaguaagcccugaucaugccacugcacucuagccugggugacagagcaagaccuugucucaaaaacaaaacaaaacaaaacaaaacaaaaauagcaacacaaguuaacaucugauucuccauaccgaauaucuuuccuauaccauuguccaucucggacucagguuaagcaaugugucuggcucauucacacaacaguugaguguggggcgggaagugugacaaccagcagucaaaaaucuuagguucaaauucugacuggcucaagauuugugacucaacaaagaauucacuuaacuucuuucaccugaagucuccauacaugaaaauggggaccgccaguacucccuccaugaacaacacggggaggggccgggaggaugauguggaugugaaugaucccugacagacacucaguaaauguuuaaugagucuguuaucuaagcacuauccucaaggagaaccagcagacuccucgggaagguaaguggcuugggacagucccuuuccaggaauggugaccgccaccaacaauaucaauaauccagcacagacuggagcucagugacacaaacugcucuguuguuauguuagacacaaugacuuccuucuaacccucagacucuacaaugauguggaucuggauuuucccaaauuaaacacagugaaaaggaacuaccuguguuccccaagggcuaaguaccugcaucaaccucucaccaugcaccacucgcagcacuuucugugcacguggggucacacugacucaccccaacaucccuaaugcggugggcacucuaaucaugcccauuuuacagaggagggacuggaacucggagaccacucugcccaggaccacacagcucgucagcagcagagcuggggccuggccucagagcacaugcucagccacucugcuauaauuucucugguggaaaucacagugaaagucccgucguuucagacauaugcugggauucuaaaccuuaugcagucuguaccuacucucaugagaacaacaguaaagucuaaauaaaaccuuaaaagucacuguguggcugagcuucagguuagugacauguuuuucuuaaaagucaauuuaaugucaaaacaugcccccccaugauagagagaguagcgccacguuacagauacuaagacucaaagaacaugugcaaaagacaaagaaccaaaauuuucugauagcaaaaucuuucacagcuuccucuuguccaaagaaaaacugaagauaaauccacacuccaaacaugucuuuaguuuagaauucugacagaugacuuggcagugagugucaaaaacuuaaguguacauaaccuaugacccuacaaauuccacuucucagaucuuacagaaauacuaauacaaguauacaaagaaaucugugcaaggaugcugacugcagcaguguuuguuaagagcaaaaacuaaaaacaagcagacuauccauccacucggcuaaacacaugaugacagacacucaauggaacgccacgcagccaguuaaaagaaugagguagcuccagcuucacugacacaaaggauucucuuagauauacucuuaagcaaaaaagcaagugacaggaugugugugguauaauccuauuuuauuaaaaauaaacuguguguguguauacgugugugugugugagacagagauguaaagacauagaaaagggccuagaaaaauacauaaacuucccuugggagguggaaauugagggagggggucucucauguucuacauuguggaugucuguauuugcuugaaauuauuuaugaaauaauauaauauuuugaaacaaaagauuuuggaggcuaauuuucuaaagggaauagcauagcuuagauaugccccuaaacugaaauguaaacuuuuuucccauuugcaaaccugugaguacguaguaagagaaacauugccacaaaauccucuuuuaaaagcucuuucaggacacuaaauuaagucauucauuucugagauuuuaaaggccaacaaugucucuauuuucagacuaugucacaaaugacauaaaugccaaaauuauagaucuuaagaagacaacacauaaaauacagacuuagacaaaacaaaugacuaaagcugcauaguucugcuagacuuuauucaaaacuggcucuauucuuaauuauuugagagaccuaaaauucuaguguucaaauguaaauacccaucauauacugaaaagucaucuucaaauuuguguucugacccaaauuuggcucaauuaaaucauacgaaagucagacaacacaaaugguuacaccucagcauauaacaaaauccuggaagcagcauagcaagugagcuaugacaucauuuaacucucaaacagaacuguaaucuuaaguuacacacaccacaauacaccuuugcacagguaauuuuauucucuccuguggguguugacagugcucauugauugaaauuugaaacguucagaaaucccauaccugaagauggucacauauucuuuacaucaugauucaguaacuauucaacaguuaugucuacuaaauacagugaacaaaacaguauaaauguuuacaccauuccccugugaacagggcuuuugugcacaauaguaacaaauggaauuaaugcauaccaugauaucaauaaggaagagaccuucucuuuaaauaaacuauuuuguuuauaaauaaacucugauuuuuuuaguacacauuuacagaccugaucaauaaaaagaaacuauauauauauauuuuuuccuuuaaaaagaaaauguugagauacagaccacugugggagaauucaccuaggaaagggcguaagaagcaagcaaaggauacuagaguuaaaaguacgaccauacugcaacuuauuucuguuagcacacacaaacacaaggacaggauugucgggggaggagcccauuuucacuugaauuccagcaaguugcaaucaaucuuguaguacacauagggguaguauucuuguugacucagguuuaaaccuggaauauccauaggagccuauggaaaaaacagacaauuauucaauuuuguauuuacagaacucaaaaaaagaaagcaaguauuaacauuuaccuuuuuauugaacaucuacucugggcuaaauguaugcacuuaaggcuaauuuaucugaguuagacauuauucccauuuugcaaaugagaaaacaaucucugaaagacugacuucuccuaggaaacacagacagugagugguaaagccagguucaagcauucugacugcauauguauuuagcaugaucccaccaaccuuuuuuauguauacuguaaaaauuaacuuuuuaaaucuuggacuuagaauacugaguugaugggauacaagacuuacaaaauauggaguaaaaauaaagcaaguaugauuuauaaguaauacuuauucuguaauaucagcacuuugagaggccaaggccuugagcccaggaguucaagaccagucugggcaacauagugagacucuaucgcuacaaaaaauaaaaauaaaaacauuaaccagcagugguacugcgugccuauagucccaacuacuuggaaggcugaggugggaggaucacuugagcauagagguugaggcugcagugagccaaaaccaugccacugcauucuagccugagcaacagagccaaaaaacaagcaaggauaacacuuauuauaaaugcauguuauaagaauuuacugcuagaacauuuauguaucaaauaauuauaccucucauuuuauccacaauugcaugaaaguggagcaaguuggccgggggcaagguggcucacgccuguaaucuuagcacuuugggaggccgaggugggcggaucaccugaggucaggaguucaagaccagccuggccaacauggugaaaccgcagcucuacuaaaaauacaaaaauuagccaggcauaaucccagcuacucaggaggcugaggcaggagaacugccugaacccaggaggcagagacugcagugagccaagaucacgccacuucacuccagccugggcaaaagagcgaaacuccaucucgaaaaaaaaaaaaaaaaaaagaaaaagaaaaaaaguguagcaagucauuucccgcauuuccuucuaucaagaaaaacugauuuuucauaguucuaauuaaugccuaugugagaugcuaccaucuacccuaaacuuuuaaagagaaaaaaaaaaaucagcaagauauuuaaaaccagaaauauaaaguaaaagcccacuacaauuuuuuuuuuuuuuuuuuuugggacggagucucccucugucacccaggcuggagugcaguggcgcaaucuuggcucacugcaaccaccccccgagguucaagcgauucuccugccucaggcucccgaguagcugggauuauaggugaccgcugccacgcccagcuaauuauuguauuucuaguagagacgggguuucaccauguuggccaggccggucucaaacuccugacuuaaggugauccccccgccucggccucccaaagugcugggauuacaggcgugagccaccacgcccagcggcccacuacaauuuuaaacagcaacaacaaaaaaacacaaguaacucuguuuauaucuucuuuuguuuaaaaaauaacaguuuuguuuaaaagaagauauaaacacauaauacauuuuuuggucuguuuuuuuuuuucuuuuuucagaugggaucuuacuauguuacccagguuggucucgaaggccugggcucaagugauccucccgccucagccuccucaguugcugggacuaccaacaugucccaccacgcccagcuacgccauuuuagaaaaaugaaccuaccuugaaaauacucaucuauugacucuaucgcuucuaccaaauaaaauuaaaauaacugcuuauuuucuuccucucugcaauuuauaguuuuuguaaauaacuaguaucacugguuucuguauuucugcagcuauaaacaucugauacacagcaagauaauuacuagcuuguagaaaugccaagaagcaaaacacagauauaauuaguauaaaacaggguaaacaauguaaauuacuauguuuacauaacaaauugagaaccucaaaguaauaaaaaaugauuaaguuucauacuuacccucccuuuucugucuaucuucuuucaaucauuuuuuuucugaaauucacuucaauucuuacucuacugggcuaauaaguacuuacaucaauaauagcugcugcacugcugucuagauguuuauacaauucauguaauacuucucucaguuucuucaaaguuuucuuauugggcugaaguagcauugcuuggaaguucacuggcaagccauaccuuacaaaaaagcagaaauacaguacgcaauacaagcaaacauguaaagagauuuucuuuucaaagcaaauauucucauacucuuuaaucaugguuaacggggagagaauaucucccuuuaccuuuacaaguucaacuaauauauauagaaacugaaacuaauauacacaaaaaacuucaauauaaacagaaacgcaaaccuuugguccccacuguccacuagaaaucucuacgccaauuacuaggaauuacuucaauuaccauucauuuuuuuuuucuuuugagacggauucuuacuguugccaggcuggagugcaguggugcaauccuggcucacugcaaucuccgccuccuggguucaagccauucuccugccucagccuccugaguagcugggauuacaggcacauaccaccaugcccagcugauuuuucuauuuuuaguagagacgggguuucaccauguuggccagcauggucucaaucucuugaccucaugaucugcccgccuuggccucccaaagugcugggacuacaggcaugagccaccacgccuggcuuaccauucaauuuuuaagguaauauaugaauauccucaggaaauaagaagaaguaaggucagcagauacuuuuaugguaauagcaugagguuacccacauauaguuugaaaauuugaaaaaauuuaaaaauagugagcaugguuacauguaaguuuugggguguuuuuuuguuuguuuuguguuuuguuuuuucaggcggagucucgcucuguugcccaggcuggagugcaguggugcaauagugcaguggcacaaucucggcucacugcaaccuccaccuccuggguucaagugauucucugccucagucucccaaguagccagcacuacaggcgcgugccaccacacuuggcuaauuuuuuuauauuuuuaguagagacaggauuucacccuguuagccaggauggucucaaucggaccucgugaucugccugccucagccucccaaagugcugggauuacaggcgugagccacugcacccggccaaguuuuggguuuuuuaaaacuauuucuaauaugagcaacccauacauuggaccagaauaugauuuuuuaaauaucucaaaauauuaaaauacuuuagguuaauaugaaaugauuucaauaagucauuagcauacuauguauccaaugacauauaaaacaccugaaggaucuuccuuuuaaacaaauauugguuaauauuuaaucuacuuuuaaguaccuacacaagaaaaagaaccugaggguauggcagcauaaaucucuuuuucuaaaccuggugcuaaagaacaagacuaauaugcauuuuauaagcuguaugaugauacugauaaucucugucucaugauuggcccuuugauuucuccaaaucaauuuccuauugcuggacuguguuauaauaaagagguccaauguaaggaaucuaugaacucuucaguuccaaguuuggcaauuaacuugcuuuaccuuaaaacagacucaacgaaaacccguaaugcuuucacgugaauccaugcaauaaaugcuucacuaaaauucacuuucagccaccguacaaguggucccuauaaaaagaaaaaaaauuaccacaaauuuggucuuagaaauagcaauuagauagaccaaauauuuuuuuaagugacuaccuauuaggaaucuauagaagaauuaagucgcauaauucacuuucuacauguuucacuauuauucucauuaucucagauaccuuaucuuaaauuagauuaaaagguucgccacuacagagagaucucaacagacacuaaaaugcauugaaccaauucacuaacacagaaaaagguauauauuuuaauaaaaguaguuaaaaugguacaaaauauagaaaugccuuagguuggaaaaucaaaauauaaagaucugaauuuacuacacaacacucuaaaacauuuaauacauguaaaaugaaauucaacuuacaaacaacuucuuaguaacaaagauaaacaguuauguaggcaagucauuuaacagcacuagcucuuaguuuucccaucuguaaaaaagggaguuggucuagacaucuaaaaccucuuuacauucuaaauuguauagcguuaaguucuuuuuaaacuucaaauauuuaguaggauuaagcggauuucaaauaccuccucucuccauacuuaaaagauucagcuaacacuuccuuggauaacauuauuaggcucauuuggauguaccaaacaauuaauuuaagcaaaaggauagcaaaacaagugaaaaucuugucaaaauaucuauuuuuuaaaaggauuuuggguuugcccuaaaaagcugguuauuuugacauuacuugguuagaaugaguuuccuccuaguugagaugauauggcuuauaaaguacuuggaaauaauuuucaauauuucccuuaauuuccucuuacauuauuaagagaaacacauuuucacucauuauguuucccuuuccaaacaagcuuuuagucuucacaguaaucccacacuugaagauggcaagaaaguuaacaccaucuuugauuuucacaauuccacucguuucccauuacaccuagaacacaccaauucuccaauagcuuaaauacaaauugcuucaauaaaagauugaggcauugaaaaaaucugccucaagaaagugaaaagucuuacugaaaagaacuucguuacuuaacuaaaaucacccuucaccuacaaggauguuaaccagaauacugcauuuaaaauuaaugucugauauggauuuagguggaguaauuucuuuuuaaguauguauuuuaggauaacuauucuaucuacucuauucuaucucagauagacauaagcuuuagaagaaagcuuucuuagaaauagaauaguuaucucuagaacaguuaagcuuuagaggaaauucauucugauuauucaauuaaaaaaaaaaacuaaaaucaaaugucuuaaaaccaaagcagauuuuuacuuucuuuuaaaucaaaggaaagcaauaccacuuuuucuucugcuuaguacugauaauacuaaauauuaaaaacacauacaaauuguuuuuucuuaucaguagaaagccuguucauuucuucuuuaucugcuuucaucuccucuucauuauacuggaagucacgaacaaugaaucuaaauuugggggaaaaaaaacaaaauuguucacauuguauacagcugaucuaacaaaguaaauaaacaaaaaaacaauaaucuuacuuguuuucucuggcuuugugucugaagucaucaacugccuuccuaaacaaggugacauuacacagguaacugucuugguccucugaaagaacacuauggaaaaaaaaaaaguccauuuaaagauuuauacguauugcugucuuucauauuaagggcaaaauucagaaacagguggaagagaaaaguaggguauaauagcccuucccaaaucaccucaaugcuuuucaaucuggauugccucaaacaccgaagauacugaauguuuaugauuuauuuugcuuaugauaccuuaacacucuacauuuauuucuuacuaaccaacaaaauuagacauuaacuccaguaaagcauccaaacgcuaagaaccacacuuuucaaucaacaucagcgccaagcugcuuuguuuccagugucuccuugauaagcacacucuucuuuucuggaagccuaauucuuucuuccuuucuccaggccaacucagccccacugaugcccagccuagccucucugcauugccaguaccuuaaaccuuggaucuuuccuuugcucccaugacaucucucaaucaaaaacugacaggcugggugcaguggcuuaugucuguaaucccaacacuuuggcaggcugaggugggugauugcuugaguucaggacuuugagaccagccugggcaacauggcaagacugugucuguacaaaaaauacaaaaacuagccaggcgugauggugcaugccuguaguccuagcuacucgggaggcugaggugggaggaucacuggagcuggggagguugaggcuacagugagcugagauugcaccacugcacuccagccugggugacagagugagucccugucaaaaaaaaaaaaaaaaaaaaaaaaaaaaacccugaugaacacaacugucuaaauaaucucugaauaaaagugccuguaugcaucucauggcuccauuuuaggcuuuagaaggucccagugaggucagaacuuccauucagucacagcuccauggacaucacuagaaagaccuuuccagacacaacugccagguaauuuuaauggucauuuaaaucuguaauaccuugggugaaaguccacuguuugaaaggugaaugguaucgcuugugauaguaugguccaaauuuggcuuucagaauuuaccuauagugccuccuguauagaaguccuuaugugagguccacaaggcugcacaggcagcuguuccacagcgauaaccuuggggcaggggaauguuacugaggggaaucucuucuccuuucugucuuucacauacuggaguucuucuaauguuuaguguuuuuuaaacagcuuuacugagauauaaucguuauacagaaaacuguacgcauuuaaugucuauaaucugaaguguggacauacgcauauacccaugaaaccaucaccacaaucuagacaauaaacauaccccucacuaccaaaaggguccuugugcccuuuuguugguuguuuucuuuguuuuuuaauguucaguuuuacaaugugguacuucugaaaucagaaaaaggaaauuuuacaaaauggaggaaugcuggggaauuuaaagauacuauauuaaaaaaauguuuaaagcaaguguaguuuuuccugaagccuaagaaccaccuguuuagccaaguaaauucaggaggcaauuacaguguuaaucacagaauggcuuuaaguacugaaucuacccuacuccucgucagccagccagcaggggcaccucccuaguguaugaccagcagacaccuccaggaguacugaucacuguaaucgcugacaugcagagaaaacucaaguacucuggauuuagaaccuccuguuaaacuguaucuucucaaaaugauuacccuuaauucuugcuccugguguccaucaaacccaaugaagggcagcuaccaaguggacagagcucgauuuaaaaaaccguuuaaggaucuucugcuuugccaagauuuacucagugaugugugaacugcuugagaucaaaacaaauccaaaucuaacuugacaggcuauuucagggccacaaauaauguuuuacuguuaucauaguaaucuuuuaaacuuauccaacacuuugcuguuuugaagacccuuccaaaagcauuuggugcuugacauggcccugugucaaugaacagguuaccuauuaagcagguuccuagcuauugugcagagaucugggacacagcaaauuccuauggcuuacucaaaauccugauggugaaaaaagccaagauaaaaccuccaucuuaucuuauaacuaaauccuacuaugccaccuuauuaugaaaaacaaauaaaagccacuugcuuucccucuuuccccuaaggaaagguauuucuuaaaacuguuuaaaaaauaaaccacgaguccuuacuauaacagacuuguagucauuuaacauguacugagacucuguaaugcaagcacuugcuagauauuaguauaaaacuaagacagcauuuccugaucuccagguauggguuuaguaaaggaaacaggcauacacaaguaacugcaauauagaguuguaagugcugcaauagaaaauauacaugauacacuggggaauuaguaacuuuaucugaggggauucaaaggaguuucaccaaaguggugauaccagguggaaguuugaaagaaagacaaaaaagagaagaacguuccagacagaaccccauaugcaaaugaauauagauguggaauaacauggugcaucugaggaauugccagaaauaaguauaaccggggcucagcaugguagcucaugccuguaaucccagcacuuugggaggccaagguaggcagaucacuuagaggucaggagcucgagaccagucuggccgacauagugaaaccucaccucuacuaaaaauacaaaaaucagcugagugugguggcacaugccuguaaucccagcuacuugggaagcuggggaaggagacucacuugaacccgggaggcagagguugcggugagccaagaucacaccucugcacuccagccugggugagagagacugugucucaaaaaaaaaaaaaaagaaagaaagaaaaacaauauauauauacauauauggcugggacauaggguacaagaagagggugugugggugugugggugugugugugugugugugcgugcugggggcaggcagucaaaauggggagggacaagcaggguuuuagacgggaaagcaacacauuuguaugucacaaagaugaaaacagcagcaauguggaggacugaugagaggagaaaaggagaccagcuagggucaauuaccaugguccaggcaagggaugagggagucagagcuggagcaguggcagugggucuugggggaguggggagaguagauuuaacccuaugaaauuguagauauuugaccauuuucugaccuacaaaacaucaauuuuuaacgguucaaccaaauacuauggaagguggaaaugacauaacugauuagacuauuucagguggggggccgguggggggaggggggugcaagggcaaaggaagauuccaaaaucacugacuaccacacuugcgguuuggaucacugggcagauguugcugccauauacuacagggcaacuagagaguuugagucugagauuggggugauagugucaguuaccuaggaaauaccacauggagugguccaguaggaaccagguaugugguuggggggaaggcuggcuacagacgaagauuuagcaguccgaaaacugcaggugaggcuagagccaugggugugguugaagugguacugacaggagaacagaccaucucccucagaaacucugaaacauagagaaacuucuggacaguggccaguaucauucuuccugcacuucuuagcuaggcuccucugcuucacuggggacuccagaucccuaaagaaaaaccucugugaagcauccaugaguuugugauguugcuuccaaugacagagaaaaggcaaaaguuaaccagugaucugacucaaucagacuauuuuaacaagcaaaagcagacaaaaaaaaaaaaaauaggaaagugguaauucugaaaggacaagugaaaagcaccucuuucugaacaguguuucaacaaaaaaaagcagaacagcagcacagccuccacuucuuuggccacagccuuggcauggcauuuauacacauugcugcauuuagccucacagcaaugguaguauuucaaaaccguccaaucuuuguagaauauuuuauaaauaguuauauuuugugaacuuuaaaauucuuucagguuugaggacaguuagaagaauagauugaaaaauauuagauugaauauuaaagugaauauuuuucaaucuaccucaaaauuccacuuucaucuucacugcucccaacaauaaucacucaaguuaucauaccaaaaaguaauguguuacuaccuauaauuaauuaacuuguguaaagcacauagaacaaagacuagcucacaguaauuacucaaaaaugcugguugugaugauaagccaaaaauucagcaucaggucauagagaucuuuccuaaauggcagacaauauuccaggcucacucaaaaaagccuauuugccccuacaugaacugcacauacucuugauggugcuauuugagcuagugcuauguucucucugacuaaauuuaaacagguaaguuuuugagucagugauuccaaauguacuuugaacugagaaauagguagaaaagauguuuucacugagcaaggaaaggcuggaagcucucggaagauuagugugcacuuacaagucacuugcaaacaagucuugacugcauuaaacuguucccuuccugaaauuugcccuuuaaacuacuaaagugacuguccaaagaucuaaaucucugauggaauauuuuuaaagucuuucuaucagaguaaaucugagcuuacuuaaugagccuacagaccaucccccuggacaucuggguuggcguauguccaucucuggaggacauucugggugcaccacguccucacucuccuccucuaccugccuccuagacacagagucaaccucuacggcucuaaugcccuaaagaucugucaguaucaacagccuaagugagccaucaauaucaagacacaacuguagucuucaguuuaccaugugaagagcugguaugaaggaaagauauuccuccaaaugaaaaaaaaaacauucaugaugagcacaaguuuguuguuaaguuccuaaaagaucaacauuugugaaaauacaguaacauuaucuuguauuuugaauacuccauuaagucuuaaaauaacuucauaauauauacaaggaaggugcuaugcuccauuuacagacaaagaaaaugaggcccagagaaguuaaaagacuuaccccaggucacacagcaaguugguagcagaacugaggcaggaaauagggucuggaggcagggaaccuaagguuguuucaccccgguuuccuagaacuaaauugaaaggaaaacccuaacuuuccacgccuaaguaacaaaaggaccagaggcuacuccuuuugaccuuuccugcauggcagaugggaaauuggcugucugcaacaaaucagacugauugggaggccgagucuucauucgcauagaaguauaacuuuguaacuucacccuagccucugauuaguugccuucugcaaccaaucagauauuugcacaggagugugaccuuuguaacuucacuucagccucugguuggcugcuuucugcaaccaaugaggcucacugcaggcuaccacgucauuuacaugaggugagcaugaaguggccaaugggaaacuuguaggaguuauuuggacccaagaagauucuguauccaggcccuugagccacugcucaggucugcuccuacacuguggaguguacuuucuuucauuuuuaauaaaucccugcuuucguucuuuuguugcuucauucuuauuuugcuuugcugggcauuuuguccaauuuuuuguucaaaacaccaagaaccuggacaacucgaagucacaacccuaccagugacggacccuaccagugacagacucuacuggugacagaaccagcaauagaacucagaucccugaguccaggacucuuuccaucauacuaagcuacuucccacaugacacaaugaaacuggaaaagaaaauauuucaugggccugaccuuacuaauuccacuucuuuacugccuccuauaucuuccacccugcugccuccccuugaagcacauauauaucuauaagaauccuuugggguggagauacacuguauuuauauuuucucaaagaauaucugguguggcaauggcagaacacagaaaaaugacauggaauaguguuaaaaggguacaggaccuggagcuaaaagaugugaguucuagcccuaacucugccauuggacacuuuacacagccauaugccucaggcaacuauuuaagcauuuuaacuucuucuuccuugagaauaagaaugauaacuguccauacuucuucacagacuuguuguaaauuucaaauuagacaaugcauguuaaaucuauaaauuuaaaaagugcuuaauaaaaacagguuuguuuuuuaaauaaaaggaacacacaaauuagguaaaaucuaagcucaaagugauggugaacaucuggagaucaacacggcaguccaguagccauucugguacacuuccuuugccaaguaaaaugaggaauuauagacacauaguagguaugcaauaaugaauaaagaauuuucaaaaggcagcacagugaggcagaaaaaguaccacaccaaagaccuagguucuaguucuagcccugccacaaaugagaugugugauccugggcaaacuauuaauaccucacuggccucaaacuucuaagucuauaaacaggagguugucaaacagacugugccaagucccuucuaggucuaaaauuauuacaacuagaguucauagaacucacucaugagguuaauuuaucacaaaggcaagacagcaaacauauuuccuaagccaacauccaaacucuaaaaggaauucuaggaaacaaaugguuuuacaaagacuucuacuuacuugcuagaccuuggaacuaccauuucggcuaguguuucauacugcuuaauccagucguugugguuuaaccugcagaaaagguacaauacacauuggaaaagaaaaacaaguccuauuuccugccauauccaggaagagaaaaaauuaugagacaaauaggaaaucuggcuauaguaaguauacuucaacucuauuuaacaaaaaaaauucggguuuccuacugagaaugaauuucaaauacacugaguaaugcaggaaaaacagaucaccacccuaccuccaguaaccauugcaaaagaggcacauccuagaacuauguucggaaaggaaguaaagcacaguauagauucuaaauuguuuucaagcugcauaguucauauguauugugccucauuuuuuaaaaauggucaugcuaaaaucacuaucauuccugcucaguggccauuaugaaggacugaaaaaaaacuauauuuauggaaagcacagaguaccaugagguaguaaguaaaugaagugacaguaaacuauguugccacaaaacauugugcaacaaccuucucuagaggccacuggcuuccagggguguggggagagacaacuacguuugagauugaaaacaaagaauuauaguguguauaggccagaauagagaauaauucaucauguaagauguccuagguccuauguuucaauuacaagguacagaaaacuguaaaaauuucugguuuugaacccaaguuuuaaauaaagguugagugagucaaauauuucaucugggcaaaaguuauuuuccuacauaguauaaaagcacagauacacagaauuuguuauaaauaaucaguguuucaguguagcagacgggaguuauguaacuagaacacaaaauaaaauuucuggagugaaauccuuagauuuaaggccuucucccugugcaaagaaaaauccaaaauuuuuucuagcauacugcaauaaaggggaaaaaaaugcagaauugagauacuacuguagccacuguaaauuccauggaggcaucauuuucuaguacuccaaaucucugaaccagauaaaaaugcagagcacagcaaggaagucuucacacaaugauacucugaaaaagacccaaaucucccaccugaguuuggaucccccaaacauucccugauagcaagacucaguguaagucaaaagugaaaccauuaauagugcuacacagacacacacaaaguccaggucuuccuacaaguacccaaagguuucauuucauuuaagauuaacuaugaucaaauauuaaauaacauagaaggccuaauccuaaggagauuucaaagguuaucuaguccagggguuagcaaacuaugcccauagccaagccuguuuuguaaauaaaguuuuauugaaacagccacauucauucguucacauaucaucuauggcuacuucagcuauaaccacaaaguugccacaguggaguaguugugacaaagaucacauuguuuacaaagccuacaauacuuacuaucuagcccuuuauagaaaaaaauugcuaaucucugaucuaauccauucuuugcuucuuacagugcuuaauuaaaccuaaccagucauaaagauuuuuucaggaaaaaaacgcaaagaccuuccuauuuugagaaaucuaaaaucuguauuuuuuaaacaaucaauaauuuagcauuacuuauguuugaaugagccaauucuaccaagcugcuaaauuugauuuggaaacucaauuuauaacugaagucuccauugccagguuaugaucuaauuucuacuuuaugugccacaugagcaaauguugaugacagaaugaauggcaagguuauauuccuuuuacgcuuggauuuuauggaaaacuucaaacuacaauacuagauacuaacauuuuucuuguauuuuaacaaguaaaaccuuuuauaauagaaagacuuacuugggaacuacuaccaguaaugugacgagauacucugaaucaagaacaaagucauccuucuucacaauuucugcuagacuucuaguuagcaaacuuccucugaggaauuaaaacaaaucauuaggcugauaauuaugugcuucuguaacacaaguaaagaaacagcaggcuaaucauuuucacauauacuauauauacauugagagggauuagucuuagucaacauuuuuacuuuguaagaagucaccauuuagcugaauauauccuacccuugcaaccaacgaaauaucuucuaccaaaauuugccucuaguguuuuguguuugcuuuaauuauuauaacucagcucuucucuugccuacauauauaauaucuugacuggaaaacuaucuacucauuagauaucaauuaaagucuauuccaucauauaauuaugaaacuaugucaucuaagcacaauaccuuuaguguucuucccucccuuggguaucauuugauacuaggcaauuuugguagcuaacccaauaauuaacucuuucaaaucaguccucauuugucuuccaguaaucacuuucccauaauaaauaugucuugcccuguuuguaucacucacaguauccaaccaacuuucccucuaggauaugaaggcacaacuugaauacuuucaugcuuaaaguugcacuugaaguagucauaguacaaggggaucaaccaaaaaaauucaguccuauuuuaaaaaaccuaacaagugaaaaaccuaaauucugaaaacagauaagagaauaacuauuacaucauaaaaggauuauucuauaguuaagugauagguaauuacuaugcaguuaaacuaugauuucauuuaaaacaauuaauuuuagacuauuuuucagugaaauaucaaauggauaaaggaauaagccaggacccaguucacaaguauuauuuauaaaacaaguauaauaaaucagccucacaucuguuuggacuagucugaauucuauaaacuuaccuuagugagcuuuucuccaugaaguaaaagaaauaccauuuugauuacagaacaacauaaacugaaacuaacuaaaucccaacaauaucuccuucggugcaugcuaguaugcuuccccaguucuuaguacucaaauauacuugaucugcuuacgcauucuuucguuccaaauucugaagauuuccuuucagguuauuguaugcagaugcucgagauuucaggucauuaucaaucugaguuacucccuuugaaaaagaaaaagaagaaaaauagauaaaauuuuccuaaaucugccucuacuaauacuaucaaaguagcuaaacuuuaacuucuacaaaaaaacccacuaguuucuaguguaagaauauucuauuauuuuaaaagcacgacuuuaggaggucauuuaaaaaacagccgacuucauuuuaaauauaauuuccacauaaaucuuuucaacuaaaaauaauguuuuaguccacauguauuuuaauuauauuacuucuuaaaccauggaaauggaaucuaggccacuggguuuggagauuacuauuuacaaggcuucaauucacaagacugaaggauauuuuccaaaguaaacuaaauuacaugaagaguuuugacuacugcaaacaucacuauuacacagaguauuuuucuaugaaauuaaaauuauaguugaauuuauucauaaauguuacaaaagcuguuuuucucagaagaauacuaaacuaacuacauggggagaaaaugugaaguaaacaacauucgaagaacugacuuuaacauagcucuagcauuauuagcuguguagcacgaggguaagucacuucaccucucuaagccugcuuuccuaucuacaacagcaucaggaagcagaugaucaaauccuuaaggauacagaaaaaaaggcucagucauaguaagaacaccacuuuauauuaucaaguaauguaaauaauaguuucuuaaacuauagucaucaaauuacaugaugacuuuaguuaaaaucuuugauagucuauuuauuuacauuuaacuauacagcacaccgcauaacuaaaguuacugggagccaaggaaagucuguccaauaauuuaaacuacacuucuugccccagccaggucaaaugcuggcaaacaauuaacagguccuugucuauuugucucauuauaguuacuguuaagacuuuuauuccacaaacagaucuuggggggaaaaagacuuuuuuuuccucucaaguucuaggauuuccuuucaaguucaaggauuucucaauauaaaaggagcucuuaacuugguggguucaugcaucggcuucaagguccauguacucccugaaacuacauaaaauuauguggcacacgaauacgggaauuuuuccaggcagaggaucaaaacuaaauaguccgaaggggucagagaauccauagaguuuaauguuugaacaaguauuguaugcacauaaacauacuucagugacuacuaucaccuaccugaaugacuaagaaaucuuaauagacuccaauuuccuauucuacacaaucuuggguacccuuaaaauuuguauaaauacagaauuuucacacuuucuuaaacacuguugauguaauauuuaaguuaauuacauaacuaaguauucaacuuagauaaucuacacauuaaaguguuauacuuuuuaacaucuuuuaaugucuaaguuguaaggauuucuucugugaaauauaauuaaguugccuuaucaaaaccuaaaaaguauuucauagugaaauuauaaaauaagcaaagccacuacaaaucaauguguccuacuugucucaaguauuaucuuaccuuggcaauuauuucagaaauauuuuucagggacugcuugauuggauauuuggccaugucccacuggaaccuuguuauauaaguaaccaaguccacugaaauaagggaauaaauuaauuacugaagaaaaacaauagaauuguucaguuuuuuacacagcgauauauuuuaaugcugaaauuggcauugaggaaaucagcaaagaugucauuucugaagaauccugauuaaaugugaacuauauuaaguaacauggauuaaucaaaauuucuaccuuguaaucucuucuccuuacucaaacuuuaauacauauuaagaugcuccuucuaauuugauuacuuuaaaaaugaaauauguacauauuccuaauaugccucauauguaggagacauaaagauuaagaaacuacuucaaauuaucuccucaauaaguagaauuucauaaaaguauguucuuucuuugauaacuuacccaaacaaacugaaaauaaacuugucuguuaaaaccaugugaugauuguuuccaggaguccacauuuuaacaauuuucaaaacauggacccuuucacuuucaaauggaaagaauaaaacauguagagcuaaaaaaauacucaacaacuuauuccuuggaaguuuaguagucaaagugacuucaccccuaaagggaucaagaacggugaaaccaaaugguaauuauggcagcgccaacugacggaaguaauucauauaaaaauaucuuucucuucucaauaucuccuuacauaauaccagucagucaacaacacggaugguauuuccaaaagcaacucuaucuagaugcacugccccucuuggucaaccaccauuccaccuacuagacugacugcccuaguucauaaaauacguagaagaucaguaaaggcaacacaaauuaacuuauuaauaucuaacauaccuucguuguuucucaaaacacaaauuaacagacacagcaaacaaugagaucagaauuacuugauaacaaagagcaagaauaaguuacuacauuuuuaacugauuaaaaauuuauugagcagcuauuauuugcaagaagaaaugagauuucaggaacacuggauuuaaaauauaguaaccuuauuagaguaggugauccuguagagaaugaaaggaaaagguuauaaaggguuauauccuucuuccuuuuuuuuuugagacagggucuugcucugucacccagacuagaguacagugguacaaucguagcucacugcagccuugaacuccugggcucaagcaauccccccuccucagccuccugacuagcugagacuacaggcauaugccacuacuuccagguaacuuuuuucuuuuucuuuauuuuuguuuggguuuuuuagagacagggucucccuguguuguccaggcuugucuugaacuccugcacucaagagauccuccugccacagccucccaaugugcugggauuacaggcaugagccaccaugcccagcucauuauuuccuguuauaaaaacguaucacuagagaugggcugauuuuaaaugaagcaaaaugcuaaaaugacauuucauaagaaaacaagaaaugcaaguacaaaugacaacaauggggucagaaucaucuuucuaaagucauuacuacauagagcaaacucuauguaaauacuggcuucuagcuacagagaagucaguaggcuauuuuacggguauuaaguaaagaaaugccaaaaucauacugagggggcacuauucugcaauaaaauuaauaauuucuguucuaaagcuuuaacaguuacauacuauuaaauacaaaaaccuacauaagacagcagguauucaacuggaacaaugcugagauauacaacuuggaaacuuacuuguaaaugagugaauaaauagaaccuggaaagaacuaagacaaaccuuuacaauacugcucuugcaggagacuuggcaucauauuauaagcuauauuacauauuauguaagacugucuucuaugagauuauguuucagggaacaggauguaccuggaaguaucaccaaauucaguaauaauaauuguauuuuaauggcuuucuauuguauuuaguguccuuuucuguagacuuuuuuacauuacuuuuuguuucuguagcuuaguuauuugcuuuguaugaguuaauaaugaucaaucaugagcauuagcuuaccuccauuagccaacagauucucuugaacuuugucuuugcuaucuuccaauacaucagccauguauugagcuacuuucuuaaccacucuggggaagaaaaaauaucaacaaccauucucaggaaaaagaucuaaauuccauucuauacaaugaacauauuacauaaagacaugaauuugacuauauguucccauuauaccuauccauauaauacacaauaaauggaucuuaccuuauaauguuuuaaggauaaaauggaccaagacuuuguuacaugcaaaaaucaacagaguaacuguaggguuuuaaggagacuacaugcaaugugucuccuagucuagaaaguaagucaugggaagcuagugagaaagagucuguaaauagccauauauuuauaugccaagaaacuagacaauuuaaggacugagaacaaaggaggaggcugagaacuagcauucacuauguuccuaugacaugcaagacacugugcuuucccuuaggaagaaagggaccugacaggcaagagaacguaagcaauagucaugaugaaaaacuaaguccuacauuauuaauucauuaacuguuuauugagcaucuacuauuuacaaggagcuaugcuauagaggaagccauaaugccaaaacuauuagguuggugcaaaaguaacugugguucuggccauuacuuuaggggggaaaaaaauggcaaaaacuccauuacuuuugcaccaaccuaaaccaagucaccuacauaugaccuugucaguucuuucauuuauaagacacugagguauaaaagaauaaguggcuuauucaaagucacaagaccaguuaacggcagagcugugacuagaaacauguuguccugacuuuggaguccagcguucucuuccuuauuccaugucugccucuaggcccugggugggauucaaaaucauacaagacaaaaucacuaccuucacacauugcuuaaaaucucauuggaaagauccaaaaauauauaaauuacuaaauacaaagcaaucugaggucagugccagcugagauugccagguugcagacagagagagagaaaggaaaaagggaucacuagcagcuacccaaucaagaaagcccaaaggcucaugaguagggcgaugaaggacagaaaugguuuuacaaggaugauuacaugggaagaaagcauaucguugccauggggcauauuaugagucaugauaagagguggaaaagcaguaggcauccagagaauggugagaaguccagacugauggaagcagcaggccgagaaguaggggagcuuaggcuaggaaagugggaugccagauugcagauacacagccucugaagccacacucuagacagggacauaacacagucgaaacagggcucaggacaaguauucugaugacuacaugcucaacagcuaggaggggaaacuggaagacaaauuaagaaauuccuguaaugguuuuuuuuccuuaaaaaaaaaaugugugugugugugugugugugugugugugugugcgcgcgcauuuuuuuuuuuuuuuuaagagagagucucacucuacugcccauguuggaaugcaguggugcaaucacagugcauugcagcuuugaacaucugggcucaagcgauccucuugccuuggccccucaagcaggagggauuacaggugugagccacaagccuggcuuguuaacaguuuaaacaagagccaauaugagccaggaaaggugacagaagagcuaaauuuaaaugacaauccuaugcugaguggucucaaaccuaaaaaucagaacaauuucagaaauaaugauguaaguccuaaaucuucaacauguuuaacuugagguuuauacauauacuugccuaugucuccaaaauucacccauuccuucaaaagggacaaaucauucucauaaaauuuggcaagcaucuuguaaacagaaccauuugcuacgaacauucuaaaauguugcauguuuacccauagaaguacuucagaguguagaaucaccuggugucaaauuuauaaacguaauguugcauaacccagaacuucaagaucuccguaugccuauuuacaagaggaucugugucaauguacacaaugucaccucaaaaauaucugcucuaaugauuacauuuuuaagaaaguacaaacuaugauuuaccacauauaccauauucuacaauauuuggccuuuaacacuuggagcauuuaagucauuaagcuaucaucugucaauacuaccaaagucuaacaacgacaugauuuuuaaauuccucuuaucauucaggaggacugaagaagaugugcuugccgaacaaugaagaaaagaacagcugacacacugccuagguaacuuuaaauucuacucaccaaacuaacuacauuuguccuuaauacuuuucagauuccuucccuaaaaaaucugagcuggcuaggcacagugacucaugccugaaaucucagcauuuugggaggcugaggugggaggaucgcuugaggccaagaguuugagaccagccugggcaacauagcaagacuccauguccacaaaaauaaaaauaaaaaaauuagcugggugugguggugcaagccuauaguccuagcuacucaggaaacugagguaaaaggacugcuugagcccaggaguuccaggaugcaaugagcuaugauugcaccacugcacucuagccugggugacaccaagacccugucucugaaaaaaaaauaaauaaaauuuaaaaucugagcaaacuuuaaauuauauucaggacaucccauuaacaauuuaaagauaaagaacuauaaagccaucaaggugacuaauaaggguauaaauaaauguuaauaauuauauucucagggaccuccuuucucagugucucuuugguugucauaacuuguaacuguaaugagguagaugagaccucagggaagacucacuccagggaugacaacuaaaaaaaaaaguucccucacauuuuuuucuuuucuuuuuuuuuugaaacggagucacgcucugucacccaggcuggagugcaguggcgcuaccucagcucacugcaagcuccgccucccgaguucacaccauucuccugccucagccucccgaguagcugggacuacaggcgcccgccaccacaccuggauaauuuuuuguauuuuuaguagagacgggguuucaucguguuagccaggauggucucgaucuccugaccucaugauccgcccaccuuggccucccaaagugcugggauuacaggcgugagccaccaugcccggcccauuuuuuucuuaauuaaaaauguauaagcaaggaaccaagagacuauucuuuccaucaguuagugcuuugagugcaucauaauuauuuucacuauauuuauaauaauucauaauaauaauuugcucuauaugaauauauggaauuauaauccuaaaaguugcuuuuccuuucaucuucucuuuccauucuaagagccaagugucuggucccaacugagcuuuuacuaucucuuaacuaaccuacugugaaacugcuaaguggccuucuugacuccaauauuaaagaacaucaauacauccuuagaucuguuuacuuccucacuacaugguguuauauuaaaagaucucucucucucucuguaacccugaccucagucucuauugccacagcaucgcuuucaggugguucuaucaauucagaaaagcauuuuaacagcagaaaugagaaaaucuucuggauagauuucaagaaaaaauucccuucuauccaagccuauuauucccuuaaagcuucaaucaaauguacauuucugagagucuccaaauucuguacuuuacaaauuacaccuguguaucuaaacucuaaaauaaaaucuuuguauccccagaguugaaggaacuguagacugauucugccaacuaaucaaaaugcaguuaucaaagagccuauaaccauuuucagcucaaauacacauguaccugaauuucaaaaguaauaaaaacugcaauuuagaaaaacucuuccaacugaauuuugaagacaaaagcauaaccaucuucaaauaaauggaguaacauccgauguucauggauaaagacaagaauauuaggaugauacuacuccccaacugauacauagauucaacacuauccucaucaaaauuccagcugacuuauuugcagaaauuugacacugugauccuaaaauucauacaaaaagacaaagaacccagaauggccaaucuugaaaaaaaaaaaaaaaaaguuggagaauucacacuuucugauuuuaaaacuuacuacaaaguuacaauaaucaagacaaugugguacuggcauaggagagaaacauagaucagugaaacagaacugagaguccagaaauaaacccucauauuuauguucaauugauuuucaguaagggugccaggacaauucaaaggggaaaaaacagucuuuucaacaaauggugcugggacaaccagauauucacauccaaaagaaucaaguuggacccuuaccucacaacauacauaaaacuuaacucaaaaugaaucaaagaccucacugugaaagcuaaaacuauaaaucucuuagaagaaaacauagacauaaaacauuacaacccuggauuagacaauggugucuuagauaugaugccaaaaacacaagcaacaaaagaaaaaaauaaauuggacuucaucaaaauuuaaaacuuuugugcuucacagauacaaucaagaaaacgaagacauggccaggcgcgguggcucacgccuguaaucccagcacuuugggaggcugaggcacgcgcaucaugucaggaguucgagaccagccuguccaacauggugaaaccccaucucuauuaaaaauacaaaaacuagcugcgcauuguggcagggaccuguaaucucagcuacucgggaggcugaggcaggagaaucauuugaacccaggaggcggaggcugcagugagccaacaucuggccacugcauuccagccugggcaacagagcgagacucugucucaagaagaaaaaaagaaaaugaagacaacucacagaacaggagaaaauauuugcaaguuauaucugauaggggauuuaucucuugcauauucuguauaaagaacuucuacaauucaauaauaaaaaggcuagccaauuaaaaaugggcaaaggaucugaauagacauuucuccaaggaagaaaaacaaauggcaaaaaaacacaugaaaagauacucaacacaucacaucacaucagccaacagggaaacacaaauuuuuaaaaaugagauauuaucagccgggcgcgguggcucacgccuguaaucccagcacuuugggaggccaagguggguggaucacgaggucagggguuugagaucagccugaccaacauggugaaaccccgucucuacuaaaaauacaaaaaaaaaaaaaaauuagcugggcgugguggugggugccuguaaucccagcuacucaggaggcugagggaggagaauugcuugaacccaggagguggagguugcagugagacgagaucaugccacugcacuccagccugggcgacagagcgagacuccgucucaaaaaaaacaaaaaaaacaaagauauuaucucauacccccugggauggcuauaaucaaaaagacaaauaauaaaaauaauaacaagugcuggcaaggauguagagaaaugagaaucuucauacacugccggcgggaauauuacacgguacagccacucugggaaacaguuugucaguuccucaaaaagcaaagcauagaguuaccauaugacccagaaauuccacucuuagguacauacccaagaaaaaugaaaacauuuaagaacacaaacuucuacacaaauaugcacagcagcauuauucuuauaagccaaaaaguggaaacaaaauaaacgcccaucaacugaugaacggauuaaugugauauauauguauacauauauaguggaauauuaguaauaaaaagaaaugaaauacugauacaugcaacugcugggauaaacuucaaaacauuaugcuaagcaaaagaagacagucacaaaagaccacguauuguauuccauuuacaagaaauguccagaccaagcaaaucuauaguggcagaacaauuugugggugguggggacgguaagugacugcuaaugggaacaggaauagaggaugaugaaauauuuaaaacugauuguggcaaugguuacacaagucugaauacacuaagaaucacugaauuguacaccugaaauaggugaaaugcauggcauguaaacuauaucccauuaaagauaguaaaaagagaaucagcauuuucauauuucaaacaggugcauuuuauguaaauuguaccuucauaaaauugauauacgaagggaaaaaagucguuuucuaaaaccauuccaauaagcagaguauacaugugauaauaaacccaguguccaugaagccugauaauagugucucccauuuugcucuacuccaugcauauaaguacauuacccuucuacaaaugcauccaguuuagccaguucaucugacaagccaaccaagacauccaacgugccaaccuaaaaggaaaauauauuguuauuuagguggcaugcuuuuuuaaaaaaaaaaaacaagaugauucaucuugaccuaaaguucucacaaaucuuaaauucucccuauuuuauuucauaauguguaaguacaguuaaaagauguuugccagacauuucaaagcuauuuauauguacaagauaauccuuuaauucaugguuauaagcaccacuuaagacuugaagacuccucaaagacaggucugugcuuguacuauucaaugacacuggaucauuugaagucuuaguuuacaacacaggcucuuaaguaggagguccacggaugugcgcuagagggucuguaauuaaauuugcaugcaaaacugugcauaagugaguacguuuuggaggaaacaucuugucucaaagguauccguaacuccaaaaauauuaaaaaucggucauuuuauugcauuuauuauuuauauuuuugagacggagucucacucugucucccaggcuggagugcagugguaugaucuuggcucacugcaaccuccaccuccuagauucaagcgauucucuugccucagccucccaaguagcugggauuacaggugcccaccaacaugccuggcuaauuuuuguauuuuuaguagagacuggguuucaccauguuggccaugcuggucucaaacuccugaccucaagugauccgcccaccucagccucccaaagugcuagguuuacaggugugagccaugaugccccaccaagaaucagucauuuuaaauauuucuuaaaugaaugcugccuacgacucccucauucaguuaaccagcaaaaugucaguaucaugaucuuuuccauucuuuacaaauguuccaucaacugauuacuggacaccugcuuuacuuugaggcugcuagaugacugaucuuugauaagagugaaucuuacauagauuaaccggauuaaauaacuggguuagauuugccaagugugauuaaguaggugccaugguaacacauuuacaauguaagaaucagcauaauauaaauuuacuaacaaaaacuucacuaugauauuuaagaauauauauuacuaagaguuuuaauuucugaaaaucauauuugugaauguaacacaucaaacauuuucauaagauuuuucauugcaauuuagaagagcacaaaaagccuaaguagagagacauuauuucaauuugguaguuuacuucuaaaauuucaaagaagacacauuuuaaaucaugccaauggcuggagaggagguuuucuuuggaaggaaccuggguaucucauuuccacuaaaagagagaacuggcccuccccuggaugaugaacucauauauaauuuugcacagugcagcuucaccuuuaagucaggaauauugaacuuggaagugacagcaagauuauuguucuuugaaguugccgcaugcaauuucucccauguuugcugacagguuuucuccccaggagcagauauaagccagaacucagucauguuuguuacuagguauuuccucaaaaaucaagagagauucugaaauguaaaacaaauaaaaaaaaucacauuuaaaaucauuuguuucuaaaguguuucagaaucauaggagaaguuauaacauauaaccuguuucaaaacuaaucuaauguuggcauaggaucucaagcaaagugaaauuuaccuaccucgaaauaaaucuacacaaauggugaaaaaacgauuuauuuaugauacuaggaaagugaggugauaaaaaccuaauaugugaaguaccuacuuuuuuucauuauaaaacauccuuaacgggaguuagccaagaagugagauuacccaaaauaccagccaccaauaguuuccuucaaccaacaaagcuggagaguuacaaauuuauagguuuaucuuaaacuuuuuuuuuuuuuugagacagugucucacucugucgcccaggcuggaguacaguggcauaaucucagcucacugcaaccuccgccucccagguucaagcgauuuuugugccucagccuccugaguagcugggauuacagccaugcaccaucacacccagcuaauuuuuguauuuuuaguagagacagguuuuugccauguuagccaggcuggucuugaacuccuggccucaagugauccaccacacccaaccuaucucaaacuuuuaaagcauacaaccaaaauaggaaauuuaaaaaaagaaaaaaaaagcauaacuuuuaucuuggagaaagaauuuaauugaaucaaugcauuuauaaacagaagucaccaaauaaauuugucacauuggcuuagcaaauccuacauggcuaguaaauuuggugguuaauucuaauccauagucaaccuagagaaaucuccucaaaucuuugaugcauagacuuaguugccaucgaacauuuacaaaucugaaaaaaaaaaaaucuugccaaucugcuuggcuauuuuaaaauauagggagcugagaggguggcguuaauauaacauuuuuggaucugagaggcaggcugcaguucucccuuuccaaagagucccauuaagauucaccuaacccucuucuauaaucucuuuuccuccuccuccuccuuccccuucccacacacacagaagggggaaaaaaguacagagacaaaucuauucagaaucuagguagguaaagcacauaaacacaaaugauaaaaaucaaaguauuaugguaucauuauuuccauuuuaaucugccuucaugagaaccaacauaagcuuucugcuaacacugcuuauuuaaccucuccugaaacuaauauucaaugucucuaaauugaauauaacuaucuuacaaaguuguccugagaacaaaaucagauaauuaaugugaaaagaguuuauaaauguaaauuuccuuuaaaauguaaaguauuauaguuaauaauggacuuucauaauuacaguaguccuaaaauuuaauuaaaguaccuacuuaaaguaccuaugaguagguaaucaaugcuaccuucucacuacaauaccauugaaagugaacuuaacauagaugccauccuauauacuuguuaauuuuucuaacuacuguuuauagaggaucuaccauauaaaagguacugcuuuaaaugcauuauuaucucaauucaucuucccaacaccucuacgagguaaauaucaugcuucccauuuacagauaagaaaugcagguuaaaccugguacagaugcagacagugguauuaaaugaauguuaagaaacuauauucuagaaaaaaaauuuuaaaaaagaaacuguacuguauauggacuuuucuaacauuacugaugaaguuaaaccuuuaucagcucuaccuacaccuucucaaaugaaagagcuacacuuucccaaauggccaacaagcuaaacacaagcuuuuuagugacagcccgucuggucagagaacagcacagcuuaacuggccauccaaggauggaagcuacucauaagcaccaugcucuaaugaggccauccaaagauaaguuuugauuucaaaacagaagcaaaagcaaaaucuucauuagccuacccaagaaacuucaaauauugaacuuuaaggcuauuauacuaucauauucuuuuccaaucugauuuuuucauucaaccuauuuuuagaauuauccagugaucauuaauuuuaauugauauaugguauuccauuauaugaauaaacuaaaauuuauuaucugcuucuuccuggaaugacuuaaauuguuuuuacuuuuuugcuauuauaaacaauucugcugugaacaauguguacauaucucucuaucugugaaagauuuuuucugggauagauaaaaguaaaauagcugaauuacaggauaugucuucaaagauggaggcgagaugucuuuccaugcuccuaugcagugugacuuugccacuccuuccaucaaaagguggagcuggccuugugacuugguuugaccaacaaaacgcauggaagccacacuaugcgaguucagggcucagaccucaagaggccuugcgucuuggaccacugcccucagacuaccacauaaggaagucuauugcaagugauaaggccacauguagagaaccaacaaccagcaugaaccaccagacaugugacugaggccauuuugagcccuccagcccagccaaucucccagcugaaugcggcugcaucaaugaguccaggcaaaacaagcagagggacuaccccagcaacucacagaauuaggagaaauaagaaaucacuguuuuaagccacuaaguuugggguaguuuguugugcagcaugagacaacugacacagaccacugccaacucuuuuggguauugccaaauuguucuccaaagccccuaccaacuuaaguuccugccagcagaguaagaguuucuauuuccacaacugaaaaacacauaauaguauauaguguucagaguuauauauacuuacagaaaauacuaaaauaugcauaggagaaaggagcuuuaguuuuguagguaagauuucauuuaaaaaaucaggcaaauagagcaaaauauucauacuugcuaaaucugcauggaugacauaauuggcaauauuuaacauuuuucuguauaucugaaauacuucaaaacuaaauauuuuuaaaauuuuuaugagaauguauuuaauuuacaaguuaaaacauaacauugcauggcaaauuuauuaaaaauaaaauuuuagugaacuuuaaaauggauauucagagaauaaucuagauaccaaauuaauccucaaaguacaaccuuuuuguuuuacaccuaguagaaaugcuuacuaguuuguuuauaucuucuuaugaccaaguauaauacauugcagacaaugcuuuuagaguuugggauuuauuuuaaaaguauuuuuggauccugaggcaggaggaucacuugagcucuggaguucaagaucagccuggucaacauagcgagacccugucucucuuuuuuuuuaauuauuuuuauuuuuaaaaaauaaauuuaaaaaaguauuucgggggucaauauguccaacaaucuaacugcauaauguugcaagugugggaguucaggcuacaccuguacuaacuccagaaccuaucucaagaaguugcuuuuaaaaauaaaucccugcugaaaucucguggaccuauauccugucuucuugucauccugucucuguucuucacaacaccuggaucacaucaccaccuaucgccgguugcuuccaguuaauacucucgcacuuagcgaaucuagcuuuuuuagcacaaacugucucgaacuuuaacauuuucaguuauuagaaaaucuaauagcaucuuuaaaccucuuuuuguaauccagaucuaagcgaucgugguuucuggaaaaauugagauuuuauuauaauaauuuuaugcaagugguuuucuguuaguauaucaaaggauacauuuuuauaccuccucuccccccaaaauggcagguaauaaaaucaacuguuaaauucuuccugaugauugugcuaaauuaucuaaacugcagcuuccucaaagauuguaauaauacaagcuauuacaguagaugucacuaucauacuacuuagaguuccagaaaaucuuuucuucuaacaggcuuccaaaggauuucaaggaauaggaaagaggaccccauuucucaucuauaaauaauaccugcccuaucuacuucacugagcuuuuauuaggaucaaaggaaauaaugucaugauaaauucugaucaaaacuacagucuaaaaauaugauagaaguucucuaauuuagcuuuuaaaaaauuuauuuuuuguagagauggagucuugauauguuguucagguuggucucaaacucccagccucaagcaauccuccugccuuagccucccaaaguguugagauuacaagugugagccacugugcucauaauucuagcuuuuaacugagaccucccuagagccuagguguuggaagaugaggaggaaaggaaggaaaaggugccuucuaagucugauguugugcuuuucacuucucauacaucauuuuauuccauucucacuacaacccaugagauaggcaguaauacacagagagguuaguaguuuacccaaggcugcacgacuggcagaugggguucaaauuuaguuguguuugacucuaaagaccauguucucucuauugugucacacuaggagaaaagauguucugugcucuggugcaccugggcucuccuauuugaagagaaauccacauguaagcuucaacaccuucacccuguuugguuccaggcucagggcacccuguugguccagugaauucugauaaagggauccaagcuuccuuuccuuguucccuucguccaggaucaucacaauuucuaaaguagcaucacccagcauccaaaacuauccuaccuucuagaaggaacaacgauuccuccaaacgaaaggacacacacacaaaauucgagauucaaaguauacuuugagacuagagaucagauacuagagauucgauggaccugccagaucauggaggaaggaacacaaacuuuggaguccugcaacaguuaaaacucugacucuacccccuuacuaguuuccucaucuguaaagugggaacacgacacaucuuuucacccagcuguuggaaaguaugaauaaaauaauguaccuagaccuuccccuuuccaugcggccgcccuuccugcggaugauuguauuagcugcugccccaccccauccuaccucccaagacucucccccguaucccagaugagaaauauccuuugcuuacuuauacuuuauaaaugccccuacuacgcacucaucguauucucccucauuuuuauaacauauuuuccucuccaccuuacugagaaauccugaagagcuagaaucauaucuucuucucugugaaacccugagagccagaauacacuaaauuccuggcaauagcagggacuuaauaaaugccuguugaauuaauaaauaaaauucaaauucaaauacaacaaugauggaaccaaucaaaacgucugauuuagagauaaacgcaaaaaaaaucauguuuuuuaaaaguguuuuuuagucuuccagaaaacccuuauuuuacaguaaaaauuaaaaauugguagaguugcagguuccuaaguaagccuuugucuuuuaugucaagggugaauaaagucaaaaauauaaaaaagaggguuugauaaagaaccuaucuguacuucaggcaaagccauggccucaguucuucuaccccucgucaaagcaaacuaacucuaaguaaagagccuaacaggaaagacaagcuacuuaaguaccuaaggaggaauguaacaacuuccuaugacaguuaacaucauaaguauuuugcaaaaucuguuuuuuccauuuuuaaacuaugaccgcucucaacuugucacuuacacaagucagguaaaaaaauuucuccuugaggccaggcacaguggcucacaccuguaaucccagcacuuugggaggcugaggcaggcagaucaccugagaucaagaguucaagaccugccugcccaacaugacaaaaccaugucuuuacuaaaaauacaaaaaaauuagccaggcaugguggcaugcgccuguaaucccagcuacucgggaggcugaggcaagagaaucacuugaacccuggaggcaaagguugcagugagccaagauggagccacugcacccuagccugggugacagaccaagacuucaucucaaaaaaaaaaaaaaaaauuauccuugaaauuuaagaacaauuuaaguuuaguuucaaacaaaauuuaucuuugcagaugaauauguaugucuuuauucaucggaaaauggaauccauauugcuaaacauauuucccuuuuucucucagcugcaaggaaacaaauugucaaaauuaguggccauuuguuaucaacuugccaagaaccugacaccaccuucuccacugcuuguuuuuacucguaauuauuucccuuuauuuuaucuugaauacgaaggaagucaggccuaaauguagcaaaaucauaugcuaaacagaggagaugaugaucaaaaaggcacccugauuaaaucguaguuucucaaggcucagauccaggucuauguccuucuucucuuucugcgugugugugaauguguguguauagcaccuuucuugaugaugaucucuacaguugaggcaauucuagucuagaugcuggacacuuucugaaauguaugucuccagcccagggcccucugcagcaucuagaguuguacucaaccaguauccacaucugacuacaagacauuuuccaccugaaugucucaaaagcagcuaaaacccaacacuucuagucaaacuuaucaucucuuccccaauauguaguccuacuccacuguucccugaguuaguauagguguaccccugcaguauuagacaauuagaacugucaaauguucauagcagccaacacuuacugggcacuuccuaucuacuagcacaagucaaaacacuucacguguauuaacucacuuaguaguuagagaaaccccauuagagggguaguaguuacaaagaaaccagggcacauaaagcaucuuauauauuauacaagguauauuauguaguaugugucucauuauauaucauaugacagcauauauuauaugcuaaggaugaauguauuauaugcucucauagaaccuucuuuguaguauuucucugggggugggggagcacuuuuuacuaguaucugucuuucaaauaaacugcccaggacgguaaguggaaaucaugauaguuuuugcucaccacuuuauccucaguaccuggcacagagaccagcaugguagaaucucagaagauauuugcugaauauucuucaauaaaaauuacugugaggauuaaaugagauaacaucaagcaccuggauuauaguugguuagcuucccucacuucccguuuuuucuauaaaaucaacuuuauuaaaauauaauuuauauagaauuaaaugcacccauuguaagaguuugaugaguuuuugacaaauguauacaccugugugagcacugucaaaaccaagauuaaggacacuucuaucauccccaaaccuucccucacacucaguccagucaaucccuaucucacugccagcccugggcaaauguuggucugcuuucuguuacuauagauuaguuuugccugaucuagaauuuccuuguaaauggaagcaugcauuagauacucuuuuguaccuggcuuuugcucagcaagucuuugauaucuguccguguuguauguauuaguaguucaaucuguuuuauuacuuaguauucuaccacauacaucuacuauagucuguucauacauucaccaguugaugaacauuuggauuguuacuacugguuugggaccacuaagaauagagauucuaugaacauuccucuacaaagcuuuuugugaagauauauuuuucucuuggauaaaaaauucuaaaaguagaauuucuaaguugaaugaucaauguauauuuaccuuuauaagaaauuggccaggugugguggcucacaccuguaaucccaacacuuugggaggcugaggcagguggaucacuugaggccaggaguucgaaaccagucuagccaacaugcugaaacccugucucuacuaaaauuacaaaaauuagccaggugcgguggugcaggccuguaaucccagcuacauaugaggcugaggcacaagaauugcuugaacccaaaagguggagguugcagugagccaugccacugcacuccagccuggacagcagagugaggaaagaaagaaaagaaaaagaaaaagaaaaaaaggaaggggaggggaggagaggggagacugacaaacuguuuuccaaagcagauauauaacauuuuauacuccuauuagcaaaguauucagccuccagaugcuccaccaacacuuaguguucuuggccuuuucauuuuuagccauuccaguggguugcaggguuauguugcauuuccaugaugcauuuccaugcggacuaaugaaguucaggagcucuucauguuauuugccauuuguauauuuucuauucaagucuuuugcccaguuuuuaaaaaacuggauucacuuauugaguugcacaaaauuuuuauaugaucuugacacaauuuccuugugaaauauauauacauauuuacauauuuucucucauucuguggcuugacuuaaugaugcuuuugaaaagaaguuugcaauucugccaauguccgauuuaucaguuuuuggguuuuuuuuguuuuuuguuuuuuguuuuuuuuuuacaauauaugcuuucuguagcaugugaaaaaccugccuaucccaaggucacaaguauuuacucugcuucgaguuuguugaguuucuuggauccauucauaguuuucaucaaauuugaaauguuuucagccauuauuuuuccucaauuuuuuuugccuucacuuccuucuuuugaaacaagaucacauguauguuaaaccacuugauacugcuccacaggucacugagcuuucauucauuuuucucaguuguuuuucucacuguguuuuacuuuggauagugauauaguuuggaugucuguccuccccagaucucauguugaauaaaccccaauguuggagcuggggccuggugggaggugucugggucauggggcagaucccucauaaacggcuuggugcccucccuguaguaacguuaccuugaaaucugauuguuaaaaagagaaugcccuccccauaguaagaaguuaucaugagaucugacuguuaccuucccccugacucuugcuccuucucucaccaugugacacuccugcuccccuuccccucugccaugacucaagagcuuccugaagccucaugagaagcugagauccggaugccaugcuugcacagccuacagaacuguaagccaaaaaaaccucuuuucuuuauaaauuacccagucucacagauuccuuuauggcaacaaauaagacuaacacagucucuugcuguaucuuguaguuugcugaccuuuucuuuggaguaucuaaucuguuauucuucucaccagugaauauuucacuucuuauguauuuuucugcuuuaaguuccauuuuuaaaauaucuuccauuucuuuccucauuauguucauguuuucuguuaaaacacugagcauauuuguaaaaaugcugcacuguguaucacuggacuuugcugucuuccuuuuaagaguguuguacuuuguuguggugggcagguaaguuaggggaggaucagcuugauccacccaaggcuuguuuucaaacauuguuaggauagaucuaaggccuuacucuagggcuaacuuagucucugauacuaaggucuaaccuuuuggggauucuauugaaugucccagguauucaauaaguucucucucccauaucuggucagaauucaaaugccucccagcaccauaagcucuggcaauucuucaguuuaaagcucucuggucauucuuuguuagaucuccugcagagaccccccccauaaguuucugguguuuauuucucugccuagcucccucucucugucaaucccaccugcaaauuccagccagauaaaccuuccccaaguccagucuccucgacucagcaagaccaagaugcucugcacggguguucccuuccuaaaacacggugcagagagugucuacaggaaaaagcaggaggaauuacacagcucauuuccuuucgcucagcuccuguacugccuauuguccgaugucuggaagcaguuuuuuaauauaucuuguccagauuuguaauuguuuauggugggaaagcaaauaugguaccaguuacuccaucgcagacaaaaacugaagucucaucugguuuuguuguauguauuauucacgaguguucgguuuuucuaauuguucugauuguuucuaugcagggauucagccacaaccucacagccucucucagccccauguuuuaacauuuaacagaaaacaggacugacaacaauaaaugccaaaaauuuaccaaaucuaggcuaaaagacuggaguacuacuguguuugugaaaaauggaacacaaugaacauguauugcuuuuguacuaacaaggaaaaauguucauuuuuguuuaaaaaaaaaaaacagcugcagcuugaauaaaugucuccaacauucacuuaugugccauuaauuugcaaauguauggcgugcuaucuugauaaguaaaacaugaauuuauuuaaaagcauuaauaggcuaggugaaguggcuucacaccuuuaaucccagcacuuugggaggccaagacagguggaucacuugagcucaggaguucaagaccagccacggccaacauaguaaaacccugucucuacuaaaaauacaaaaaucagcugggcaugguggugcaugccuauagucccagcuacucaggaagcugaggugggagaaucacuugaacccgggaggcagagguugcggugagccgagauugugccacugcacuccagccugggcgacaaagcaagacuccaucucaaaaaaaaaaaauuuuuuuuaaauaaaauaaagcaugaauacagcuguaacaauuugucaucauuaauaaaauaucuaaaauauaucuuagauauacuacaucaucuauuucuaaaauaaucuaaaauaauuacacaucacaugggagcccaagaaaauucugcagaugagaaacaacagaugggcugggugcaguggcucaugccuguaaucccaacacuuugggaggcugaggcggguggaucaccugaggucaggaauucaagaccagccugggcaacagggugaaaccccuucucuacuaaauacaaaaauuagcaagacacgguggcacgcaucuguaaucucagcuacuugggaggcugaggcaagagaaucgcuugaacccaggaggcagagguugcagugagccaagaucacgccucucacuccagccugggugacagagggucuugaaaaaaaaaaagaagagagagagagagaaaagaaggaaggaaggaagaaagaacaaaagauagacaauuucuggaacacaauuuggcaauauuuaucaaaacccacaaaaugugcauauccuuuggccuagcuaugccgaucuuaagaaagaaaauaaggauaugcauagguauaaacauuaaauuauaaaaaaaaaaacugucaacaauuaucucuugggagugauuaugaauguuuguuuucauccuuucuguauauuuuuuuccuaauuuuuaaauaauaaauuauuacauguaaacacaaacaaaaaaaugucccaccgcauccuuauuagggcaguauccucauauuugaaaacacugaaaaguuuagagaccauuaaauggcaucauaacaaagagcccuggaguucauacaaaagagaagggcaaagcugguuaauuguagcuacuucugaagaugugaucaaaguugguaaacggcccuuuuaccucacugggaaucauagucaaagaaaacccaaaugucaauuucaggaagcacaauguaaucgccagagcacugcgcugaggauaugaagacuuggaaucuaaucccaguucugcauauaauugucugcauaaaugucuucacuuguaaaaugagaggauuggauuacaauauccaggauccucuucugcuccuauacucacuaccugaaccuauacuaggugaggcccaggauucuuuuuuccuauuuuaagucccucagguaauucacccaaauuucagaaccacuguaacaagacaggcauuucuaugauuauacaguauauuuaauguuacaagaaauggcaauacucuugaaggcuauggacagaaggcugaacaacucaccaaaacagacaccccuaguccugcuucuuucuuggaaacaaaacucaaaucugccaaucuucacugucaucacuacuagcaucccugucugaguuuuucugccuuauccucgcauuccuccugagcucucuuuauccaucuugaccucaggccuccuucccuuuccuacccugccuuugcucguuucgcacaaaacaaauuucucucuuccaguuuaagccaacccaagccucccuuaacaaaaugauuuucccaacuaaguccauccaugcaccaaaccuguuacuauaaucccacuacuucucccacaugucuacuuacacucaugucauuaacagcauuaggcagacaucuauuuuauguuuugucacacaucucaucugacuguaacuguucucaauuaaagcucuuauucaucucacaaaauauuuuggguacuuaaguucccaaaacuguaauagacucugagaaacaaaacaaacaaaauguagacccuguccucauggagcuuacaauugggggugggagaggguggcaggucuuacgagcaggcaggucugugugugugcagggagggugggaggaagacuucauguagaugucaagacagaaaaaaacacugaagaacauagggaggcacaagggaaacacuagucaauucuguaggcacuucuauuuugucugacugcaauaagugugcugcuuaaaaaaaaaaguaacaauuauuuuucaacauggaagggaaaaaagugggaggaaaggagaaaaaaaaaaaacccuagauccaaagcuaugggacuguuaauuuuauuuacuuuaucucccacuucugagaguuugaaggcuauggauuauuuuccuaccacaauugauuugcauauaaagacaauaaaacaauaacuauuacaacauaaaaggugaggggggguugguuauaagccugaacaagacaucugcuggcacugcuucugugaauggaagguaugggauugacccaagauaggggcaaccacagaaaacaguaccgcacuccacuaagugcuccgacacuuaacugauuucaaugcuuucaagaaaaccaaaccguggucucugaaaugcaaucaccuuucacaguaaauuaaauuucacaauaaauuaagccuagaagguggucuccaugcaaaacaacuuccuuuucaguacuugaaaauaccaaguuuacuaaagcagcuuauuuuaagaagcacaagaaggcauaccucagcuaucagugaaauaucacauagccuuccaaaugugcacaucaacuuuuaacagaauugaucugugcgaaacauuuaccacaauccacucaguuaaaaaguugccacauccuacccuagaaaucacuaacaccauacauauaaaaaguaaaaauaacugcuuccucuuugaauguaaaaauucuauccuucgaaacagaagcaucuuaauugggauugugggaggggcuugcucauaauacaacuuguuuaaacauuuucaguaacuagaagggggauuuuaccuuucaaggaauacguccaugauucauacgaaaugagauuuuaaaacugucagaaaauaugccuuuuuauuuuuuuuggagacggagucucacucuguugcccaggcuggagugcacuggcgcgaucucggcucacuguaacuucugccuccuggguuuaagcgauucuucugccucagccuccugaguagccgggauuauaggcacgagccaccaugcccagcuauuuuuuguauuuucaguagagacaggguuucaccauguuggccaggcuggucuugaacuccugacaucaagugauccgcccgcccuuugccuccgcuucccaaagugcugggauuacaggcgugagccaccacacccagccccgccuuucuuaaauaaaucuuaaauauuccguguuuuguuuucaauggaaacaauacccauaaaugcucuauaauccuauuaaaacuaccauaauuucuugccauaaauauacuuaaauaugaaaggcaauuuaaucuuuauuagacucauuuuaucaacuacaauuuuuuuauuccacauuugccuagaaagcaaucuguaaaagcaaagccuuacuuucacacagauaccuaucacaaaaacuggaaacacacugugacauuguggagugggggcuggggauguaauacauaauacaauguuggaaaauuucuaguaacuucugguaaagcuacugaauuggcagacauggccaggagggcccugucguacacccauuacugcaaguaaucaccaaaaccuucucagcuucuagagacuccuccucugcacaggcaacucagcggugacccagugggcaaauaauuccuuccaugccaggggauucccugaaucuacacucauggcucccaaaacaugacuucccuuuucuucauggcuggcaauuuauaauagugacuggaccacgguaccacauucugcuagaaggugcugauaucuccaauacaauguauuuuggccugaaauucaccaacuuaaagacuuuaagauuaguuuucuccaacucaugacccuaaguaagcuugagauucuguuuacugguaacaacuaucacugaauauguaccacauguugugcccagugauaagcacuugcaucuacuaaagcaauuuuguauuuaauucccucacaagauguguuaucaccacccccacuugcaaaugagggaacagcuggugaaauuaguugcccaaagacauuuagugacuacauuuuauugggauuaaggggacucuauuugaguuauucaugcaguuuuacaaaagacaagugccucaaagaaauauuaggauauaguuucaguaauuuuacacuaaaggaguuacauuaaaacaucaaacacuagauuuuaaauuacuugaauuccauuauaugcaguuuauuaaaauauuacuuuuaaccucuguaaccucaacaucuuaauauuuguccaacaaauaaacugacaccacaugcauguuuugcaccaaauggugccucucuccuccaggaggagucuggaaauguaugggagcauuuuggguugucccaauguggagaucgcuaaucagcauuuaguggguaggggcgaaacagaccuccaaacugccaauagcacccacauagaaacacuaaacuaugggcugauucaaaaggaaaaccuuucaugguaaaguuaaaccaccuguuaacacgccuuaauuuacaacuuccuauucauugauagucuguuuaaaauaucuuagaagauccaucgaucccuuucuauaaaacaucacuuaccuagcauuuuauuuucaaauacacacacauacucacacagacacacacacacacaccccacauuuuagauauacaguuaauacucuuuuauccccgauguaaccaaagcacuucuccuccacugccuaccuggcucauuuuuuaacucaauaaaugcauaguaaccaaagcaccucuccuccacugccuaccuggcucauuuuuuuaacucaauaaacgcauaguacauuugcacaugguauaaucuuagaaguagauguccugcuggauaaaaaauuuuguuucagcaucaagaauauaguuugaaauuucuaguuccaagaaucacucaugucaauaggaaauuuuagacugccuugguucacugccuaagcgucccaagggcacuaugcuaauguuuauacuaugucugucuuuaaaaauugaugaaaaauggaaaucuaacaugaauuaauuuauaaaugauauauaauuccacacccaaagagugaaaaagauguaaccuguagacagauuuaaauauguacaagagcaaaauuuuaaguaggagguacucagucaaaacuguaguacuccuaagcagaaccaaguucaaaagaagacuugcugcuuagggacggguaaacuacauggagaccuuuggcaaagguuuacuuuggcauuccaguuggccaaugguauuaucucgugaguuguggaaauaaucacaaaaucagauuuuugaagcccugaaguuucuuuuuagguugaaaaaacuaauguacaugaggcuccuaagacuaauauaccaaaaaaauaaaaaugaguauuuugugccaaguuuuaaaagcugaauuacacuaucuagcucucagcauuuaguuagauccugaguacuguuucuuuagauuuuaucuagucccuacaagguauaccaaaagagaaaaagauccaggacuucugagacagaacccugaggcucagucuucagcauaauuugagacucacuuuuugccaaagaacugugauugacaaccugagcacuuucaguucaccuuauuguucauuauuuccuccagaugaacuguaaauugaacagcucuauccaagauuauagauaagacauagcccaccacugccaauuccuuugaagcuguucuacuagaaaaaguucaucaaaagugcugacucuucagggagaaguuccccccccccaaaaaaaaaugcugaaucaaagacuacugugcacuucaaaaaacucgcccuuuucucuagaugugacugugguuaguacuguguagguaaucagcaggaauacaucagcagucagaaaacuguggcaguuacuccggacucagccaaaucacuuuacguguuucucuagcuccagguucccaucuauacaaugaauagcauuuucauccacugucuuucaaagaacugugagaacaaaauaaauaugaaagugaucccucccuguaacuauauuucaauaaaagauauucugaaauagaugaccuuacaaaaggauaaauuugaaaagccaaaacaaauuuuugcaaaagagccucugcuauguacuucaggacugccucgaggguaguuacgacuacccugugaaggguacaaauagaaucgaaucauucuuucccuuccccaaguccugaacccucuaaaagugaauacaguuaaacauucugaaguccucaguggagagagaagguaucuugucuucaaauccuucaguggauuacaacaauguuccccugagcgggucuccccucauucacuuuugccacccuccacauuaucucccccccaccaaaaaaaaaaaaaaaaagccacaaccugucucaauccacugccuguaaucuucacuggcuucccucuguuuuuagaauaaaagcucugcuuggcgugaccccagcuuucuccaccugccucucucccuccccguuucagccaugcuagccuuucaaaaaggcugaaaagcuuucuuccucuucacauuucagggccuugacauacgcuguugcuucagccugaaauguuccuuuuucguuuuucagagacagggucuagcucuguuucccaggagggagugcaguggcaugaucacagcucacugcagccucgaacuacugggcucaaaugauccucucgccucagccucccgagcagcuaggacuacaagcacacaccaccacucccagcuaguuauuuuuuuauuuuugguagagacgguggucucacuauguugcccaggcugguccugaacuccuggccucaggcaauccucccaccucagccucccaaaauguugggauuauagucacgagccacccugccaggccuggaauguucuuuucacucacaccuucacauucccuuuucagucucuuuucagaucucaggucaaaagucauacccucucagagcgagaggguaugaagaauauaaauaaaauuguuuuaaucuuuaaaaagucauauucuuagcaaugccuuuuuaaaaucuuccauaauacacaugccccuacuacacucuuucauaccacuguuauuccuucaaagcacauuucacgcuugcuugauuuuuaaaauccauccccucugcuugccuguaagcucuauaaagacaauuuucuaaacccuaccaucagcacuguaccugcauacagcauguauucaguacacauuauuugcaugaauaaguaaacgacuaccauucaaaaguccucguuaccugacucccaacuuucuuucccacuucuccgcagugcaauccacuguaaaagcuacuucugacuccaccagaagcauucccuacccccaucuucaggcuuucaaauccuguggcuuucccugccuguaaaauuauccccauuucucucaaccuguucaaauccugagggcuugccaagacucaaguuuucuuuccuccagaauaucuucccauagugccaguuuacacaugugucguugcuccacacuuucaaagcacuucgcauucucuuuuugguaaguauacauaaacugcaucguauuuuaacguguccuguguguagacuuuucucuccaacguuagugcuaacuccuaaggauagacuguucacaucccacccguuccauucccagagcggcgcuaaguacugggcucgcacugaagcaugugauuuuucccuaacauaccagaauuuuccucugaaaagaauacuagcuucccccuuacuccuguuucucaagugauucaauaugccuuaugugacucucaccaaguucuuuucuagggguuuguuuuguuuuguucuguuuuguuugccuacccucccccauucuacuaaaaaauaguugaguucucuggauuccuguucuuucucauuccuagagggaccuuguguacucugugaggguuccuugccugcaguuaggggcuccuaggccuuuaaacugucaucccaccacccccgacccccgacacccgcgccccccccaacacacacccagugaaggcacuugcgcuagcugugaccucacacacaccacuccauagccucaccuggaccuaucacuucauuccccucaaucaaucaggcggcgugcauuccuacccaagaagaaagaucccagaccgcuguaucucuccuuucugccugucauuaacuacccacgagagcucuuucucuuuuucccuccuucucuuccuuagagacggaaccuaggcccaagacggugaauuggcgccgagaaaccagacacagccacccagccagcuccagcuccaacgccacggucucugcccccgcacccacccgcgucccucccaggcagcgaccggagcucaugcuucggccugaccaggacuccccauccggggagagccaucgcucacugacccaggaaggugucaaacgaggaaguagcagcaguaacagguaccgaggcagacagccuagcggacgcuaucggcucagcgauccaucccuucccgaccuaagcuccggccucacggcuuccucuacccaagcgaacacagaacaagucacgugccagcccagcagucagcugaccgcggcgcgcgcugcuccgccuacgcccgcgc

SEQ ID NO: 192542 - RNA, 28739 nt, Homo sapiens
aaaagacggaggagauccaguucgggcugacagugagaggaugcagcccggugucugggcgggcucuuaccggcgaagcggaucuucacgaggucgagcggaugcagcgcaagguuggauaagacgccgccgcucacgcccgcuaucagguucucauaccggacguggcggaauaccgugcuccacgccgacgacccggacgccgacuggcccuggcccgucauaggcucggggcccgucgacaccacggcgcccagggccgcggaggugggacgcgaugcaguggccgccaccguggcgacggucgccccuugugagcgcaaccccaccuccgggaccaacgagaggacucuuaugcccaaggcgcgugagcgaagccggagacucuaguacugagggggcaagaacggggcacagacacuacgucacgccggcggaaagcgcgauggaggggaggucccagccucucccgagucuccgcccugccucgcccacaaaugcuccagcccacggacgcggaagcgacugcacagcuaaagaaccgccccuugcuaacguuugccggcaaaacuacggagcggcgcaggauccaguugagccagcaggccgccgcuccgcgagucacgugacuggaaguagucugggaaaagcggaagucgccugugggaggagguggcggugggcggaacuccuagcggacaccucguggaguccggccggaagagcaaccgagaugaaggugaagaugcugagccggaauccggacaauuauguccgcgaaaccaaguuggacuuacagagagguaagauaaguugguagggagaaagggacgguuuccgcaagucguugggucuagccucggcuuucgcggaguaaagccgggggaggcuggcacucuggucugguucuuucucaguuaccuuucgcuaaggcaaacuuugugcuuacggagucgcugcggaacuggauggauagcaaguaaagucuguucaaguccuuuuucuaagaauuuccucuaguggugagugggaaacaguugucuauaguggagaaaaauuccagcugcugcucugggauugucuucagguuccuauuacugaaaaguggacuugaaugagccaaacucguggguugaagggcugagaguuaaacaggcuuuuaaaaccuuccuacugcucuucuugccgcuuuacuacuucacauuaguuguggauguuggaagagacaaagaugaauuuaaaagcaucaguuuucucuuaccaucccuuaagaaguuugaugaaagaaugguuaaaugaaauuaauuuauccuuccuggucuguucccccguuaacaugcuaaccacuuauaaauuguacuuugugauaccuaaaugacaagggaccaaccaugcguaagcagauuguucuaaauaaagagaauaacaggagcaaaggucuucaggcaggaaugaaccuaaggcauagaaagaagggcugugucauuaguuugaaugaggaguaagcgagaugagaugaggcgaaaacaguauuucacuauuuugguugaguaggagauauuaucaacaugugugugagcauugcuaauaagucucugcucaaaagauguuuacaguuugucacaaggcaguaauguuucuaaaauauaaauuagauuugucacuuggauuuggcaucguucccaguccuugaaucucuggucccaccuuccuugccacuuuagucagucacuacguuucccacaagugguuuaguauucacccuugcaaaucucagugcguuucagucaucuuuuuuaaggccuccuguggcacacacccuuacccaguuuagccgcuuucucuggaagacuuucaccgaacaguaaucuguuccugcuuaccuccugcaugagccccgcccccuucagcacccgucuucugugauucuaucacuucuucacaguguuuaucacauugucucaugauuauuauuuugguuaauagucuuucccaucagacuuagccuccaaaaaggggaagaaucauguucguguaugcacuguuaagacagcaccuagcacauaguugcuuuaauaaaugucaguuucuccaucuauaaagauucauuuuugccuacaugaagagauuuagaaacaaaaugaucuaucuuguugggguuuuuaaacuucuguugaaauuauuaaaaugcuaauuuuaguuguaggaacagcugcugacaucagaguagauagaaauuuucuagacuucaaaaauaaucuuugcaaaacugauggaugagacugaaaauuaaauauauuaaauaaacguggccaauuauggacauuaucauuuuggguaugcuuucuuugugaaguacaggcauucugcacuuugcacaguaccauauuaacugaaccagucccacucuuuaagagguuuacagugauugaaaucacaucuguuaaccacgaaacuuugcaaaguggggaauugauuccaguaugcaacccgucccguuaauacaguacagugcgaaagugaguacugcuugaauuuuuuuuauaauaguagccauuaaaaccaaacauugaauuaagcugaaauuagaaccuuuaaaucuaucacaguguugaaucaagauuuuucuuaaaaaaaaagaucuuuggcugggcgugguggcuuaugccuguaaucccagcacuuugggaggccgagacgggcggaucacgaggucaggagauugagaccauccuggcuaacacagugaaaucccgucucuacuaaaaauacaaaaaaauuagcccagcguggugcugggugccuguagucacagcuacucaggaggcugaggcgggagaauggugugaacccaggaggcagagcuugcagugagccgagauugcgucacugcacuccagccugggugacagagggagacuccgucucaaaaaaaaaaaaaaaaaaagaacaucuuuaauuacaugcucucauuaacauacacauauguugagaagggaucugcucaaaaacucuguuauuaauggggcacacagaaaguuugaagacuacuauauagggagccuuuggaaguuuuaagcaugggagugacauguaaaaagcuguuuuaagaugacaucugauaggcugggcgcaguggcucacgccuguaaucccagcacuuugggaggccgaggcgggaagaucacgaggucaggagaucgagacuauccuggcuaacauggugaaaccccaucucuacuaaaaauacaaaaaaauaaauaaauuagccgggcaugguggcgggugccuguagucccagcuacucgggaggcugaggcaggagaauggugugaacccgggagguggagcuugcagugagccgagauugcgccacugcacuccagccugggcaacagagcaagacuccgucucaaaaaaaaaagaaaaaaaaagacaucugauaauaguguaaauugccgccaaaucaaguagggaugauauuaaaguagcccaaguauaagauaaugaagacccaaacugccugggaaugcaguggcucacauucauaaacccaacacuuugggcggcaaaggugggaggaucucuugagcccaggaguucgagaguagccugggcaucauaaggagacccccgucucuacaaaaaauuuaaagauuaauggggcaugguggugcaugccucagguccaagcuacuugggaggcugaggugagaggcuaaggugggaggaucacuuaagcccuggagguugaggcugcaguaggcuauagucauaucacugcauuccagcuugggugacagaaugauaccgcaucucaaaacaaaaacaaaaacaaaacacaaaaaacuagaaauagagaguugaaagaugaguaaguguugcaaagagaugaugaguaggacuuugaguuuugguaguagggaauauggaagauggaauacauaagaaugaccuaggcuagagcuuuguugaauguuagauauaacaccauuaccagggagucagaaagaaacagcaggaugaagucaugggguaagaagaugcauuuacuuuuuacucacugaguuuuuuuagacauacgagcuuaaaauuacuuucuaagcauaauuauauauauauauauauauauauauauauauauauauauauauuuuuuuuuuuuuuuuuuuuuuuuuuuuuuuuuuugagaugaagucacacucugucagccaggcuggagugcaguggcgcgaucucggcucacugcaaccuccaccucccagguucaagugauucuuuugccucagccuccugaguagcugggacugcaggcacauaccacccccaccgcuggcuaacuuuuuguauuuuuaguagaugggauuucacugugguagccaggauggucucgaucuccugaccucgugauccguccgucccggccccccaaagugcugggauuacaggcgugagccaccacgcccggcccuaagcgugauuauuaaccaagacaauguguuuagcagcguaucaggacaguuaaaacauagauucuggagccauacugccuugguuugaauccuggcuccaccgugucguauucgaguuacuuaaccucuuuaugccucaguuuucccaucaauaaagugugagauaguaauagaacuuaacacauaggaugcuguggagauuaaacgguuaagguuuuuggaacagcgccuggcacuugaacucuuaugugagucuuuuuuaaguaaguaaacaaacauagaaagugcucaguaaaugauagcuauauaauaucaucauaaucacaacuucgugugucuaucagcacaguauuuagcaccagagauuaauaauguucccugcccuacaggaagcuuagaguucuguugagcaaacaucuugcacauauuuugucccagaaacugugcuaggcauaaggaaguacaaaugaaaaguguauuggaagcccugacagugaacacuuacaacccaguugaagaggguacuaggacauauaaaagggaggccgggcacgguggcucaugccuguaaucccagcacuuugggaggcugaggcguguggaucacgaggucacgagaucgagaccagccugaccaauauggugaaaccccaucucuacuaaaaauagaaaaauuagcugggcgugguggcaugcgccuguaaucccagcuacucggguggcugaggcaggagaauugcuugaaccugagaagcggagguugcagugagccgagauugcgccacugcacuccagccuggugacggagcaagacuccgucucaaaaaaaaaaaaaaaaggaaaugcugcauguauauauaccuagggucuaauuguuuugcaagauguaugcaucccaugauuuuccaguaauuucagaaagauuucugaacaacaggucuucuacuuuuguauucuuaguguuaggcauagaacaaugucacuaacuaaaugcuuauugaauaacagagugauuagcugaggaagacugcaggaaauauuaagugugaauuauuaagaaggaucauucuuauuucaguuccaagaaacuaugauccugcuuuacauccuuuugaggucccacgagaauauauaagagcuuuaaaugcuaccaaacuggaacgaguauuugcaaaaccauuccuugcuucgcuggauggucaccgugauggagucaauugcuuggcaaagcauccagagaagcuggcuacuguccuuucuggggcgugugauggagaggcaagugucaaucuagaugauauuuucaacuaaaaguaguuauauuacaaauguuuucccuuuaguuuuuaguuacuguagguuuuacuuuauuggauuucaauuuacuucucaagacuaaauuucguuaggaauacuguuuaguauuuucuucuuuaaaccuaagaaauuauaaaugcaguaguuuaaggaucaauuugacaguaaauuaaauaaucauguuuauaauuaaaguauuuaaguaugaguuuuuucacagauguugucaacaccuaauuuccuacuauggcaagugaaaaaguuuuguaacacuuuagaaucaacagaguauuugucagguuguauuuuuugcucaucaguauacuuauccauaugcauugcauuguuuuaauccaaaggauuuugguuuuagcugcccaguagagugauucguagccuugucaguguugaauuuauccugaacauuuuacauuuauaguucacugaaauuuccugguaugccuuaucauagguuagaauuuggaaucuaacucagcggaauuguauccguacaauacaagcacaugaaggcuuuguacgaggaauauguacucgcuuuugugggacuucuuuuuucacuguaaguauaauaccauuaagucauuaaauuugaucaacauagguaagaauaaucuaauugaauacauuuuuuuucaaguucauuuauuuguuccuaggcccuuuuggaguuucacaaugcaaaauagcuuauuaaaccuugaaaauuacuaguuuucuuuauauaauucagccuuccccauaacuuaacaugauuaaacuaauauucaauuuaccacaaaaguggaauuaaugagagguaagucuagaaagaguuuggcuuacucuggaggauuuuugaugcuaagaugaguaauuuguacuuuuguuagucagauaauaaggaaucaucgaaguuuugugccuguguguggcaagauauccggaacguaaaauuuacucucuguuuuuaaauauacaguuugguggcauccaguacauucacaucacugugcaaccaucaccaccaucugucuucagaacuuuuucaucauccccagcugaaacuauagucauuaaacaauaacuccucuguccccucaguccccaaccccugguaacuacuauuuuacuuuuugccucugugauuuugacuauucuggguaccucauauaaauagaagcauauuuuaaagaauuauaccauuuuguguauguggaauaaggcuuuugggucuggcuuauuuuacuuaacauaauugucuucaagguuuauccauguuguaguacaugucagaauuuccuuucuuuuuauggcuaaauaacauuccauuguaugugucacauuuuguuuauccguucauucaucaaugagcauuugauuuguuuccaccuuuuggcuauugugaauaguguugccgugaccauugguguacaaauaccaauucaaguucauugaaagucuuuuuaaacaaggggaacgacaaaaucugagcugugcuuugaguuaaguaauuugacagcaguuagugaucaguuugaaggccauuuuaauaguuuggcaggcaauaauaagaggcuaccuuauuauggagacugaaaacuagaaaucagugguugauacuuuggaggauugacagguuugacaacugagaggugccugggaagagguugguuccuguugcugaggaguaccagcaaguuuugaaggguggcaaugggaaggauaugaugugacaaacuggacugcuaaugggcuguucgagugaagaugucugucauaccuuuacagaugcaggucuggagcucaggagggaggucagagcugaacuugacaucaucaauauagaacuaaucauugaagccauaguauggcaucauugggaggaaaugaggaggaaaauauagaaauacaaagaugucaaggaaguagccuuggggaaugcccaccucugggaagugggaaaacucuaggaguagccagagcucaaagaaucugugaaugagcauaguguccuaggaggaaggaauagucaguuuugugaacuacuacaaagaauaaugaaaaaugaagacugaggaaaacauuuuagaaauguagagauguaaaaaauagaaaauuaaagauugcauaauucuagucuuucacuucuaacacuauuaguuugguguaugucuuuucaaguguuuugaccuaccuauacaacaguuuuuguauacacaugcgcuaaucagucaaauagaucuuccuuauucuuuauuuacuggugacuuuuuaaaaaacagguugagcugaguuauaaaauguagguugcaauccagguuggcugggugcagaagcuagauugcaagagaauaauaaagggaaaagaugacuucugggaaaccugauagcuacaauuugaaagauugucaugugaaaaagaaaauagacuaauuuguugcuccauagagaggcacuggaaauagguguuaguguuaaaagauucgguuuugguguaaaaaaaaaaaacuuauuugcugucaaaaagcagaauaggcuaccuugcaaagcauucaguuacuuuucacuagaggggugcagauaagcugccugacccugcaagcccaguguugugcaaggaauugauuggcaagugggaauggauggcaccuaaggcuucuuacacuugguuauucucuuggauauauugauuaauagcucagccagaggacuuaguguauuuuuuuuuaaugcuuaaaaugaauaaaggcucauuugcagcauuauucacaauacccaggauauggaaucaaccuaaaguguccagcaauggaugaaugaauuuuaaaaaaaaaaguacacacacacacgcacacaggaauacuauucagccuucagaaagaaggaaauccugucacuugcagcauacaugaaugaaccuggaggacaugaugcuaaguuaaauaagacagauaccacaugaucucaguuguguggaaucuaaaaaagccaaacucuuagaaauggaguaaaauggucauuacuaggggcuuugagggagggagauuggggagauguuggucaaaagagacaaaauuucaaauagaugggauggauguuguacaacacugugauuauaguuaauaacaacaugcucucuugacaauugcuaugaaagugaauuaaauguucucaccacaaaauaauaaguaugugagguaacagauauguuaauuagcuugguuuauccauuccacagugucuacguguaucaaaacacaauguuguacaucauaaauauauaucuuuuauuuguaaauuaaauaaaaaacauuuuaagaaaugaauaaagacugaaaauguuucauauucaccacuuauuuccccccacuuuauuuuuuuaaagagacagagucuugcuacguugcccaggccgauguugaacuccugggcucaagccugucucagccucccaaaaaguguugggauuacaggcaugagucaccaugcccaccuuauuguuucucgguuuuucaaaaagauuuuuuuuuuuuugagaugaagucucccucugucgcccagguuggagugcaguggcaugaucucugcucacugcaagcucugccucccggguucacgccauucucuugccucagucuccccaguagcugggacuacaggugcccaccaccacucccggcuaauuuuuuuauuuauuuuuauuuuuaguagagacaggguuucaccguguuagccaugauggucucgaucuccugaccuagugauccacccgccucagccucugaaagugcugggauuacaggcgcgagccgccaugcccaaccaaaaagauauuuuugaguaaugugugcuuugucagagauaagacacaugugaagacuacuugcugguacaacuuuaagaauguuuuuaaaaauuuuaguacacaguguugcaaaacauaaacuuuuauuaccuaaaacuucacuaagauauaccaguuuguaauaccaacaauuccuucuucagcauaaccagccuggagaugagauguucuagccaggcacauauucuuguucggcuacucauuucuauaaaaugagaaaacccuucccagaauuggugguccgcugagguuuguacucaguagacggcagaacagcuuggucauuuacaagcaaauucagucuugagcuugcagacacuaucagaaacuugauggagggauagcgucuucaggaacggggugcucagggacacaguuuauccuguauucuguaagugcuaaaaugucucuuugggucaagccagaucagucaagaccugguaccuagauuacaucuuagucucccaguagaaucagguuucuagaauugaguuuuaguauagugccaguggcucagauucauaguuguuaauaagauguagcccuauuaaauacuuuuugucuauaacaaggauguaguuaaggauucuguucaucgacauccucaacaaaagacaucgcuguguaaucuuaguaccaaaaccuuuccugaucacuuaucuguuuucaucucaugggcacuguaaacuguuuugcaagaagcguuuuccuuuuugaauuugcuguaagaaaagagcuacauucauacucuucccuuagauaaagauaucuuuguuaaugauuuuaucaaaaaguggauauagauugcaucuaauauauaaauguaagauuuuaaguuaaaacuagcaguuuuguauguaugcaguuauacaguaccacauuuaugauuuuguuuucaaccucaaacuacauuauauguucuguuuuguagucuguuucaccugauagcuuaaacaugucugccaaauacccaugucuaaauuaccauaguuuguugcuuugccuugauuugggcuaacgugccaacaguuuugcucacuguugcuuuuuuacuauuugugcagcugucagcacagugaaaagacaaacuaugucuuuacuaacauuaugaaaauaguuuugacuguguggacccugaaaaguucucaggguccuccagaggcccaaaguucacaguuugaaaaccacugacuuaguaguuucugcaguucaugcagaaaaggacuuuaucuauuucaauauuauaacaaugccuucucuccaguauuuucauguuuuucauuuuauuuuuuacauuuaaaauuaccuggaauuuuauuuucacauaaggcaucaaauuggcucaauuuuuuugaaugacuaaccagauauuauaauaccauuuuuuauaauccauuuuuucuccaaguugaaaugccauguuuaucacaauaugcaugaccuaacuuugccccuguucuuguuuuucuuuugcucuacucauuauauuuuuaguuuuauguacuuuauguauuugucacaaaucuuuacuaaaacaaggugggauauaaauggaucaauaaguguaauacuggaaugauaugguauguuaccuguuuuaaacaagauacuuauuugauauguguuggcaaguuuuaauuuauaacuguuguuccuuaccaucaucauaauaaaacaaauauuucuagguuggugaugacaaaacugugaagcaguggaaaauggaugggccaggcuauggagacgaggaagagccauuacauacaauauuaggaaagguacaaaaguaaauugacuaauagcuugccuauuaacauucuuuuauuuaaaauuauuuuauaguuauaauuuccuaagauggggaagaagaugcagauaagaaacgaaagacuuuaggcuguaauuguugacccauuuacgcaauauuuaaugcagcuaaaguccuuugaugcuaaagaauuuuaacaguuuuuuuuuuuuuugguauucauuguaguagaguuugauuucuguuuuuagccagaggauacaaugaaacauuucccaugggaagaccacggagaaaaagauagaaguucagaaaaugcuucagcuugucuaguugaugucaucauagaucuuacacaaaacucagaauuucuuaguugaaagacuccuuuaagaaaugaagaaauuuaauaguauuaugcaucauguauaaaucuuauuaauguuucuaccaaauuauucugcaaaucaggugaugggugguuuaguuuuagcauaagaauaauuuagaacauuuggucuauccauguuuuauaauguuuacauuuuuauauuaagcaaacaauuccaaaauuagauuuaaucuuuaaauuaaaucuaccuuuuaaaaaucacuuugucguuucaauauuaugguuaguauauaauauuuagguucugcuuuagguuucaagaagacuaaauguucuuaaagggauaggggaaugggguaugaguaugagguagagauaauuuguaguuggaaacacguuaguaauuucuaaaacaaaauugguuucauucuuaaaaugucuugucucauuaugguauuguuucccccuuuaaguaaggacuucaaagaaguuucuuugugaacagggcuuuucucuaaaaagauaguauagauaaauauauuuaaaauauuauucugcagauuugaauuaguaaugaaaaaaauccucuuaaccuuuuugcuuuuaaagacaguguauacugggauugaucaucacuggaaagaagcuguuuuugccacauguggacagcaaguagacauuugggaugaacaaagaacuaauccuauauguucaaugaccuggggauuugacaguauaaguaguguuaaauuuaacccaauugagguaauguuuuuuuuuaaguauguuuuacuuauuauggcuuaauaauuucaguucuguuuagaaaacuuuugaauguaugauagaaacuucugaauuuuaaugguguuuuggcauuuugucaguuuucccgauuguaaaugaguucugauaccuuugcucaaaucccaacauguuucccagcaguuuagucccagauacuagaguuaagcauuguuagaggaguggugugugcauuugcccauugggguaaaauccaaguaaauauagucuuguuuuaacuuuaguuuuacucaugccuucaacuucauguuccauagauuaugucauuguacauuuaggaaaauguuaauuuuucuaccugccuuggaggucagaagaaggagcauuggacaucauuuugucuauuuguaauugguaagguaccaaugcuucauaaaaacauuugugauuauuguugaacugcaugguaauuaguuauaguuauauuuuucuuugcucagaagucugaauugugauucccaguuccuccaggccuaagggaagaguuggagauuggccacuacaugucgucuguuuaggucugaauuuaggaauggaggcuguccugaaggcuaagcuagcccuuggacuccagaucuuucucugaacuuuuucuuaaugcauaacaauagaugaacugauuguccagaagacucaguagggauauguuuuuccuguugaaagaaaaggcaaucauagcauauauaagccaauuuuagcaguuauugcgaggcuaccauuuuagguaguaugagagaaaaauccuaauaugcaaguguuaugcucuuaaagacccaaccugauaaaagauaggaaguaagguugagucaaaauaguaagguauaaaaauaguuuguaugauauacuggaaaaugagaugcugcagugcgaugugagcuuggccuugaggaauuacugagaagucagaggacacucuuccugcaacuaccacaugcucacacacacacuuucuagagacgcuacaggucuagaauagguuggcaaacuagucugugagccacauguggcccacugccuguuuuuguaaauagagcucugcuagaagacagccauguucucuugcguacauauugucuguagcugcuuucgugcuaugauggcagaguuaaguaauugccacagagaccauauggcccacaaaaccuaaaauacuuacucucuggcccuuuacagaaaaaguuuucugauuccuggucuggagugucugucucuauuauaucuuucucacuccauccuccaucuuccuuccuuauguuucccuugguuguagaagagagaaguggcauggaaaggcagcuaccuuugcagagcaggaccaaguguaaaaguugauaacauaugugaacauuuuuuaaaagugcuauccaaauucaagauggugacgguauuacguacuaaaaaaaaaacacaaaaaaaccuaaacagacacugguucuuacuauuuagaggaacaaaaaaaucuuuugcuucucugcuuuggugaacaucugugucagaagagccgaucaccaauucuaaaaucguaauuauuagggaugaccuagugaccauguuuuucaaacuugccuguauagcagcuguauuuguucagcuguuuuuuuuuuuaauugcuauuaaccuuaugaacuuagugguaaaaguaaauggugugugugucucuuauccuguuuuaaacuuaauggaaagggcauguugcugugaacaaauggaguguauuuguauuugucuccucuaaucauuaauaauuaauuuucucuuaaaauauugaagccuagaauucugguaaagccaaaaguuuaugcugaucauugggacguuuuacagugugaaagguggcauuuggucuagguagauuguuuugcuuuguucagaucaaagucuuucuuuuuagaaauggaaccuggucagacccugaggcgacauaaugagaagccaagaaagguugagggaccucacuagggaagucucagaaaagcagccauuaagauagcaggcuuucagaaagaacugagaggaaaucaugaucauaacauuagcuuuaugauguguuauuugaauugcguacagacaguaggaggaguuagcuggccaugcaacuauuuaguaaauagcucuucuugcugcccacauacuugcaauaggaaguaauuguaggcagaagccaauaguugugagugucaggaaccaugagugaggaggaaugaugcuacagagagaggguuucagggauccacuggaugauagagggcuuauuuuuacuuaaugccaagggguuaugugaguaccaugcacauuuauaauugacuuacaaauaaaauaauuagaaaaaucuucaaacaguuggacaaaagacaggccuaauuuauagagaguuaacaacacgaagaaacauuuacuaauaaaacaauaaauuuauauagcuaggaaauacugucauacagauauuuuaaaugacacuuuuaaaugacacuacccagugcugcccaguugcauuaaaauggacauaucccacauuguaguguauacugguacagcucuuuggaaaaauaauuagcccuaaauaucaaaagccauaaaauuguucauaccuuuugauucaguaaugucauuugugaaauuuuauccuaaggaaauaauucaaaagaagaacuacgugggggggaaauguuuauugaaguauuacuuauaauaguaaaaaacaggaaacaagucuuaaguugaagaguagguaaguaaaauauguuuuauuacaaauuagaacacaguaauaucuguacauuaaaauacaugcaugggggccaggugcgguggcucaugccuguaaucccagcacuuugggaggcugaggcagguggcucaccugaggucaggaguuugauaccagccugggcaacauggugaaacccugucucuucuaaaaauacaaaauauuagcccggugugguggcgcaccccuguaaucccagcuccuccacaggcugaggcaugagaauugcuugaaccugggagguagagguugcagugagccaagauugcaccacugcacuccagccugggugacagagcaagacucugucucuaaauaaauaaauaaauaaauaaaauacaagcaugaggauuuuacagugaaaauacuugguuuaaguugcugagauuauggaugauuuauuguacccucuuaaaauggacuuuguuuuuuaacauaaauauuaagggcaauuaaaucauuuguuuacugaauggaugugguuugcugccaggucuggcuuugaacuggugauuguuauacuuguuuuuagacauuucucuugggaaguugugcaucugacaggaauauaguacuguacgauaugaggcaagcuacuccuuugaaaaaggugaguuucaguuuugacuuuugcuuuauacaguuggcauuauauauuucucuguaaauagagugacuaacaauauggagcaaauauuuucucagaauuaaaaaaaucuuuuauacagguguucuuagaacucuacaugaugauagucauguucuuucagcucccuauugcuuuuuagagacucuuaaauuucugcuagguauuguauccuagucaccaaccuugugucuuccaugaugccaguacauuuuaggccucuaauuaauacuuacugaauugaaaguucuuaaagguauugcauccuguuacuuaacaguguaauaauauucaaauaauauucaauaaauucaagccccaugauuaucguaugacauguacacuauuuuauuccagaagguuuuagaacucauucacguaaccagcuuuauuuguucaguuacaugcugaucaauacuaguuugacauuuaggcaaccacuauccuguucaaaguaacagauuuccuaacaauucuaaaguaguaauuucaggacuuacauaucagagcuaauaauacaacuuaagcuaacucucaagagggagacagauacugucuguaaguaaggaaaggagugccauuguaaguaaaaggguauaaaguuuauuucagguacuagaauuuugagugacagaaagggcuggacaucauugagaugccacaagucuguugucguaguccacauacaaaagaaaugcuuuuaauacuugcuuuuguuauuccuaaaucauuuuuauaacguaacaacuagauauuaggagaguacauucauugaaguuugaaguagauaaauaugauaaucuuuccaaaguaccacuuauaugauuucacucauucaugugauuuaaugggaagauccuauaugaacuuuggucuuagacuuuuaagcacguuaaccuaaaauguguuucuccuguaagguggugguauuaauaacuaucucgcagcacuucgcugagaauaaaacaugauacuuuaagcauuuagcagaaugcugacaugagguacuaguuuaaugaauagucauuucugcccccucccaccuaccuaacacucauucuguuuuuuuuuuaauuuaguuuauuuuucauuguuauugccuccugcuuugcacauucucaguuuuuaauggagcuccauuaauuuuagguugaagaaaauguagccuggcuuucaaggugcucugaaaucugguucuaauuugcaacucauuuauuucuuuuagucaguuagguaacauugaauuggaguuugucacaugcaggucacuuugauagauguagggauuguuagacacugcuacuuucuguugcuucuuugcuccaucuacuagucuaucaauguuucuuuuauccuuucucucauaaauguaguaguucuuagucagggauuguaguccccuaccagguacaguucugggaaugcaagagggacauguagugggaggucccugaguggcaaaacauccuacaguggauagucauacacaacaaaagauaauccugcucaaaaugccaacaguguucccauugagaaacacugaauuacugauccuucacaggucaguucaaaucauacuugucuuuagaaacaguucuuuauguuaacccuaagcucaccauuaauuuugccccuaauuugauacuuagucauuuguuacuuuauuguuuauauuuuaacuuuuauuaugugucacauuuuucugacuaaacuguaaguuguuugagauuaggagacugggaguuaagcauuucuauuuuuauauuuacuauucugccuguguauuuaagaagcaauuacugauugauuucucuucccauugcacugagcugaguacuuuacacauaauagguguuuaugaaauauuugcuuaaaucaguggggaaaagaaaaggaaaggaagugggaaauucauccauucuuccuuucucagguuaucuuagauaugagaacaaauacaaucuguuggaacccuauggaagcuuucauuuuuacagcagcaaaugaagauuauaaguaaguuucccucuuuuaaaaacuuguguauuucuaucaugaauggcuuaauuguauaagucguacuaauaaaauauauaccacuagguagguauaccuauaaaguuugaaaacugucaucuguuuagcuuuaaaaaguuuuccaaauuggagaagaacuucuuagaaaaguauuuauuucgucaguauuuagaaugauguagaccagggacaguaaacaacucguggaccaaauccuuucuguugccuguuuuuuauaaaguuuuauuggaauauggccacacccacuuacuuauuuagauauuggauauggcugcuuuugugcuauaaugccugaguugaauaguugcagcggagaccuuauggcccacuugccugaaaauguuuaacauuuggcccuuuacagaagaaguuggcugauguuugauguaggucuuauaaauaaugacugaaccauacauguuuuaauggaaaugaaaauaucugccugcaauguuuguauugcggugaguaucagguagcugaugcucauguggucauguuaucagcuaucacuguucagucagauggaagaaaaauuauaguuaucuuuucaguauccauaugagguaggugggacaugcauguuauccccuuuuuaagauauuaaagcggggagauuagucucccagggaggaaagaguaucuuaucuuuuuuuuucccaaagcauuuauuauagcgcuaugccuuugauagauucuuaauacauguuuuuuuuaagaaggcagaaguuuguugguggauugaacuuuagaucuuuguauuguuuuauguuccacuauguagauuuggaagcaaaaaaguaguaguguuagcucauaaaaggauuuauuauaugauguuuuagugguaccaacuaaaagcaucuuuuaugacuuucugcuaaaaagagguuuaguccaggaguuugagguuacagugaguuguaauugggccacugcacuccagccuggccaacagaacaagacccuggugucuuaaaaaaauaaaagaagcucaguuagacucucauuaacuagcaauaccaaaccacaguaauugaagcuuuuuuuuuuaaccuuuauugauguuuugaaauuaaguggcauuguuccaguuaaaggcaauaaaagacaagaguaauacagcauuauugugaccaaccucauuaagauuucuaaagaauguucuaauaagcuauuuuagcaagguaccguuuuucagaguguccucggaauuucucauuccuugccuugaaaagaauugcauaugccaccugaaacaaagagcauaucccuuauaauaagugacuguuggaguaucauaauugcucuuugaaaaugaucuugcuuuuguaucccuuuucuauauuuguaaguauuuuuuucuuuuauugcccuuuagauauucuagucauucugaauuagaaaccuaaguucaagucuaggccgaccaguaauuacuguauaaacuugggcaagucauuuaaacuaacucuauaucauaguuucagcaucuguaaggugaggguuagaauagaugaucccuaaugaauccuauaauguggaacuuuguuuauuuaaagguuuuccauguacacaaauugauaugcuuagaauuggaauucuuaucauuuuucccauguagaaauaaagcaucuuacuaaaaagcaguuugcuggaaccaagcaaaccuagcugaaaaccacuguucuuaggcaggaacuguaaagcaguugucaaugucuuacuacuaguaauguuaaccuugaucauuugguuaggguggugucugccagguuucuccacuaaagaguuacuuuuuuuuccuuuuguaauuauuauauaucuuuggggagauacuuugaaacuauguagauauccucuucucagacuucuacucacuaaucuuagcaucuucaaguauuuuuauauuaggaacuuggucacaauauugcuguauuacuuuuguccauuguucauguugguucauuugaagcacuauucuuuuagccauuagauuaagaauuuuugaaucuugaaacucaugaagucauuguuuuuaccaauugugcauaaaguauaguuucucauuuugauucacccuuugaaaggccauguucacucuuacauaucaccaguaggaguauaaauuagugcaacuuuguuggcagugauuuggcaacucaaaucaagccuaaaaaugcucaugccuuuaagcuuaacaaugcuacuuguaggaaucuguccagauuuaauugaaccugucccauucaguuaaagauugaauguuaaaaauccaaacguugggaauuuaauaagcauuauauauaauaaaauguuggaaacuauuaaaauauagggaaauaaauuauuugaacuuauauauacagccauuaaaauauuuucaaagauuguuuaauaacauggguaaugcucauuaauaugcuacgugaaauaucagaauauaaagcuuuacauaacauuucaauuuuauuaaaaguauguauuuaaauaguauggugaaaaagguuuuuuaaaaaauuaugcuguacuaaauaacuggccucuggguaguagaauucaagguaauuuuuguacucuacuuuuuuugaaauuuccacauuuucuacaaugagauuuauaggguggaaaauguguugguauauauauaaguggagucuuaaggaaucauaaaaacuguugaaauuuuuccuuaucccucaccugcuuguguacagcauugagcuuuuuguuuagaugugcauuguuuugcaaaugguucuuguuuucagugguaucuuuuaguacugcauauggcaucuuucuagaaauaugugucaaauauuuaaaaauucuuuuacagcuuauauacuuuugauaugcgugcacuggacacuccuguaaugguccauauggaucauguaucugcagugcuugauguggauuacucucccacugggaaggaguuugugucugcuaguuucgauaaaucuauucgaaucuuuccuguagacaaaagucgaagcagguaugugccuaccaguaagccauuuauauucauaugucacuuaacaauggggaugcauucugagaaaugagucauugggcgauuucaucauugugugaacaucaucagagugcacuuaaacaaaacuagaugguauaacguguugcacaccuaggcuguguggucauaugauauggccuguugcuucuagacuacgaaucuguucagcauguuacugugcugaauacugugggcaauuguaacacagugguauuuguuuauguaaacauauauaaacacaggaaaaguacaguaaaaauccaguauuaucuuaauggaccacugucguauaugcagucucucauugaccaaaaugucauaugacuauuuuuguuucauuuuucuuuguccugauuauuauuuaucuuuucugagaggguaccugaguuuaauaaaguuuuuugcuccaauacaguuuaagaaaaauuaguaauaauacuuuacauuuguuauuuuuuacuuagucaaauccaacucuguaugccaaaccaaaaauuaaaaaagaaauaaaaguaaguuuaaauugucaagaccguucucccucuauuucacuuuaguagguauauggcuugguugaugagagguugagaggugggagauuugaauacucagcugucccauagucucgugugugucucauuuuguaagcacauagagugugauucuaauauuuaagauuuuuauuguguuuuguauaguuuggcccuuuacuacauauuauauguuauuaaauacaguaucuauuuauacaucuauuauaucuuauuuuuguaaagagguaguuuacagaaagugauggcauuuuaaggaguuugcaaggggaauuuuguucucgaguuuucacuuuacagacugacuuuaaaaacuaaguccuguauagauacagcccccuguauagugaauuaugguuuacaaagagcuguuauacacauucccauuguuccuuaguaaugcuuuagauguguuccuggaagcauccauaaaauaaauccaaauaaauggaaauaauuuuucucaaaaaauuaugauaauuggaugaucauggucauagucaaucugcuuaucuaacucuuugcucuuuuacuugugauauuuaagucuuuuuccacuguaauuugaggaagccauauggauuucuacaccauguaucgucauugucagcagauaauuaucuucaucacuguuuaucugauuaugaaggugcuucaguuagaagcauacugacaggaguguucugaugacuuugaucuucauuucaucauuucuguuguagagcuucugcuguguguuccuaugugacuauugcuuccuuuguugcugccuugauauucuccaaauugucaugaguguuuuuuuggcauuauucacuuaggcccaaggcaagacuaauagcuuccauauuucucucaccucuggaaaauguugagaaucaagagaauaugguccuccaucauuucuuggcaccacaacuuccaaagguaguaggauaguauuuuuccaacaugguacauaaguagacaaaagaaugaaacgagaacaaagaaaaaaacaggacuguguaguuaccuaugaucccaaggggccagcagcugaguucaggcugaauuauuccaaagcuaguguggacagcuaaauguaggucuagcuagaaaacucacauuauuccaaaauuguauaaaaggguucuuauauuucauuucuaagaaauugucuccugaugucauuuggagguuuuguaaucacagucuuaauauguguuaacguccuguuguguuuagauauaaaugguguucccucugaccuuugccuuuaucugcuugaaagcuaguucuaauuuguuucugugguuuguuuccuaucauuauaaacaucaaauaacucaugcuugggugaauaaucuguauuuaaaaaauauuuuccuuuaaaagaccuuaaaauggcuaaagcauauuauuuuuaaaauaaauuuugaguaaauuuuuuaaaacuacaguuaagucaguauuugaaaguaggcuucuguuggaaguucauucaguauuuacugagcaaacaaguaaauuaauaguguucacauggaaaaauuagugugacuguguauauaaagaauuuaagccuuuaaaaauguauuuaucuccuaauaguagaacuuuuggugagcuuaauaaacuuagcauauaugcagacauaaacauaucuagaaguuaagaacucagcauaguuuaccauuggggaggauucucaguuacuuaagugacuaaccguuggaucugacuggucuacugcaugaacagauuauguuuaaugguuacggaaaccugauugaauuucccuacuucaaaugcauuauacugcuuuggaaaaaagggcuucuuagguauguggagauuauaagaaaugagucuucaaaagcagagcacugagcgggagaagaaaaagcagucuaucucaucuaguuuucauuuuaauaggacguucuuuuuaaucauccccucucuuuuaaaaaugaauuucuaaugguuuaucaaagugcuuaaaacauaccuaucagaaacaguguaaaagaccaguuuugugaguauagucgagagauuuuuuuuuuuuuuuuugagacagagucuggcucugucagccaggcuagagugcagugaugccacacggcucacuacagccccugucuucugggcucuagugauccuccuaccucagacuccugagcagcaccacaccuagcuaauuuuuaaaauuuaucuuuaguagcuauggggucucccuguguuacucaggcuggucucaaacuccugggcucaaguaauccucucaccaaaguacugggauuauaggcaugagccacugcaccuugccuacuuuagagauauuuuuuauagauaugaauauuugauuuagucauucuguuugaguuuuauuuuacugugcauaguuuauugagccuguuuccuuccucuuuauauacucugcauuuugaauaauuuaauccagaugcagaaaauuuauuucuccagaaguuucaucuuacuuuuucugaccuuguauuuuacuugcuuuuuaaugccuuucuuaacacuuacuaauauaguaucaccugugaauucuucuagcauauuucacagccuuuccaaauagguaugauauuugacaucuccauuuauuaaaugauucuuuuuuuucuuuuuuugagauggagucuugcucuguugcccaggcuggagugcaguagcacgaucucggcucacugcaagcuccgccuccuggguucacgccauucugccucagccucccaaguagcugggacuacaggcgccugccaccaugccuggcuaauuuuuugcauuuuuaguagagaugggguuucaccuggucucgaucuccugaccucgugauccaccuacugcagccucccaaagugcugggauuacaggugugagccaccgcaccuggcucuauuaaauuauucuuaccucaacuuaucagacacuucuguaguccucccuuccuuuucacacauguaaaucaucaacucacuuuaauuaagcuuuuuuuuuuuuuuuuuuuuuuugaggcagagucucacucugucacccacgcuggaguacaguggcacaaucuuggcucacuacaaucucugccucccagguucaagugauucuccugccucagccucccuaguaacugggauuacaggugugugccaccacgcccaacuaacuuuuguaauuuuaguagagacaagguuucaccauguugggcaggcuggucuaauuaauuaagcuuuuuaaacaauuuaaccaaaacaaaauucuggcauuagauucagcauaucaggagguacucuuugaagaccauugcauuucuuucuuuuucaguaaaaugaaggggaaaaaaaguguguugaccugaauugauuugauauggggaagaggccuuuuaagaucaaguccuuucuuuuuguuacaaaguuaccuugguugaacaucauauuuuauuugcauuuuaugcuuuuaguuauucugugaacuuuucuguacaucugguuuugcuuaguuuguucauauuuauuucucuuacuagauaguaaguucucugagagcagaaauuuguuuacuaccccagcacuuaacacggaaccuuauuaguuggguucaauaaaaauacauugacaagaauuugaguuuuuauuuuauacuccuauaggacucagaaauaguauccugauacuuaauaggcagugguuacucaaaaucuguaccaaaauccaaaggguuuuaacuuaauucguuuucuauagggagguauaucauacaaagagaaugcaacauguuaucuguguaaaauggacuucugacagcaaguauauuauguguggaucugaugaaaugaacauucgccuguggaaagcuaaugcuucugaaaaauugggugugguaagagaauucauuuucuuucauugucauaaagcugauuucuaauuuuauuagauauuacauuaugaaaauuuacuuuuagguauuuuuggguauuuugauuaaauugacauagcugugauaaaaaaagcaauaaauggacaagguuguauugauaauuauuugcuucauucugaucuauuauuguagacacuguacauucaaauugacauuuaagaccuucagaaugccuuuguuaauucagauguuugauaauauugagucuuacugguuuuuuguguuuuccuugagguagggacagaagaugcaggaacuagaggcucagaacuuagagcucguaucucuuguuagagaaauagucauccagcaacucaaaggcugcaagucccugggagaucuuguaauaucaaagacacaauggaacauuuaauaaauacagaaagcuucauacuuuaaaaaagauuccaugaaaaaauagcagguguuaucauuggcugguuaccuccaggauaggggauuaugguugauuuuguuuuguucuugauguuuuucuaaaugucccauauuuucuauaagaaacagaguguuuauauuagaaauaaauauuaaguuuaagaaggaaaggguaagugugaauuauuuucuacuuaguccugauaggaaaaucaaaggcaauucuguuuuagguuuaaugauugauaaguauugcauugugccuagguccaucauuaaauguuccucuaaaucguaucauccuuaacauucguuaaacaaaggguaguucuuauggaauuggauacuuauuuuuucuuugcuguuucacuauguuuaacucaccucuuuacccacccccaaaauuugagugagugauuuaggugcuuuucuauguuauugaugccuagggaagguccaacucagugauccacguggcccuacuccuucagcacugcugcuuucuacuggguggcaucuaucuacauggcgaguguguugccuaaaaggaaauucagugcuugcagagcuaguguuacuaauauaaccuuguaaagugcagaauuacauuggcaauuuugguugcauaucauaaaagauuagguuagggggaaaagggugcuuucuagcuuuuuuauacugaagcaaaacaacacacuauucauuaagauaccaaaauguguauuuucagcuuacaucacgagaaaaagcagccaaggauuauaaccagaaauugaaggagaaauuucagcauuauccucauauaaaacguauagcucgucaucgacaucuaccaaaaucuaucuauagccagauucaggaacagcgcaucaugaaagaagcucgucgacgaaaguauguuuugaggcauuugacucuauuacccuuuucugacuucugcucucaucucaccaaaaacaaaguuaacugccauucaagggaguaguuuaugugcuauuauuuaauaguauguuagugauguguuugaagacuucuacagaaggccuuuucuuuuuucuuuuuuuuuuuuuugagacggagucucgcucuggagugcaguggcacaaucuugguucacugcaagcuccgccucccggguucaugccauucuccugucucagccuccugaguagcuaggacuacaggcacgcgccaccaugcgcggcuaauuuuuuguauuuuuaguagagacaggguuucaccauguuagccaagauggucucaaucuccugaccucgugaucgccugccucggccucccaaagugcugggauuacaggugugagccaccaugccccgcccagaaggccauuucuuuuucuuuuucccaaaaaagggaagcagugacuaucugagaaugggagaacuuccauuaccuguuuuugagaauauguuuaaaggacaaacgaugaaaaugaguuaccaaaauaagaaaacacuugcucauauuaaaaaauuauuguaaaaaauguuuuaaaaaauaauuucugauguagcuggaauuaagagauuuuguguauuuuccaaguuaaagaauuaaucuauaguagagcucuuuucuuaaguaaaaaguguucugauauacuuuauuauaacaugacaucuaucauuuuggauauagagcagagcuacuaccaccaccaccauuucccgugaaauauucuucucuuugaaauacuugaagucaugcaugaaauucuaagagcucuuuauuuuucaauuagaauauacaaauggcucuuuuuuucugucuuuggguagauguugcaguagaaucacuuuuagaaauuuuauuaacuguggaagguuuuuaaacuuaguaaaggacccuauuagguaaauaugauaagaagcaauuaaauaaguaaaguugauuucuugguacuagcuuccuuuuaccuauugucaucgugaaaauauuuuuuuaaauagguguuuuucuagugaaagaaaaugcuuugauuuuucugagaaaguuuucuuuaagaugaguucccauaacuugcuuauauuuuguauauuuuauuucuagggaagugaaucguauuaaacacagcaagccuggaucugugccacuugugucagagaagaagaaacacguaguggcaguuguaaaauaauugguauuccuaacaauccugauguauaauuauuuguuacuuuugauuugagaacucuacaaauaaaagugcugggacuagauuaauugcaaacauuuuaguuauauguguagagcuuuauuguuacuccuuuuagcuacccugaaaaaugauccuuaaagguggccuaguugguaagacuguuuuauccuuaaucugcauucuucuuucauuguagaauacaguauuugcaacucauuuuuucuuguuuuuauuacagauauacuuacuuucucuuugaucuauuauuguagacacuauacauucaaauugacauuuaagaccaaacaucucuuauguuaucuuuaauauuacuuugaauaaugauugcaaugauguuucuuccugugauuccacauaacauuuagaauaaugaugucaauuuuuuacaacugaauuuauuucuagugcuuuacuuauauuuggcuuuuugacucuuuuaaaacaaucagccugcauuuauauaacuuuuauaaauaauaauauaauuugggucaaguuaagauauuaaaaguuccuuucagcauugaa

SEQ ID NO: 192543 - RNA, 89015 nt, Homo sapiens
guacuucauagacuuuaucauacuucguagcauccaguauguuuucuuugcuaagauuauugauuuuguauugaagggucccauguccaucguuuucaaugcuuuaucuccaggguuggagcaugccugguaaguaggacauaaauuugucucacaaauuaaacagcuuuaugaagacauaauugacaauaaacuacaaauuuaaaauguacaacuuaagaaguugugauauauguauacacccgugaaaucaucaccacaaucaagauacuaaacuuagcuaucauucccaaaguuuccuuguacccuucuguaaccaucucucugcuccuucugcauucuagguugacaguuuuuucuuucaaugcuuuaaaguuauagccucagucuugcuuauauuguuucugaugagaaaucucacauuauccuaucuuuguugcucuauacauaacaugccuuuuuucuucuguuuuaagauuuuucucuuuuacauugguuuugagcaguuugauaauauuguggccagcugugguuuucuuuaugauucuuauguuugggguuuguugggcuauaaacugcggacauauaguuuuuaucaagaucaauggcaauauuuuggcuauuauuucuuccaacuuuuuccccuccuuuucuccuuugaagacuccaguuacacauuuuuagaucacagaaguuggucucagcucaugaaugcccguuucauuuuuucuucauacuuuuuucuguuuuauugccaauaguuuccauuuucaugccuuuaguuccguuuacuuuuuuuuuuuguaauauuagucucuuguuaaucccaucugguguauuuuucaucuuggacauuguaauauucacaucuagaaguuugauuuaaaucuuuugcaucuuucuugcuucuacuuacuuauguugaacauacauggaguacauguagcaauaauuguuuuuacaucuuguucugugaauuguagcuuccaugucaguuuuauauuggcuucuauugauugguaauucucuucauuauggauuuuguuuucuuuccucuuugcauaugugguaaucuuugauuggaugccagacauugugaauuuuaccuuguuaggugcagguuauuuuuguauuuuuauaauguucuugaguuuuuuuuccgggauauaguugaguuacuuggaaacagauuaauuccauugguucuugcuuuuaugauuuguuaguccgaucaggagcagugcucagucuaggguuauuucccacuaccgaggcaagacuuuccuguguacacuacccaguaucccacaaauuaaggguuuucuccauucugcuuauugggagcaguuaugguuccuagccuuaugugagugcccaggauuucucuucaacccuuucagaugguucuuucuguagccugggguaaucuccucaaacacaugccauuaguacucuugaguacuugaggcagacucucagaucucugggcuucucucugcaucucucuuuucucugcuacucugucuaaugacagaguaguagccuaguuucuucaacucaaggagguugaagucaacucugcauacaaguacucuggccuuuuucuuucuucagagaagggggaagaaaagcuggugaagauuuacacuacaguuaaagggagggaaaagccauguaaccguuguauuuauguagaguugacuauaccucacuuucccuucuuugugcuguggucuggaaacuccucaaggcaguaaacuagauuggugguggggcuaaucucauaaguguccuuuguuguuuuaugucugaugucuugaaaacuguuguuucauuuaacuuucucugguuuguuucaucuuauuggauguuucugguggaaagauaaaucugguuccuauucuuccauguuggcugcaaacaaaaguuauucaauguauauuuuuaagugaaaaaauauuuucuguagaauaauagagcuagaaacaauugaaaagggcuaaugaguauagugagaaaauggauguauaaacagcuuuuuaaagaaguuugagaagaacaagguaggggagagcucugcuuuagcggccaggcagagaaaaggaagccuuuuuuauuuguuuauuuugcgaguggggaaguuucagcauauguaaguggaggagaaacaccaguggacaggagauaacuucuggcaggagaaaauugaaucauaaacaccugugugggaauuagccuugaaugggagaaaaggaacagggaaaucaaugcuuaaucuuaugugccaugcauugauaguaaauacauugcauauuucgacugaagcuugucaauguuuugguacaauuaguauuacuaaccuuuauuauagaugaggaaaugggcaauaagaugagcuaacuuaaccaaguuauucaucaguggcaaagcugacccuaaagcucaugcuuuuccuaaugaucuuuguggucacucuggccuuuuucuuucuucagagcagagggaagaaaagcuggugaagauuuacacuacaguuagaguaaagggagggaaaagccacguaaccauuguauuuauguagaguugacuauaaaacucaucucuacccuuauggaggaaaagauggggaaaauacccacaugaauguguugaggucagagaaguauugcauaaaauaauuuuaugggagcagugcucuuaacucugguccucccguguucuuuaagucucgcuuuagaauuuguggacuuguacuuuuacuuuuuuacaccuucauagauaaauagcaagcucaguaacuaggugaaaagaaggcuuauuggguugauucuagaagcuaagugguccaugaagugaccuuuguaaguuaacguucuuggccucucucuucccccucuuuaaagauuauuauacuuugcuuauguaaauauuagacugcaucauauuuaauuggugucaaagaguuaaauauuggcaauaucaugugguucaaguaauaguguauuuugagaagccaagaaacaguaaugaauaucaucguuagcacuauuagugcaggagacaggucuguuuuauucacuguuugugcccaaugccaaccacaaugucugguacauauaguagauauucaauaaauaauuuaugaaugaaaaacuauagcccuuugaggucccaugaggcuuuugugguuuucaugugugaaaaacuagguuuugagguucgguaaguauuugggcaaauguuaagggagacucuucuuuugaggcccuaaguucuuuuuagaagacuaauccuuaucagauuuuucagcaaagcucuuuuauuuucaaugcaagguaucauuaaauaauaaaauauuuacuacacuggcuucucuguaaaaaguucuucuucuucaacccuuacaaagaucuaugcagagauugaagccucgcugcccccuacuucuuuuuuugggagaacucugcaaaagagcucugccaguagcuaagaacugucacauucuggacacugcuuuucuacuuucaguugcucugccucccacuuuuauaaucaagauaauugacauggucaucaucaugugauaacuuuuccuuucucauuugaggccagagagguguccuuuuucuaugcguuaauagagauuuuacaaaauagcauguaauauggccuagacucacaucugugucuuaauaacuuauauaaauuauuuuguuggaaugaaacaaucaugaaguguuguaauaagacugaugucuaagaagccuccaguuuguucaggauugcccagaggucuuugcacagauaugaagaaaauguauuuguuauaucguugucuaauauuacugcuucaggcccuuauguuaccaugcaguuuuccugcaguaucgaguuucauccacacaguggugcuagaaaaccaagaauacauauuucuaacuguugcuuauaaaauaagugguguuauauguuuccucaaccucuaucaaaucuaucauaauuggauuuuuaccugugagauguuuccauuaucucucaaccagaugauugcaauagcuuucuaauggaucuuccuggauuuacccugcuuuauuccaauuuguuuuccauauuguaguuauaaguacucuuuuauaaacucaaaucugaacuuuacucuccugcuuaaaaacuguuaaugaauucuuuuaaauugaauuugucaacaaaaauaaauacaguccauucauaauccaguucuugcugaguuuucauuuauugcaaccuuuccuguacaaguccccuuguugcucugcauuucggccaguguggccuucuuugaacaguguggccuucuuuguguucuuugaacacaaguuuuucuuccuacuuuuuacagauuuuccuucugucuggaaaaguagaggaguggguaugcauguauauagguguauuuuuuauuuuaaaaauauguuaaauugauaaacugggauuuuauguuauauuuugaugcaugcauacgguguguaaugaucaaaucaguauuuaggguguucaucaacuucaguauuuaccauuucuuuguguugggaacauuugaaaucuucuagcuauuuugguacucgcuguuuugaaauacacaauauauuguuguuaacuguagucacccaacugugcuaucaaacaugagaacuuaauccuuuuaauuguauguuuguacccauuaagcaaccucccuucaucccccacccccaucuuucccagccucugauaacuaucuuucuacucucucccuccaugaaauccacuuuuuuagcugcguguaugaugucuuucuguaccugguuuauuuuauuuauuuauuuuugagaugaagucucacucugucccaggcuggagugcaguggagcgaucucggcucacugcaaccucugccuccuggguucaagcgauucucgugccucagccuccccaguaguuggaauuacaggcacgcacugucacacccagcuaauuuguuuuuugaauuuuuaguagagacgggguuucaucauguuggccaggauggucucaaucuccugaccucgugauccgcccgccuuggccucccaaagugcugggauuacaggccugagccucggcgcccggccuugugccugguuuauuucacuuaaugaccuccaguuccaucuauguugcugcaaaugauagaauuucguucuuuuuuauggcugaauaguauuucaguguguguauauacuacauuuucuuuaucuguucauccuuuggccacuuagguuucccccaugucuuggcuuuuguaaauagugcugaaauaaucauggaagugacgguauuccuuuugauauacugacuuucuuuuguuuugauaaauauucauuugugggagugccuauugugguauaguaguuauaguuuuaguuuuuugagaaaccucuuuacuauuuuccauaauggcuauacuaauuuacauucccacugacagauuauauguucccuuuucuccacauccuugccagcauuuguuauuuuuuuuuuuuguauuuuuuugaaaauagccauucuaacuacaggaagaugauaucucauugugauuucaauuugcauuuccucaauaauuagugauguugagcauuuuuucauguaacuguuggcuauuuauuuauauauucuuuugagaaaugucuauuaagaucuuugcccucuuuauaaugggacuuuuuuuuuuuugcuucaacagcaaaaaaaauuuucauuccuuacgauugaauaguuugcaaauauuuucucccauucuauagguugucucuucacuagguuguuuguuucuuuugcucugcagaagguauuuuuguuguuguuguuguuuaguuaaauauaaucccauuugucuuuuuguuuuucuugccuaugcuuuugaggucuuaaccauaaaaucuuugcauagaccuauauccugaagcauuucuucucuguuuccuuuuugguauuuuuauaguuuuugaguugauuuuugcauaugaugagagauaggagucuaauuuuauuuuucugcuauggauauccaauuuucacaccauuuauugaggaagguauccuuuucccaguguauguucuuugcaccuuugucaaaaaucaguuggcuacauguacauggauuuauuucugauccaugagcaugagaugucuauuuguguccucuucaauuucuuucauuaauguuuuguaguuuucuuguagaagucuuucaccuucuuguuaaaauacuuuuucuuaaguuaauucuuucuuaucuuuuaugucguggcucaaaccuuggaaagcuuuuguuaaucuccccaaauagaacucuuacauuauguguucucaugguacccagugauuauucuuuaucacaauuuaauuauauaaaauuuauuucauaaaaauuauuuaagauuuauaugauuauuugacuaaugcccauuuccucacuguaucauaagugcuaauuggcaagauuccauucuuggcucaucacugugucaucgaugccuauugaaauuuuauuuauuuauuuuuaaauuuauauuaguuucuguauaaaugaauauaagucagacaggacucaaagcagguauuggaagugggaacaggugagcauuugggggaggaagaaaacaguugccaucagaauacaguaaagugaguuuuauauuaggguaggauauuggcccagcauaauccauuuauauguuuccugcuggggcagaaauuaauuccagaucaugagcaguucugagccaugaaaguuuccaucuucaugaaagggcaggaggagugggaggaagagaucacauuugcuagauuuaaaccuagggaagcagcuaaugcuuaagugaagaaaucucuguucuguaaguaggagaucuuguuucuaguccagcugugauacuguuuugcucuguacccuuggaaaagauguaguauaacauuggagaagucauuauuuguguauacauuuauuuauauaacuguauaaugagauuuuaaaaguuaauuucuuaauguguauuaaaaugaaugagauaauaguauauuaaaacauuuuuaaaguauauaaacacuucauaaauugggcuuaacauuuuccuggaaaugguagauucuucaauuuuagaauuucuguuauuuuuauucauaauuauuagaggugccuaaaagagggucaugacauaaaaagcccuaucuccuguggccgcuguauucuaagucuuguaaggacgugggaccauaucaguuuuacuuacuguuuauccucuguacacaguacccagaaauuaucuuugaaagaaugauauacugaauuguccugaaggccuuugugauuggcauucugugauuuuuuuuuuugccuuguaggcauucuacagauagaaacuaucugaggcaaaacucuugauguuuauguuugcuuuucuuguauuucagcuguggcagagguaaaacuucgagaugaucaauauacacuggaacacaugcaugcuuuuggaauguauaauuaccugcacugugauucaugguaucaagacagugucuacuauauugauacccuuggaagaauuaugaauuuaacaguaaugcugguaagagaaacauguauguaauaauuaauauauguauguaauaucaagcaaauuugauaauuaaguuucccuuuugaaucuaauauccagagaagugaggugcacauaccuguaguauauggaauccuaucuacguaauacuccauuucuuauuucaauuuuaauuuuucucuuugauccuguuauuuacacuuacucaccuccacucucaccauugggcagcaacucucauggauuuuauauauuauuaauacugauguaacuguucaugucugcuuuuccuaugugagguguuguccccaacuauaaugaugaauuugcuuuuguuuuaguuuuuacuuuauguauuuuuaacuauguuaauugguacaaacauuuaggauuguuuuauuuauacugaauugauucuuuuagcauuuuaaaaugucucuuuaucucuagguucugugaauauuuuuugucuugaaaucuucuuugguauuaauacaguuauuucuggauuuuuguaaauuaguauuuuucuucuuauaugcuuuuucuauuuaucaguguucuuguuuuuaaaguaugugucauaaagagcauauaguuggcucuuguuuuuuccauaugacagucuuucucuuaauuggagggcuuacauuuauacuuaauuuaaucuaguucccaauauucuugggcuaauauuaccaucuugcucuucucauuaugcccuguuuguucuuuguuccuuggugucuuuguuccuacuuuuuugcaggaggaauuaaucacaguuuuucuuuuuaaaaaaaauguccuuagaacucgauuuaauuuccucuuuuggcuuuuuauuuaaaccuguuuguauuauuauuuuuuaaaugguugauacagagguuauaguguuuuccuugacuuaccacagucugccucuaauuaauauuauuuuacuuuaaaaacaaugugaaaacuuuacaacaauauaauuccuuucacuuacccucucauuguuugagcuaauuuuaucauauguuuuucaccuucauaugcuggaaacuccacaauacauuguuaauauauuugcuucaaacagccaauaaucuguuaauagcuuccuaaguacucuauuccuucuagcccuccugcgcauugcaucuacagaguagucugucugauuugcguguuuaauauuaucacuugcuaaaauucuuuuaauauuuccuucauggcaaaauccauguuuuuaauauguaauuuaaaaauaggcaauguguucauguaauuuaaaaaccaaaaaaguuauaaaagguauuuagugaagccuccuugaucccaucuuuuaucuauccuaucuccaguauccauuauuuccccugcaaugucuuuauugguuuugugugucuuuccagaugugguagguuauuuguuguuguuuuuugcaaguauaaacacaaaaugauguugcgggaagucagggaccccaaauggagggaccagcugaagccauggcagaagaacguagauugugaagauuucauggacauauauuagcuccccaaauuaauacuuuuguaauuucuuaugccugucuuuacugcaaucucuuaaacauaaauuguaaagauuucauggacacuuaucacuuccccaaucaguacccuugugauuuccuaugcuugucuuuucuuuaaucucuuaauccugucagcugaggaggaugucuaucgccucaggacccuguaauaauugcauuaacugcacaaauuguacagcauguguguuugagcaauaugaaaugugggcaccuugaaaaaagaacaggauaacagcaauuguucagggaguaagagagauaaccuuaaacucugaccgcaggugagcugggcggaacagagccauauuucucuucuuucaaaagcaaaugggagaaauaucgcugaauucuuuuucucagcauggaacaucccugagaaagagaaugugcaccugggggugggucucugaacuggccccccugggcauggucgucucuuauggucgagacugcagaggugaaauagauuccagucucccauagugcucccaggcuuauuaggaagaggaaauuccugccuaauaaauuuuggucagaccgguugaucucaaaacccugucuccugauaagauguuaucaaugacaauggugccugaaacuucauuagcaauuuuaauuucgccccaguccugugguuuugugaucucgcccugccucuacuugccuugugauauucuauuaccuuguaaacuacuugaugucugugacccacaccuauucgcacacucccuccccuuuugaaaaucccuaauaaaaacuugcugguuuuugcggcuaguggggcaucauggaaccuacugacaugugaugucucccccggaugcccggcuuuaaaauuucucucuuuuguacucugucccuuaauuucucaagcuggccgaugcuuagggaaaauagaaaagaaccuaggugaauauuggggcaggcucccugaugaaaugauauauauucuuaaaauaaacuuuucaucuuugcauauacguuuauaugccgaguuuucuccaaccuugucuuacagcacuuuguauacuacauucuagccauacuaaacucuugcaguuccugagacaugugcuguauccuauuucuucugguccuuuucucauugauuaacuaccuggagcauacuuuuaauucagugucagucugcuuugcaaucuuuacuuaaguccuagguaaccauuuugucaucuagcaagcuugccuugacaucuuaccucuguuccccuaggaauauucacaccauuggcucucaaaucuacaugugcugugaauuucuucuauucuagagguugauacgcuuuucugcacaaggccagcuaauuuaggcuuugugggccagauagucucuuguugcucgcuuuugcuguuguagugugaaaucagccauagacaguuuauaagcaagugaguguggccguguuccaauuaaccuuuauuuacaaaaacauaaaaugggccgagcgcgguggcucacgccuguaaucccagcacuuugggaggcagaggcgggcggaucaugagguuaggagaucgagaccauccuggcugacacgaugaaacccugucucuacuaaaaauacaaaaaauuagccaggcgugguggcaggucccuguagucccagcuacucaggaggcugaggcaggagaauggcgugaaccugggaggcagagcuugcagugagcagagcuugcagugagccaagaucgcaccacugcacuccagccugggccacagagcaagaguccgucucaaaaaaaaaaaaaaaaacauaaaaugggcaggaauuggccuguggacuauaguuugccacccacuggacgaggccauggguucuagcacccagcagaaggcuugaucaguauauuuguugaauggauaauagcuguguaaaguucauuauuacuguugggaguuggcuuuggaauagggucuuccuccuguuauuucuaauccaaguguagguaugaguucuguauuggcaaugcaguguuuaucucaaaauguucagaaaggaguuagacauuuccugguaauaaauauuuuccuucaggugacuccuaaaacagauaguguaaaauucugauuguuucuuguuggaucagaggaaugcaaucuggccucuuacucuuagauauuaguugcuuuuucuugcuagccccauguucuacuaaggauuacuaucuaggcccaauguguauaagccaacuaaagugauaggacaugcauuuuuaugaguggcuaugcucugaucucucugaucaaauaaauuuuaaugaucaaauagauuuugauguagaguucuguguguaugugcaugaaaguuuuuccuuaauccuuuuuguguuaacaaauagggcauuuguugauagcauuugcuguaccauaaaguuugccaauaacauuuauucuaccaauuuucugacucgaagucagaugacauuaugguagaucugaaaguguuaauuuuuguaguaccauccauauucauaaucuauuuuacuuuuccauagauaucuuguggcacauguaauguagcucuaauacguguuguuagggagguaggguaguuggucaaaaggaaacuagacauuuaagacagacuuaccaaaugaguucauuuuaacguguuuauugaaaaccugcucuguguaggacacuaauguauagguuggugcaaaaauaaaaacuguuuuaccauuauuuuuaacauguucaaguacuuauacuucuacauauaaguucagguaacuuauauguuauacuuuuuaggugcuaauaugaguguacagguaacuauuacaugguaauauguagcugacaaaaaggguacagcagucuccauauauccuuggcuucaguuucauagaaaauaagaauaaugauaagguuuuuuagacguuaaagcaaggugugugaaaaugcuuugaaaaguggaaggcauuaugcaaauauaaagagauauuacuggcauaugccuugggguaucacuuuaugggagacaaacacuggcuaguuuuuuuugcacauauuccuucuuugagagcaguagaacuguaugauaagaauaaaucauaaugucagguaacuuuuauugcauagagauuauuacauaucaggaacaauucuaaacacuuuacacguacuaacuguuuaauccacagaacaauggauccuguggauccuuucucauaggauaauauccugauauuauccugauauaccagauacuauuauuauccacaucuuacaguugaggaaacugaggcauaggauguuuguaagagucuggauuuaaacucauuuauuccagaaugccacagugcucuaccaguucuccuuauuucuuguuaauagagacggauauuauguguuaauagagacagaguuucaccauguugcccaggcugguuuugaaccccuaggcuccagagauccgccugccucagucucccaaagugcuggaggauuacaggcaugagcaacugcuccuggucucuauuaucauuuucagugccaguucucuaaucaccuguucaguuuuuugugcaguaauggguuuauucaaaguguguuucuaggguaauuuuguaauauguauuuuuauuagaggaaaccaucaguuuccucuuagguuuccaaauaugcugcuauaaaguugcaugcguuaugcucuuaagauuauuguugucuuuucucuuuccuuucuauauuuuuccucuuuuuaccuaaucaagcuuuaggaaagguauuaguuuauuuuuaaagaaccauguuuuagguucuuaaagcuuguuuucugcuuaauuuucuuugguucucagaccauauuguaccuuggaauaauuguggaguaauugaucaaaacaaaaacuaauuucaagguaccauuucccaaaauucugauucauuauugucaggguuggucauggacugggaaccugcauuuuaucaagcaccucaggugguuuugcuugugguccagggaugaccagguauuaagaaauuuuguaccugggauacagaagaauacuacacuuauuuuuuauuauuuuucucaucagcaacaaaugaaaucaaccuacucugaguuucugucaggugcaggcagguagagaauguugaccacuaacuagacuauuggcuuauagcagaaaacagcucuuccaauauccauuuuauuguuuaauaauuuuuuuuguuuucuuuuguuuucaucaaaggcacacgugcacaaauccuagacaggcuccuuuucugugacugauguacaaaugaccaccuuuguuaaaccugaacuguuguaguaaaagugaaugcuaugggacccaacacuugaaagccauagguugcuaggucuucagacugucuggagccaacagguggcagcaggucuacauacugguuuauaaagacagaauacucuccuuacaaaaaaguuuaacuuguagguuuacaguccuuaauuuuagggaaaugucccucggaaagaagugugcuaaggaaguagaaaaugccuugggaaagcaaaaauguguuuaaacuuugguuuuuuaauacauccuuauuuuauauauuauggcuuauuuuaaaguaauguguuccguuucuuaauauuuaggaaauuauuucuguaauaauuuguuuuguauuuaccugaaaagcuaauuuguuucuguuacuaaaagagugucaucuuauagugccucuuuaauuuguacuuaaaggucuaaggggcaguuacuggauuucauuuguaagaauauaugugugagguugcaucuuggagugacauguuacaacuauuuguuagaggagcucaguuuuaugucaguauguucaucucuaggccugaaugucagcuuguuuucacaguugaguuaauuauuaggggaccacuuacuuaccuguguagagacgaaggcaaaguguccccuuuauucuuagaagguuugcugaaaaucuguugacaaacggcagauuaacaugagaaaaaggcauauaaauauauuuuaacauguguacauggcagaauccaggaaaaugacuacccaguaacccagugggguacagaugcuuauauacccuuauucauacccuucuuaugcuugaucaguaggggacaugggggacaugcgggauagcaaaugaucuuuagggggaaaugaaugaaugggccugaugcucagacaaugauuaguuaauacuuuucuuuggaaauugaaugggauggagagcagacaaugguuugugacuaaguucaucugggcuguaggugggguguuuaauuuucagccucuuccucugugauagaaguuuuaaucuucucugguuaaugaaauuucagggaaagcaauuguguuucucuuuggcagguccaguuuauagguagaugaaggaacuucagagaauagcuucauccugugcuugggagaaacaggaagggaggggaggccagaaagaccuugaggcugcuucauguugaaguggcauuauuucggaguaacauuuuuugagcugcaaugccugaugaaagaaaaaaauaaagagugggguaaauacguagaacugugcguuuaauacaaaaaaaagggaaaaggaaaaaggaacuuuuuauguucuuucuuccaaauaaaguuaaugguuauuaaugaugaaaauacuuuguccagaaaaagaucacugccuuuuaaaacggcaaaguuuuaaauaucauugucucauaauacuaguaaauaguaucuaauaauacuaguaaaugguauccccacuugcuuauuuuuuuaaacuugaguagcccuuucuauaaaucuauauuuauuagaaaacuacuucguuaguucaaagauucucuacuuauagcugcaacuaagagggucccaaaauguguuuaaagauguuuuuuauaaauauauauaguuuauguauuacuuguuuacuguuuauuuacagugucauuuauauauaauauaugggcauuauaauuuuuauauuacaucuauauugacccaggcaucugcauuaaaaauacuguguagaggccugaagaaaaacugaauauaguaguuacauucaagguugauuugggggguuggggauggguauacuagaaauuguauugagaucugaaguauuaauuuauuuagaaaaucuucagaagugguuucuucucaagcaaauguggaguaggggaaagaaaaccaacuuuuggaguaggguuuuaucaggauuugagucuuggcccugucauuuucuagcaguggagcuccaggcaaauuauuuaaucuuuuugaaccucucuucuaaguguaguuaauaauuuuaacuucauagaguuuggugauaaauacaugacauggcaaaaagucaaagcacuuauuuaauaaaauucuuauacauuauacugauucaguaaguauuccguucaucaaugaaauuuuaauccuucugcagucagcuguguaauguugccuuagaaugauuuucaguguuagcccuugaacguaguuacauuaacucuuuuugugaggaaaaagaaaaugauuaugugagagcuggacauuauagaugucaguuagcauauaaaguguuguuaugagggcauguagugaaauugucaauagagguuauucagauauaaguaaaugcuauauuuugggauuuagagaaaaagauauuuuauugcuuauaguccauuuaaaauuaaacuguacuuugaaaauuagaucuaaacaaucagaaacauuuaguuugcuuucacuuuaacugucauuaaugcaaguaagagagccacuauguguuuccuuuuguguuuuaauuuaauuuuguuuucacauuuagauacucaaguaucuuaaucauucuauuggauauuguacccauuuaucugauugauaauuagacuucuagcaaccuccgucauguauaaccagguauuuuaaagaaaauggcuuaaaaugcucauaauuguguauaaaaugaagaauaguaauuuaacaaguuuaucucuacguucuucccaguaaugguuuauuagauuaaaugcaguguggggccauguaguagacacaacuagaaaccuuuacuuugaaauaacuguuuugaggaaagccucccauuguaucuuacuaauaccuuuaaaauuacguauaucacacacaaguugcucagucuuaaaauaguaauguauuugaagcaaaaggggaaaauuuucucauacuccugaucuccccgaccacuacacuucagucuuauuuuccuaauaguaaacauucuuaacaggucagcaugugucuaucuauacuuugugcugucguaucaugauauuuguuuuggcauauauggauucauauuguauguauucugcaucuuuuuuuaaaaaaucaguauuuuaugucaguauuauuaauccgccuuaguauauuuaacaauuauuugguauucuauaggguggaugcuccauaguuaaccauuugccugccaaugcucuccagacaaagauaccaggcacgcaucugugguugaaugaguuggauuuguuacuuuugcaguaagggagaacacauaccaugggaaccacagaguguucaguaaaaggaacaggaugcuguuagaagguuuggcuucuguugggugauuuuggaggaaggguuaaagaaagugaggcuuuauucuagauugaauacugucaggaaauugguuguuuauguaauggguaucuuaauaagucuuaccuagaaggagggaagacuagacugaggcucacacuauaauuaguaaggagcugcagcugcuuauauuggccuggucauauuuguagccuugacaguguugauguuuuaucuguguucagauauuacugugaagugcugcuuuuuuguccugcuccaucacggucaugcagaggccuuaucugauguguauguuuugugaaacuauuccuguucaacagaacaccuguuagugccaggcuagcuaguaacaaaacaaaggccuggcugauacugcuaggccuucuccguaaugucagggucugcuuucaucuuuaccuacuuuauugauaaacaacuagguuguuuuuccuaguuuuuauuggcacaguuuuuccuuuucguuauuaaaauaaacauacuuguuacguggaucuucguguacauaugcagguauucuuauugaauaaauuccuguaaguggaaucaugucaaacaguauauaaaacauaaaacuuaauaaaaccauagcagcaccucauagcuuuaaauuaucuccaaaaagccuauaguuauuuuuauucccaccaacauggcacuuuagccaagaauugucauuacuaguguaagauuguuuucucuggccaaugagauaaucauauucuauuaauccauuauuuuauaccagugauuuggggcuuuuuuuuuuuuuuuuuuuuuugacagugucucgcucuguugcccgggcuggagugcaguggugcgauuucagcucacugcaaacucugccuccguguucaagcaauucuccugccucagccuccugaguagcugggauuacaggugccugccaccacaccugucuaauuuuuguauuuuuaguagagauaggguuucaccauguuggccaggcuggucuugaacuccugccucaggugauucgccugccuuggccccacaaagugcugagauuauaggcaugagccaccgcgcccagccgacuuuuuuuaaacuauaguugucccguucaaauauuuuccccauuuaacauuuuuuaauuuuuuauuuuuaauuuuuuuauuucccuagguuauuggggaacaacagaugguguuugguuacaggaguaaguucuuuaacggugauuugugagauuuugguaaagccaucacccgagcaguauacacuauacccuauuuguaguccuauuuguaguugaauuuuaucccucaccgcuucccacucuuucccccgaguccucaaaguccauugugucauucuuaugcuuuugcauccucauagcuuagcucccacuuacaagugagaacauacaauguuugguuuccauuccugaguuacuucacuuagaauaauagucuccaaucucauccaggucacugugaaugccuuuaauucauuccuuuuuauggcugagcaguaucccaucauauauauauauacaccacaguuucuuuauccacucauugauugaugggcauuuggguugguuccacuuuuugcaguugugaauugugcugcuauaaacguguguggaaguaucuuuuuuguauaaugacuucuuuuccucuggguagauacccaguagugggauugcuggaucaaauggagguucuacuuuuaguucuuuaaggaaucuucauacuguuuuccguagugguuguacuaguuuacauuccugcuagcagcacagaaguguucccuguucacagcauccacgccaacaucuacuauuuuuugauguuuagauuauggccauucuggcaggacuaaguuggggguaucgcauuguaguuuugauuugcauuucccugaucauuagugauguugaguuuuucauaugcuuuuuggccauuuguacaucuucuuuuaagaauugucuauucauggccaggugugguggcuuaugccuguaaucccagcacuuugggaggcugaggcaggcggaucacaaggucaggagauugagaccguccuggccaacauggugaaaccccaucucuacuaaaacacaaaaaauuagccgggcgugguggcgugcgccuguagucccagcuacucgggaggcugaggcaggggaaucacuugaaccugggagacggagguuucagugagccgagaucgcaccacugcacuccagccuggcagcagaacaagacuccuucucaaaaaaaaaaaaaaaaaaaaaaaagaauugucuauucacguccuuagcccacuuuuugaugggauuguuuuuuuuccuugcuguuguagauucuggauauuaguccuuugucagauguauagauugugaagauuuucucccacucuauagguugucucuuuauucugcugacuguuccuuuugcugugcaaaaacucuuuaguuuaauuaagucccagcuguuuaucuuuguuuuuaaucucauuuguuuuuggguucuuggucaugaaauccuggccuuagccaaugucuagaaggguuuuuccaauguuaucuucuagaauuuuuaguuucaggucuuagauuuaaguccuuaauccaucuugaguugaauuuuguauaaggugagaaaugaagauccuguuucauucuccuacauguggcuggccaauuaucccagcaccauuuguugaaaaggguauccuuuccccacuuuauguuuuuguuugcuuugucgaagauuaguuggcuguaaguauuuggguuuguuuauggauucucuuuuuuuuuccauuggucugugugccuauuuuuauaccaguaaccaugcuguuuuggugacuauggucuuauaguauaguuugaaaucaggaaaugugaugccuccauauuuguucuuuuaacuuagucuugcuuugguuaugcgggcuguuuuuugguuacaugugaauuuuuuuuucuaauucugugaagaaugguggugguauuuugauggguauugcauugaauuuguagauuguuuuuggcaguauggucauuuucacaauauugauucuacccauccaugagugugggauguguuuacauuuguguaaucugugauuucugucagcaauguuguguaguuuuccuuguauaggucuuucaccuccuugguuuagguauauuccuaagugguuuuuuuuguuuguuuguuuuguuuuuuuuuuggcagcuauuguaaaagggguugaguucuugaucugguucucaguuugguggcuguugguauguagaagagcuacugauuuauguauauuaaguuuguaucuggaaacuucugcugaauucuuuuaucaguucuaggagcuuucuggaggagucuuuaggguuuucuagguaaauaguuauaucaucaguaaacagcaacgguuugacuuucucuuuacugauuuggaugcccuuuauuucuuucucuuugauugcucuggccgggacuuccaguacuauuugaagaggaguaguaagagugggcaugcuugucuuguuccaguuuucagagggaaugcuuucaacuuugccccauucaguauuauguuggcuguggguuugucauagauagcuuuuauuacauugagguauguccguuguaugccaauuuugcugagaguuuuaaucauagagggaugcuggauuuuguugaaugcuuuaucugcaucuauugagaugaucaugugauuuuuguuuuuaauucuguuuaugugguguaucacauuuauugacuuguguauauuaaaccaucccugcaucugugguaugaaacccacuugaucaugguggauuaucuuuuugauauguuguuggauucaguuagcuaguauuuuguuaaggauuauagcaucuagguucaucaaggauaucucucuguaguuuucuuuuuugguuauguccuuuccugguugugguaauagggugauacuggcuucauagaaugauuuagggaggcuucccucuuucucugucuuguggaauagugucaauaggauugguaccaauucuucuuugaacaucugguagaauucugcugugaaucugucuggucccggacuuuuuuuuuuuuuuuuugagauggacucuugcucugucacccaggcuggagugcaguggcacgaucucggcucacugcaagcucugccuccuggguucaugccauucuccugccucagucucccgaguagcuaggacuacauuugccugccaccaugccuggcuaauuuuuuuauauuuuuaguagagacuggguuucauuguguuagccaggauggucucgaucuccugaccucgugauucacccaccuuggcaucccaaagugcugggauuacaggcgugagccaccgcacccagucugguccuggacuuuuuuuuuauugguaauuuuuaaauuguaaugucucccauuuuguuucuuacugagcuuauuuggauuuucucucuucauuucuugauuaaucuugcuaauggucuaugcauuuuauuugucuuuucaaggaaccaacuuuuuguuuccuuuaucuuuuguauuuuuuuguuuguuucaauuucauuuaguucuguucugaucuugguuauuuucuuucuucugcugguuuuggguuugguuuguucuuguuuuucuaguuccuugaggugugaccuuagauugucuguuugugcucuuucagacuuuccgauguagguguuuagggcuaugaacuuuccacuuaguacugccuuugcugugucccagagguuuugauagguugugucacuauugucugcaguucgaagaauuuuuuaauuuccaucuugauuucauuuuuugacccaaugaucauucaggagcaguuaauuaauuuccauguauuuacgugguuuugaauagaauguauauucugugguuguuggauuaaauguucuguauauaucuguuaaguccauuuguuccaggguauaguuuaaauccauuguuucuuuguagaccuucugucuugaugaccuguguagggcuguuaguggagcauugaagucccccacuauuauuguguugcugucuaucucauuucauagaucuauuaguaauuguuuuauaaauuuuggagcuccaguguuaggugcauauauguuuaggauugugguauuuuccuauuggacaaggccuuuuaucauuguauaaugucccucuuugccuuuuuuaacugcuguugcuuuaaaguuuguuuuaucugauauaagaauagcuacuucugcucguuuuuggugccauuugcaugaaaugucucuuucuacccuuuuaccuuaaguuuaugugaaucgugagucucuugaaggcagcaaauggguugaugaauucuuauccauucugcaauucuguaucuuuuaaguggagcauuuagaccauuuacauucaauguuaguauugagauguaagguaccauucuagucaucaugcucuuuguugcccguauauauguuuuuuuaauuguauuuuuguuucauagguccugugugauuuaugcuuuaaacagguucuguuuugauguguuucuagaauuuguuucaagauguagagcuccuuuuagcaguucuguagugguggcugucacacacguccguguaaagagaccaccaaacaggcuuugugugagccacaaggcuguuuauuucaccugggugcaggcggacugaguccaaaaaaggagucagcaaaggguggugggauuaucauuaguucuuacagguuugggauaggcauacaaaguacauucuuaagggcauagagaauauuacaaaguaccuucuuaagggcggggaugggaagaauauuacaaagugccaucuuaagggcaggggagaauauauccuaucaguuaggguagggcaggaacaaaucacauugguggaaugucaucaguuaaggcuauuuucacuucuuuuguggaucuucaguuguuucaggccaucuggauguauacaugcaggucacaggggauaugauggcuuaacuugggcucagagcccugacauuccugucuucuuauauuaauaagaaaaacaaaacaaaauaguggugaagcguugggguggugaaaauuuuuggggggugguauggagagauaaugggcgauguuucucagggcugcuucgagagggauuaggggcagcaugggaacauagagugggagagauuaaacugaggaaagauuuuguugggguaaggggugauauugugggguuguuagaaggagcauuugucguauagaaugauuggugauggccugaaugugguuuuguaggaauugagaaacuaaaugaaagacacaagcucugaauaaaagaaagaggaaaacacguauuaaaggacuaagaauugggaggacccaggacauccaauuagaguguccagugggguccgggggugggggggguucaacauaauuauuugcuugguuggcgaguuuuuggacucuauccuugaguuuuuuuuuuauguugucauauaccacgcaagauugauuuagguaaaaacaacacucuucuuuuaaaaauauacagauucccacuuuuuuuuuagcagugaguaaauagaggccuuggcgauuuuggaggaaagagaaaugcaaagugaacaauuguuucuuaaagaaggauuagaaacggcuaggagagagugagugagauugauaguguggcagagauagcuggggagagguagaggguggcauaagaacaggaacaagaauaagagugaguauaaaaguaaagaauaggacuucaucagggugaaaguauuggaguguaaccugucagcaaagagcaucuauccacuccaagagggagucaagagugguggauuggggcuaguaccagaggauauccacuacgauaguuuggaagaaaaguguaaacuggcaauguaaacaagggcagggcauuuaugaguaguugagaguggugaguaggaguaagacuagacaggaaauaguagggaugacaaguuuucggggugcaguccaaguagugagagugacugcauaaagcccuguugcaaaaagcaggguaaggacaaauagaccuaauagaaugaagggauguauugggcuuauaaggguuauuacuguucuucagaaaugcgagugaguuuaagggaaguaggggggaguacuugcgacuuccaggaggaagaggagaaaucaggcuggcuggcugacgggcacagcuuuacucuggaucuaugaaccuaaugcggggguccugcagacgaacagccguugggguacuauagaugacuaagugggguccaguccaccaagguuguagaauuugaggggucagauucuuaauaagauuagcagccuggugaauuuccugucuguccugcuggaggacaggaagauaguugcuuagagggcuagugcuugggaugagguuggggccgagcaagaaacugcauccauauaaaaguucaaauggauuguacccuguaguaucucgaggacaggcucuaauuuugagaagggcaagagguaaaaguacuguccaguccuuuuuaacuuggaggcugagcuuggugaggugugucuuuaaaagaccauuaguccguucuacuuuuccugaagauugaggacaguaagggguaugaaguuuccacugaauaccaagagacugagaaacugcuugggugguuugaauaauaaaggcuaguauagaggugggaaggccaaacugaggaauuaugucuuacagaagggaagaaaugaccacaguggccuucucagacccugugggaaaggcuucuacccauccagugaaagugucuacccagaccaagagguauuuuaguuuccugacucggggcauguggguaaagucaauuugccaguccggggcagagacaaauucccaagcuugauguguagggaagggagggggccugaacaaucccugaggaguacuagaauagcagauggaacacugagaagggauuuccuugaggauagauuuccacgauggaaaggaaaugagagauucuaagagaugggcuaguggcuuguaaccuacauggaagagguuaugaaaugacgacagaauagaaugggccugugaggcuggaaggagauauuuuccuugguccaagaaccauuugucuugugugggaagggauugauagguggaaguuucagugggggaguuggugggagugaccaacgaggaggagaaaaacuggcccugagggacagaaguuggaagcuggcugcuucuuuagcuacauuaucagcauaagcguuacccugagcgaugggaucugaugccuuuugauggcccuugcagugaaugacuccagcuuccuuuggaaguaaagcggccuugagaagaguuuuuauuaaagaggaauuaaugauggaggacccuuacguagagaggaacccucuuucagcccauauaacagcaugguggugcaggauauggaaggcauauuucgagucuuuaaauauugacgcguagugccuuugcaagagugagggcccgaguuaaggcaaugaguucagcuugcugagagguaguggaggguggcagagcaguagccucaaggauagacguggaagauacuauagcauagccugcuuuugcugguaaguggugauuaggccuaguggaacugccaucaauaaaccaagugugaucagagugagggacaggaaagaaggaaauauggggaaauagagugaaugccagguggaucagagagauacagucauggaggucaggugugguaucaggaauaaugugggggcuagccuaaaacaguaaggucaaguuguuuggacagaaaggcuacacagcacggucccggcucuuguguaagaguuccagucacacaccccugcacuucagcuguguguaaugaaaaagguugggaugaguuagggagagcuagugugggagcagcuuuuagggcuguuuuuuaaggauuggaaaggggaguggggaaaggauuuaggauuuauggggucagcuagguuuaucuagaacagaauaauggguuguggaggggagguauugaggauaggagaguauaugguuuuggcaccauggggugguugauaaggcgcagauccugaacuaaccuguaagacuuguccaguuuuuggacaggugaaaugggggaaucguaaggagaguuuauagacuuuaaaaggccaugcuguagcaggcgagugauaacaggcuuuaaucauuuuaaagugugcuguaggaugggauauuggcauugagcgagguaagggugauuagguuuuaaugggaugguaaggguugcgugaucgguugccaaggagggaguagagguguccuauacuuguggauuaagguggggagauacaaggggaggaugugaaggaggcuuuuaacuggggaaaaagguggcaaugagggguggcuguagccuaggaauagucagggaagcagauaauuuaguuaaaaugucucaaccuaauaagggagcggggcaggugaggauaacuaacaaggagugcauaaaauaauguuguccaaauuggcaugagaguuggggaguuuuaagagguuuagaagccuggccgucaauacucacaacaguuauggaggcaagggaaacaggaccuugaaaagaagguaauguggaguggguggccuccauauugaugaagaaggggacagacuuacccuccaguguaagaguuacccaaagugucugugaugguccuguaggcuuccaaggcgaucgggcaguguuagucuucagccacuaagcugagaagaucugggaaggagucagucagagagccuugggccagaguuccaggggcucugggaguggcugcugggcgaguaggacaguccgauuuccaguggggucccacacagaugggagacagcuuaggaggaaucccaggcugcgggcuuuccuuggcccaguggcuagauuuccagcacuugaagcaagauccuuggggaggcgguccuggaggaacaccuggccccugcaguuuaggcuuuuugaaguuuuggugugcuggaaauguggcugggguuucucucacaguggaggcgaguaauugcaacucuucuuuauuauuguacaucuugaaagcgaggucauuuaaguccuguugugggguugagggccagaaucuaauuuuuggaacuuuuuaauguagggaguggguuggguaauaaaaugcauauugagaauaagacagccuucuggccccucugggucuagggcgguaaagcgucugaggguuguugccaaacgggccauggacugggcuggguuucauauuugaugaaaaagagccuaaaugcuaacugauuugggagaugucuuauaaagaaagaggagcauuaaccuuggcuaugccuucaucuccagccaccucuaagaggaaaucguugggcaggugggggagggcuagucacagaacgaaacuaagccagaccugguguaaggaggggagguaauaggaggguuauagggugggggaguggaggcugaagaagaguugggaccuggcuuggccuggcgaggcacagccuggggaggaggggagaggucagaugggucuguagaaaaggaggauucccaggacucagagcuugggguggagacugaaggaacagacagcagagaaagaagaaagauuugggaugagucucauugggagcagagauuaggaagggaccgauguguaaaagaaugccuggacaucaggcaccacagaccauuugcccauuuuaugagaagaauuaucuagaucuuguaugauggaggaaucaaaagugcuguuuucuggcuauuuagaaucauuguuuaguuuguauuggggccaggcgauguugcagaagaaaauaagaugcuuagguuucaggucaggugugaguugaagagauuuuaaguuuuuaagaacacaggcuaagggagaaaaaggaggaauggaggguggaagguugcccauagugaaggaggcaagcccagagaaaagagaggguagagacagggagaagggagguagugagcagcccugggcugcaaugugggcaagcagccaaagcaggcauccccgcacuugacuugccaccaaaggaauguuggugaaugaccaaggcaggcauccccgcagugaucagacaccaauggagugugggugaauaaucaggcaggugucccugcagugauuaaacaccaagggaagacugucuucccgaguccaugacuggugcuggaguuuuggguccauggauaaaaugugucucuuuugucucuauuagagaggacaaagagcuggaauuggaaggacagggagauugaaggguaguaagagagggagauugaaggguagcaagagaggcuggagaagagaguagaaaggccgcuuaccccauuugaaauuggugagauguuccuugggcugguuggucugaggacccgaggucguagguggaucuccucacggagugagggagaggacagaggacuggucucccaaaggaguccuccugucccgggucuucggcaccaaaugucuggcgcaucuguguaaagagaccaccaaacaggcuuugugugaacaacaaggcuguuuauuucaccugggugcaggcgagcugaguccgaaaaaggagucagcaagggguggugggauuaucauuaguucuuaagguuugggauagguguacaaaguacauucuuaagggcggagagaauauuacaaaguaccuucuuaagggcggggggagaauauuacaaaguaccuucuuaaggaucggggagaauauauccuaucaguuaggguggggcaggaacaaaucacagugguggaaugucaucaguuaagacuauucucacuucuuuuguggaucuucaguuguuucaggccaucuggaugcauacgugcaggucacaggggauaugauggcuuagcuugggcucagagaccugacaguggcuugguaguggugaauucucuuggcauuuguuugucugaagaagacugugucuuuccuucauauaugaagcuuuguuucacuggauacaaaauucuugcuugauaauuguuuuguuugagaagacugaagauagggccccaaucccuucuagcuuguagggcuucagcugacaaaucugcuguuaaucugacagguuuuucuuuauagguuacuugguucuuuugucucacagcucuuaagauucuuuccuucaccuuaacuuuagauagcuugaugacaaugugccuaggcgaugauuuuuuugcagugaauuucccagauguucuuugugcuucuuguauuuggaugucuagguaucuagcaaggcuggggaaguuuaccucgauuauucccccaaauauguuuuccaaacuuucagauuucucuucuuccacaggaaugccgauuguucuuagguuuggucauuuaacauaaucccagacuucuuggaggaguguucauauuuucuuauuauuuuuccauugucuuuguuggaugggguuaauucaaagaccuugucuucgagcucugaauuucuuucuucuacuuguuugauucuauugcugagacuuuccagagcauuuuggauuucuguaaguguguccauuguuuccuaaaguuuugauuguuuuuuauuuaugcuauuucauugaauauuuccccuuucacuucuuguaucauuuuuuuuuguuuccuuacguugggcuuugccuuucucugaugccucccugauuagcuuaauaacugaccuccugaauucuuuuucagguaaaucaggaauuucuucuggguuuggauucaaugcuggugaacuauugugauuuucggaggguguuaaagaaccuuguuuugucauauuaccagacuugauuuucugauuccuucuuauuuggguaggcucuaucagagggaaagucuagggcucaaggcuguuguucagauucuuuugucccaugguguucccuugacguaguagucucccccuuuuccuauggauguguccuccugagagccgagcuguagugauuguuaucucuguuuuggaucuagccacccagcaagucuaccaggcuccaggcugguacugggguugucugcacagaguccuguguuguguaccauuugugggucucucagccauggauaccagcaccuguccuuguggaggugucagcggggugaaauggacucugugaggauucuuagcuuuggugauuuaaugcgcuauuuuugugcugguuugcucucuauuaggagguggugcuuuccagagagcaucagcugugguaguauggggaggaacacacaguggauggggcuguagaacucccaagaguauaugccuuuugucuagaguucccaagguggguagggaaggaccauugggugggggcagggcuaggcgugucugagcucaggcucuccuugggcauuucuugccacagcugcugugggggaugggggugagguuuccaggucaauggaguuauguuccuaggaggauuauggcugccucugcugagucuugcagauuguucagggaagugggggagaaccagcaguuacaggccucacccaauucccaugcaauccgaggggccugucucacucccaacaugccuuugccaacagcaccaagucuguuuccagguagugggcaagcagggcugagaacuugccccaggcuaccugucucccagcugcaaaagcaaauauggcuuuccuucuuugccugccuguggagucugcccaccagauucacacccuucccugaguucugggaaggagacuucuccaucaguucaaaguguuacaaaguucagcuggcgauuuccuuuucccuguggccuuugcccggugccucuggcugcccucccgaaggaccccugugaggacaggcagaaaugguuuguuagggaacccagcgagcugacagggcuuucccugcugcuuccucuaccccuguguuuugcucagcucucucaagugacucaguuccagguaaggucagaaucuucucccauaaccuagaccuucagguuccaaguggggguguguguuugaggggucucucuuuccuacuuccacaguuuggguacucacaguauuuggggugucucccggguccuguaggagcaauccacuuccuucagagggucugcggguucucucggcuuuccugauuuauuccugcagucauucuggagcaaaaaaucaugaugcgaggcuccacaggcugcucuguccaucagaguuggagcugcaauuuaguccugccucccgucugucaugaucugcccaucccccuaaacauuuuaaauaaucauguuucuuguuaaguuuuaagggcuuuuuuuauguuauacauauuagcccuggguuauauuuaugacaaauacuugucucccuuucucuuacaugccuuuuauuuacauguagaaagacuuuuucuauccugagauuauaagaacaguauuauuuuccuuuuccuuuaacacacuuagacacuugaucuacuggaauauggaauauuuuuguuuacgauaugagggagagaauaaguuuaauuuuuucccagaaguucucuggugucccaguagcauuuguggacuagucuguuuucuuuuuauuucacuaacuggaaauaccacaucaugcucuaaaugaugugaccuacaguaaaauuuaucuuaauugaccuccacuuaacagaccaaauggguuaauugauagucucuguucucucuguaaaacauacugauggaagaccacaguaagcuugauguuuacuacuaauaggcuacuuaauacuaugcugguaugauucuguuucuugcuugugguuuuagaucacugauacucagauuugaucauucuacaaacuuaaugugagcucugcuugccauugaguauuuauuauuuaauuuaauauuauauaaagcaguaaaauaugaaaggaaggaaaggugcuguuucggagaaagcuaaauuaggugcuuuagaaagaaaaaaugggucaccaaaaauuuuguggccaguaaggacauuguauacaguuuacuuaaauauuauagcauauauagaucuaaguucuaggagaaaguaaugaaauauggauauaaaggauuacuuuucuccuauagaaaaacuuguaaaguuuagcaagaaaaacaaaugguugaauuugaaugcaguuugguauaugagaggaaguuuaucuucuaaauuauagaccuuuaaaaauauauucucuuguaaaacauuuuaaugauguaacuguuguaguccauuugugcugcuguaacaaaauaccugagaauugguaauuuauaaagaacagaaauuuauuucucugaguucuggagcugagaauuccaagauccagguacuggcagguuuggugucugguaaggguucagucucugcuucuaagaugaugccuugaacauugcauccuccagaaaggaggcauaauacguccucacaugacagaaggcggagggggaaaaagagacaaacucccucuuucagucccuucuccaagguuacuuaaucccaaucaccaguguggagcccuaaugaucagaagcccuaacuucuaguaacaucacuuuggugauuagguuuuaacucagcuuuuggggaggauaccacauucaaacccuagcagcaacucauaacuuuacauuauaaguacauagaccaauuaaaauuuguuaacaaaaaccuagauucauaguaggcuaaauguaguguuuucauaccgcagacuggugucucuguaggcauuuugaacaugaugugguauuucuaacuagugaguuaaaaauacugaucuuuaacucuaaaauuaagagaaugaaaacuagauuacugcauuguauuaguuuucugucauacgacaacuucaaaacuuagugacuugaaacaauaaccacuuaccauaucacacaguuucuguggucagaaaucagggaguaguucagguggguggucuggcucaugauuuuuucaugaguuuauagccaaaacgauagccagggcugcagucaucugaagccuugacuaggacuaaaggauacauuuucgaaaugauuaacucauggaaugcugauuguuggcaagagccaucauuuccuccccaugugggucuguccauggggcuaccuuaagcauauucauagcaugguagcuagccacccucagaaugugugauccaagagagagagugaaguagaagauguaaagucuuuuaugaccuaguucuagaagucauaugccaucugucacaucuacuguauauuuuuguuaaaacugaaucaguaggacagcucacaucaaaggaagaggaauuagacuccaacucuuaaaaaggagagaaaccaccacaccgcagauauuuauuuuguguguguggaucagugaagaggaagagauuaauguauaauguuuggucuuuuuaggacacugccuuaggaaaaccacgagagguguuucgacuuccuacagauuugacagcaugugacaaccgucuuugugcaucuauccauuucucaucuucuaccuggguuaccuugucagauggaacuggaagauuguaugucauuggaacaggugaacguggaaauagcgcuucugaaaaaugggaggugaggguuuguuuaagacuuaugcgaaguccagaaaguauauguaaauuacacccuacuuauuuuaaaaugacacuuuucaaggaugguuuacaugugaucuguuguuuguuugauauauaauguuuuggaucucuuuuuaacuaaauuauaacauauauauuuuucacaaacuguuacauuaaccacuccuguuuugaucuggagucagugcaguugucaagaauugcauucauuuuucagcagacaucuuauaugcguagaguacuucauuaagcauuggcguugccuccuccuucuugaagaagaguugaccaaaagcuuauguuaggaugauuuucuccucugccauuauguuagauuugcugggauguuuacauuggucaaauaguagucagauuaccagaauauucucuacuuagaaaaauacaugauauaaauauauaguuauaugccaauuuccaagacaacauuuuuacuuuaauuuuaaaaauuagauauaaaucuaaaggguaguuuaggguuuuaauaguaauaaauaaggaauuaauuucucuagaacuacaguuuuugaaaacagaagaaaaugaugccaaguagauaaucaaaagauuuaguuuacugcuucagcuccuuugaguuaugcuaauaaguguauuguaauauugcuacugucugaaucucuguagguagccuuuaguucuggguaaauaaagagaugcgagcuuaauauauuuaugucuuauaaaauaauuucaucugaccaacagaugccuacagagaccaggcuuuaauuacuugagaaaaaccaguuaggucuuagaaccaaaugguuuaccuaccuuacuaaguuauacuaaauguuauacuaccaaauuauaguauguucaaaauacacaguaaauaaccagaacagcaguagccuauuuacaagagccuguugcauucacaguuucagauauucauuggauacuguggcaauuucuguuuuggccuuuaguaacaacuuucauuuuucugaaaaacagaaguaaugugguauguagcacagcuaccugaaacaguuggaagguauuuugagaauaaugcgcaggagagauaugagugggaauuuaucugguauugagcuguauggauucuguagauuuugaacaggacaaaccuacuuggcucacuuucaucuuaaaaauaauaccacacauuauuucauaugggcuuauacuucuuuugguuuuguuuuguguauccccuuggcguguauuaagacuucaauaguaucuuuuaaauaaauuuaaaaacuuaauucuaccuugugccuucuuuagcauauacugcccuaaugaaauaagcucccuucagagauguuuucagcuaauaauaguuuugacuagauacuggugggagagggaggagacuuggggauuaauugaggugggagggauacuguggaauauuggucacuuuaagaaacaauucaggaggguuuuaggacuuuaggguaauuaauauaacagagaagcuaaaaguagaagugauuacggagcauggugggggguaagggggccaaggguggugguggugauuacugaaguuuaaaaagagaaauuaaaggagacagcuugcuuuccaaauguguugccucuaauaccauggaagugccauguaucaacgguaucacaguuuagaugcugggcuuguucagaaaacuagaaacuucagccuaacaauuuuuaaaaguacgccaucuacucuucugguuucauuacaguuccuuucacucauacuagaaagaaaaaaagaaacaauaaacuagcuacuuguuccugccaaaacuugucauuuucuguucuuccguuuuguuuccccuauuccucaaacaaaagcaaaacccaaucaaccaauaaaaaccugccuucaucugucaucucuguuuugaauauuuaaggauuuuuuuuaagcuuuuguuuuuucuguuuauggaaaucuuaagaauggauucugaaggcccauuacuugaaugauuuuggcagauguucaaauacauagggaacuugaugacauuaaagcacauuuuucuuuguaagguuuucaaguagaaguagauauguggggauaccagguacagguuuuguuuuuuguuuuuuguuuuuguuuuuuaaagcuaccuuuuuuucaguuaggcuuuuucucaacuguccauaucuuauuuggaaaucuuguuuaggaagcagccuuaaaaccuucucuauuuuguauuuagucuuaaaaauguaauaguuguugagaucuuguguuugugguauaagaaagaauuugauaagauuuuguguguuucuguaugaugcuuagacaagauuuuguguguuuuuauaugaugcuuuuuugcuuuucaaaaaacacuuuaggauuauuuuaaauagaguuuguuaacuuauucuuaaaugcuaauaggcucuuuuguuuuugagaaaaaacauguuuuggugauuuauucuucaauguuuuugacucuugccuuuguaaacuuccagagaauaaauaacaaacaaaaaacaggaaaaaggcauacacacaugcacacucauauacaauaucuagaaacugagaggaagcaagguagccaagacuaaugaucaguuuuuuucuuauacaaauaaauauuuucuuaaaaguucuguccucagggaacauuaucuaaacuugcagucuuuauguaaaggccuuuuuauuuucaaauuucuuguaauaaauaguauccaaaauaacuguugaaucaccagaauccuauauauucccucuaugcuaucuguguucauguaauuauguacacuuuuuuguguguguaauuuuguuuuguagauuauguuuaaugaagaacuuggggauccuuuuauuauaauucacaguaucucacugcuaaaugcugaagaacauucuauagcuacccuacuucuucgaauagagaaagaggaauuggauaugaaaggaagugguuucuauguuucucuggagugggucacuaucaguaagaaaaaucaagguaaaacaaaagucugaaucugucucuacugguuggcauuauuuaguagauuuugaaacacaaagcugucccuguaaauacuguuugcucuuucuugggcauuguguuacaauucuggcaccugccaccacugguggaaugaauauguauagauaguuuuuccucagguauauuuuauagaaaaaaauugcagugugcauccacagccaauuaugccuuuuauauaaaagaagacauuguuauauaaguuuugaauaauuuaacggguauauuuuuaauauauacaaaaauauaugcauauauaugugugauacacagaaacauauaccuaaaacuaaauguaaauuaauacauuauaguauaauuuaaauguaaauaaauauaaauacuuacuuggaaaugaaugucuuuauuucauuaaaguacagguaugauuucuuuuaaaucuaauugaacuucauuauuuguuucuacauuuaggaaaacuguuacuuuuucuuaccugaugugcucccauguuuagaauaguccugaacuuuggucuguuugaagcugucugucaagcuucuaacuugacauuaaaaauuacaaucucaugaauuaauuaggauuucuuuaagguauuaagaaaucucuuugccuuugcuuaguuccugcugacucauugaguguuuucuuuuuaacuguaguugaguacugagagugcuuguuuccauaaugacucuaugcucuuuuucucaguaguuuuuauuagcugacucauuuaugaguaaguuaauauaaauuaaauuaucauucaucucuguagaaaaauauuucuuuaccauagcugcuaguuugcaauucaguaaagacuguuaguauuuguuuccuaagaggguuuugccuuuuauucuaaaacagcuaucugucuaucuaauagauaucucaaaauuguuuauaaauaaacugaauaagucuccuagauuuguucuuugaaguauucaauauaauuuauuaguucuuuuugguguuguaguuuuaucucuggaggaacacaguaacuuuaaacuuuaauuagauauuagaaaacuuuuuugaaaucccaguugguaaccauaagaucuaugucacagcuauccgaguaugccaacacaguacaaaagcauccauagacaauauauaaaugaaugaguauaguuguguuccaaucauacuuuauggacauaggaauuugaauuuuauguuuuuuugacauauauuuaaauauuauucuuuaaauauuacuauuuuaacaauuuaaaaauauaaaauucaugcuuagcucacaggccauacaaaaauaggccuagauucagcuuuggcucaaggguccuaguuugcagaaccccugcuuuagauaauggaagccuuaauuuuuuuaagguacguaauucaaaaucuuacaggagacauugucaugcauauuccuccuccuuucuccaagacacuugguucuguaacaucuuuuucucaaucugugguaacucaucaaauugccucagaacauagcaguacucugcuccagcucuacuucuccaucccguuugucuucguuucuuugccucagcuggacaaauacauugagacuaaccuuuuuucucccaagauuguaguuauagaaucauuaauucucuuuauuguucccuuuaucuuucuuuuauaucuuguuccuucucucccagacuacuacuaauaugauugguuuuuuucuucuuuuucuuuuuaguuaacagaacaguauuuucguaaacuauuuugaaugaaacauuucauaaaguauauuuauggucagauaaguuugaaaauguggacauaaaauagcuccauuacacauuaagcauauuaaaguuucuaaaaauugugaguaaaaaaaguuuagguuagaugcaaaggcucaugccuguaaucucagcacuuugggaggucaaagcaggaggaucacuugagcccaggaguuugagaccagucugggcaacauagugagccaccgucucuacaaaaauuacagaaacauuagcucggcaugguguugugcaccuauaguuccagcuauucaggaggauugcuugagccugggaguuugaggcuacagugagcagugaucgugccacugcauuuagcuugggcaacaggguaagacccugucucaaacaaacaaaaaacaauuuacauuuaauuuuaaccuagcauuucuccacauauuuaaccacggaauccgguuuuugaggcuuccuauucuuuucugucccaugcaugcugggaaaggccacgcuauaaauaugugaugucgguguuuggaucuuuaaagucaaguaggacuuuuggcccugcauguaucuauaggggaaguguaggaguuuuguucauucauuaaauuacaagccuguucuuaaauaugugugaacugaaugugugaauguaggugaggauuuugaguaaaaacaaugagauauuuuagaacagaugguauuauuauguaaaaacucauaauaauaugacauuaaguugugauuuucgacuacucaguaugaagccuacaaguauaacccacuuaaagaguaacaguauagguaaaaguauggagucagcuaaaauguuugaguacuuuuuaaagcaaaaaauuacugucuuuauaggaaaauaaguuuaauuugucagaaacuuuuggaauacaguuaauuguuuauaucuuaaaaguagcacuaauuuauguuuaauuauaagcauauagauaaaugucuuguguaaaaaaaaucauuucugcuauaaauuuauuucauuguuaaaaugccccuuaucgggaguuagagcaggcagaaaaauagaccacacugcauguuuccccuuguccucaauuugucacuuuucagaagaaacuuaucacauaccugcugagaaggcagacaggcuuuagucaaggagagguaggucauacagaagcuguuauuccaaguaagccggucauguuggaguucugggguacugcugucuaauaagagauuucuccaagauggacauguuuuauauguguaccauucacugcaguagcuacuagccauguguggcuauugagcaauuaaaauguggcuaguaugacugaggaauuuaaauuuuacuuaauuuuaaguagauacuucuggccagugacuaccacauuggacaggacaaucgggaacaaauuucaccagacccaauauuuuaaaauagggacuuauuuacggaaaauuagauuguaaauuguuuauccuuaugaaaagacucuuaauaguguaccuuuuaauaauacauucaaauuauuuaauuauaauuaaaaucaauuuuuaaauaucagaauauuuugauaauaguuuuuauuuguaauguuuuguucugaaauacuuuucuuacagauaauaaaaaauaugaaauuauuaagcgugauauucuccguggaaagucagugccacauuaugcugcuauugagccugauggaaauggucuaaugauuguauccuacaagucuuuaacauuuguucaggcuggucaagaucuugaagaaaauauggaugaagacauaucagagaaaaucaaagguaauuuuuauucuuaauagagcuuauugguauuuucauaaacauauauuuaugucuuuuauuuucccaguuagguuaauaguucuacaagggcaagauagaugcauaauuuuuucuuuauuuucucauguauuuuccagaagucuuuuauaagguauaccaccuuaauagugugaaugaacugguuuaauuugaucauuuuguuauuaccaaaaauguuuuuuuaaaaaaucguuuauuagcuuccuugauuaggugcuuaauaaauaguuaucaaauaaaugucuauuugcuauuaguauugaugguauuaauaguguaauauugaagauacuaauuuuuaaaaauaaguuaagcuaauguaccuguucuuaccuuuuauacuaaacugaaaguaaguuccuugagggcagaaucacauaauuuuauuaauguugaaugaaugaaugaagguuauguuuuagcaugaaaagacuggccaggcacggcagcucacgccuguaaucccagcacuuugggaggccuaggugggcggaucaaaaggucaggagaucgagaccauccuggcugacacgaugaaaccccgucucuacuaaaaauacaaaaaaaaauccggaugugguggugggugccuguagugccagcuacuugggaggcugaggcaggagaaucacuugaacccaggaggcagagguuguugugagccaggauugugccacugcacuccagcuugggcaacagcgagacugucucaaaaaaaaaaaaagaaaagacuaacaagaaauuucagaagaaauuuauauuuguauauaaagaacagacauucuuuuaaagcuguucaagagaacauuccucuguaauaauuacuguucauauuucugauguucauagccagagaauaguauauuuuauuuaacagagauuuuuauaauauuuaacaauucuacauauuauucuuugaaucucccuuuuuuguuaaacaaguuauuuuaaaaaauuaguuuuaccuuuuuguuuuuaagugaaaacacguugauuaagaaaguaaagaaauaaaagaauggcuacuccauaagcagagcaaccuagguuuacuauuuuuggaugcuuuaagaaaugaauauuaauguaauauauaauugaaaaauauuuuccacagguuuauaaauauaugcaccucugaauacaaaaaguugugcuuaguaggccuuuucuuuagacuuuuaauaccuugguuuucucaugugggauucguuuuuuguuagauuaucucuaagauccuuuccugaauaaauguuacuauucugucuaauuauaaugcuaaccucauccaaagcuuagccagaauagcuguuuauuucucuagaucaugugucuuuagaauuccuuugguaagcaaucucgagggaauagaaagcuugccuuaaucuuuggaaccguucugcccagauaacuuggaaccaugcaguuccaagacagauugaagccuaagugggacacaucauguguuuaaaucacuaccacagguauuguuuuccuugaugacaucucaugcuguaucuugaguucccuccaaauucauuguuuauuuugucauaggauuuucacaguaauaaaggaaaaguguuguaauuuuuaaaaauuauggguaguuuggucauugauuggcauuuguaauacuuucugaauauuaauauauauacugguuuccuuuucuguuaacuucaagaagacugguauuaucuauuggcuauuuggcauuuuaauaacauguuuuuaaagaccuaaaacacaaucucuaaaggcauagaaagguacucaaagcaaccaguaauugagagaauuauuuagguguuuguauacauucaacaauguauacaauggggaggugauuaaaaaacugugacuuuaccuuuagucuacauccauggccuuucauuaauuaauacauuuuuaaaauuucaacuucuauuuuauauucacgggguacaugucaauguucuuuuaccugguuguauugcauggugcuuagauuuggaguacgaaugauccugucacccagguacugagcauagcacccaacaguuacuuuuucaacccuuucuacccccucuaguagucccuauuguauguuguugccaucuuuauguccaugaguacccaguguuuagcucacacuuauaagugaggucaugugguauuugguuuucuguuccugcacuaaucugcauaggauaauggccacuugcuacauucauguugcugcaaaggacaugauuuuguucuuuuaccuggcuguguaguauuccaugguguguauaugugccacauuguuuuuauucaguccacuguugaugggcaccuauguugauuccaugucuuuacuguggugaauagugcugugaugaacauacuagcacacgugucuuuauggcaaaaaaauuauuuauuuuuuauauauauacccacuauugagauuacuggguugaauuguaguucuguuuuaaguucuuugagaaaucuccaaacugcuuuccacaggggcugaauuaauugacauucccaccaauaguguaucaucauucccuuuucuccacagccuuaucagcauguguuguuuuuugacuuuuuauuaauagccauucugacuggugugagaugauauucuccuuguaguuuugauuugcaagugcaaaucucugauaauuagugcuaaugauuagugauguggaguauuuuuucauguguguuggccauuuguaugucuuguuuugcgaagugcuguucaugucuuuugcccauuguuuaauggaguuauuuguuuugugcuuguucauuuguuuaaguuccuuauagagccuugauauuagacuucuguugggugcguaguugcaaauauuuucucugauucuauaguuuguuuacucauaguuucuuuugcuguggaggaacucuuucauuuaauuagguaccauuugucaauuuuuuuguuguugaaauuccuuuugaguacuuagucauaauucauucucaaggccaguguccacaaugguguuuccuagguuuucuucuaagauucuuacaguuugaggucuuacauuuaaaucuucaguucaucuugaguuaauuuuuguauauggugagagguaggggaccaguuucauuuuucugcauauggcuagccagcuaucccagcacccuuauugaauagggacuccuuucccuauugcuuguuuuugcugccuuuaucaaagauugucagauggguauagguguauggcuuuauuucuugguccacuggucuguguaucuguuuuuguacuuuuuuugguuacuguagcccuguaguauacucugaagucagugugaugccucuggcuuuguucuuuuugcuuaggauggcuuuggcuauuugggcucuuuuuuggauccguacgaauuuuagaauaguguuuucuaguucugugaaaaaugacauugguaguuugauaggaguagcauuuacucuguaguuuguuuugagcaguauggacauuuuaaugauauugauuauuccaaccuauuagcuuggaaugucuuuccaguugucugucaucuguuauuucuuucagcagugcuguguaauucuccuuguagagaucuuucaccuccuuguuagaugaauuccuagguauuuuauuauuauuauuauuauuggcagcuacaguaaaugggauuguguucuugauuuggcucucagcuugaacauuauugguuuguagaaaugcuacugauuuucauacauugauuuuguauucugaaacuuuacugaagccauuugucaguuccaggagccuuuugguggaaucuuuaggguuuucuagguauagaauuaugucaucugcaaaguuugacuuuuccuaauuggauaccuuuuauuuauuucuuuugccugauugcucugguuaguacuuccaggacuauguugaauaggagcaguaagaguaagcaugcuuuucuuguuucaguucucaagaggaaugcuucguuuuugccuguucaguaugauguuggcagugaguuugucauagauggcucuuguuauuuugaaguguguuccuuugaugccuaguuucuuaaggauuuguauagugaagggauguuggauuuuacugaauacuuguucuucaucuauugaggugaucauaugauuuuuguuuuuaauucuguuuauguagugaaucacauuuauugauuugcauauguuaaacuaaccuugcuuccccaggaaugaagcuuacuugaucauggucaauuaaauuuuugaugugcuguuggauucagcuugccaguauuuugaugaagauuuuuacauguauguucaucggggauauuggccuguaguuuuuuugugugugucuuugccagguuuugguaucaagguuaugcugccuucauagagugaguuagggagggaguuccuccuucucgauuuuuuuggaauaguuucaguagaauugguaccggcuuuuccuuguaugucuaguagaguuuggaugugaauccaucuguccagggcuuucuuugguugauagauuuuuuuauuacugauugaauuuuggaacuugauauuggucuguucaagguuucaguugcuuucugauucagucuugggagauuguguuucuaggaauuuauccauuuucucuggauuuucuaguuugugugauacagggcuucauaauagucucuggguuuuuuuuuuguauuucuguggaauugguuguaauguuaccuuuucauuucugauuguguuuauuugcaucuucucuuuuuuuguuaaucuagcuaacagccuauugaucuuguuuauccuuucaaaaaaaaaccaacuuuugguuucauggauucauuguuugcauauuugggucucaauuucauucaguuuugcucugauuuuaguuauuucuuuucuuuugcuagcuuugguguuaauuuguuuuuuuuucuuguucuucugggugugauauuagaucauuaauuugagacuuuucuuacuuuuugagguagauacauagcacuuuccucuuaacacugcuuuugcugcaucccagauaauuuccaugauacugugugguuuuugagagaucuucuugguauugauuucuauuuuuauuccacugugaucuuagaguaugauugguaugauuucauuuuuuauaauuuauugagacuugcuuuauggcugagugugugagugaucuuggaguauguucugugugcagaugaguaggauuuauauucugugguugaugggugggguauucuguagaugucuguuagauuaagugucaaauuuaaguccauacuuuuuuucuuuaguuuucuaccuugaugaucugugugaugcugugagugguauguugaaguuccccacuauugucuuguggcuaagucuuuccauaggucuagaaguacuuguuuuuauguaucagggugcuccaauguugagcacauauauauuugggauaguucagucuucucauugaauugaacccuuuauuauuauguaaugcccuuuguccuuuuuuaccuuuguugguuuaaagucuguuuuaucugagguaagaauugugacuccugcgcuuucuguuuuccauuugcauagcaaguuuuuuuccagcccuuuacuuugagccugugggugucauuauguguuagaugggucucuuguagaaugccgaugggccuuguuuuuguuuuguuuuuuuuuuuuuuuuuuaauccagcuuucuacucugugccuuucaagugggauguuuugaucauuuacauuuaagguuaauauuguuaugugaaguuuugauucuaucaugaaguuguuacugauugcuuuguaguuucuauuguauaguugcuuuacagggacuauggcucuguccuuguguuuuugugguagcagauacuguucuuuuguuucccuguuuagaacuuccuuaaagaucucuuguuaaggcugguauagugguaacugauugucuuagugcuugcuugucuggaaaagauuuuguuucucuuucacuuaugaagcuuauaguuuagugggauaugaaauucuuggguggaauuucuugaaaaauucugcaaauagcucucaaucucuccuggcuugugagguuucugcugagaagucugcuguuagccuaaugggguuccccuauguaaucucuuuucuuuaggugccuuuaagguuuuuucuuuaguguugaccuuggacagucuagugcuauaugccuuggugaucuucauuuuguauaguauuucucagggguucuggauuucuuauaccugaaugucuaccucucuagcaggauuagggaaauuuucugaauuauucccucaaacauguuuuucaguuuguuuaguguuucuucucuggaaugccaguaguuaauaggguugguuacuuuacaugauuucauauuucucagagacuuuguucauuuuuuuaaaauucuuuuuucuuuauuuuugucuagcuggacuaguuugaaagacuggccuucaaguucuggaauucuuucuucugcucaguucagucuguugauaaagcuuucaauuguauuuggaaauuccauaagugaguuuuucaauuccagaaguuuguacugauuucuuuuaaagauguuuaucucuuccuucauuucuuggauugcuuuagaaguuucuuuguauugauuuucaauuuugucuuagaucuuguugagcuuccuugcaauccaugcuuugaauucuuugugucuuuuuucugagugucuauuuugguuaaggaccauuucuagaaagcuagugauauuuuuugucaugucacuacauucagauuuuuuuuauggugccagaauucuugcacugguuucuuuuuuuuuuuggaauuuuuuuauuguacuuuuaaguucugggauacaugugcagaacgugcagguuuguuacauagguauacacgugccauagugauuugcugcacucaucaacccgccaucuacauuagguauuucuccuaaugcuaucccuccccuagccccccaccccccgacaaccccggugugugauguuccccucccuguauccaugaguucucauuguucaacucccacuuaugagugagaacaugugguguuugauuuucugguuucuuaucuagagauucuggcacuucaaauuuuuauaauauuuuugugcagauaggauuuuuuaguuuucuuucuuuccuuauaauauuauuuuuguuuguuuguuuguuuguuuucuuucucuuucccucucuagggggugugacuauagagaaugcagaguagggucuuugggcuuugcuuccauagcccuaugcacuucuguuggcagguuguauauugggcuaugcaguuuaaccuacaagccaguagauggugcuuguuaguaacagccaauugcagccagugcagcaggguauauacuuaauccuuguuuacugggagaacucucuauugccucaggcaaugggcugauucuuggauugcacaguugucugagcucccugcucagccccggggaguaggggccaagaugggcaggacgagacugggcagaucugccuacagaucccccaguggcagguguggacaccagcgcugagggagaaucuaccuggcagccacuaaaugcccagaggcauaccuaaguguggagcuaagaaacccucccagccccaaguucucuggacaggguucgggggauggcaugagcuccuaaucuaggagagcuccaggugccuggagcucugccuaggcauggagcagggagggccccucuguaugaaaaucucugcacaggagauguagguuaacucaggcuguugaaacaggcaaacaggugcuuugaaugccugaaaguccaccugggugugaagcagagagggccccccaacaccagaucuaugaauaggaaaggugggacaguucaggcugcaaucugggcaaggugcuuugaaugccuggaggucugcuuagaaauggaguggauagggccuggcugcacugugauguaugcacaggaaggguugggguaguauggccuuuaauuuauacuaaaagugcaugugauuuugcacauccucccauucccauuaucuggcagaagcuauccauugagauauuauuauguaacugcuuugcuagcuuuucuggguaacauauuuuauguucuuuugaacuagggauucacucuguguguguguguguuuguuuaaaggaaagaaggagugaaagagggaggaagggagggagagagggaagaaaugaggauaaaggauugcuaucauuaguauuuuaugagugcuuuaucuccucaagcaucagguaagucuggaagaggaaaauuucauguuaauugcugcaaaucuuugagugaaaauuccucaaagagaucugugcauguuuguuuauaauuacguuuugugagaugaucacuaguaaauauacuaaaauucuuuuagauagguuuuguguguguguaugcuuucucuaauuuuuuauuacaugaugcauuuuucuuuucccaauagaaccucuguauuacuggcaacagacugaagaugauuugacaguaaccauacggcuuccagaagacaguacuaaggaggacauucaaauacaguuuuugccugaucacaucaacauuguacugaaggaucaccaguuuuuagaaggaaaacucuauucaucuauugaucaugaaagcaguacauggauaauuaaagagaguaauagguauuuuuuuuuaauuuuacuuuaauauucuauuaucuuuuuuucuuuucuuuuuacucuuuccacagugguuacaucagagauuaauacaauaguucugucuguauugcugguuacuuuucuuaagauauauuaaaaauagaauuacugugucaaagagcauauuucuaguugaaauuaaagauaguagcauagcuaucacuuggagaauaugguagugcuuuguuuuaccagcucuggauacaauaauaaucauaggugaaaauggcuauuuuaaauugcacuuuuucaaacuuuuuaauagaaauaauuuuuuuaacuuuaguuugcuggcuugauaauauauuuccauucuuuaaaauuuuaaauauacaaaaggauguagagugagaagucugccuccaacacaagccuaugggucacccauccucccacuccucacaaucaguguuguuacauuuuacauacauucaagcaugacacauacuuuuuccuuuucuuuaaggaaaacuacuuuuggcggcuagcugcaguggcucacgccuguaaucccaacauuugggaugcugagguaggaggauugcuugaggccaggaguuugugaccagccuaggcaagaagagaaaacccugucucuaacaacaauaaaaaaguuuuuugacacauacuuuacacaauuauacaucuugcuuuuguucacuugcaaugauaaaucuuagggaucuuuccauaaugaauauauaaaaauuauuaaauucucuuuuaugacaucacgguauuuuauucuaucaacugcaccaucauuuuagacaauuaauccucuauuguguuaauuuagguuguuuucaauaacuucuguuuauauacauauuauuucacauguguagaaauauauaugaaggauaaauuucuaaaaguggaauaauuaauauuucuuuguaaauuguaguaauuuuuucuuauguaaauucuccauuuacauuuguuuuuugaacuguguguucaggacacaaagccauaaaagaaauacauaaguggccaggcacaguggcucaugccuguaaucccagcacuuugggaggcugaggcggguggauugccugaggucaggaguucgagaccagccugaccaacauggugaaaccccgucucaacuaaaaacacaaaaauuagcugggcgugguggcgggugccuguaaucccagcuacuugggaggcugagacaggagaacuacuugaacccgggaggcggagguuuccgagaccaggccauugcuuuccggcccugggcaauaagagugaaacuacgucucaaaaaaaaaagaaagaaauacauaaguuagacuucaucaaaacagacauuuucugcauaucaaaauuaaaaauuuuuguucuucuaaagauaccauuaagagaacaaaaagguaagccaugaacugggaaaaaauauucacaguauucaucuuaaaccaaaggacuuucauucuuaguguauaaggaagccuuacaaauucauaauaagccaauuuuuuaaauggucaaauuauuugaauagacaugucacaauagaagauagaugaacagcuaguaagcacaucaaaagguaauuaucauuagacauuaggaaaauuaaaacuagagugagacaccaauacaugacuaaaacuuugaagacugacaguaucaaacguuggcaaggauguggggcaccagcaacucauucauaucugguacgaguguaaaauaauaauacaaucacuuuggcagacuguuuagcaguuucauaucaaguuaaacauauaccuauuuuuaaucuuaacaauucuacuccuugauguuuaaccaaaauaaaugaauguauauaauuuuuuguuuuucugagacagggucucacucuguugcccaggauggagugcaguggcacagucacucagcuaauuuuuguauuuuuuguagagaugggguuuugccauguugcucagacuggucucgaacuccugaccucaagcgaucugccugcuucgaccucccaaagugcuaggauuacaggugugagccaccaugcccaacugaaaauauauguuaaaaaacaaaacaaagccaaaacaaauuugcaaacauauauucauagcaggcauacuuauaaaagccagaaauaucucuaguguuacugaaaaggugaauggauaaguacgugugguauauucauacaauggaauguuacucuguaauaaagugcuagcaauaaauaaaaagcaauaugaaugaauuaaaaacauguggagugaaagaagccaaagacaaaaaaucauacuguaugauuccacauauggaguucuagaacuggcaaaacuaaucuauggugauacaaaucagaacacuuguuaucucuaggguguagggagauugacugaagaaaggccaagggaacugccuguaugguggaaauaauucaguauccucauuggguuacaaagguguaugcauuugucaaaaucaguaaauucuacacuuaaaaccugugaauuuuauuuauaaauuacaccucaauuaaaggagcaaaacugugucuuuuuaaaaaaagauaaaguuaagugucuuuuaaaauuauaauccuuugccccccacaacugugccauuuugcaaaucuauuauuccaggcaguuuuuuccccaauuauuuggauuacuaaaauuacuuucuuuuauuuuaaaucaagucuuaguaauuauuaaauucagugauggauuaaugaauagaguuaggcaguuaauuuuuuaaauagucaaauuuggucagaaaugagaaaugguugauuuaaaauacaaccuaaaucuugugcuuuaaguugauguuacauagaggauaacuuagauguuuuuacacaaaguauaguucuuaauuaguaguauaugauccaugugagucugauacaagucuaaaucaugagcauccaagaaaaauauaucuagcucauagaaaguuugaaguuguaaaagguaucuuacauuuuauuaaugaagacauuuggugauuuuguuacacuuuuuaauauaucaaaaauaauugcuugaaaguuucuuuuaaaaguauuuuguaucuccacauacuccauuuaauuauguuuauguguaugugagucacauuuacaaauuggcaagccaacuagaacauauuguuaaauguaagucaucaagcaguaacccagcaaaggucugggggaauagcuugacuucauguaaguaguuucagcauucaaugcaucaacauagaucaguauuauuuuuccauuaaauuugagguguuugauuauuauuuuguguuaaaaaagauaacuacaauguagcguaggugguauuguuguuuuaaaaacacgauuuucuguacuugaguaaauuauucguaccucucguuuucaaaaguuacuguugucucacuuuggaaagauuuuuuuaacuaaucuguaguuuauuauauuuggcauuguuugggguuuuuuuuuugcuuggaugguagcauacaauacuaguuuuaaaacguacaaaugcagucuuagaagaagggugcacugauuaacugugcaaauuaaugaugguuuggaaauuauaacagauuguaucaacucuuucagaccucuuuagguagcaacuaagaacaguucacuggguaaguguucuuuaauaguuauuuacauauauuuuuucagagaggcagaauagugcaguagugaagaacauggacuuagagccagacuguuuaaauagcuugugaccuuggcaaguugcuuaaccucaguacuuuuuuuucuuacuuguaaaauggugaugauaauaauauuuacaguacuuuauuugguuguuguaaccaaugaguuaaaacauguaaagugcuuaagacagcaccugacauauagguaaguauaagcuauggucauuauuacuauuauuaucaucaucauuauuaucaagauuaccuuuauccuuagaaaauguaacucagucugggggcugggcacgguggcucacaccuauaauccuagcacuuugggagaccaaggcaggcagaucacuugaggccaggaguuuaagaucagccuggccaacaugacaaaacccugucucuacuaaaaauacaaauauuagccaggugggcaugauggcguggccuguaaucccagcuacuuacuugggaggcugaggcacgagagucacuugaacccgggaguuggagguugcaguaagagagauugugccauugcacugcagccugggcaagagagugagacucugucucaaaaaaagaaaagauguaacuaaaucugggcuuuuauugugggaguaauuuucagugcuaauuauaaguacucauauuauuauuuuguauagucucuuaaaauagguaguuucagaaaaauguuaaaugcuguaauucauaagguagugauuguaacagucuugaaaaagaacagcugguaaguuugcguguccuauuugauaacuauaauaguuauuauuguauucuugcaguuguguuccagggcaugagcuaauaugguacauguguacgaaagauggcacauggaaaagguugcuuuguuguggaauagcuauuaccacuccccuuuucuguuauagcagugggugcucccaaagcaucuuacuuggguuuuccuuccuauuccagaggaacaugggacaaguuacuucuucuccuauguccguagucugccuugacucugcucucuuucccuuuccugcugcaucaguccuugaucucaggguucccugacagaccauuuuaagugcaucuggaauuguuuaguuguuuacauguacagaauuagauuuuaaauaaguuaauagagaacacauuaacaucuuuuuucccuguauuaccaaaguuaauuuuuuuccuuauuucuacuuuucaguuauuuaacaucuguauuuuaaaauuaagauuugcguugauuuaaccugcuugaucuucagguuaauaaucauauauuauggcucuuaguuugugaaaauaaaguuaauuguugauuccagacacaaagaauuauccuuuaauuacagcccuuuuacucuuugcuuacaugcccacacccccgaccauuccccagaugucuuauagauccaugcuucuuguauuucuauuaaguucaggaacauacugcauaccaguacuuucuggaugacuugacucuuuccaggcaauccucucuucaggccauuugauguaccauuuccagugguacuuucuuucuuuauuaaaucuggacuauuugccauuggauuauagguuuuccaucacaugcaaaacuuaaaugagcaagauuuuugguaaaccauccucuggacaccggaggguucuuucuauagaagauagaaacaaacaauguuugcuacugauuguauaauuuguauaauugcuuaauguaacauuacuuuucccauuuaaacuucuagcuuggagauuuccuugauuaagaagaaugaaggacugaccuggccagagcuaguaauuggagauaaacaaggggaacuuauaagagauucagcccagugugcugcaauagcugaacguuugaugcauuugaccucugaagaacugguaaguaguuggaauaguagugugacuuuccaaggguccaaaaauauguuaugugaagauuaugccaugcuuuucaaacaauauuuugcuuuuccuaauauaaaagauacauaucagauacuacugaucugagugauguuugaauauggccuaaguucuaauauuuauuucuuacacuauguaaauacauacauauauguguggucauacuguauagaggguuugccuguaucuguuuaugugugcguauguauugugcgcucucucucucuacauguauucuuuaggagaaucaacugaccaaugcugguaggacaaaaauuauguuacaauuuauuugcuaagaaucuacuuaucccuaaaauuuuugaggugaguuuacaauuuugcaaggauauauguaucauauauaguauaguuauuuuuucuuuauaauguaauucauugugauaauuacagugacaacacaauacuuaaucaugagguugaauacauucccacucucaugacguguaagaucauguuaagaaugugaacaaauacagcaguacaucagaacuugaaauuauguguucguuuucuaacaaugauaucagcauaugaaagaugucugguuuauugccaucuugaauuauagagaugaggaagacugugcaaaaauuauuuauacuguaauguuacuugcauccuaagauagaaaagaaggacuggaauauugaaagugaaugucacuaucaaaaggaaacauggcuaaauagagaaacuaaguuucauguuugccaguaguaauugaaaauuucagaaaucacuggaauucuuauguaggacugcaaaacuuugauuucauagcccuguuuacaacaagccaugcaggcugcauugccuuauauucgcucauucagcaaguauuauuguauuaggcucuggggauauaauagugacaguaguggagauguguuuugagauuguagauaauugcaguuaacuacuuguuaaacucaaugguuucaauugaauguuaguguuuaugagaaaguuauuuaugccugaacaccaguguguuuguuagauuaugagaagacaaauauacaaucucaucugcagcugaaggcaguuuuauguuuuucaauuauucauacuugccuuacugcagugguuagaaugucuacuccacagcuauauagaacucucgaaugguaaaagcagacauucuugccuuauuugugaucuuggggaaaauaaucgacuuuuaucauuaagaaggauagguucuuuuuauuacauugaagaaauuuucuucuauuuguagugugcugagaguuuuuaucaugaaugauuauagaauuuucugcauuggugggauaagcccgucuuggucaugauguauuauccuuuuacauauugcugaauuugauuugcucauauuuucuuggggauuuuuaugucuauuugugaggaauauuggauagguuuuuuguuuuguguuguuuuguuuuuugccaucuuuuuccaguuuggguaucugggauaauaaccuuguaaaaugauuagggaaguguucucucuucuauuucuagaagagaauguauagaauuaguguuaugucuuaaaauguuugguagaauuugucaguaaaacaaucuggaccuugaguuugcuuuuuuggaaggcacuuaacuauggugccuuaguuuuuaauguuuuucauuucuuuuaacagauauaggucuaaugugagcaucuguuuccauugccuuuguuuuucaguuuuccauuucuuauuuucuguguuaaauuuauuauguucuuccuuuuguuuaccggggauauauuuugcucuuuuuuucuauuuuugaaggugauacuuaguugauuuuugaccuuucuguuccaaugaaagcacuuaauguuguacauauccuucuaagcacuacuguagcugcauucucuaaauuuuugccuaccuucuuaauuccauagggauugauuugauuugaugcugggcuucagucuuuuacauggcugauuuauuccauguuuauucuuacaccuaaggcaaaacuuuucauuuaucucaacugaaagccuaggaugguuaccaggucuucuccuacuguguggacucugaagucuaauuuuugacucccaagcacuuuaauaccccaaacucagcuuuuuagcuccuuauuugcugcuuuccgcuugucuuuuucgacucaguuuagaaaucagcaaaugguccuuggaaagcaguauagcauguuugacccuuuucucugcaauuuccuugucucucuaaucuuguccugugaagcacugguggccuugauagucccgaacuuuuaauuuuuucugcuucuaaaguaugaauaauuggaaggggaagggaaggagaaaucuauaggguacuuucucuauucugcuggacauagauaucuccuugagucacugugcacaauggcaucaacuaaccaggagauuguuggcggugccuuuacagccagccacagcaaccauaauuguucccauugauauuuagaguagaggcaacagccacaacuaggugguuccauaucccagcugggacauggacacauguugaguauguagaucuucuagaacucccauccauuuaguuucagauucucucaguucauuucauuaaguucuuaauaacaugagaauuaacauaucucuguaucuuagcaaacuagauguuuacacauuuggucaguuguagaauuguauuucugcuauaugcaaauauuguauaauuuauuccuuaauuauugugauccuguuacucugugagguauauaagaccagacagugacccuugcauugaagcaagggaacauuuaaaaauugcuuuuaugaauuuaugaauuuuaugaauuuauuuaugucuacuuuaagcauauuguuaacuauauuucaauguuucuguuuggguagauauuugcguguguguguguguguguguguguuuuagugguucuagagguuacauauuugacuuaucaccaacuaucuuuaaaaacuguaucaucuauaauuuaagaaauuuauauuuuccacucuauucuuuguauuauuguugucuuacauuuuauauuuuauauucuauuaaaauuaauaauaccuuguuauuuuagcuauagucaguaauucucuuuuaaaagagauuaaaaaugugaaaaacaggucuuucauuuacucuuauauuugccuuuuccucuauucugcauuccuuuguguugauugacauuuucaucugauguuauuuuuuucuggcuugagagcuucuuuuagcauuuuuucuaguguagauuugcuggugauaaauucucucagcuuuuuucugcaaaaauauuucucuuuucuucccuuuuccaaaguuauuuuuguuauguauauaauuugguguugacagguuuuuguuuuuguuuuuuucucuuacaccuucaaauauccaccauuguauuccggccuacauaguuucugaugagaagucagcugucuuuuacaucuuuguuccucuguaaauaauguaucuuuuccuccucugucugcuuuuaggaauuucuuuauuucugcuuuucagaaauuuaauuauaaugugacuuacugugguuuuugauuuuuuaaagaaaauguuuguugugcuuggaguucuuugacauucuaaaguguuggccauuacuuauuugcaauuuuuuuccccauucuucuugcccuccuccaguuacccauaugcuagaccauuugauauuguuccacaggucacugaguuucccugcuuuuauguuuugucuuugugcuucauuuuguagucacuauugcuauuuuucaagcucgcuggucuuuucuccugcagugucuaaucagcugucugucacaucuguuuuguuuuucauuucagauuuguguuuuuauauccagaaguucagugugguucuuucaucucucucuuucucaacaugguuauguuuuccuuuacaucuuugaguauauggaacuguuuauaauaccuguuuucauauccuuuucuguugacuucaucauucuguuauuucuguuuuugugauuaugauuuuauuggucauagguuugcaauucauuuuuaauuacugcuguaaccuuaaaauuuuuaaagaugaagaaacccauucccuuguuuauuuguuuuacuuauuuacuuauuuuauuuucuggacuaagaauccaaauccagauaaagaaaaaccaccuugcaaugcucaagaguuagaagaaugugauauuuucuuugaagagagcuccaguuuaugcagauuugauggcaauacauuaaaaacuacucaugugguaaguuacugauauuaauauuucuaaaauuuugucaguaguuacucagauaaugauuggucuaaauauguuuuucaaagauacuugauuagcaguuacuggcuuugauaagucucaucacuccauaaaguagcaucuuuucauacuaccacacucagcaaaacaguguuguauaguuuugguaccacuguauauugauaucuuucaaguggugcuuuucuggacagcuuuuuaauauacaauugugacccuguaauguauaauaacuucacuuuuuuuuuuucauucaacaguauggacuuaaguguuuccucauguuauugaaaugucugguuuaaugguuggauuaugcuaugauguuggucaugucugcauguagugguucuacacauuacaauaaguaauaacuuuuuuaaaguacauuauuuaugaugaugcuauuuuuaaaaaucucugucauaugaagccuuuucuauuuccagggauauuuaucuaauaacgaguuacagaauucaaauuaaugaaucauaagccucugacaaauugauuaccacuuauauuuuuauuaguaaugauugcaguuauugccugauucacugcaucuucaccuucacuuuuguuugaucauuauuaauugguguguagaauaaacuugugccaaucuuuuuuuuuuuuacugucaaguuauuuuauguaauaacuauuucuuuugugaaguuuuuauuugucuuaguguuucuuaccaauuuguaugauguguuuuaaauuugaauaaugcuucuauaucaagugaguuaauuuuuuucuucuuuuuauauuuuggaauguuuuuuauucagcucauuaauucaucuggaauuuguuuuuccuuuucucucuggugugccauauaugcauauauuucacaccccaccuuaaggcacccccccccccccccgcccccgccaccucaaaauuacacucuuuuuacaagcuuugacagauuuguauuaagauacugaagaagacugccuggaguggcuuggugcaguagauguagauuuuuuuuuuuuuuuuuuuaauuuagaaccuuauuagauauuccuucuuaggggaauccuuaaccauuaguuaauacuacuaaauguguuucauagaguuguuuaugugagcagggugucucagcaaaucaguggcuaauuuagagcugugcauauagaaauuaaucuaguguuauuacugaaaccagaaggaaauuuaggagacucauuccaagcaaaagcaacagaggagauugagaacaacuuggucuuuuguuucuguuuuuagacuugugagucuuugauacagguuucaaagguucuguuuucaagaaaaaccugaaaaaugucugccaagugugcccugauguuucuuugucacguagagauuugggggaaaguguauucuagcagaauucauguaaccgaaguuaaaagugucaugggaagcuggcuuaccaggucugaguucuggcccaacauuuuacugacuaaaaggaaauauaacuguucuucucacucgcuaucccuuccuagucuuuuuggauacuuaccagcuuuauuuaauggcugaacauuaauuaguacucaaagaaguaaaaugagcauuucuagauuacaccaguguagauaaaugagguggaauggcauaggaccaauggcuaggcagaaguaccauuugaaacuguaucaaaauuaaauauuugcuuuuacaauuaauuucuaucucuucaaugcucucuuguucaccacacuuuaacaccaguaaguucuaaaaagcacauguaugacauuuuaccaguguccucaacaccuaccaaauguucugauucauaauagaugcuuaauauauuucuuuagaauuaucuuuuagugacagucauuaaauuaaaaaaaugguuuuagguccaucuuggaucucaagaaaugaauaucuuucauuuucccgcuuccucuucaauuacucuucuaauugaagaguaagcaguauucuuaaucagauuauuauauccaggcuggguacuggucaaaacccaagauuauuggagcuguuuugauuuuuuaggaguuuuacuuccuagauguuguuuaguuuugacauaaucccauacaugauucccugaauugugauaaauaagagcuaucacauagcugcucuucuuuuuauuaccuuggguuaaauuuuagagaaccaguugcaggcgugacugauagaaggcuguugaaucugacuuaacuggagauuauuuguucuaauaaugaagaaucugguuguucuucuuaacguuauaguuuuaggugcuauaacucuuagauacuguuuucugccaaacuuuugaaggcagcuauaucuuaggugucauaaaaugcugugguuuaaacguagcuucccugagaauuucaguucaucuuaguacuccuaaguauuguugaucaguaguuuaauguuggucacuaagauacccccaguuuaugauaccuuucuucauuuccuauguuugagcauguuaauuaaaaccaagcaauggcaaaauaaaaccauuauuacugauacauuacaguaccaaagcuuaguggaucugcuuacuaaguccuagaauuuagcagauuuaacuauagucacaggcaauguuacaucagcucuggcugccccuagaggggcagcugaaaccucuucuuuccugaggccucuagcuccuuauaggaaaaagugauagaacugagcaaaauacaccgauuuuucuuacauuuaccaaucaaaugugacuucacuccucaggaauuuauaaaagcuagaauguuauagcaguggaucuucucagugucguagauggaaacaucaagaguggggaagaaguccaauauauaauaaaaagggacaaucuuuccagcuucaaagaaauuccauauuucaucuucuucauuuuacagauuuauuaagacaagcugagauagauggaguuuauaugggaucaaagcgagagucaguaguagaaacuagaucucucgggcugccaguaugcuuuccauaauuuucccuaaacaacaggaucauaaauuucuauuuggaguuacuaagcuacugcaguuaguacuuacuucugaauaaauacaguuagucuucuguguuccuaagagugugaacaauagauuucugugguaagcagguucuauccucaguaacuuaagaaauaaacaaauaauccuucacuguaccauagcuuuuauagacaauauuugaugagacauuuccaguauuuuguacauacuguuuuaacuauuuaaucacauuucagaguuuaauugcugguuuaacuucaauuaguguauaauuaaaacuaaagauucuuaucuuuguuucaguuggauuuuaaaccaaacuuucuuuuuaugauuauaagcccuuuaugguagaacaauuuuuauuucuuuggauauauauacagucaugggauugcugggucagacgauaauucugcuuugaguucuuugagaaaucuccaaacuacuuuccacaauagcuaacuaauuuacauuccuauuagcaguguauaagcauucucuuuucuccccaaugucaccagcaucuguuauuuuuuuacuuuuuaauaauggccauucugacucgugugagauccuaaauacugaguacauauggacacacaaauaaaaacaacagacaccagagccuacuugaggguggagggagggaggagggugaggauugaaaaacuaccugucgggaacuaugcuuauuaccugguuggcgaaauaaucugugcaccaaacccccaugacaugcaauuuaccuauguagcaaacuugcacaaguaccccugaacauaaaauuuaaaaauuauaagcguuuugauuuuucuauuacuaauuuuuauaaauauagacaaaaaugcagugaaguaaaaaugcauaaacguauauguagaauggauacucauacaauguuugaaauuugaaauuaccuuacaugggaagguuaguauauguccuuagaguuuuagaaaauaauacuguaaugaaaaggucagaacucuauguuuuaaaugacaaauaucccaaaauauguuuccuuuaaagacauggacauuaggguuagaauugccauuuugaaaauaaaauguuaaauaaauaaaugaagcagcacaauaaaagaaauauuaaauaucagaacugaauauuuaauauuucucugaaauauuaaauuggucacugaaguguaaagcacaaaucagaauucagauagaauugaagaugaauuauuuuuacuucuaagagcuaugcugucaaaauguuagccucuggccauauggugacuauugagcaauugaaauguggcuagucugcauugaaaugugguauaaauauaaaauacacaaccagauuuugaaaacaugaaauacauaaaacauaaaauauuacaaauagccgggcgagguggcucacaccuguaaucccagcacuuugggaggccgaggugggcggaucacgaggucaggaaaucgagaccauccuggcuaacacagugaaaccccaucucuacugaaaauacgaaaaaaaaaaaaaaaaaaaaaaaauuagccgggcaugguggcaggcaccuguagucccagcuacuugggaggcugaggcaggaaaauggugugaaccugggaggcggagcuugcagugagccgagaucgcgccacugcacuccggccugggugacacagcgagacuccgucucaaaaaaaaaaauuauuacuaauaaauuuuuauaucaauuuucauguugaaaugauaaucauuuggauauguuucauuuaauaaaauguuauuaaaguuaauuuauccaguuucuuuuaaugcuuaaauauggcuacuagauaauuuaaaauuauguauguggcucccauuuuauuucuguuggacaacacugaucuguauuaaucaaauuauauagacuugaaugaccagaaggugaaaggauauuuuuaaguauuagauuauggugaauuucuuagaucagaugauauucaucuguugcuuaagacagggguccccaauccccugggccacagaccuuacaggucccuggccuguuaagaaccuggucgcacagcaggaggugagcagugggugagcuccgcauccugucagaugagcagcagucuuagagucucaaaauggcguuauugugaacugugcaugcaagggaucuagauuaugcacuccuuaugagacuaaugccugauaaucugagguuucauccuggaacccccacacaccccugccuuuguccgugaaaagauugucuuccaugaaauguguccuuggugccaaaaaaguuggggaccacuggcuuaagauauaaaauugaaacaccugaaauaauauuuguaacuuuuaaauaaacucaucaagacaggaggaagaguuacaaacagaaaauaauucuuuuaaguuaaugucauuaugaaaggaaguaggaaaggcaagugcuguacauuguuaauccuuucaagaggauauuaaggauaggaucagaaguuauuagagcauuuauaauaguguaaauaguuauaauaguuuaaaaaacauuuaaaagguaucuaaaccagugguuuuuggucucaggaccccuuuacauucuuuuuuuuucccuccauauuuuauuaaacuauuuggaaaugaaaaauuuaaauuauuauaaaaaacagaauuauccauuacaaaaagucauucaaaguaaugaauaaucaaguaauuucauguaaacggcauuuuuacgaaacaaaauuguuuaauuacuaacaauucauuuguaauuaaaauuaauguuagaagauuugagauuuauuuuuuaauuagguuaaacauuauccuugcaauuauguuucacugaauaauuaguauucuuagcaagccuuuuaaccacccaauggguuuacuuugccugucuuuaccuccuuaagcuuuuugguguacuuaauuuuuauauuuggauuauauuuaucaaaacguaucauauuagaaauuaagaauuuuuuuaaauauucauuuuaaaauaauaaccuauuaacauaaauaauauuuucuaaugaaaauugggaucuuuuccagaguaaaaaaaaaaaaaguaggaggaaugucauuguuuuacauuuuugcagaucucucuaaugucugcauuaauauaguugaauccuuauaucugcuucugcauucaaucucuugcaauaugauacuguaguugaaauauauucagauuccuauagauauauaacuggaaagaaagggauacuuaauuaucauuugcaguuaauggugaguuuuuuccuuugauauuacaccaaaauuugacaugcccauuucuuaaauauuaguugcaauguaaacuuuucaugcucuguuacuuuaaaaucaguugguuuuugagacacuuugaauggauguuuuuacccaugacgauaacuuggaaauauugcuucucagaguuaugcagacuuuccaaaugcuaaucuauuucauuauucaauauaaaccgauacacacauaagcauuuguuaauauaccacuaaucucaccagaaaaguguuuaaggauuggcaggcuauuauccucauggugauaaauaugaguucuucaaaauucuaaguuuuguucaaaagcugaaauuuuaucuuuggcaacaaauacuuuuggguguucuccuugaagugacagacuuuggucauuuacuuuggaaaaauguuugccaaaucucaauucagaauaaccauaguuugucgacuguuguuucagguaaaaaugauguuccaugaaaaaacagccauuucaguguuugcaacucaaacgauucccaagugcuucccaaguacaaccaugguacuuuaguaugcagcagaagugcuuuauguguacuuccuauuuagucaugcagaauacuaaaaagacauauacucaagagucaagauuuaauaaaauuaaucauuuugacuucuuucucaaggacauuuuaaagugaaacuggccuuuucuuuacagugaguacguggcagugaagaauguagcaacuucaaguaauuacuaguauguggugcuauuauuugcaguaauuuaugcuaucacuccaguuuuaccuacuuuuccuuuuguaccauccauacaaauuuaaaaauagggagaaagcaauuuacauccuaguauuacuaugaaaauaguuuuaagccuauggacccccugaagaugucucccagcaccccccuccccaacccaauaggguucugcauaucauacuuugagaguggcuaaagcagagauuguguguauaugccacucacacaguaacagcacuaauucuuagaaaguuacagaauaauaguuacgucaagaacugugaagguucugagauuuuaccccauuuacaggcuaacaaguuaaccugccaguuuaauggauucugguaggagacaggaaauuacuggauuggagucuuuauuugcacaguaaacagcauaagcauuagcauauuugugccaauuucucaagucuaaaauucccacugggcaaaacagauggguccagauggauucccaccuacaucaauaggcuguauuacaggagagaaaacuugagcuuagggaacuugaaucugcuauaaugaucaguuagcaugucuaacugcuuguugucauaaacauuuugcccauaguacuggagggaggcacucuaucuucuaagguuguucauuaugcaaacaucccugugugaacaaaguucuuugagaaggaauuuggaggaaagagacuuuauuccagugaacaguuuacagacugaggagauguagccuuaggcagccuucaguguaaaaugaaggugcguucuagagaacaaagagaggguucaggguuuuuuuuuuuuuuuuuuuuuuuuugagacagagucucacucugucccccgagcuggacugcauuggcacgaucucggcucacugcaaccuuugccucccagguucaagcgauucuccugccucagccuccugaguagcugggauuacaggugcccgccauuagacccagcuaauuuuuuauauuuuuaguagggacaagguuucaccauguuggccaggcuggucccaaacucaugaccucguuauucacccaccuuggucucccaaagugcuaggauuacgggcgugagcuaccacacccggccacauucagguuuuauagcaacaguuccugcccagguucccaagcagauccguuuaugcaaaugaaugaauuacagcuuaguucugaucgaucagcacagcugagccccuuggucaauauaguugagccaugauugauugauuuacuuuggaagaauguuugccaaauacccaauucugaauaaccauaguuugagcugaauaaccacagcugagcccugauugaccagggcaggugagcucugacugguugguuuucaagcauaaaaccagaagucucugucaaguguuucuuucaaauggugagugaugggugaggggauucuggcugcuguuuauuuuggcaccaacaauaggaacugguuugacuuggcuguagaaaaggaaguccugucauacuuuuacaacagcuuucugagaacacaauaggugaccacuuccucacccagccuuggcugccugcuucuguuuuaacuuugagcacuucagccaugggaguccauuuugucuguccacugggggcauuaacauuuggaaagguauuagagaguaaagagcagucaguaucuccgcuuucaaaacauacagaaguuaaagagaaauguagaauuaacuuaaaacaauacgaaguaaaaccacauauacaaguauuuaaauuuucuuuuucuugguagauuccuuuagcccauagagaguggcugaagugaguagucuuuucuugcccuuguaguuugauaacugaaagacguuuuuuuuuguugcaacaguaauugcuguucauaacaccauguaaugcagugcuccauaccuguguguguauguguacuaguacagauguguauguauagguauauauuauacuucuuuaugguguguacuagcccuuacuaguacauagugaggcccugugaguccugagggccuaugaguccuacuugaagaaaauuuacauuuagaaaaauaauuaaaccgggcaaauuaugaugguaugaagucaucauuuuaauaaaguuuaaguagaagucuuuuauuaaaaauauauauuguuuaaauagcauuaauguaaaugaaaauaaacaaugaaucaauguuuuuguguuuuauguuuucuagaucucaucucuuaacuacuuauaucuccuuacgccuuuuuccucuugcccaagaaagcaguccuaaaugucuaauauuucauuguuaguauuuauuacuuauauguuuaacagcccuuaucacauuuaccucuuaauaauagguuaauuucauguucuugaacucuaugaauggaaucauaaucuggaguauucuuuugugacuuuuuuucuuuaaguuugugagagucaaccacauugucauguauaguugaguuucauucguuuugacucuuacauaguuuucaucauguauauauauguaauuuauucauucuaguguggauuuuucauuuucuugaccuagcagugcuaauguuaaccuuuuugaaacuuucaccuuguaguccuuguguaauuuuuaugucuauaacaauacuguagguucaauuuguagccuacuguuuuaaaaauuaauauugccaugagcauuuuauacuaauauauugcaugcugucauauaggcuuauacuauaauuuaaucaguuaucuaaugaauauguuuccccuagauuuuuaaaaauuacaaauauaaucauuuaaaauaccccccuacauguauuucuuaaauuaucuuagagucuuggccuuggauuaaaguguucuacaaauauugcagaaguuaccugucaccacuuuuaauguaaccaugccaacauugagcaaauaaauguauauggugcuuacauucaauuucgaagacuuguugguaaucaagacagucucuacuuuuaaaacauacagucauguggggaacaagcauguaaauaaauauuuauaacaauaauuauaguguaggaaagugaggaaagagaguuguaucaagcaaauauugcaauuuaugugauaucccagagaugaugguucuuuugagauucagaaucagcacaaaucuggcaaggccagaguauagagucucaaagagacgugugcauguguguaugcguagcaauacuacuuaauacuauuuccaucuuaaugguuaugaauugauaucugagauaugugaauuauacauugaguuucuuuggcucauauugcauuugauuucuguaugcuuguuuuaaauucuguuugcuccuguuguaccuauuaucuauuuuuuagcuuuuugacuagcauaugggccaggcgcaguggcucaugccgauaaucccagacuuuagggagccaaggcuggaggaucacuugaggccaggaggucaggaccagccuaggcaacauagcgagacuccacccccaccucuuguguauacaaaaaaauuugccaggugugguggugcacacaucuaguccuagcuacucaggggccugaggcccgaagaucucuugagcccaagaguuggaaguuccagugagcuauaauggugccuacacuccagccuaggcaaccuacaacagagugagaccuucucucgaauaaaaggaaaaaauagcauaugauuugauuuugggucauaauuguugcagacauuucccuuuggcuguuuuugguuaauauugcuuauuuuuucucacuuuaaugacagcuuuaaguguuuauguauuugaguaauguuuauauauuugccuucuugcacuuagaagauuauugcccucauaaaaaucugguaaauauucauacuguuuuuugauauuuuuauuguguccuaaucuucugugugacucuuugagguuuacuuuuaguauaugaaaaaaucuuuugaauaguaagcuguuaaaaguaugaauuagcaaguacuugauuugcccagaagaaacuuauuaaauaagguaaauuuguguugcuccuguuuuugagaaagugaaacuuaucaugaaaaucuuuaaaaaacagauggugauauuuaguuucuagcaaaacagaaauuaaagcacauuaugcuuuaauuaaaguacuaccaccaaaucagugagaagauacuuucuucuggaagagaguuagcaacagccagggcauuauucaggcagcugucaaccaucuucccaguacucaaccugccuuuucagcuccucauuaauaggcagugaaguggagggcauuuauugccugauuaaccagauaaucccauagacacaccucuaaccuuguuaaucaaccuguaaggcucucauuuuucuccuccagggagcccuuucucugucagcauuccaucuucuuauccauaaugacagugggucugagauuuuuagccuacuugcaagcuaacaaguuagccuaucacaguuucauagaugcugguaaaaagacaugaaacuccugugucagacacaaaggauaguuuauuacugacagcaauagcauuaacccagaguaucagcauuuggaccaguucccugauccucaguuuccacggggaaauguggagauggccaguaagccuuccuguacuuuguuuagaagaaacauuauucuacuggacuuuaaacaaaucugccuuuugcuuuggaaagagaugcuauaucuuccuagguuauuugcguuauuugcuuuacaaacauccuugaaauaguaguugagaauuaaggacuuauauuuagugccucugcuucaaagauaugcagaaaaugugaguauuuaggaaaauugucucccagcagcuuaaaguucagguaucacaguaaugcugaccucaauaugagugugguuuuauuggagacauuuuaguuucuuucgggauugugagaguauauugaauaauguuguuaauuauugguugccaauuauuauuaccuaugauggacuuaugugcagaagucuuuaauuccuuuuuugccuuucauucuccucugaaaagauauacuuuuaguugcaaaucuuauauuuuuugauucuuaaaauucuguacagugucaagccuucagugcaguagaauucaguccuuuccuugggauaguaaugaaaugcuuaacugauacuuuuuuuuucuuagaaucuguguucauauauacugagccuuucuccaggaauauacucuuccuagaagcuguuguuuuagcuaggauauuuaauuauuuuccuucuagaaucuuaaagggcaaagccauuuuuagcagcuaucauaaauuacuaucccaguuggaagaauuuuuaucaaauauagcuuuucuuucuucgccaaccuuuuccuagggagacugccccucacacacuagaugagaugaagucuauguuccuggcuggagggauugauagauaguugauaauaaaugcaguuuguuuauuauuauuaucauuugcuaugcauuuuguggguuugacaguaauauaaauaauaaaccugacacaugaauacaaugaccuuauuugugacaagggugacauagcagugcagugggaaaaggauggucuuuucaacaaauggcacugggucuguuagauaucuguaagaaaaaaaauuauuuugacuuuuacaucauaccauaugcaaaaaucaguuacagaugggcugcauaugaaauaauaaacuaugaugauaaacaugaaguaaacuaauaaaacuuuuagagggaaacacaaagucaucuuuguggccuuggauuaggcaaagauuacuugacuaggacauguaaaaacacuaacuccaaaaaaagaaagugaucaauuggaucaaaauuaacaucuauuuuucaaaaauaugucauuaugagaguaaaacaaaaaccuacagagaggggaaugaauuuguaauacauguguuugacaaaugauucauuaucugcaagacucagugggccagguaccuguuuuuauaaauaaaguuuuauuagaacucagucauagacauguauuuauaugcuaucuauggcuacuuacaaacuacaacaacagaguuuaauaauuuuaacaaagacuguaugaccuuuaggccugaaauauuuacugucugaccccuuaaguuugcugauuccuucuuuagacaguacuauacuggcuugauuacugucgcguuacagggaguuuccguucagaugguguuagucuugauuuuuuuuuccuaaauagguuugguucuuguaaaaacuuuacaaucagcuuuuuaauuugcacaaaaauggcuauggggcuuuuaauuggaauuguguuggaucugcaggucaacuugaggagaauugauacuuuaaugauauugaaucuucugauccauaaacauugucucuucauuuauuuagguuuuccuuaauguguccuagcagccuuuugaaguugucaguguuauauuuaaucccgauauuuuguauuuuggaauucuaauauaauuaguauuuuuuaauucccaauuuauuuuguguauuauguagcaacaguguuacuugacuuuauauuguaacuucgauaaauuaucucuuuccaguuacuuuauuguagauacuccaagauuucaguguacaggguaguaucugugaauaaagacaguuuaacuucuucuuuuccaaucugcauacguuuuauuucuuuuucuuaccuuauuguacuagcuaggauauuagaugcaaugcagauaucagugaugagaauaggaauucuuguccuguuccuaaucuuaggaagaaagauugagugguuuaccauuaaauaugacauuaguucuagaguuuuuauuuaaguagaagucauguuuaccuaguuugcugaguuuuuuuuuucuuuaucaugaagagguguugaauuuuuaagugcuuaguuauggugucucuuuaaucuccuguaauuuggaauagcaaguuaaccaacauuuuuaacuuuauuuuguacuuuuuuuauagauuaucuuuuaauuagauuguauauccucaucggguucagauguugcauuuuuuuuuugccaggaauacuacauaaaagauguuucccuugcagugcaucacauuaagaggaacuuggugucauuuuuuccuuuucuuguggugcgauauuucauuaugugaugucuagcagguuucuguaaucuaaaguuaucuuucauuuugaauuaauaaguacuuugugugaagaucaaaguaaucuuuuuaaaggauuuaguagauuaugucauuucucuauuccuguucucccuauaguaggcuuccuauguguuacauuuagaauaauuuucaguguccuuaccauggucuacaaagaaccuuccaaguuucugcaacucacuguaggugauacguguuugagacucaacacaugcacacacacaucugaugcaaaaguuucacaaaacaguacuauccuuauuguaugagauguacucuaauauucuucugugguauuuuaaugaaauaaaauagaaaauccuguucuugaucuucuaacuugauuuugcuaccaauguggagacauaguuuaaaagaacacugccauccaguccugauuaucuuauuuuucaccauuuuuuccuaguucaguuuucuggguuguguuuugcuuuguguuuugagacggguaucgcucugucaccaaggcugaagugcaugcucacugcagccuagaccucccaggaucaagcagucuucccacuuccagccucuugaguagcugggaccacaggugcaucccaacacgccuagcuaauuuuuggauuuuuuguaguugugggaucucacuguguugcccaagcagguaucagacuccugaacuuucaaguaaucuuuccacuucagccucccaauugcugggauaacaggugugagucacagcacccggcaacuaguucacuuuucuuuagcugcacuggccauuaugcuguucuucaaaccugcugaaacaugcuguucccuuagagucuuugcauuuguuauuaucucugccugaaauguucuaccuuuucucacuguuuccuuacuuuauuccucuuauucucuuuauuuaccucuguucauguugucuuuuguccccuauuaaaacauaaccacauuauccaucuucucacgugcuuuuuucuuuuuuuuuuuuuucuguguggaacuuucuauuuucugauauguaucuguguauuuauuuuaucugguaacauuuauauguauccuccacuggaauagucaguaaaauguuaugauacaucauaguuaagaccuaauuugauaauuuucaaaaaaugaaaaaaaaguaucaguuuuaaaaaauauuucuaaguaauaguuauguggcuuuuuaaaguagaaauuuaagugcauuuccaccaguuguauuuuauaccacuuagcuaagaucugacaucuuccuaugcuucagucucuagucaagguaaagagauauuuaaguauauagguaauuuaauggguguucaaaccaaaaaaugcaacccaggauuuacuucuuuuccauauuuuuuagacaucaauuuuauauacaaaauagaugaacaacuuaucuauacaacuuaacugacaaaacuagauuauaagcauauuuauaguaugugaauuacuguaucugaacuagugucuagccagggacacauucuggugguuaauagucgcuauaaaauggacuuugggagaacaugcagguggugguaaagaacaugaguuuggaaauauaucugaauuuaaauucuagcuaccaguuguuagcuucuugacuuaaaucucugaacuuaccaaguuugaguuuccucuuuuaaaugggaucauauucuuaauucucaguuagcaaagguuaaauaagguaguaaauacagaucagcuaaauacuugaugcauaguaagaacacaguaaauaauuuuuacaauuuauucuguguacagaauaugaauuuggaauuaaaguuucaaucuggcaucccaauacauaccuucugaguagauaaaaccuuuuuauuaauauuauuuuuaaauuuaauuugguauuagaagugauuaaaaguugucuaaaugucuucacuuugacauuuaaucuucaguagucuuuaauugcuaaguguucuacagagaauaagacaauuaauugacuauuugaaaugcaugccaaauuuucccuagagaauauuuuacucuaauuguagucuucauucaaagacuacaaagguaauucaaagguaaauauaaccuuuucuagaguaaacauaagauaagaaauguggaaguauauuuuauugcccaaaggauuuauggaguuuagaguugguuuuuaugcaguaagauauuuaguugguauuaacaaggaaugaauuuuccaaaugaguaaauugccuaaauaaguuaauuuuuuccauucaaauaccaaaaauauuuaaagccuucuuuucccccuuggaaucuuacuaaaauguauuauuugcccaacaucuuacauaaagcauucugaagagaaaguaacauuuuguugaugguuacauaucaucagaaugaacauuaauuaccauacuuuguauuucuagguaauuaccauuaaagguauuugaauuaaaugggagucuuugccuacuucauuuaaaaaaaugucuuuuguguuuguuuccacugcucauaagcuauuggcugcuucaucucaccucuggcagugcauguacccaaagccacaguccuucucuuucuuauuuccuguuuugcucuuggcuaccaaguuguaaacucgauggaauuuuguucacagucagaauaaauaguucucuagugaaaaauggguuuuguggcaccuguucuugacucaggaaccuucugaacaucuuguacuuuuuucuuccagguaauggcccaugcuagauaauggauaauguuuuacuuccccuguuuuccacuucaaauuaugaugcaauauccuuuuguuauucauauauuuuuucuuuuucucauauugauauuuucugugucuauaggauuauacaguaaguauacuuuaaucgugcuuuuuaucacacuucauuuuaauucacuuagcaaaacuaguuauuuuagucacuuuacuuuuuaauuuuaauuguacuuugcuuuuggaagaaagagcaaaguacaaugguacuggaaguacaaucguuuuggaagaaauccuguuaccuaaacuuuuagagguugcaggcaacagagaaaaccuuugguuaucucaagucaugaugugagcauauauggagccugugaggaacaguggaaacaaucucuuuagaucucauggauaacuaaggucauuuuggaaacaaauucacuggcaagucaggccuaaaggaaacguggaacauuguuuagaaaauagcacaaguucugaugaccaggcgaucuauuugccucuugauaaucaacuuguucucuaagucaguucugugcuauuaugaucacauugccaucuucuguauuugcuucugcugagcauacuucuacuuauugaucacuccuuuccuuucuacaucuuaugguuucugcuuacuguacucucuagcuaugucuucugccucucuucuuagcuugaauuguuuauuuuuugguauuuaaacuuccugaacaagaggacuuuauuguuuuggcuaaccaccauucaguaugggaagcaucuguucgagaaaacacuucaucauaaccauuuuauaaaucaauagauuaaagacgguuaacuuuggauuagaugccaacccuugauucuguuagcagaagccagggaaguggguuccuauaguacauggguuggcuacuuguauauuuggaaccucuuguagauauugaauugucacuggucuguugauuauaaguugaaauccuaagcuuuuuaggcaaguuaauaaauagugaucaaggaaauuccugcuuuugccuaaaauguagaaaguuggaaagauugucacgcccauuguaauaaaauaaugcuggauuauuuauggaaucauaacuuuuuaaagacucaucagaaagcugagcuuacagggcagccaacagcuuaaaaucuaaggaaaaguaugucaagaagagaugagauagggacacugguucaccugaacauuggagggagacaggaggacugccauguaaguggguaagaaggauucaacuaacagauugcuaaagacguggugugacccguaacugucaccuagcauucacagacacaagggaaguugcucacacuuaaaggaucuucuuuauggaccuuggcgagggcaggacauuagaagauguccugguucagaauuggauuaaagggguguguucucugcugugggaaaaguaugaagucuugccugcacuguuuuuuuuuaaguaucagcagccuaagcugcugagggaagagugucaaaucuuagcuugccaaggguucagaagaagacccauugcagcuagaggaaaagauaaagaaaaaccucaaaacaccaucucuaugccuugaggggcagaaaaucauccagguuauuagaagucuccuaccacuggaggagggcaguaucucugaaaaaccucaaaaccugaaacugaggucacagaguacugaggcugaaccagacaguagagaaugcuuuuccuugacuccccaacccacaucccccucaccaucaggcuaggaagcacaucaagcaacaaguaaccacagccuaccacuagagaggaagcaagagcauagacucugaggugaacaugcacagugaaggccuaaagcuugggauggaacaauaccauugaggaaaguacucgagcaaaacugaguaaccuaugaauuauaguggaacucaaaaggaaaguuaaaacauauuuuguauugaacgaagaugaaacauggcacacguggaauacagcuaaagcuuagggggauauuuacagcauuacauguuauacuagaaaagaaaaaagugccccaauuuaguacuuuaagcuuucacauuaagaaacuaggaaaagaagagcaaacuaaaucuaaagcaagcagaaggaagaacacuguaaggauaaaagugggaaccaguuaaauugaaagaaggaaauaauagagaaaacuaauaaacuaaaagcuaguccucugaaaagaucaagauugguaagucucuagccagacugaggaaaaagaaaacacaaaguaucaacaucaggaauagcacuuaggaugucaauggagauccuaaagacacuaaaguguaaccaaugaagucuuaugcacaacuauauuuccauguauuugacaauuuauauggaacaaauuuuuuaagcugcaaaauuacuaaaguucacuuaagaaauagaugagaccuggccagacacgguggcucaugccuguaaucccagcacuuuaggaggcugaggcggguggaucacgaagucaggaguucaagaccagccuggccaagauggugaaaccccgucucuacuaaaaauacaaaaauuaaccaggcguggugguggguaccuguaauccccgcuacucgagagacugaggcagagaauugcuugauccugggaggcagagguugcagugagccgagacugugucacugcacuccagccugggcgacagagcgagacucucuccaaaaaaaaaagaaaaaaaaaaaaagaaauagaugagaccuuauuaguuauaucuguugaagaagauuaaauucauuuuuaaaaacuuuccaacaaagaaaucuccagccgcagauggcuucacugguuuauuuuaccaaaugaagaaacaauaccaauucucuacaaacuucuagaaaguugaagagaaaggaacacuuuccaacuuacuuuaugaggcuagcauuacccugauaccaaagacauuaaaagaugagaaaacaggaaggaaaaaacuaguauccuccaugaauacagacacaaaaauucuuaacaaaauauuaguaaaugaaauccaucaauaaguaaaaaggaaaauuacauuaugaccaaguaggguuuauucugggaacucagagcugauuuuguuauucaaauaucaucaaucaguauaauucaccauaucaacagacuaaagaaaaauauuugaucauccuaguaguugcagaaaaagaauaugaaaaaaaaauaccauucguugaugauaaaaaugcugagcaaacuaggaauugaaagaaacugccucaucagaaacccuagaguuaacaccauacuucaugguaaaagacugaaggcuucugcuacaacugggaacaggccaagaugucugcucgcauuacuccuguuaagcauaaugcugggagucccagguaggcagugaggcaggaaauaauagugaaaggcauaaacagcuaucaagagauucuaauaccaccaugaaaaaaaugaagccaaacaccuuuuaggcauuaucuuaaaauaaugcucauguucaguuucuuuauccacucuuaguuuggaaucuuugaauuguuuuccuuuuguggcaucuggccaaccuaagaaguagcaaacaucuggcaguggcaaaaucuuuauuuuauuuagcuguaugaaauacuuaguuuugaaguaaaaaauagggaagcuagaauuuauuuaauaaguaaaaugaguaucacauagucucuuacuacauacagaaagaaguaaagaauucaacaauucuugccaggcaccaguggcucacaccuguaauccuagcacuuugggaggcugaggcaggaggauugcuugaguugaguucaagaccagccugggcaacauagugagaccccucaucucuacaaaaaauaaaaaaauuccccaggcauggcagugugugcuugucgucccagcuacucaggaggcugggguuggaggauugcuugagcccaggaggucaaggcugcugugagccaugaaugugccacuggacaccagccugggugacagagugagaccccaucucaaaaaaaaaaaaaaaagaauucaacaauucuuuauauaucucauuuuuuaaugggauucuuaugucucuccguaaauuauauguaguuacugccaucaaaaaauugacuaguuuguuuacuuuggauuuuaaacuuuaagguacuugguuuugaguauauguuaaaaauccaaaucuuauuugaaacaugacuuugucccuuuucaggggcagauccauuuacugaggaauauaugcauuacaggaauauauaaaauugaaagcaauaagcauacauuuguaaccacugauaaaaauagaauuuauaugacaaaaugacaaguagaacaaugaauucuguauuucucauuuuugaaaugguacaagaguauagaaauuugucucaaauaugcugggauuaagacagaauaaguguauguuauuuuuauagcuauuuacacauuucugagacauaaaauuguauaagagcuguagcugugagcuacgggaagauuacuugaaagcugcuaugcuuuucugucaguguuacucaucucauucuuaaaauuugaaaugccauuaauauacaaaacaaaauguuuuaagaaugcuggaaggguaauaauuaacauuaauacuuauuaagggcuuuccuagacagguaauaaucaacaugaacacuuauuaaguucuuucuaagcuuugaaauauauuguuuacucaucauaacaauugugaagugaguaguaguuaccauauuuauaaggggaauaaaaugguuuaaauauccuacccaaagucauagcuaucacccucaaagagcauauaagugaaaugaagagacaaacucuauaggaaaaguauaaauaauuaguugcaauacacaauuucuuuuuauuagaauuagggaaaacuuccuuggaggagaagaugccauuugcauauggcauagaguguauaauggacaggauaugcaacagguuaaaaaaaagcaugaauaaaggaauggggaaauaggggagacaguuuugcaaauugugauccaguuuugcuaaauguuauauuuuaaggaaaguaauagugaauauugaaaaguaugcuggggucagguuucgaaaagcuuucaaaaugccauuuaaggcaauguggaccuuuuuuuuuuuuuuuuuuccaaacaguggaaagcuauagagggaaauuacugagaaacuaacauuucuggaagugagaacuaaaaggcacagagaacuauguacuaagucuagaagcucuugacccuagucacccucuuguuagguuaagaaccuaauuaugagauuuuugccuuacagaaucuucagccaauuauucuaacuguaaaauagauaauucccaaaucuaaagauagauuagccuuggugaagauauuacagaaauaaucacuuuuuacauaacauucauuuaaaaaaauuucuuuacaauuuggagaaaaaagggcagacuucuaguuccuaagaagaauuaguguugugagaugggugguauguuagguugcuguuauuacugcaacgaauugcugcagguguagugguugaaaacaacacagacuuauucucuuacaauuugggaggucagaaguccuaaagugguuuguagggacuacauucauucuggaggcucuaggggagaauccauuuccuugccauuucuaacuucuagaggcugccuccauuacuuggcuuguggccgggcccauccugugucuucaaagccagcaguauaucaucuucuaaacucugucuauccccuugauuuuguuguuaucucaccuucugugucuguggcccuccucccucccuaagaauacuucuuaauacauugagucuacccacauauuccaggauaaucucuccaucccaggaccuuaaacuuaaccacaucuacaaagucccuuuugcuauauaagguaacuuauucacagguuccaagggauuuagauguggacaucuuugggggacguuauucauccugccacaggugguauguaaaaauauuaauaaucuaauauaauaugauaaauaauuugauaggaauaacauacaugaugcuggaguucucagaauucaagcagcucauauaaccacgagagugggggaauucugagagcaacugaugguugaauugagucuuagaggauaagugggaaucuaucagguaaaaaaaauacaaggaguccaaacagaaugcuaugucaaagguauggcaaagacaagcuguaugaaauugcuaguuucacaauuaacaacacuugacacagucgccauaauggaaauaugcguaagguaaguggcugcugaagugaagaaacaucuaagucagagugaggggcucauaauaaggcaccuaccuucauucuuauccucuuauuuucaugauugaucucccuugguggucaccuuucacuucgugguucaagguccucuauucuuuucucacugcugucucuucaaguauggauggaccagagaucauucaauuauauuaauccucauaauauucaauacauucuuuaggcacuuggcucaugaaaguagauguauuguugugaaaauauuguuucaacuuguauuuuauuuuagcuguuguuuauuuuucuucugugaaagcccuugguuaaaaaaaauagaguaucagaguuggaguacagggaagagagcugaagcaguguuaggucugucaaacauaauaauaaaaggccaguuagguaguggugacuuugaaaauaaaccucaucuagccacugaucaucgggaguaaggagagaaaagaaauagucuguggucucugugugcuggccuucuccccuuauuuuguagagagcaagcacuggcucuacgaaaaagcccuauuucccuggcauugcuggggagcagaagauggguugcucugacacuguauucuccugugaccaauagccuguguugucacagcuuuaccaauaauagguccccuugcuggagagccacuucacagcuuucccuguugaauucaggucaggucuccacuucuuacuuuaacccaaucuuuuacgguucuccagucugcuugcaaacuccuagaaucaauuacauauuuauaaguacugugcauauuuuauauuuucuacauuugaugugauuuuuguugguauucuguuucguauuuucaacucugauaauaacauuucucauaaagaagacuauccuuacaacaugucuucauuuagaaaaaguauugcuguagaugaaauucagugaguuucaauuugaugauuuuguauuaaaaugcauuucuuuaggcaucaauauugcaguaacaauuauugauguguuacaauaacaaauguugacauuauugacauauugacauugauacuuuaauuaagcaguacguuuaaguaaauaguuuuaaacaucugagugugaauuccagcauugugauauuucucuuuagccuagaacaaguuacucaaacucuccaagccuguucuuucaucccuuaaaugaagauaauaauagccuugcgaguuguuaagauuaguauuuauaacaugccugguuauaaauguuaugagagugugcucauaaauucugguagugucauuguucuugguaauuauuacaaguuagcauuaguaaacuucauguguguauucuauggccuaaaaauagucugcuuauaaaauuggugcuuuauaucagcaguccccaaccuuuuuggcaccagggaccaguuuuguggaagacaguuuuuccaugggccugugggggcuugguggaugguuucaggaugaaacuguuccaccucagaucaucagguauuaguuagauucucauaaggcagacagccuagaucccuugcaugugcauuucacaauaguguucacccuccugugagaaucuaauuccacugcugaucugacaggagguggagcucaggcaguaaugcucccuugccugcugcucaucucuugcugugcggcccaguuccuaaaaggccacugacugguaccagucugcggcucagugacuggggaccccugcuuuauaucguguuuuaaacuauuuacuaacaauuaagaggugguauaucacguggugauuaagaacauagacucuggguccaaauuucagcuccaugacuuauggccaggcugaccaucgacaaguuaccuaaaugccuugugcaucacuuuccucagcuuugaaaugaacauaacaguagcacauuuaucucagggauauuaugaggagucaaucagauuaaguauauaaaaaguauaaaacaguugcugacacuuaaugcuggcugucagcuucugccauuguuauuguugcuauuauuaauuuguuguugaguaaauuuuuuuuuaaaucacuuuuuaggugaaucuuggaagcaaccaguaccuuuucucugucauaguggauccuaaagaaaugcccugcuucuguuugcgccaugauguugaugcccuacucuggcaaccacacuccagcaaacaagaugauaugugggagcacaucgcaacuuucaaugcuuuagguauaaagcaaacucuuugacauuuuccaugaaaucagaaauacagucaucauucauuuaaaguucauuucuuuuuuuucuuuuuaauuugagcuguccugauuacauuuagauugauuugcgcuaugauuuguuugcuuguacuaguugugaguguuagcacuguuggaacauuuagacuaaucuguuuuuaugcuuguacagaagaucaacacagaauagaaaugaaagugguuaucuaaccacuugaauuauucuaauaagucauuugcuuuuucuaauucuguaagccauauaauacuggagucugagcaaggagcuugauaauacccuacauggaacugguguucaaguuucuucagaguaaucuucagaaacaucauagaauuccccuaagguguaaugcacauuaggagacaucuuuugucaaaauuaaguacaaaagagagccauuauaaugaaaauacuuauggaaagcggugauaagcagaaauuaaauuuauuugguaggauaaaaggaaaaaaaucaguuuuaaaauuagggcuugacaauguuuaaacuacuuaauuauagacguaugcaaucauugauuuucugucaaaaugcauuaguauugugugacagaaauuuuuuaugugaauuagccacaguuguugcuuuauugaaagguuauuuuaaacaggcagcaagaagugaaguuacguauuuugauggcuauaugugcacaacccuaauuguagaagaaauuuauuaauuaucccuuauaguuaauaauguaggcugcuaaacugguucagacuccaaauggauuuuuaugaccugaaguacaaaguuugguuaacuaauuuaaccauauaauuuuuagccucccuacuauaaugcuauuuuuuaauuaucuauacuuuggucagaagaaagcucuaucauaucaucuuuagaugcucagauguucuauuuguauccccaaauccccuauuauaggggaauucuaugcuuaauucuaaguuaaaucaacauauauuagauauguacucuugaaauauuauauacauuauucugucaagguuagccuggauagcuacuuuaaacuauuuaaauagguaucuaaaucuucacuuuuccugcuucaaaccugcuuaauauuuuuaaaaacaguauugaucugcaugugcucaguaguuccuuugcuuauucauuguuugaugagaucucaauuuuaauuaauguuauauucuuauuuuacaugaucauaaauaccuaacauuugcuaaccaugucacuaucuaaaaaucauaauuuauauuuuggaauauaaauguuguuuuaauccaaaaagauacuuuuuaaacauguacaugaauuaagauaaggauuuuuuucaguuuagagacuugaaauuauuuuugaaguuauagugaucaacauucuacuugugggggcuaaaaguacaaaaaaauccaguuacaguguugguauugauguauaaaaauaucacuaacauuuuagggauaauaagagaaugcaucacgaauacuaguacauucagggauacauuaugaacagaaaacuaaaauaacuuuaugaugguauccuauacacauuuuccaauuuauuuaagaggaaaaaaaugguucugugaugcccuauccguaacucacgaagcuaaauauuaaauuggcacuuaaagauauuuugucauguauugaguguuuuagauuuuagaauuuuaguguucgaauuauucguggaaauuaaaugaagcuauauuacgcuuuuuuugaagcgagaaagccauaucuguuuuguuccuuaggaauuaaagucguauuuuuguaccagaugggagagacugauuguggcuaaucguuaaugauucagaauuauauaccuuaugguauauauuuuacuugggcauuuuaauuuguaauaaacauugcaaaauauuaaauguuaaaucaucauuuuuccccuucuguuuaauauauaguuuuucuuuuguuugucucauauucuuggcaggcuauguccaagcaucaaagagagacaaaaaauuuuuugccugugcuccaaauuacucguaugcagcccuuugugagugccuucgucgaguauucaucuaucgucagccugcucccauguccacuguacuuuacaacagaaaggaaggcaggcaaguaggacagguugcuaagcagcaaguagcaagccuagaaaccaaugauccuauuuuaggauuucaggcaacaaaugagagauuauuuguucuuacuaccaaaaaccucuuuuuaauaaaaguaaauacagagaauuaauuauucuaacauauuggccucuuuguacuggaaaaguauucagugguaccuggaggucuggacaguuauacuguaaccucuuaaguuuuaaugugcuaaauauaucuuguaugauuuuuuauuuuuuaauaacauuggaaauauauucaagagauuaugauucuguaaagcuguggaaugaagcugcagauuuagagaacauuggcuucugaaaaaaaaaaagagugaagauaguacuagcaaguauacuuauuuuuuaaaacaggcuagaaucucauguuuuauaugaaagauguacaauucaguguuuaaaaauaaaaauauuuauuguguacucuguucguugauuaguugcuacaggcuguaccuauaagauguacaggauaauaguuaaauguugaguauuguacauauguauuuaaguggauugaauaacugagucuacauggaggaggaaaugcuagagaacagcaggucuaauauuuuuuaaguuuacugagagaccuuuauuauuauuuucaaauuaaguauagcuuuauguaacuuuuagccaguugcucugccacagacauagacaaagagagauaagauuucacauuauccaucacugcauaacaaaccacaccaaaacucagugguuuaaaacaaggacuuuuauuauuuuucacgauucagugaguuggcugucucugcuguacagggccucucagccuccaguagacuagacgaaucuucuuuccauaguagagaaaacaucuuaagagagcaagcuccaauaugcaagagcuuaucgauccuguacaucuaucauauuuacuaauguuccauuggacaaagcaaaucacauggccaagucuagagucagaaugaggggacuacacaagcugacagcggaugguaugacucauugggggccauugauggaacaaucuuaccacacaaggacaaauuauaauuuauccuuguggcucucuuuauuuuucuaacaacuucaacaaaauaauccuguuuauauguuauaguuucuugccacaaauuuuguuuuuucaaacuuaccuuuccagguuuguuuuaguauguauguaccuggaaauuuuuauuacuuuuuauaccauuucaagauauguaucuuauauaaaccucaaguuggauuuuauauuuuaauaaggaaguuaagaccuucauuuaagaggcagaagauuaagauaagaaauauaagauagaaaagcuuuguuccuaacauaucuuuugccugucugggcaaguauuugacucaacuaaauuuuaaugaacgaaugaaugacagagaggaggaaaaaagaugaggauugcauacauguucuaaacccuuugucagauugcaguuuccuagagaguauugaggugcuagguagaaaguuaggaaagguccugaggacugguauugacaauuggaguccuaauaguacucuauucguauuaggaaagagagacuagauaccaaacaucacgagaucauagagauggaaaacuguauaguaaccaaaaaccaaaacagugauauuuccagaacuuuuuaguauuguuguaaaacuucaugaaacaaaagaccauuuaaauagugaauuauuaaaaaucuuuaugaugggaaaguagaucuaaauuuucucuaaaauuuuccccaaagauaauauccucuuagggaacauaagaaaaauguauaauaaaaauguggugcuuaauuaaccaugacuauguauauauugccaauuuuaguaaucaauauucuuugugcaugugauuuuuuugcaugauuaauguugaauugaaagcucucaggauaauuaauccuaaauauugucgcauguugaccuacguuaaaagaugaauaggucuagagccgugauuucaagcuauuuuccugaaaugcuucagggauuccauaaacauuuaaacaauguucuaagguacauauacuuagaacauugagauauauacuacaagugcuaagaauauaguaccuuguauuuuuguugauuuuuaucauguuuuaaauaggaauuuauaaaauauuuaugauaguaauaaaguaguauuuuauguguuuugca

SEQ ID NO: 192544 - RNA, 102061 nt, Homo sapiens
acagacaagaugucggcggaugguagcuucgagcccuugcggagaggagcaucucugugacagaagcuugucgacggcggcuucuaggagcuagucgaaggagcgagguugaggcgggcagcgacccgucaggucgcucaccugggcaccggccagcugcgagacgugacuuggggaccgcaggggaguggagagugugaggugccaaagacuaguaaugccccguaucccccuaggaagccgggaagccaagcuccgcgggaccgcuucaugccgcugacugguguagagcccgccagaaugaacaggaagaaaggagacaagggcuuugaaagcccaaggccauauaaauuauaaguauuuuuucauuucccuuccuuccuuuugguuuuguugccauuaauuauauuuugcgauugcuugaaauugacuuggugggccugggaaaccuagugggaaacuagaauuuacucacugugauggaaaugguguuuguaagguaaaaauguuuugaaugacagguuauucagcaaauuuaauucccguugcaaguuacuaaaguuuuugucuaaguacuagauuguauuucugucaaaucuguuuucgugacuguugcuagauuuuaaaaaauuaucccaauugguagaguguuuuuuuuuuuuuaauuuuuuaauuuuuaagacggagucucucagucgcccaggcuggagugcaacggcgcgaucucggcucacugcagccuccaccugccggguucaagcuuuucuccuggcucagccuccugaguagccgggauuacaggcgugugccacgaugcccggcuaacuuuuguauuuuuaguagagacucgguuucacucuguuggccaggcuggucucgaacucuugaccucgugauccgcuugccguggccucccaaagugcugggauuacaggcgugagccaccgcaccaggccccaauucguaguuuuaaaaugaaauauugacauguaauuuugaauuacuuagaacauaguccuaauuuauacuuggauagaauuauacuuugauuuaauaauaaaaauuauuuuuuccuuauuuucuuuuuauauuuauuaauauacaacccaucaggucgucugcaucaacaacauaaauuuccagagaaaaucuguugugguaaguuuauucucaacaauuauaaauaguaacaaguccacuauaaagaguaacaauccaccccucacaguacuuagaaaguuuguagucuuccagauaauuguguuucaagaauagguaagaauuaaaauuagggucuguaugauuacaaguuccaugguccuucuauuaauaccuauugccucccaaauucucccuuuccuuuuuuuucaauuuccuaauuaaaauuuuauuccucuuuaucugguguauaauaugaaagccuguauagccaagcauuuuauaauugugcaugaaacaaguauaagcccauagcgacauuucuucuaugaaaaaaauuaagauuaauacacucacugacuuggcuucuaagaggccauuuuugcuucuugacugacuugguuuaggugauguugcuuuguaaugaaguuuuagauagaguauuugagaucuagaaacccucuaccucccccugccucccgacacaauuuagauguauggauugcugauauaaucaauuuuaggaaaaagcuugaacauucaaguuuuuuguuuguuuguuuguuuuuggagacagagucucgcucugucacugaggcuggagugcagugcugugaucuuggcucacugcaaccuccaccuccuggguucaagcaguuguccuaccucagccucccaaguagcuugaauuacaggugugcaugaccacgcccagcuuauuuguguauuuuuaauggagucagaguuuucuccauguuggccaggcuggucucgaacuccugaccucaagugauucaccugccucugccucccaaaaugcugggauuacaggcaugaaccacugcaccuggcugaaaacucaaguauuuauuuaauuuacuuucuuagggcuaccuuuauuacauaggcuaaaauguuaaugagagcugguuuuccuugagugaugguaucaacuucucugucagauuuguuacccauguauguauauauuuacuuaggauaagcugaauagauagaaaaaugucgcuuuucaugagucauagaaucuuagauuuguaauguuccuaaaagauuuauuaaauuuagucuccucguuuauggaauuucucaugcagucuucccuagguuauguaccuuauaucuuauauaguaggauacuugaguuguauuauguuguaugaauuggguaggaaagauaagggaauuagggagucuaguucagagguuacugcgguaaucuaggggagaaauggugaaguccuaaaugaagauagcauuagugaaaauggaauugaaauagaguugacaugauugaauuagugaacauauauuuagccauuaauauauguaagauaucuucuaagguuuauguguauuaacucacuuaaucuucauaauuacccugugagauagauaauauuuuaauccuaauauuagaauuaaggcaugauugaggcagcuaaaagaauggagguucagggccaggcacgguggcucacaccuguagucccagcacuuugggaggcugaggcggguggaucaugaggucaggagaucgaaaccauccuggcuaacacggugaaacccugucucuacuaaaaauacaaaaaauuagccggcugugguggugggugccuguggucccagcuacucgggaggcugaggcaggagaauggcaugaaccugggaggcgaacuugcagggagccgagaucgcgccgaaccugggaggcgaacuugcagggagccgagaucgcgccacugcacuccagccugggcgacggagcaagacuccgucucaaaaaaaaaaaaaaaaacuaaaaaaagaauggagguuaaguaacuuucuuaagggcauaaaguuggcaaaugaugaaacccuuuuuaaucacugaugaccuaagaguuugaugcacuuuuuacgucuuucauucccccuuccaccuguguugucccugaggaaucaauagaaguugcauguggcuuuuucaagacugcuauaaagggguuguggaugacuuaaguuucccauuggaaacuuugauuggauguuguauggguuaggaucuugguaggaaguaaauggcagauauacauauauguauguguauauauauauacacauacauauauauacacacacacucacacacacacacaaguuaauugagggaaaugaagggaguauuuagaacagaguuaacagaaaccaacaugagguggaggaacccucugagcuaucaacagugaggaacaguugucuaggccugaaacaacaacgggaaggggaaguuacuagaaccuacuguagccauggaaugggucaccuuguaggaccugugucuuuuaauagaagaaugaagcuacugcuuaccugcagccuggcggaaaggaaucugggguaauuaauauaaacuugcuuuccuucuguuuuccaguuuccuuuuuguggaaacuguuggaccaacccagccagaaggguagagcccaguuaaugcaacucguaggguauugaguaggguagagagcagaucaggaggggcaaaaugagaauaaucagaacagucuaccuuuuuaaccccaacgcauccacuguugucuuugguugagaugaaaagcuagugcuccuaacauggggaacuuacaaaguccuaugagccacugaaagaguugguaauggcugacuacuuguuuuuuaagugaaauguuacuugaacacagccauccccauuuauuuacauauugacuguggagguuuuggagcuacgcuggcagaggcgaguagcugagacagagacugugugacccacaaagccugaaauauuucuaucuggcccuuuaagagacaguuugcuaaucccugagcuauucuguuagugugagagaugacaguucagcccuguucccaccuaaaauauuagcuaccucuagugucuuuuaugcaagauaguggaaagaaaagugguugaaagaaauaguauaaaacuaaauuguaacagucccugcuucccuuagcugguaguauggccgaaguugauacauacugcuuuauuucuucaccccuucgguguuuccuuuuccuucugcugacauuucuauugggaugaccuagacccuuguuucuuuaggaccuucacugcuguuuauaucuuuauuggguuguugcaguuucuguugccuaggacuguuaggggggaucugagaggcaucugagggaauccucuagauuucagaugugauucuuguccuuauuguauagcaaagcuuuaauuuucuguucaguaauugaaaugauucauuccagccagaacaggaccccuuucucugcuuuuugguucuuugggaugaggagcucaagguggucaaggggcagccucaacuuccaauggaauggaaucaugguuaugugcccugguggaugcauucuucacuuaggcacuaggaccucucaacaugcugaacccagggucacagagacaggaggcaaaaauuccuuccauggcugggcacgguggcuaacaccugugaucccagcacuuugggaggccaaggcggauggaucaccugaggucaggaguucaagaccugucuggccaacauggugaaacccugucucuacuaaaaauacaagaauuggccaggcgcaguggcucacgcuuguaaucccagcacuuugggaggccgaggugggcagaucacgaggucaggaguuugagaccaaccuggccaacacagugaaacccuaucucuacuaaaaauacaaaaaauuagcugagcaugguggcgggcacccguaaucccagcuacuugggaggcugaggcaggagaaucacuugaacacgggaggcagagguugcagugagccgagaucaugccacugcacuccagccugggcaacaagagcaaaacucuguccccugcuccaaaaaaaaaaaaaaaaaaauuccuuccauggccuuuuugguguaauagugagaguagucacuccaacuuucaccccuugguucccaguucuguuuuggcuaggagagauacauugucuacuaauuaaaggcagcauccugugggagguuucucaauuguaguuguaacugagccuucagcaauugaucaugccaucuacuucuguaagauaggguacaagauaaaaugcauaaguuuaaacaaaugguuacucuguguauggaagggaagggcagcagguuugagaggaaagauuuauaggucagauuagaaaauuacauuccaugcacuuugggguuauuaaauugagaugaauaguggguaguuggcuacaugucugugcagauaaaggauggugagagaaauuugggagccuuugauauacaguuguucauuaaggguguggaaaagcucacuuagaguaucuagcaggaagugagcaucagggagaaauaucugaagaacaugauauuugagaaaacugacacuugggcuguagaaaccagggaaaaccuuuuuuuuugagacaggaucucacugucgccuaggcuggagugcaguggcgcaaucacagcucacugcagccucaaccucccugggcucaggugguuaucccaccucagccuccugaguagcugggaccacaggcacguaccaccagccuggcuaauuuuuguauuuuuuguagagacggaguuuugccauguugcuuaggcuggucucaaacuccugggcucaagcgauccacccuacuuuggcuuuccaaagugcuaggauuacaggugugagccaccacaccuggcugaaaaacauaucuuaagaaggaggaggcugggugugguggcucacgccuauaaccccagcacuuugggaggccgaggcugguguaaggucaggaguuugagaccagaccggccaacauggugaaaccccgucucuacuaaaaauacaaaaaaauuagcugagugugguggcagaugccuguaaucccagcuacucaagaggcugaggcaggagagucgcuugaacccaggagguggagguuccagcgagccgaaaucgcacugcugcacuccagccuggacaacaagagugaaaccccaucucaaaaaaaaaaaaggaggaaauggaaugguuauuaauuuuaaauguaaacaggaaauauaaacuugaaaacugaaaguaaucuuggucauaagugaccauagcaaggguaaaguauuuguccauuuucacgcugcuaauaaagacauaccugaaacugggcaauuuacaaaggacagugguuuaauggagaacucacaguuccauguggcuggggaaaccucacaaucauggcagaaggcaaggaguagcaagucaucucuuacauggauggcagcaggcaaaaagagagcuugugcagagaaacuccuguuuuuuuuguuuguuuguuucuuguuuuuuuuuuuuuaauuauacuuuaaguucuggguuacaugugcagaacgugcaguuuuguuacauagguauacaugugcccuggugguuagcugcacccauaaacuugucaccuacauuagguauuucuucuaauguuaucccuccccuagucccccaccccgcaacgggcccugguguuugauguuccccucccuguguccauguguucucauuauucaacucccacuuaugagugagaacaugugguauuugcaaaaacuccuguuuuuaaaaccaucagggccaggcacgguggcucacgccuguaaucccagcacuuugggaggccgaggcgggcagaucaugaggucaggagaucgagaccauccuggcuaacacagugaaacccugucucuacuaaaaauacaaaaaaaaaaaaaauuagccaggcguggcggugggcaccuguagucccagcuacucaggaggcugaggcaggagaauggugugaacacaggaggcagagcuugcagugagccaagaucgcaccacugcccuccagccugggcgacagagcgagauuccaucucauaaaaacaaacaaacaaacaaaaaaaccgucaggucucgugagacuaucaugacaacagcacaggaaagacuugcccccaugauucaguuaccucccacugggucccucccacaacgcaugggaauucaagaugagauuuggguggggacacagccaaauuguaucauucugccccuggccccucccaaaucuuaagcccucacauuucaaaaccaaucaugacuucccaacagucccccaaaaucuuaacucauuucagcauuaacucaaaaguccacaguccuaagucucaucagagacaaggcaagucccuuccgccuaugagccugugaaaucaaaagcaaguuaguuacugccuagauacaaugagaguacaggcaauggguaaauacagccauuccaaauggcagaaauuagccaaaacaaaggggcuacaggccccaugcaagucugaaauacagcagggcagucaaaucuuaaagcuccaaaaugaucucccuugacuccaugucacauccaggucaugcugaugcaagagguagguucccauaguuuugggcagcucugccucugagacuuugcagguugcagccucccggcugccuugacuggauggcguugagugucugcagcuuuuccaggugcacggugcauguugucagugaaccauucuggggucuggaggaugguggcccucuucucacagcuccacuagguggugccucaguagggacccugugugggggcucugacaccacauuucucuucugcacuggccuaggagagguucucugugaggauccuaccucuacagcaaauuucugccugggcauccaggcauuuccauacaucuucugaaaucuagguggagguucccaaaccucaauucuugacuucucugcacucucaggcucaccaccacaugggagcugccaaggcuugaggcuuguaccaucugaaacuauggcccaagcucaaaguuggccccuuucagcccuggcuggaguggauaggaugcagggcaucaagucccuaggcugcacacagcguagggacccugggccuggcccacaaaaccacuuuuuccuccuaggccuccgggccugugaugggaggggcugugugaagaccucugacaugcccuggagacaucauuuuccccauuuucuuggggauuaacauucagcucccuguuacuuaugcaaauuucuguagccagcuuggacuucuccucagaaaaugggaguuucuuuuuucuuuuuuuuuuuuuuugagacggagucucacucugucccccaggcuggagugcaguggcucaaucucagcucgcugcaaccuccaccuccuggguucaagcaauucucuaucucagccuccugaguagcugggauuacaggcgcccaccaccaugccuggcuaauuuucuguauuuuuaguagagaugggguuucacugucuuggccaggcuggucuugaacuccugaccucgugauccaccugccucagccucccaaugugcugggauuacaggugugagccgccaugcccggcccggauuuucuuuucuaucauugucgggcugcaaauuuuccacacuuuuaugcucuacuuucauuauaaaauggaaugccuuuaacagcacccaagucaccgcuugacugcuuugcugcuuagacauuucuucuaccagauacccuaaaucaucuuucucaaguucaaaguuccacaaaucucuagggcaggggcaaaaugcugccagucucuaugcgaaaacauagcaagagucaccuuugcuuuaguucccaacaaguuucucaucuccaucugagaccaccucagccugggccuuauuguccauaucacuaucaacauuuuggucaaagccauucaacaagucuauaggaaguuccaaacuuucccgcauuuuccugucuucugagccaucuaaacuguuccaaccucugccuauuaccuaguuccaaagucgcuuccacauuuucagguaacuuuuuaucagcaccccacucuguugguagcaguuuacuguauuaguucauuuucaugcugcugauaaagacauaccugagacugggcaguuuacaaaggaaagagguuuaauggggaucuuacaguuccacguggcuggagaagccucacaaucauggcagaaggcaaggaggagcaagucauaucuuacguggaugguggcaggcaaaaagagcuugugcagaaaaauucccguuuuucaaaccaucagauuucaugagauuuauucgcuuuaugagaauagcauggaaagacuugcccucaugauuaaguuaccuuccaccaggucucccacaacacaugagaauucaagaugagauuaggguggggacacagcccaaacaugucagguaacuucaguggaaugaugacugcauaagucauacuguacugaauggaagagagaguuggaacagugaacauauucuacuuuuucaagaauuucucuuuugaagguaugggaaaaagauggcacaaaauucauuugaggauagcauagaucuaaaggcauuuaaaaccuugagucuugaacauauuuauaggcacggaaaaaauucuacagaaaggaaagauuguaauuauaggagagagaaaaacagugauauuucugaggauauuguggggagugggugcuaaaggaccauuggauauaucauucuuaaacagaagggaaagauggguacgugaaacagaggggcaagguaauugguaguuggcagaggagugguugaauuuaaggauuuagggugaagggagaaaaagccccaggagugccaagaagauuaauaaaugcuuuuguuauucuuuucugaauucuuuucuggugagaaacuggaagaagucaaggacaggaggauuucaggcaguugaacaggaggacugggagagaaguaaugagaggggugaggagaggcauuguggaccuuugaguucauaaugucagcaucagagcaguucuaagcagugaugaagugcuuuucagagugugaucuugauucuuccuggauggaagugaagauuguaggaacugaggucaaggaacuuugaggcaguuuuauuggauggaucagacauaucuauauucaagucacuuagagugauggcagacuuguguuacaaaagaagaguaugugaccaguugcaguauuuauaccuguaaucccagugcucuuggaggcugagauaggagggucacuugaggccagaaguucuagaccagcuugggcaacaugauaagacccgucucuagagaaaaaaauuuuuaauuaaccaggugugguaaugcauuucuguaguccccagcuacucuggaggcugaggugggaggaucacuugagccuggaagauugaggcugcaguaugccaugauugcuacagugcacuccagccugggugacagagcaauacccugucucugaaaaaaaagaaaaaaaaaaggcaagaguaugagccuucaucaaauguuggggaauuucauagauauuaaugaagaagcauaaaggaugauguaccuguauagcaugaacacaaaggauaagcagaaaagaauaacaaaagcauuuauuaagcaaauacuagaugccagcuauaauuuuaaguguuuuccauguaaguuuuucaguugucuuuguuuuuugagaugugaucuugcucugucacccgugucacaaucaugacucgcugcagccucaaccucccaggcucaagcaaucauuccaccucagccuccccaguaacuggaacuacagccaccaugccuggcuaauuuuuuaauaguuuauguacagauagggucuugcuauguugaccaggcugguucugaacuccgggacucaagcaguccuccugccucagccucccaaagugcuaggauuacaggcgugagcccaugccuggcuguucgguugucauaauaacacuaauaggccaauaaugucauuuuuuaugaggaaacugaggcacagugggcuggaguuacuagcucaauaucauacaguuacuaagugguagagcuaggauuugaauacagggagucuaccuccagaacaccugcuuuucacggugacacuacacuguccuuaaccuuguaguguacaguaaauaaaauccuauaagugacccagaaguagucguggaaacuaggagaaugccuauuuuccacuacccucguuuauagugaaugggagaguaaguagcuucuugucuaggaggauucaggaaccauuucauuuaaggcaagaggguagagagggaguuuuagaaaagguugaaaagcacaggggaaauguuuaaaauggagugugggcuccaggagaaugguuaucugugaagugguggggagagagcaagaagcaaggagugagaagcuagaugacccgagaggcuugcaguuaugccaguggcuaagggcagcagagauugaagacuuguagagguuaauggguccgaauguuucaggcagcuguagguuagagcccuaggugguggcagaggccugaugguacaaggagacugggcuuuuccuaucuuccugaaauacauuucaucauucuauuauuguuaccagaguuuagaaaaccagaugcuguucuuaugucccacccaaguagcaguugacaguacuucuuuaaucuuuuguuuuguaguugucuugguucuaaaucuuaucuuucagcugauccaagcucauuuaaauuuagaauggucauuggaugacagauaugcuaauuaaaaggaauucuggucuuccuuccuacagcagcucauaguuuacaccuuuaaacacagaaucuuuaucaacuuuauuuuggccuuuguucuuuuguucucuguguuucuagcucacagauaugugcugauuguucuaauuuaaguguauggcucuccucuuacuugggaauugagaacaaaggggcuacagaaucucuaggcuuucuugagcgguuggacuaaauguuaccuaaaaacaauucuugcauaucauuuaaaacccuuguacccacaggcauuauggcauagugggaauuguuuggaauuauuuaguuguguuugaaucucuagucucuacuuauuacugaccuacuuuuuuugccuuucuuaucuuaucuguaaaaaguuaacuuuuuaauacuguacaguaguauuuguagcuucucuguagaaaguauaaaguaguacuugucucuuagaguugguauuaggauuagagggaacauaggaaaguaucuaguguaaugucugguaccugguagcagccauuauaaucuaguccucugugguugcugucugaauuuugucuuagauauuucuguuauagccucugaaauuuuucucuucacguuggaguccugaaauauugcuauuucaugcugucccuuguuuuauguuugaguacaucaauuuucaacccaggauauuaaaaucaauuaacauauauucuguguuucaucuguucgucuuucccauugauucaauacaagaggguggugggcagucuguauuuaacuguuuuucauguguuggauacagagacauugcuaccauacagcuaacaugguagaacuacauauggccucuggacuacuugacaggaagugauugaacacugugauguauuugcugcuccuggauauggcagcagauuuuuccuacuugccuugguaucuuuuguagcucuugcuguuuuaccuguccuaauuuacucaugagcagaaacucauacuuguuagcuucagugguauaauuuuuuaccccuuuuuuuuucugccauguucuuucacucaucacccuucugauuuugauucccuuucugcucuguaauuuuuuucuucuucccuuuuuagggccuagucuguuuagaaauucugguuuuugagaguagugagcccuuuuacuuuuuucugacugccuaauuuucacugauagugaauaugaaccaccaggaugauaaaguauacauaacucacacccauucagucacuaggacaaucauguuugaaauuaagauacuuggagagcauauguauguauguagcuauuagggauuuugucucuguaguauaauauguguacaagugguaaaaauaaaagaaauauauucugaaacauaccagucuuuauaaugaaguuguuauucucuaucuuuacagggauuuguggaacugacuauauuucccacaguugcaaacuugaauagaaucaaguugaacagcaaacaguguagaauauaccgaguaaggaucaaugauuuagaggcugcuuuuauuuauaaugacccaaccuuggaaguuugucacagugaaucaaaacaguaaguuaugcacuuuaaaagucacuauuuuuaacaguuuugaaaaaauguuuuuaaugauuggauuaguuuuucucaaaguauuuuuuuuuuggaucguuaaugggcuuugaaucccaaucuuuaucuguuuuaccacucuguacauuugguucaagugauuuugcuagcugugcccaacguaguuacuaaguuucccuucuucauguuaaaacuuuaaggaaguguuaucugggaacuuuaauuagauuuucuuagucauuuuuuuuacuuucaguguuuuucuuaauuauuuacuucauaaauuuugaaaguaauuuucaguggguuagauggucacuguaaucuguagaccagaggcuacuuuaaaauauucuauaaaaaaguuuuagaaaguagauaaugaaauugacugcauuaaacuaucuuauaaacauauuaggucuaaaguagcucguuucuucaccuuagauaaauacuacaucuauugaggcuacuucugauuuuuaucauuaaacauauauugcuguuaucaguuuuauguucuacuucuauuucauacuuuguuuccauuuucuguguguguguguguguguguguguguguguguguggacuucauuuuuuugucaucuuugugguuaaauaauacuccauuugcucaguguaguauaguuuguauaauuauucuccaguuuuuuggcauuuugcagucauaaguagugagugaauguuuugucacauacaaauuuuuuucccuuugauuauuuuacuuuucauuucuaauggcuguuuucaguauuuuaccugauugugcccuaguguuuaaaugucuacuacuuuaaauacuaucaaguacaguugagggcacuugcuuuuucaaagcuuugauaacauuggguuauaucauuucugugauucuuuguguuuugggguaggaugccaaaacuuuaucauaaacuuuuuagucaagaugauguuuuaacuagucuagagguauaaugccuuaaggcagcaguucuuaaagugugauucccagacaagcaucagcaucaacugggaacuuguucuacaggccaguucucaaucaauaccccagacccacugaaucagaaauuguggguaggcuccuacaguuuguguuuuaagaagcuugccaggugauucugauacagaccgaagcuugagaaccacugccauaagcaauugcaaaguuuuagaagggaggcuuauuuuuagacauauuuauggucccaauaaucauugguuuaaaaucuuucacauuuagagaggagauacacaaaugggauuggaaaaauucagggaacccugauuuacuccuguaacuuuccauuucacaaaggugaguuguugaaauuacauugcuuuuaaagccacauuuguagaacugacauaaaaagacuuauuacaaaauuaucugcaucccuuuccccccagaaaacaaaaacaaaaacuucuaccuuuggggaaguuaguauacacuaauaaauggaaaggucaccugauaaagagcagauagaggacccauuaccuugccagaaggccaaaauauccacccuauccagccuagaacucugcauuugauaauaggguaagaugccuguuugucagucacaaaagacagugucuguacaucuuuuuuacuaauaauuuguuguugcugcccaggucucaggauaaucuguuaaguguaaugacagggauccuggucuguuaaggaagcaagcuuuacuuugcucuuuuuauuuugauaauauucccuaaaauuuuucucuaguaauaauggaagaugccucauuacuuuuaguguucuaaaucagcaguuucuuggaagacaguuuuuccacggaccaggggggcagaggggguuuuggaugaaacuuccaccucagaucaucaggcauuagauucucauaaguagugugcgaccuagaucucuugcaugcgcaguucacaauagaguuugggcuccuaugagaaucuagugcugcuggugaucugacaggaggcaaagcucagaagguaaugcuugcucacccgcuacucaccuccugcuguguggccugguuccuaacaggccacagaccuguauauauauuauauuuauaauacaaagaaugaaaaggaaguuauaaaagagaaucuuuucaaagguuaggcuaggaaauugggaaagauggaauguauuuaaaguuuuucauucaacuagaaccauagcucuguuggccauggccacuuaguaaaugcuugacuaauaauugucuacuaugcuugacuaucccugcuuuuuugcuuagcuuuagaaucuugauuacucuuuaagagaggugauuuucaauauuuuugcuucuguuuauccucugaauuauucaaaaagaauuugaaauuuauuuuagaguuuuauuagacgaaaguuuuagaaaguagcuaaugaaauucgcaugaaggauaaacaaguauaggaugguggauacuuacuauuaaguuacugcacaauuccuagaggaaaacuguagauuugugucuuauauuucugauugccauagcaaagaggguuuuuaagauucauaagacaugacaaaaacacaccaauuauucagaagaaauauuauguuuauuggcaguuagauaugaaaaagacaagugaaagauguuauuuuuaaagagaacuuugggaaaggcagauagcuaaggccuuuagcaugcuccuagaugcuucuguuacuuauuucuaaaauaacuuucuuucuuuaaugaaccaauaaagcuaaaacagaaauuaaauauagcaguuuugaaauuaaaagugaaacaucaaauuccgugguaaauuugauuuuaccauugauuuuacauacaaguaugucuuaacacugaaagaaauaauauuuaaucacauuuucuuauuauuuguuuuaaaguuaaggugccaugcccucccuauuuuugauugaaagagugugcuuacaggccuggugcgguggcucaugccuguaaucccagcacucugggaggccgaggcgggcagaucaugaggucaggagaucgagacuauccuggcuaacacagugaaaccccaucucuacuaaaaaaaaaaaauacaaaaaauuagccggguguaguagugggugccuguagucccagcuacuugggaggcugaggcaggagaauggcgugaaccugggaggcggagcuugcagugagccgagaucgcgccacugcacuccagccugggcgacaaaguaagacuccgucucaaaaaaaaaaaaaaaaaagaaagagugugcuuacagugguugagauuccuuugaacuguagaggaauauaaggaaaagaaacacuuggauaagaggcugaaaggcauuucuaucuauuuuauccaacuguuagcugacauguuacauuacauauacuaacaauuuaaaaacauauugguuauguaacguguauaagcagcugucuuuuugcuuuacuauuugucaauaaaauaauucagcacuugaaguuuuucgacauauauuuugugugugaaucuuauggauuguagauagauuguagauugucuccacaggagcuacacuuugguguuuuuguuuuugcuguacuucucuuuucuuagaaaaaguuaaauguagacuuugucagagaaacugucucuguggauggguaaccuagcuuuuuuuccucuuuguuuuguuccuagauaggcuuugccucuuuuucuuuucuuuuuuuuuuaagaccaagucucggccgggugcaguggcucacgccuuuaaaucccagcacuuugggaggccaagguggguggaucacgaggucaggggaucgagaccauccuggcuaacacggugaaaucccgucucuacuaaaaauacaaaaaauuagccaggugugguggcaggcgccuguagucccagcuacucuggaggcugaggcaggagaauggcgugaauccaggagguggagcuugcagugagcagagauccagccacugcccuccagccugggcgacagagugagacucccucucaaaaaaaaaaaaagaccaagucccgcucugucauccaggcuggagugcaauggugcaaucucugaucacugcaaccuccgccucccagguucaagugauccuccugccucacccucccgaguagcugggauuacaggcaugcgccaccacaccuggcuaauuuuuguauuuuuaguagagacaggguuucaccauauuggucagguuagucucgaacucaugaccuugugaucaugaguucgagaucaugccuuguaaucaugaguucgagaucaugccugccucggccucccaaaguucugggauuacaggcgugagccacugcaccuggccaggcuuugccacuuugagaagccccccaccccgccccacuuuuuuuuuuuaaagacagaguccugcucuggcgcccaggcuggagugcagugacacgaucuuggcucacugcaaccuccaccuccuggguucaagcgauucuccugucucagcuucccuaguagcugggacuacaggcacgcaccaccacacccggcuaauuuuuuuuuuuuuuuuuuuuuuguauuuuugguagagacaggguuucaccacauuggcccagcuggucucgaacuccugaccucgugauccgccugucucagccucccagagugcugggauuacaggcaugagccaccacauccagccgagaagcccuuuuuuauuuuacuugaaaugucccaacuuuucagugucaaaaaugaguuuaauuuccaccaaggaggggcagcagaaaugaaauuaucuauuuuaguauauaaaugaaguaguuauccaguuauaaugauuuuuuuaaauugcugugguuuuuuuuuuaagauuuuguagauucuauauuuuaaugcagacuucuacauggaguuuaaaauuauuucauuaaugucacauaauagaaauugguaauucccuuauugauuaugguuaaguaauagcaauaguuuaacugagcuacaaugcugcacugccaguugguuuauuaguauuagaauuaaguuaucuuagaguuggagggacauuagaguucauuuaguuuaaacuucaacaugaagccuuacuauuucaucuucuacuugaauacuuccaguucggcagggcucauaauauguuuuucuuaauuuuuuuauuuuuauauuuuuaaagacagagccuugcucugucacccaggcuggaaugcagugguguaaucauagcuuacugcagccuugaacuucugcacugaagccaucaucuaccuuagcuucucgaguagcuggaacaauaugugcaugccaccacguucgguuaauuaauuaauuuuuuauuuuuuacuggaugcauggucucacuauguugccuaaacugguuuugaacuccuggccucaagugguccuucugccuuggucucccaaagugcugcaauuacaggcauaagccaccaugcuugguccucauuauauuuuaacacaccccuuucauuauuucuaaaugcuggaaaguucuuuauuacauugagcuacaguucauuuugccuuaauagucacaaacuuaauccuaauuaaauacauaccuuuccccuaaguuuucuuaucuucaggcuacagaauuauugagauuacucucaaccauuccucauguuagaaacucuuucucaauuuauuuccauccucuuuguccuucucuggauaaucucagauuugauacuguguuuucuuaaaugugguaaucccggaacucuagauaugguucuuccuauuuggacuaaucaguauauacauuccaguagauccauuuuguccuuuaucuagauacaguauuucuaguagcuugaaacucauuugccuuuuaaaaguuguuuuaggauuaaaaaucacaaaccaaauauccacuguccucaagagaaucaccuaacacccauaaggauucuuguagacucaugguaaagggguagcuauuguuuuauaucagauagcaggaguagcuauucuuuuauaucagauaaaacacauuaaagcaacaugaauaggcauuuguuaaaagaagauauacaaauagucaacacauauaaagaaauucucaacaucacuaaugaucagggaaauacaaauuaaaaccacgaugacauacaccuuaucccagccagaauggccauuaugaaaaaguaaaaacaaaacaaaaaaaacagauguuggcguggauaugguaaaaagggaauugcuuauacacugcuggugagaauguaaauuaguacaagcuguguggaaaacaguauggagaguucaaguagaucuaccacuuuaucuggcguucucacuacuggcuaucuauuaaaaggaaaauaagucccuaugucaaaaaagacaccuacaugucuauguuuauugcagcacaauucacaauugcaaagauauggaaccagccuaaguccacauuuaacugaugaguggauaaaggaaaugguguguaugugugguguauguauacauguguguauauacacacacacauacaccauauauacacacauauauacacacacacacacacacacacacacacacacaccauggaauacuacucagccauaaaaaaauaaugaaaugucuuuuguagcaacguggcuggaacuggaggccaguauucugagugaaguaacucggaaauggaaaaccaaauaccauauguucucauuuuuuauuuguauguugaaaucuaaaccaucagauuauucgagacuaagcuauggguaugugaagacauacagagugauagaagucuggauauuggagacucagaagcggggaggagggagagauuuaaaaaaugacauauugggugcaauguacacuacuugggcaacagauacacuaaaaucucagacauuccuauuguaaaauucaucuauguaaccaaaaaccacuuguacacaaaaagcuauugaaauuaaaaaaaaaaaaaugaggcagcaaucacauucggcucccugucuugagcuaucuauuaaugccuugaaacugccuguuauggcccagguaguuaguuaaccuaacaaggucacauaggaugcuauaacucacacccuauagcuuaaaaauauauagccaaucacuaaucaauguuauuucuuuaaaccagugagaaucccugacagacaguuuugugucaaaccacuuccugucccucuuuuuugucuuuaaaaacuugcgugcaacaaaguuuaaauggaggccauauccaagguuacuugggugagucuucugagcagcuguugucacuuuggcucauguaaacgcucuaaauuuaaaaaaaaacaaaaaaguugcauuuguaguuggaucaaauuugagcuuguaagcagugaaaccccuaggcuuuuucauaggaaaaccuguuaagguagauuuuucacucagcagccuuaugucaugguuccagguuaaauuuuguuuugguuauuuuuuuuuuuuuuuuuuuuuuugagacggagucucacucuuucgcccaagcuggacugcaguggcgcuaucccggcucacugcaagcuccgccucuuggguucaugccauucuccugccucagccucccgaguagcugggauuacaggcgcccaccaccacgcccggcuaauuuuuuguauuuuuaguagagacgggguuucaccguguuagccaggauggucucgaucuccugaccucgugaucugcccgccucggccucccaaagugcugggauuacaggcgugagccaccgugcccggccuguuuugguuauuuuuagagucauccuuguucauugugguuuuggcuuauuacuuuaauuuuucaguuugugaaaauuuaucgagcuguuuacuagggcguguguagcuuucugauuuacuuccauaaaaguuuacuuccauaaaaguuuacuucuauaaaaaauuuuuuaaauagagggaaaguuuacaaauaauugaaacugaaguuuuauaaaaucugcaucuauaguuuuaagaggcagauguucuuuauuugacaaaugauuaucauauuaauucaauauggauauuuaaaauucuuagagaaaauuauaucuauucccuuaauuuacuaauuuuucaauaucucucuauagcauuucuucucuuuaaguugcauuucuguaaggaggauugggagauggggaugguagagguuauagggcaaggacauuaaauauuuuguagucauuauuauucugaaaauugaaaacacauuauaauuuuacacuguaauuuuugacuucuaugagguuauuaugaaagaaaacauuugauuuguguauugaaaucuaaaccaucagauuauuugagacuggcuucccaguugauugcauuuauaaugacucacucauuuuauuuggaccacuucaccuuuucucaggaaaugagaagauuaaaugaaaauaauuucccauaaaaaaacuaauuaauauguaauguuuaaaucuggcuuucuuuuuguacaauaguuauuuuauuuuugcauuucccugauaacuugggguggaauacaaguuuugcaaucaucaaauuuuauguuuuugaaauuuuauugaaaauaaauuauacucuauagauaaaauaguccuuaaaauuagaugguguguuaaguaagugcugacaaggauuuggagcaacuggcacuuucagaucuugcugauggcaaugcagaaugguacaacucuucugaaacaguuuuguagauuuuuagaaaguuaaauguguuuaccauaugacucuagucccacuguuagguauuuguacuacagagaugaagcuuauauucacacaaaaaucuguacacaaauguucauaacaguuuuauuucacacuuccaaagcugaaaauaaccuaaaugcccuucagcuggucaauggaucaacaaacugguacagucuauacaauauaauaccacucaauggcaaaaggaucaaauuauuaauauauguaacaacuuggaugaauuucaaaaaccuagugacacaagccagucucaaaagguagcauucuaugugauuccauuuauuuaacacaaaggauagcauaagggacuuuuuggggaugauagaacuguucuauauccuacuuuuggugguuaacugaaucuguacauauguuaaaauuuguacaacuguacacccccaaaaaagugguuuuuuuaauuguaugauaauuuaaaaaaacacaggcauaccuccuuuauugugcuuugcucuguugcucuguugugccucgcagauacuguuuuuuuuuuuuuuuuuuuacaaauugaagguuugugauaaccuuacaucaagaaaguuuaucagugccauuuuuccaacaacacaugcacauuucaugucucuaugucacauuuuuguaauucuugcaauauuucaaacuuuuucauuauuauaucuguuaagguaaucugugaucagagaucuuugauauuacaauuguaauuguuuuggggacgccacagauggcaugcauauaagaugguaaacuuaaaugauaaacauuguguguguucugacuacucuguggaccagcuguucccugucucuguccccuuccucgggccucccuguuugcugagacacacaauauugaaauuaggucaauuaauaacccuacaauggccucugagcaugcaagugaaaggaagagucucauaucucacacuuuaaaccaaaagcuauagaaaugguuaagcuuagggaggaaggccaaaagcuagaccucuuggccccaguuagcuaaguugugacugcaaaggaaaaguucuugaaggaaauuaaaaguacugcuccagugaauacacaaaugauaagaaaaugaaacagucuuauugcugauguggaguagguuuuaaagaucuggauagaaaaucaaaccagccacaccaucccuuaaggccaagccuaauccagagcaaggcuuaacucucuucaguucugugaaugcugagaggugaggaagcugcagaagaacauuuugaagcuaagagaggcugguucaugagguuuaagaaaagaaacuuugucuguaacaugaaagugcaaggugaagcaacaagugcugauguagaagcugcagcaaguuauccagaagauuuagcuaagguuuuugaugaagguugcuacacuaagcaacagauuuucaauguagaugaaacagccuucuacuagaagaagaugcuaucuggaacuuucccagcuaaaaagaagucagugccuggcuucaaaggacgggcugacucuuuuauuaggggcuaaugcagcugggaacuuuaaguuaaagccagugcucauuuaccauuccaaaaauccuauggcccuuaacaauuaugcuaaaucuauucuuccuguucucuguaaaugaagcaacagagccuggaugacaacagguguucacaguauggcuuacugaauugaauauuuuaagcccacuguugagauuacuggucagaagaagaguccuuucaauaugguacugcuuauugacaagacaccugguuacccaagagcucugauggagauguacuaggagauuaauacuguuuuuaugugugcuaacauaacaucuauucugcagccuauggauuaaagaguaauuucuacuuucaagucuuauuauuuaagaaaugcauuucauaaggcgauaguugccauagauagugauuccucugagggaucuggacaaagucaguugaaacccugaaaaggauucaccauucuggaugccauuaaggacauucaugauuuagggaggaggucaaaacaucaacaugaacaaggguuuggaagaaguugauuccaaaccucauggaugacuuugagggguuuagagaaggaaguaacugcaguugugguagaaauagcaaugaaacuagaauuagaaguggagccuaaagguaagacugaauugcugcagucucaugauacaacuuuaauggacggaggaguugcugcuuauggaugagcaaagaaagugguuucuugagaugggaucuacuggugaagaugcucugaauguuuuuggaaugucaguguucauugucaacaauguuuauuuaacagaaagaaauuauuaaaauauauugagaagucuuuucacuuccagaacucugugcuuuguaguuguuaccuugaauaguuguuaaagccauaguuauauuauauccuuccuaacugguagagagauugaugaagauggagagggaauggccucugucaaguuaagagucuguagccuuaauguuucuuuaauggcuuuucucauuuuauuuuuccuuuaauuauuccguagaauauguggaacuugucuuuuuauuuuuauuuuuuaauuuuuuugagaaaaagucucacucuguugcccagguuggagugcaguggugcaaucucagcucacugcaacuuccgccucccaggcucaagugauucucgugccucagccucccgaguagcuggaauuacaggcaugcaccaccacgccuggcuaauuuuuguguuuuuaguagagaggguuucgccauauuggccaggcuggacuugaacuccuggucucaggugauccaccaccuuggacucccaaagugcugggauuacaggcaugagccaccguguccagcuaaaacuugucuuuuaacuagaugaaaaaaguauuaaguuauaggaaugucacuaauuucaccuuguggcuacaccuaacggcaggauggcagacauaaagguguacaacgaggaugugguccaugguguuuguguauuucaucuuguauucuugcccuucccauuccguaucuuuuuccugucuuucauuucuuucguauuuuuuuaaacuaauuucagugaggaaauguaauauguguauauguacacauauaaguugcuuuuauggaguacaauuuaaaaaccaguugagaacaacauuuucacguuucuguaagacuucaucguauuguuuucaucaaaugggaaauaaggucagauaacuauggaacaaauauuuauguaguagucucuccugacauagugaauauaacggugagccugcugaaaauucucugcuucauuaagcuuacauuaugaugcacuaauggguggagguaggugcuauuacauuuugaggaacugagucccauccugauuuguuuuaaacaucuuaauuuuugucaaauuauaaagcuuguugaauccauucaauuuuuugccacauugauagggaauaauuauuuauucagugcuucacguauucuuuacauuuguaucaaaaaaggauaguggcuuuggcauuccaaaauuaaugaagaaugugauagucauaauaauagucauguaacuuggugaguagaauauauauucuguuguauucauagauuaauaguuuuuaacauggugaguagagcaaaccauuacuuggcuaaagaguguucuuagaaauuauauaagaagauaaaaugcuuacaaauaauugguaucaaaugauauuuaagaaaaugcucagaggccaggcaugguggcucaugccuguaaucccagcacuuugggaggccaaggugaauggaucacuagagguuaggaguucgagaccagccugaccaacauggugaaacaccaucucuacuaaaaauauaaaaauuagcugguugugguggugggugccuguaauccuagcuacucgggaggcugagggaugagaaugcuugaaccuggagguggagguugcagugaguugagauggugccacugaccucuggccugggcaacagagugagacuucaucuaaaaaaaaaaaaaaaaaaagaaagaaagaaaaaugcuugguaagauacauggcuuauuauuaaaaguuggcucuuuuuuuuccccaggagaaaccucaauuauuuuuccaaugcuuaugcagcugcaguuagugcuguggacccugaugcaggaaauggagaacuuugcauuaagguuccaucagagcuauggaaacacguugaugguaaagcaccaagaguauauugacuguacacuaaaaucacguuagauucagacacuagagaauuuuacaugagaacuaaugaugcaggcacugugccucaugccuguaaucccagcacuuugggaggcugaggcggguggaucaccuaagaucaggaguucaagaccagccuggccaacauggcgaaaccccaucucuacuaaaaauacaaaaauuauccaggcuuggugggcgcauguaaucccagcuacucaggaggcugaggcaggagaauugcuugaacccaggagguggagauugcagugagcugagaucgcaccccugcacuccaaccugugcaacagagugagacuccgucuuaaaaaaaaaaaaagaaaaacaaaaacaaaacgaaagaacauuaacgaugucaaaauuguaaauuaaccaguugaaauauauagaauggguuggaagcucuuuuucuuauuaaggaucacuggcuaacaggaugauaccauuucagggcugugaaaaaagcaauuuauuucaccguuguuuuuuaaagcuaaaaaaaaaauuuuuuuuuguuuuuuuugagacggaguuucgcucuuguugcccaggguggagugcaauggcgcaaucuuggcucacugcaaccucugccucccgaguucaaggaauucuucugccgcagccaccgaguagcuaggauuccagucuccugccaccacgccuggcugauuuuuguauuuuuaguagagacaggguuucaucauguuggccaggcugcucucgaacuccugaccucaggugauccacccuccuuggccucccaaagugcugggauuacaggcgugagccacugcgccuggccaugaaaaauauuuuuaaaaaaucauauagguagaaccugcacaauaucaaauuaguuuagaauuguagcauuuuguagcaggaaagauccugaaaaaaucugguuaaauuccuucuuuuuacagaagaguaaucugaagucuaaugagagugagugaccugcugaacuucacuuagcaaauuauuggugaaguuaaagcuaaaacacaugguuccugauacucagucugcagacuuuuuaaaccuucuuugugucuuguauaaaguuuuagccauuguaauauuguauauuagcuucugccuugcuuauuuagccuuauaaaaauuaaucaaggaaguaaaagaguccuuguuuuguuuauugguuuccguugugggugcuggggacgggguaggguuuguggaggaacuuacccuaauuuaggggacagacguggaagucgucauugcauuuuuaggguuuggagauagugcauaugauuguaauucuuggagggaaauuaaaaucuuaugaaagcaacacaguuuauagugaagaaaucaagcauaacaaaaaacgugauaauaaugcaaauucuccggugguguucccuacucuaccucucauccuuguacuccccaaagucacccaggguuaaguuugugggauaauauaauaagagaaagaacuugaaaaguaaguguauuaguccguuuucaugcugcugauaaagacauaccugagacuaggaagaaaaagagguuuaaugaacuuauaguuugacauggcuggggagaccucacaaucuuggcagaaggcaaggaagagcaagucaugucuuaugcagauggcugccagcaaaaagagagagagagagcuugugcagggcaacucccauuuugaaaaccaucagaucuugugacacuuauucacuaucacaagaacagcaagggaaagacuugccccugugauucaguuaccuccuaccaggucccucccauaccacaugggaguuaugggcgcugcaagaugagauuuggguggggacacagagccaaacuauaucaguaaguuugggguuggauuuggaaggccuaagugugcagugugggaguuuuggacuuuuuaggcauuguacauugucagaaauguugagaggaggauauggcguaaccaaagguguauuuugggaaaauaauacaagcaauaguuauaauugauuggagguagaaaaccaauaggggcagccuguugaguuaauauaggcagacauaugguaaaagucuaaacuaggguaaguagugugguuuuucauauaaaucucaguccucaauuccauuucauguucagcauuaaaucuuugucuuuauuauauagaccacuguaacuuauguaucaauguguguauauguuuauuuguugcagaguuaaagguccugaagauacacaucaauuuuucuuuggaucagcccaaaggaggucuucauuuugugguacccaguguagagggaaguauggcagagagaggugcucauguuuucucuuguggguaucaaaauucuacaagguagauuauagauucuuaaauauuucaauuaauuuuuaaauugcauuuuuuauguauaagcaagacauacauuugguguaaaacaagaaauacuaguuuuauucccuuccaaauuuagacuucuuucaaauuacuuucuguuagucauuccucuuaaaaaaaaauuuuuuuuucuuuuuuuuuuuucagacagucuugcucugucacccuuguuggaauacacuggggugcuaucucugcucacugcaaccugugccuccuggguucaagugauucucaugccucagccucccaaguagcugguauuacaggcauucaccacuacaccugccuaauuuuuuauauuuuuaguacagaugggguuuuaccauguuggccagaauggccuuuaauuccugaccucaagugaucugccugccucagccucccaaaguacugggauuacaggcaugagccaccaugcccgaccccuccucaaucuuacaucucccuucuucucucucauuuucaugucuacuguucuaaaauaaucaucucacuugauuccuucuuuuuuaaaaacuuuauauugaaguaaaacauacauacagaaaauugcacagaauguaaagcucgaugaauuuucacaagugaacaagccuacauaauuuacaucuagagacaaagaauauuacaagauuauagagaccuccucucaccugcuuucauacucuacuuccccacuccacauucuacuacucaacucugcuuauuuauuuauuuuuuuugaaacagagucucacucuguuguccaggcuggagugcaguggcauaaucuuggcucacugcaauccccaccuccuggguuccagugauucuccuaccuauccuccuaaguagcugggacuacaggcaugugccaccacaccuggcuaauuauuuuauuuuuaguagagaucagguuucgucauaucuuuaguagagauagccuguugcaccagcuggagugcaguggcgcaaucucggcucaugcaaucucggcucaugcaaccuccaccuuccagguucaagugauccuccugccucagccucuggaguagcugggauuacaggcagaugccacaugccuggccaauuuuuguauuauuaguagagacaggguuucaccauguuggccaggcugguuuccaacuccugaccucagguaauccaccugccucagccucccauagugcugggauuacaggugucagccacugcgcccagccuguccucagauuauuauaauaacuucucuaaaccagggauaaugucuuacacacuuuugugcuucaauacuaaguaccuacccugucacguaacaccuuacugaacugaugaaagcugacuauaaauuuuauaucuaacuuaaccagcacucaguuugaauuuauacaauacguuacauacuccaaaaaagcaguuuuauaauuuaauggaauaaauucugaauguuaguuaugcuuuauaaaacuuuuugcugugagccuuuuuuaguuucuagaaaugaaugcugcauaaaaacugacuaauaugcggauacaaguuaaaauuauuuuuuaaaacacugaaagcuaagaauugcuuaacucuuuuuaggguuugaacugaugguaccacauaauauauuuucuuaauauugccaaauaguauuuggaaacagauuuuauuuuaucagauuuuuuucagguuguacaguaaaaagcuucaguagccaaauagcuaaagguuuuguuuguucauuuucuagaaaugcuaaaauaacuugcauguggggaaaacaauguagagaacucuuugaauacauuuucuauacugucaaucuuuuuucuagauuuugguucccuuguguugauucauacucugaauuguguacauggaaauuagaauuuacaguagaugcugcaaugguugcuguuucuaauggcgauuugguggagacaguguauacucaugauaugaggaagaaaacuuuccauuauaugcuuaccauuccuacagcagcgucaaauaucuccuuggccauuggaccauuugaaauacugguagauccauacaugcaugagguaagucagagcuuuccucucuuacucuccuccuggcccuuuacugcuuuuaaaaagauagauauuggcaaggcacgguggcucaugccuguaaucccagcacuuugggaggccaaggugggcggaucacagggucaggagaucgagaccauccuggcuaacacaguaaaacccugucauuacuaaaaauacaaaaaauuagccaggcgugguggugggcgccuguagucccagcuacucgggaggcugaggcaggagaauggcuugaacccaggaggcagagcuugcagugagcugagauugugccacugcacuccagccuugaugacagagcgacaucucaaaaaaaaaaaaaaaagguagauauuaaugaaauauugucuuccuucacucuuuuuucaacuaucaagaauaugacuagagagaaaauguuuccuuaucuaauauauauaaugaugugaauucuugaaugaauuucuuucaaaauguuguauuuaaauuucagauuauuuuccaacagagucuuagcauuucaaaagagcuucaguuauaucuugauuuagcauauagguagauuucuguaacuaauuuuguucauuacuaaugacaucuuuucauuuaucauguuuuugaauguuguggucccaucucuggaaucuaaaauauuguaaauucaaaauuaaagagcaagauuuauucucucuucaaccuauacagaggaaaacagacagaguuagaaaccugguuagcaaacucaugaagacuucuaguuucuucccagcacauaucuuaucacaauucauuuaucaauugacaggccaaaucacaguuuuaggccuccccaagcaugagacuucugcugauuagaaaaugauuuauuaguuguuaacucucuuuuuucgucuucaauuuagguuuauuuuuuaaaaaagaaauacauaagcauauaauuugaccacguauaucuccacagcauuucuuuuagucaugugaauaaaaauugagggcagcaggcuuucggugagcuccucaguuugccuuuuauauuugccuugcugaaauucacaggauuuguaaaaucacucguggaaaagauucaggauauuuuguguugguuuugcuuacguugucuuaacaaugacucuuuuuaaagguuuauccacugauaagauuagcagugaacuuuauugucuuugguaaaugaucagcuuuaaacaugcuaccugacuucaaacuauacuacaaggcuacaguaaccaaaacagcaugguacugguaccaaaacagagauauagaccaauggaacagaacagaggccucagaaauaauaccacacaucuacaaccaucugaucuuugacaaaccugauaaaaacaagaaauggggaaaggauucccuauuuaauaaauggugcugggaaaacuggcuagccauauguagaaagcugaaacuggaucccuuccuuacaccuuauacaaaaguuaauucaagauggauuaaagacuuaaauguuagaccuaaaacuauaaaaacccuagaagaaaaccuaggcaauaccauucgggacauaggcaugggcaaggacuucuuaucuaaaacaccaaaagcaauggcaacaaaagccaaaauugacaaaugggaucuaauuaaacuaaagaguuucugcacagcaaaagaaacuaccaucagagugaacaggcaaccuacagaauuggaaaaauuuuugcaaucuacucaucugacaaagggcuaauaugcagaaucuacaaagaagucaaauuuacaagaaaaaaacaaccccaucaaaaaaugggcgaaggauaugaacagacacuucucaaaagaagacauuuaugcagccaacagacacaugaaaaaaugcucaucaucacuggccaucagagaaaugcaaaucaaaaccacaaugagauaccaucucacaccaguuagaauggcgaucaguaaaaagucaggaaacaacaggugcuggagaggauguggagaaauaggaacacuuuuacacuguuggugggacuguaaacuaguucaaccaucguggaagacaguguggcaauuccucaaggaucuagaacuagaaauaccauuugacccagccaucccauuacuggguauauacccaaaggauuauaaaucaugcugcuauaaagacagaugcacauguguguuuauugcagcacuauucacaauagcaaagacuuggaaccaacccaguccaucagugauaggcuggauuaagaaaauguggcacauaugcaucauggaauacuaugcagccauaaaaaaggaugaguucauguccuuugcagggacauggaugaagcuggaaaccauuauucucagcaaacucgcaaggacaaaaaaccaaacaccacauguucucacucauaggugggaacugaacaaugagaacacuuggacacaggaaggggaacaucacacaccggggccugucgugggguggggggaugggggagggauagcauuaggagauauaccuaauauaaaugaugaguugaugggugcagcacaccaacauggcacauguauacauauuuaaccugcacauuguacgcauguaccguagaacuuaaaguauaauaaaaaaugauaauauaaaaaaauuuuaaaaaaucaauguuugauuaguaccgauuuuguauuuaagaagaauuuuuuuucuacucugagcuauugaauaggaacaaggcaaaugauagucaagaauuguuuuuccugacuuagucuucucugugucaaauacaugacuugucugcauuaucaguaaauuugcugucuuguaggauuugucuaaaaauuaguccuuuuuuuggugaauaguauuuuuuauuugcauacacaaauaaaauuaugauuaaauaugauuaauacaaacagaguguuaaucaugauacaaauuugggcccugauuauuaguaauacauagaugcuuuucuccacucuuaugguagccucuaaucuguucuuuuuaaaugcuauuagaagaauaauuuuuaugauaaaaauuucccuugccuuuauaauucugcaguaauuagaacucuuuagcauggcuuucaagaucuucuauaauuugaccguaauagauguuauauucaaaauaguuuacuuauauuucucugaucauaccuuuuuucuucccaucuuugacccugggacguucucuuuuccuguaccaaaaguuuccuaucaaacuucuguugaacucaaaaagauuaccacagcuucacacuccugcaugaaaccuuacacgguuguucuagucagugaccugugucauuguugauggcacucauuuggcacagaucauaauaagagauagcauaugauauuugugugaccaaagugagauguaaccuaaugaaaaaaaacagaguuacuauuucuguugcaggcauuuuuuaaucuccuaacuaccaguaaacuuuucugcagucuuugguguguaauugaaauauuagagggggacuacaguaauuauuuuuauaugcagauaauaugauuaacauuaacuguugauaagauaguacuauaacgugcauuauucacuggguuaaauauuuaugaauaagagguauguuuauaauaaaccuuugaaauuuaagucuuauuauguguaccuaugagaaaaaauuuuaauugaauuuggaacuagaguuguauuuuaguuggucugagcauuccacagacuuauaauccaccgugaauuuaauuuuuaaguaguuaauauuuuauaaaugugaucaguaaaagugaucacuauuuucacaacauuuucuuucagcaucuugaaauuauuaaagaauagauuuaugagaacauuuauuuauaguugagguguuuaggaaauuuccaauauuaaauuuaacucuuucauuuagaugaucuuccuugcuucuucuuuucagguuacucauuuuuguuugccccaacuucuuccauugcugaaacauaccacaucauaccuucaugaagucuuugaauuuuaugaagaaauucuuacaugucguuacccauacuccuguuuuaagacugucuucauugaugaggcuuauguugaaguggcugcuuaugcuuccaugagcauuuuuagguugguaucucuucagauuugaaaugccuaaauuaagaucaugauaugaagaaaauuuacugauuuugcggucaauuuuaagacgagcuuugaacuuuuuuccgcaauuuggaugugauuggcuuuguacaaaauuugguuuuaaaauuuuuuaaauguagaaaaacaugaagacaaaguuuuugagauaacucaaaaggcucaucuucauccagaauuaacuaauauuaguauuuucccuguuuuagucuuguguucauaaauucuuuaaaaauuguacaaauuauuguaugacuaguaugaauuuuuuucuagcacuauuuaaaaauguacugauauugucagaaauuuacugauaucaucaguggaaaauguguucuuugcuuuaagcaaguuacuaagaugaugaauuuuagcuaaauuuugaaaagauuagaaaggugggagaauuuuuucucuauuuagcuuccauuguuuuaaaaguggaauuauuuuauuuucacugaauaaguauuuauuucuugguuauaaugagcuuucuucucuuuuaaauuccagcacaaaucuuuuacacagugccaugauuauagaugagacaccuuugacuagaagguguuuagcccaauccuuggcccagcaguuuuuugguuguuucauaucuagaaugucuuggugagugaccugaaaguucauacuacugagaagagaaucaaguuuauuuuucuuuucuuucucugcauuuaagcugaccuuugcccuaauugcagauagcuaauuuaagagacacuguucuauauguauuuaaagaaaaaugauuauaaguuucauccuaacuuuuuggccaugaaaucaauauagucacuuauauuuauuaguuaauuaaauuagcuaauuuaaaagacacuguucuauauguauuuaaagaaaaaugauuauaaguuuuauccuaacuuuuuggccgugaaaucaauauaaucacuucugcaguuuauaagguaagauuuugguaaaacagugucuuaaagaacugaaugaauucuauaaauaaaagaacuuaaauguacagaaaucugaaguuagaauuuuaaugucaguguucaaagcaauuggaaauaacucaauauuuaauguaaaauaguacuccucugcaauauuaauaauuauuuagggauuugccuacuagugcucagcuuuguaccaguuuguugaaagaaaugaaagguauauaugcuuuuucuuuucuuuuuuauuaacuugagauuauuuugaagaaaacagaaaaauuaagauuauaauugugaacauucuauacuauauauaguauggaaauguugguuuucuuuuuucgcuugcuggaguggagaggagagggcagagacuaaagauagaucucuugauuuguaguuuuccuaaaaucacauguagaaguuucauuaaagaauagugcuuggaauguaguaggcaaaauauuauggauggauggauggauggaguggguagauggauagauggaugaguauacaaaugaauaaaugagugagugauguuaauugccauuuuucuagagaaagcaaaaaaaaaugaaugaaggaauuaaacuuuagguuuuagaauaucauugguaauggcauaaugcaugggauuggcaauaauagcauguagacuuuuagaauugaacaguauaguccuggcuaugagcaaguauuuccuuagaggcagagacaguaagaacagaguugggcaggagggaagcagcacugucagaguagagcauguacucugguaauuuauaccugaagcaagacuguaaagcagucucauaaugaaagguaaaggcaggugugaauaagguauaauaaaugggcaaguagaacucagaggaaguugggaaaccugauaauuuguuaauaauuuucauuuucuuuaugaaggcagggaaauacacacuacacuuauuccguuauccucuuugacauuaucugaggaguuuuuaugauuaaaaguaauuuaugcuuugacuuuuugcuuaggucugaugaaugggugcugaagggaauuucaggcuauaucuauggacuuuggaugaaaaaaacuuuugguguuaaugaguaccgccauuggauuaaagagguaauaacagcuagaucccuuauccacuuacaagucuuauguccuccauuuuuaaugacuguaaaauacuuuuaaaauacugcuugaaaaucccuaauuuuucccagcaaaaugggaauugauuuacugagaaagacuaauggucuauuuuaucuaaucuccauugucaacauuggccccuaaaaaccuuuuuuuccccuaaggaagagaauauuuaaguuucuuaaacaucagauuggucguuagguaugucccagcuccuuauaguagucguuuguaacugugcuuccuaaauuuguuagcuuuguaaccuuaaucuuuccaagucucuguuuaaggagggcaauuguagugucugcccauaggcagagauuauuagacauuauacaaguaaugugcaugaugcuuugcacauauuaacugcuuauuauauucuggcuaggcuuugaaugcauuuauguugucauugucacaucuuuuuuuuuuuuuuaacgauuuaaagauuuggccaaaaagaaaacaucaguuguauuuuacuuagcacauuguggucauauacauaaacauuuuaaucauaucaugcuuagugucuuccuucucagguggaagaauugcagccuuucauaucuucauuaaacaaaccuuaucaucuuccccguauucucauuuuacauauuauuaucauccaagaguaaacucaaguaagccaaaaaguuaauuuucgaagacuucaaacaccuagagcuauuaagguauuuguacaucuagaacuggagucucuucuuuauuucagaaacuauuaaagaagaagaacaaaguaacacaacacuuaaaauauuucacgcacuguuacaaauguuuuauaaauauuaaaaugaucuuaauucuccuaacuaccuugcuaucauucccauuuuauagaugaagaaacugaggaacagaaagaaagguuaaauuauuuggucaaaguauacagcuaguaaguaguaggcccaggauuccagcuuggcuuuuaguuucuucucuaugcuguuugccacuuuucuguacuacaucuguauuauuuaaagcaguuaggaguuuccagcacaauugugguagugucuuuauuuuaacuuaugcuuuuuuuuuuuuuugagacggagucucacucuguugcucaggcuguagugcaguggcgcaaucucggcucacugcaaccucugccucccgggcuuaagcgauucuuccaccuuagccuccugagagcugggauuacaggcacccgccaucacgcccggcuaauuuuuuguauuuuuaguagagacgggauuucaccauguuggccaggauggucucgaacuucugaccucgugauccacuugccucagccucccaaagugcugggauuacagaugugagccacugcgcccgucuucacuuaugcuuuuuuucuuuuaauuaaccaggcacgguggcaugugccuguaguuccagcuucuugggcugaggugggaggaucaccuaagcccaggaagucaaggcugcaguaagccauaaucagcuacugaacuccagccugggugacagaguaaaacccugucucaaaacaaaacaaaacaacugcccccaacccccccuuuuuuuuucuguuuaaaaaaaaaaaucccccuuuuuaaaaguucaauuuaugucauguuagagaagacuggagaaguuuuaaaaugauagauuccugacauaauuuauucccauuccuuuuuacucgccuaaauuuuuugaagcaaaauacagagaaggaaaaauaaacuuggagacagcucagagagauugagaacagccauaagaaaaaguugccaggcugcuguccagcccugaagucauaaaguagagaagucuuuggcuuuugucauucugccagcuguguaggcugcuuuauuuauaagaacauaaacuacucuuuaaauacauuucacuuauuuuaagaaauuuacauucugauuuuaggaaaugagaauucacaguuuaauucuaaaauuugguauguaaaaaaauguuacuuuacaaauuuuacugacuccuauuuuuauauauuuuuuaggagcuagacaaaauaguggcauaugaacuaaaaacuggugggguuuuacuacaucccauauuugguggaggaaaagagaaggauaaguauguuuauuguucagagaugauauuauaaaccuugacuauauauaacaauuauuccauuuaagagcuaaauaguauuucauuguaccucagaauuuauuuaaccuuuuucuuauugcuauucuuugcuaaagcuuacagacucauaaagcucauaagauuggaaguaauaaguaaaauauaaaaauaauuuuuaaaauaucagauugauuauaaaguaucugaaguuuuaaugugccacauuaaaaauuuuuuuuuaauuuuuuuuaaauggggucucacauuguuacccaggcugaucucaaacucuugggcucaagcaauccuccugccuuaaccaauaugccacauuuugaaggagaugcauaauaccacuugccauaguuuguuuauucuacuauaccaaaguaccacagacuggguaauaauguaaacaguagaaauuuacuucuuguucuggaggcugggaaguucaagacugaggcacugggaggauuggugucuggugagggcugcucucugcaccuaguuggcaccuaguugcugcauccuccagcgggaaagaauguguccucacaagguggaagggauggcagggcaagagaacgcucccuucaaccuggagccuuucuaugagggcgcuaaucccauucaugaggguagaucccugaugauuuaaucacuucccaaaggccaccucuuaagacuguugcguugggguuuaaguuucaacaugaauuuuggagggggcaccaucauucaaacaaacuauagcaccacucauacacugugagaguguaguuugauacaguguuucugauggguaauuuagugugguacuaaucagaauuguagaauggguaauuuuuagauccagcaauucuucuagguaugugaucauguagaaauucuucuggcccagcgcgggggcucaugccuguaaucccagcacuuugggacgcugggcagguggaucaccagaguucaggaguuugagaccagccuaccaacauggcaaaaccacaucucuaccaaaaaauacaaaaauuagccaggcgugguggugggugccuggucccaacuacuugagaggcugaggcaagagaaucacuugaaccugggagguggagguugcagugagccaagauugugccacugcacuccagccuggggauaagagcgagacucuaucucaaaagaaaaaaaaaaaaaaaaagaaagaaagaaauucuucuaggcauuuaucauacagaaauauuugcacauguguaaaaagauacucaccauagcauuauuuggucuagugauaauuuguaaacaaauuaaauguucauguaugucguaaauauuuucuagacuguaucuuucucuaaauuuacuuaugauccuuuucauugugucaaaauguuuuaauuuuuauguagucauuguggucuuuaugucuuccagauuuuguauuuuuucuuaggaaaauuuuucccaucccaaaauauaaagagaaauuuuuuccuucauuucuuuuaguacuuuuauaaugguuuuuguuuuacauauauaaucaaucuuuaauauauuuuagugcaugcuucaauguugggauauugauuggaauugcacugauuguauugauggauuuggggagaauggaaguauuuacaguauuguaucuucccaucuaggagcuugguguuuguuuccauuuauucagauuuuccuuuauguccuuaaguaaaacuucauaauuuucuucuaguuaaguuuauuuuuagauguuuauuaguacuaaggaaauugcuuauauauucuccugagguuuuuuggguauuuucuugauguggucaugaaauuuauuuuuuauuuaauagucacauuugcuguauuagguaaauguguuuauuuuuuuuaguccggcuucccaucuacacuuuucaauaaagcauccacauacacuguccugggaauacuacaguauguuucaguguaaagcccaccuugugaugagauugauugaaaauaggaucaguauggaauuuaugcuacaaguaaguauuaaaguuaagaacuuaacaaugguaaauaaagaucuguauguguauaaucugaguauguuucuguagaauaggagucaggacaucuggauuuauaguuuuguuugcccacuaaguaaccugugcuuuauauuugcauuuccucagauguagaauggguaucaauaccagaacaacuuugcacaugaauuuuaugaagauauaauuagaaugugguggcugggcaugguaucucaugccuauaaucccagcacuuugggaggcugaggugggaugauugcuugaggccagggguucgagaccagccugggcaguauaguaagaccccccccaucucaaaaaaauuuuuauuacuaagucaggcauaguggcaugauucuguagucccaccuucuugggagguggaggcaggaagauugcuugaguccaggagguugaagcugcagugagcuaugauugugccacuucauaccagccugggugacagagugagacugucucaaaagaaaaaaaaacuagaauuguggggaugaaaguaaaacauauuuauacauaugaauuuguguucugcauuguauuaaggaugaaaugccacuuuaaacuguuuucaauagaaaaacguaaaccaauaaaaaagauguuuauuuuugcuaucgcuaaauuuugccauguauuuuaagcaaguuucagaguaaaugguugugauuuaguaguugcgaguggaaaccaaauguucagccauuuuuuuucauuguuaacauucuuagaggcagguaaaaaauaaugcuuuuuuuaaagcauuuuaaguuugcuguaaaguucaguuucuuuaaucuuucuguccuucaccuugccuuuuuuugguuuguuuuguuuuuuuuugagauagggucucugucacccaggcuggagugcaguggugcagucacggcccacugcagccuugaccucccaggcucaagggauccucucaucuaucucagccuccugaguugccgggacuacaagcaugcaccaucgugccugacuaauuuuuguauuguuuguagagaugggguuucacuauguugcccagucugaucucaaacuccugggcucaagcuacccacuuaccuuggucucucaaagugcuaggauuacaggcaugagccaccacaccuggccuuuagaaugaagaacagaaauguuaaaagagagaugguccauaaagagccacucaagcuuuggagugguauaaauccugaugaguaucauuagcuucuuaauuucuaguuucuauauaaacuacaauaaauuauagguauuauauauuauucuuacuauaauucuuaauauuauucaguacaucauuaacauucaauaauguuuauaugaagaaugguuuuguauucuggcugcuuauaucuuugcauauuucuauugcuaguagucuuuagaauaaucuguguaauaaauagugaaauuauugucuucuauaauugacuacaauaaaguuauaaugcaaagugaguauucuauauaauugaaaagaaucuguuauaugaauuuacuaaaugauuuuauccuuacagguuuucaauaaacugcuaagucuggcuaguacugcuucaucucagaaguuccagucacauauguggagucagauguugguuuccacaucuggguuuuugaaauccauuucaaaugucucuggcaaagauauucagccguuaauaaagcaguggguguauccuuuucaauagcaguucaacagaguggggaagggaauaagguaugugugcaaggggaagauggaagaagagagguuugagggggacucaaggaaguaugaacuguuuauauuucuaaacaaugguagaaauaaugaugaacugugaauuguuucaucuaagaugccuacuagacauuaaggugcacacacauguauguuuauauuuguaaaguuuggcauauuuuaaaguacuuucuagugaguaaagaauaugugaguaaaaaaauugguuugaugauaggauagguaaguaaucuaccagacagaccuguaggauuacuugugaggugugguaguuuagugacuuguggaugugauuagggguuggcgcaauuugagugguaucuuggaauuuugcaguuuuugcauuuuucacuuuaaaacacuauuaauaacuuuguauagugguucugcuucuuucaaaacacaaauuugucaguguuucagaaauuuuauuuaaaucugggaaagcauuuuucacaaguacuuugaauacuuugccaccugguuuacuguagcguaugcucucaaacuuugaacuggugggaaugcacuugaaaauuauuaauaccaugauggauaacuuacuuuguuuaguacauauucguuucaguauguaaacuuuccuuuacaauucuucagagaucagaguggagugguaaaauuuuauggaaguuuugcauuuaauagaaaacgaaaugucuuggaacuggaaauaaaacaggacuauacaucuccuggaacucagaaauacgugguaagucuuuuuccaaaaucgccuuuguacugcuaucuccucaguuucaauagaagagggacuuagggauggguuacuacuuagaaauuaaugagauuuuguuugaaguggauaaauugagaaaacauugacuuugucaaagaagggaagaggaaguacagagauuucuggggacucagaaucuuccaguugcccucuuuggcaccaauugccuaucuaggucuccagauacucauuuuguguaauauuuuauaucuugauuuauauuucucuguacacauaagcauacauauugguauuuuuuaaaucacaucucugaacaguacguuuuuuuuuuaaaagggaccacuuaaagugacagugcaggaguuagauggauccuucaaucauacacugcaaauugaagaaaacagccuuaaacaugauauacccugccauuccaaaaguagaagguaggcauuacauaauaacuauaaauugaaaguuaaacuacaaaucucacagacuaaaaugccaaaauaaaaauucucuuguauaccuaauuuuuuuuaaauuauacuuuaaguugugggauacaugugcagaacaugcagguuuguuacauagguguacacgugccauggugguuugcugcacccaucaaccugucaucuacauuagguauuucuccuaaugcucuccuuccccuagccccccaccuccugacaggccccggugugugauguuccccucccugugucuguguguucucauuguucaacucccacuuaugagugagaacaugcaguguuugguuuucuguuccuguguucguuugcugagaaugaugguuuccagcuucguccaugucccugcaaaggacaugaacucauucuuuuuuauggcugcauaguguucuaugguguauaugugccacauuuucuuuauccaguuuaucauugaugggcauuuggguugguuccaagucuuggcuauugugaacagugcugcaauaaacauacgugugcauaugucuuuauaggagaaugauuuauaauccuuuggguaauacccaguaaugggauuucugggucaaauaguauuucugguucuagauccuugaggaauugccacacugucuuccacaaugguugaacuaauuuacacuuccaccaacaguguaaaagcauuccuauuucuccacauccucuccagcauguguuguuuccuaacuuuuuaaugauugcuguucuaacuggcgugagaugguaucucauugugguuuugauuugcauuucucuaaugaccagugaugaugagcuuuuuuucauguguuuguugccgcauaaaugucuucuuuugagaagugucuguucauaucuuuaacccacuuuuugaugggguuggguuuuuuuuuguuuguuuguuuuuguuuuuguuuuuuauuuuauuauuauuauacuuuaaguuuuaggguacaugugcacaaugugcggguuaguuacauauguauauaugugccaugcuggugugcugcacccauuaacacgucauuuagcauuagguauaucuccuaaagcuaucccuccccugggguugguuuuucucuuguaacuuuaaguuccuuguagauucuggauaucagcccuuugucaguuggauagauugcaaaaauuuuuccaaaucuguagguugccuguucacucugaugguagcuucuuuaacugugcagaaacucuuuaguuucauuagaucccauuugucaauuuugacuuuuguugccaaugcuuuugguguuuaguccuaaagucuuugcccaugccucuguccugaaugguauugccuagguuuucuucuaggguuuuugugguuuuagguguaccuaauuuuuuuagacagucuugcucugucacccagucuggagugcaguggcgcgaucucagcucauugcaaccuccgccucccgguucaagcaauucuccugugucagccuucugaguagcagggauuacaggugccugccaccacgccccgcuacuuuuuguauuuuuaguagagacaggguuucaccauguuagccaggcuggucuugaacuccugaccucagaugaucugcccaccucggccccccaaaaugcugggauuacaggcgugagcuaccaugcccggccuauguauaccuaauuuuuuagguagagaacauguuaucagguaucuuuuuuuccucauuuuacuuccaguuaguauuaccaaacauucuuuguuugcuugccuucuugaugacauuuuuauaagaauuuuuaacauuuaguuuuaagaauccucauuuuguuugaagguagaggccgaggagcuagaaugaaaguuuuaguuuuugguacuagaaaaaaauucaagacaaauagguucauucuuguuagucuuguuggauuaauaccuagaggaaauauuagaaaaauggugauugaagggaaagaacugaauaugucaugaaaagccucuacaucuugcuuacuaugucuuuuuuucuuuuuucucuauaucagcaugccccuucagaacauucuugauguauuucaaaggcaaauugccacuuuucuuuaauauauucuucauuuaccccuuauuuaacacaacaauuaguauguauucugaacagugagagaugagaacauaucugugcuuugcuggagaaauacgaacuuucaggaacagaaguuguauuauacucaugacuguguuuaguucacucagauagaugagagugucuguugacuuugaagucuuuuaaggaacuugauucugaaaucuucuuauagucauucuuacucugagaaaaugcuuucuuaaaucagagugagauucuuauuucuuuuuguccuauccaccuuggaaauugguaacauuugauugcuauucucagguuuuuuucucuguaauaacagaaugucauuuggaguauucuuugguaugaggaacacaggaaaaguuuucucuguuccuguuuuuauuugcccuuccccaguuaacauaaaaacuguugcuuuuguuuuugcuuaucuugaaccuugugcguauuaauugguucuacauauugaucaauacucuuaagauauuuuauuagcuaauucauauaggacagaaccuugcauauaugcagcugacagcucagaauuauucguaucccauuucaaggcugauccuuuuucuguuuaagaguuuucuuuauugauauauccccuuuucuauacaaaauugcagcuaucaguucuuggaauauauguuuuagguugacauuuuauuauauauucaugcuucuuguuaacauuugaucaggaaaauaauuugauguuuacuucauucccaccagcuuuaaaauaaagagacuuuguucuauuuaaauuuuauuacauuugauagccauuuuuccuaaggauagcuuucaauguugugugaaauacuuuauuugaauuuuagcugcuguuaauguccauucagaauuagaaaucucacaauuuuccaaccuacuuuuucuuaaauguaggaauaaaaagaaaaaaaucccacugaugaauggagaagaaguugauauggaucuuucugcaauggaguaaguuaguuaacuuaaauauaagguuauaauacuuucugcauucucaucugucuacuuuguuaugcguacguaaaaguguauaacuguccuccaaaugagugcuuuaacauuauuuuaauuuaauagaaacccuauguuaaaacaguuuauguaaaaucauaacuaaucagagauaaaaaguaagucugccagggccuaggugaaauuaagaggaaaugcauuaugguugaggggugagcacaacuuugacuaggcagcuuccuuauucucucuuuguggccucuagagcagugcucagacuauaaugugcaugugaaucaguuggggaccuucccaaaaugcaguuucugauccaguacuacacuagugaggccugauaguuugcauuucucaugagcucccaggugauauugauucuuuguccuuagaacaaaggucuugggugccuuaagucucccuaugcuugcaaaacaauuuaaaaaccacuguucuaaacuuuaugugguaauauuuauugauugacaguguuuuauuuuuaaauaugauacagcucaaacuuucuaauuuugcccauucuguaccuguauauuuuuuauaaaaccucuguaauuauuuacuaacuugauugccagauuaucacugcuguuuauauacagauuauguuuguuugcccuucaaaaucaguguuaauuuuuuuuugagacagagucuugcuugguugcccaggcuggagugcaguggcaccaucucggcucacugcaugccuggcugcaugccaccaugccuggcuaauuuuuguauuguuaguagagaugggguuucgccuuguuggccaggcuggucuugaaccccugaccucaagugauccacccgccucaaccuccgaaagugcugggguuacagacaugagccauugcaccuggcugagaucagugcuaauuuugauuuuuccauagcaaguacccugccuguaguaaguacacaauaauauuugcugaauuugaauuaauauuacaggugguguucuuuugaugaaggugucgacauagacuagauuuuuuaaacuguguuuguuacuuugagaaauacaugaaaauaaauuugugauauaccuccaaauuaugauuucagaacuugcuguuugaaaaaggcgaucgugagucuaguauuuuuaaaaagucuuaagucagcuaaacaaauuaagaaauucaucucauucuuuuuuugccucauauaaucacaaaucaaaaucaccaaaauaauuucagaugggaaaugagagauucaguguccuuuguaaaagacaauuaauauuuucuuauuuuugaguaucuuuuuagcaagauugauauagaucagacauugugagaaaguugacauauguuaaacauaaugagaaauuugucagugcaguuuaaaaaaaugaauacaguaaaacuccaggcagucuugaauacuacaucuaaaaggaaaccugguaaauaaaugcuuuguauuuauuuucuaaauauauagaugauaaguuuaaaaauuaaauuaaaaagaaaauuguauuuucuugcagugcugauuccccuuugcuguggauaaggauagacccagauaugucaguauugaggaagguagaauuugagcaagcugauuuuauguggcaguaucagcuccgcuaugagagagauguuguugcacagcaggaauccauuuuggcuuuggaaaaauucccuacuccagcaucucggcuugcacucacugauauauuagaacaagagcaguguuucuacagaguaagaaugucagcuugcuucugucuugcaaaggugagauuauauacagcauaaaggaaaugacuauuguauauauuuuuuguaucucugaaaaugaauuaaaauucaccuagucuuuaaauuuacuugguagcugauucuuugaaagcuuuugccaaagugcuuuuaaauuaauaggacuguuuugaaagaaacauguuuugaucugaaaauagauaugcagaauaauuuuauaauugucaaaaugaaaaguuagauuuuaaaaaucaaagagaauuuucaccauuuuguugaauugccaaccacauuuuuaaagcgaagaauauauuuggugagcaauuccuugguuugagugauguuuuacauuguaguacaugaaaucucugugugugugugugugugugucuguggguguguguauuuuguuuuuuuaaauaaagacaagaucucacaauguugcccaggcuggucucgaacccuugagccugagugauacuccugccucagcccccaacacagcugggauuacaggcacgugccaccaugcuccacugugcuugauugauugauuaaucuuaauuaucccacuguaauaauuauucacguugauuugaguuuauaaauugguauuagugauaaguaacuuagaaugguagacuauaauauucuagaaaaguuaauuaagaaaaccaaauauguuuuuuagaugcaaauuaucugaagguagaacaaaugaaaaucagaaaaaugcagacaaaacuuuguccagaaauaauguuuuccagguauuuuuuaaaaacuugauaauagguucauuuuccauuuagugacucuugccuuccucacuguuaaauccauauguccuauauuucaacaaguuaauaaugguuuugauuuauuuuuaaugauaauaagugaguaguugaauuccuauguucucagauauaugagaaagcagugauuuuccuugauaaaaccaucugcagaagauauaauuucaauguuucuauaaagaucuuugugaucccuguaugcuaaaaucuuagcaggucuauaaaauuguagaauauguuguuuaaucauaauuucauuuuuuggggcaugauuuuuauauacccuaaaaauaucaauagcaagacauaggguaaagcaagauaugcuuuuguaaagcaugcuuacagccuuaaauaguagcacuguauuuggcuucugguucaguuaggguagauugaaaaaccuuauuuaaaauucaugaugauguuucugucucauaagguuaaaauauuagaauuauaucugucuaaacgaauaaagacagacuauucaaaauauaagucuuuugcauacauauuuuucuaaaacuuaauacugccauuuagaaauuaacuuguagaaaauaauuauaaauacauguaagaauuuuuucggccgagugcaguggcucacgccuguaauccuaacacuuugggaguccgaggcaggcggaucacuugaggucaauaguucaagaccaaccuggccuacauggugaaaccccaucucuaccaaaaauacaaaaauuagccaggugugguugucugcaccuguaguuccagcuacucaggaggcugaggcaggagaaucucuggagcccgggaggcagagguugcagugagccaugaucgcaccauagccugagcgauagaacgagacuccaucuccaaaaaaaaaaaagaggaaaaauaauuuuuuuuuuuggagagagucugucacccaggguggagugcgauggugccaucuuggcucacugcaaccucccccuccccguccugagucaagcaguucucccacaucagccucccaaguagcugggauuacaggcacccgccaucaugcccggcuaauuuauuuuguauuuuuguauagaugggguuucaccauguuggccaggcuggucuugaacuccugaccucaggugauucacccgccucggcuucccaaagugcugggauuacaggugugagccaccaugccuggcuggaaaaagaacuuuuuugcagggugaguuuguauaauuucuuggaaauggugauaaaaugcuaaauuguuauaaauuucugagaagugaaguuguugaaaacccaauccaguuguaguauugauaacuuuuaagaagcuguuuuauuuuaaaguauguuugcauugguaauggaaauuacuuuguuuucuaauuauuugcagauugcaaauucaauggugagcacauggacaggaccaccagccaugaagucacucuucacuaggauguuuuguuguaaaaguuguccaaacauugugaaaacaaacaacuuuaugagcuuucaaagcuauuuucuacagaagguacaguuuacuuucuaauuuucucaugguuuuuauauauuucaguuuaaguuggagacuguucaaauaauagauguguuuacuuucuuugccuccauucuuuuuuuuuuuuuuuuuugagacagagucucacucugucgcccaggcuggaaugcaguggcgcaagcuccgcucacugcaagcuccgccucccggguucacgccauucuccugccucagccucccgaguagcugggacuacaggcgcucaccaccaugccuggcuaauuuuuuguauuuuuaguagagaugggguuucaccguguuagccaggaugguuuucaucuccugacccugugauccgcccaccucggccucccaaagugcugagauuacaggugugagccaccgcgcccggccucuuuuuuuacuuuuaaacauuuuuccaaacuuugauuaagugauuauugauuuugugaucugugugcaaguaacucauuggccacauuaauauuaaaguguccagaaauguuuaauuugccuuuuugguugguuaccugggggauggagaagugaguaagcccuucgauuggcaguccuagaauguggacagcacaucugagucagagacagcacagcauagagcucuaguuuuagucccaguccacuacucacuagcaguuugcacaugcauaaguuucuuaaccuucugcaccucaguuuaaaauuuaucuuuuuuggaauuaagaucaaguauguaaaguguuuuaugcuaugcuuauauuaaguuuucuauaaguggaauuuuuagaaaguggugguuagagucauuguuuuaggaaaggauaugggaaugacaggauggucagcauuugagcuauuuggauaucauacauagagguuuuuuuuuaguaauuucauaaugaaggcagagaucagauuaacuagauugaacuagaaaggaggagugaaguugaaguagagagaacuaaugaagccuauucuuucaagauuuuagucaaagauauaagaacggauacuauguugaggaugaagcaagguugagaaaaggacuucuuggguuuguuuuguacaggggaagaacaaacuugaggcauguaugacacagggaaaagagccagugaagaggcagagauggaauagucaggugggagaaaguaaauagagacggcugagcaaguucuggaaguguuagaggguggggcacauuaaggaaguaaauuuuagaaaacaacauuccuuuuuuugaggcagguggaauguagauuaaaaacaagugaaaagauagauguugaggggaauguuaggcaaguugaaauuuauuuacgauggaaaagaaguagguugcacagcagcacuggggugccuuuugagaguggaagccagaauguauuuauaguaaaucuaaucaggacagauucaggaugauccaaguuuugggaaagguaauaauggugugaucaaagaagucuguggcauccuguuauuuuguuuuuaagaacugcucuguauuaccauuucacgaauuuaugguauagaagcaaguuaauuucuguguccaccugauauaucugucucaugaugccacugugcuuucauguagcuuaggucaguguuucaaauuggaguuaugaaccauuagugaagggaucaugaaaucaguguaguuuuuauuucuauuuuuauuuuuuuuuuaaauaaaacagaauagguaguauucaauauaaggcauuugggguucacuuuuaaauuuguauacguugcaucugaagugugugugugugugugugugugugugugugucuuagguuguguuacaaaauguauuuuuuccuguuagcuacugucaaaaaaauuggaaagucagugcuuuuauaccaauucaccuuucugauaauacuucuaguggacaggagagagagagagauuggugccuaaaugaaacuugagucucaaagggcagaaaaggcauaagacagguauuucuacggaaaagcgccuuucccucaguuguuccuauaguacuaaaacugacuguuguugcucuuguuaucucugcuucuucaagcaagaaaaugagccauuuuccuuucugaccuccauuuuagaggauauaguuauuuugaguaagaagaggggcuaguccauaucucgccaugugcuaaagacugagaugucuaugcaucuguaguccugccuagcauuuaauuagcuuuguuuuacugauagaguuaaccaguguguguaagucauguuucuacauucuuaaaaauguugccuaugaaaauuuggaaagagaaaaauuaggcugcauuucagauaauuuaccauuuuguccuuagguugaggauuggguguucaugaggauuagguguugggacaaucaauuuguucuaagacugaagguuggcuccaccuacuuauaucguuuauugcugaaaaugauugugaggaaaugaggcuccuacucaauaggcaacgagcuaaaggcaccuagcacagaagguaguagagcuuaggaguugaauaaugguccaucuaaugcuaaaaucuguaccuuuuccacuguaucacacagaaguaauucuaaaaucugugccuuuuccacuguaucacauagaagugaauuuauauaauuuacaucacauauauuuccuccagcaaaugaaggccaaggcacauagccuacagagugaugugcagucauggaacucuucccuuaguuuccugcccagcucuucucuuauguuagaaugcuuugagauauguugucagugggagggguugggguguggagguguuaggcuccauccagauaucuaugucagcccaagaguaacccuuuucuauuuauaguucaaugaauuguaguaacaaaaaguuagguucugugcuuuuaaaaguucuuuuuuuucuuuuguagacuaugccaguugcaauggcuuuauuaagagauguucauaaucuuuguccuaaagaagucuuaacauuuauuuuagacuuaaucaaguacaaugacaacaggaaaaauaaggugagguacuuuuauuuuuaaaucuucuacaacaguugucuuagauaauuuucuuaaugaauauuacagaacuacccaaugguauuuuguuucuaaauaaauauuuagucuauaaaaaucaucguacuugaugacuguccacaguccuugacauuucuagagauagaggcauguaaacacgauuuauuagaauaaccaguggauaaaaaacaauauuaguuuuuaaauguucuucaaaccucuuguaguguggagagaguaguacaucagauuugggguagccaguuaaaacuugauaaaaccugacagcacaauuuuauuuacauugauuuauuuuuuguucaccuaaugauaccuagaaaagaguucucgauugggauuaacuuguuccuugauucauuugaccuuuuuucuuuucuuuaccauugugucuuuauucauuuauuuagcaaauagcaauuggauguccugcuucaaaaauuauuuuaucuuacuuguuaucauuccaacaaucagcaaauguuuuuaagaguauaugcugugcuagagaguguccccuguuagcuggaaugaaaagaugguugaugucuuaaugaacuuuauuuauucauuaaaaaaacugcucuauauuagucugauuuuacaccaucaaggacacaaccugauagggaaaucagacaaguaagcaaucagcagucacaugugauaauugauacaauggaaauauauaugauucccuaggggaaugcaaaguguagucaucucucaauauccaugggggauugguuccaggacccccuuuuuguauaccaaaaucuauaaauguugaaguucuuuauauaaauguuauauaauauuugcauauaaccuauucacauucucucauauacuuuuaaaucaucucuagauuacuuauacuaccuaauacaauguaaaugccauauauaucauuguuaauacuauacuguuuagaaagaaugacaaggaaaaaaguccauacauguucaguacagacacaaccuuccuuuuucuuccccaaauaaauuuugaucugagguugguggaauucaaagaugcagaauccauggauauggaacccacauauauagagagagggucagcuauagugucuacuuugaaggauguagggagagacucagggaaguuuuguauagaaguagugacccucaaacugagucauaaagaugaguaggauuuucccaaaguaugaguaggacccauguaggaagauuguucuagacagaaggaacagcacauacaaagacacaaguaaguguuaggauaaaucaaauugaugaaacuuuuuuuugagacagagucucacucagucgcccaggcuggagugcaguggcgcgaucucggcucacugcaagcuccaucucccugguuuacgccauucuccuaccucagccucccgaauagcugggacuacagguacccgccacuacgcccggcuaauuuuuuuuuuuuuguauuuuuaguagagacgggguuucacugugguagccaggaugguuucgaucuccugaccuugugauccgcccgucucggccuuucaaagugcugggaguacaggcaugagccaccgugcccggccaaauugaugaaacuuuuaauaaaacguuacaacaguaaaaaaaaaaaaaaaaagcacaggcauguuuauuaaaagaugacuuuuuaaugaaaaucaagaaaacaacauugccucuuuaguuuaacauucaaauaauuuaagcguaaagacuccuuuaaaaauuaacauuguaaaagaauacauuaauucauuuuuucuugacguuguuuaauacuguugacuucaucucugauaggcucuaugaucauuggucucucccagaauaaggcauauuagggacauaggaguccaagguuaucuuuuaguugccuuuguuaugauaguccaacauuuuuuaaugaguaguaagcucgucuaugcauaccaauuuuaggaagcaugugcuuuuuauucuuucauuauuguuuugcucaaauggcucagauuuucauguaauuuaauacuaaauuagaauaauaaaacuaauaacugguaacuaaaacuaguaacacuaaauuaacauaagucaucuaguguuuuauuucacucaauagauagguggcuaaguaguucccagggaaauuuuaucugauggaugguauaacuggcuauuuauuuuucccauuauuucccuuaaaaguuguuaauuucaggaccacguuaaaguuuuuucagcaaucaacguuuauuuuuuauuuauuuauuuauuauucuuuuuugagacggaaucucgcucugucacccagacuggaguacgcuggcgugaucucggugcacugcaaccuccaccucccagguucaagcgauucuccugccucagccucccaaguaucugggacuauaggcacauacccccacgcccagcuaauuguuguacuuuuaguagagacgagguuucaccauguuggccaggcuggucucgaacuccugaccucaagugauucgccugccucggccucucaaagugcuaggauuacaggcgugagccaccaugcccagcuguagucaaccuuuaaauuguguuggccugcuuguuggaagcccucaaauguacccaaaacacauaauuacuauuauuuuuugaauuacucucugaugcuugauuuggggauuugauuuucaauuuuuuuuuuuuuuuuuuugagauggaaucuugcuuuguugccaggcuggagugcaguggcacaauuccagcucacugcaaccucugccucccggguuuaagcgauucuccugccucggccuccugaguagcugagauuacaggcacgagcugccacaccuggcuaauuuuuguauuuuuuuaguagagacaggguuucaccauguugggcaggauggucucguucucuugaccuugugauccgcccuccuuggccucccaaagugcugauauuacaggugugagccaccacgccuggccuccaauuuuuuuuaauauuuaauaaaguccuuuuuuuuugucauguuaggcuuuguuagagguuuuuuguuuguuuguuuuuaccauguauguugcauuaaaauagcucugaggauccuacuaaaauugaaauuuuuuaaugagcuauuuauucauaugaugcuggaguuucuuucuaauaacaccagguucaaaucucauggaacacuauaacuacaagaagccaaauguguaauuuaguucagcuauuugcuuuguaacaagacuaagagcauauaaggggaaguuauuaucucugcugcuuuuaaagaaauccaagauugggauuuuaggaccaguuuuacuaaucaggucaguaugugguuuuguaaauaaauuuucuccguguaaaucagggauguccaaucuuuuggcuucccugguccacauuggaagagggcuuauguugggccacacguaaaauacgcuaacacuaacgauagcugaugagcuaaaaaaaaaaaaaaauugcaaaaaaaaaucacaauauuuuaaggaaguuuaugaauuuguuuaugaacauucauagcuguucugggcuguguugaauaagcuugguguagauagucuuuguguguaaauagccuauaugucauaguaaauauauaaaauacuggaaaauaguagacaccuuuuaguuaucuuucucuaagucagacacuuaaaguucauuuauuuaauagacauuaauacuagguuuugaugauacugugaugaguaacuuaugaucuuuccaggugcuuaaucuguagugaaagaaacauacaaaagaucaauuuuuuuuuuuuugagauggagucucgcucugucccccaggcuagggugcaguggcgccaucuuggcucacugcaagcuccgccugccagguucacgccauucuucugccucagccucccgaguagcugggauuacaggcacccgccaccacacccggcuaauuuuuuguauuuuuaguagagacaggguuucaccauguuagccaggauggucucgaucuccugaccucgugauccacccgccuuggccucccaaagugcugggauuagaggcgugagccaucgcgccuggccaagaacaauauuuuuaauaagacaauuauuaugacauuagguuaauuaaccugcuaaggaagugcuuggaaggauuaacccaaauuaaggauggggaagccagaaaaggcuuccugggaaagguugaaucuagagagagcuguaaguuguugaggugaaagaacaggagaggaggaauauguggucaauuauagaaucuauauauagagagggagcuuauugaauuugagagguuucaagaucauuauuuuagaaguuauuuuuauaacuuuuggcauauuucuugaaaauggauccaucuuccucauauuuuuacuuaccucauaagaugugaguaucuuaacuccuacuauaaauccaguuucuauuauuguauaaauuauguaaguacaaagaggauauagauauaaauuuaacccucuguaagucuaagaaaucugagagaggaugguggggaguaagaauggggagaaaggguugggaaaauaauuguagccuugaagaaaugagggauugauuuagaauuuagaaaguuauggaaaguauaucaacuuuuaacuuggaacuuaucagcaaacugagcucuuaagacuucuuuguauuuuuuuuuacauaaauagaaaugguaguguauuauaagaauagcuuuagcacaaugcuauuuggaaaagaauaaucuacuuauuagguaauugugcuguuuaauuuuguagcuaaauuuugcuauuauuucuucuccuaucuuuuuaaaaaaggaaaauuuuaaagaaagguaaccauagguuuuuuuuuuuuuugagaaaauccaagcuugcuuuuucaauaaugaugauguugauucugauguucacuuauugagugcuuaguacauucuugguaccauaagugcuuuuccugcauuuucuuauuuuaaguaauauuauuauuguuauuauuauuauuauuauuauuugagauggagucugucucuuguuaaccagacuggagugcaguggcaugaucucggcucacugcaaccuccaccuccuggguucaagugauucuccugccucagccuccugaguaauugggauuauaggugucugccaccacgcccagcuaauuuuuguauuuuuaguagagacgggguuucaccauguuggccaggcuggucucgaacuccugaccucaggugaucugcccaccuuggccucccaaagugcugggauuacaagcgugagccaccacacccggccuuauuuuaauuaauauuauuauuuuauauuguguaucuuuuaaaaauuuauuuuagauucaagggguggguaggucugcggguuuuuacauugauauguuaccuaacaguuggguuuggacuucuaguguacccauuacccgaguaguaaccguuguacccaauagguaauuuuucaacccucgcuucccuccuagccuccgcucuuuuggaauucccaguuucuauuauuuccuucuuuauguccauguguucccauuguuuaguucccacuuacaagugagaggauaugguauuugucuguuucuaaguuauuucacuuaggauaauggcuuccaacugcagucauguugcugcacaagacuauuuuguucuuuuuugugacuacauuuucuuuguucaauccaaaguagguuguuaauuugagaucucucuuuuugauguaggcaugcaaugcaauaaacuuuacucuuagcauugcuuuugcuguauccaagagguuuugguauguuguaucucuauuuucauucuuuuuuuuauuugucuugauuuuauugcuuagccaaaagucauucaggaucaaguuguucaguuuccauuugcucauguaguuuugagaguuccucuugauauugauuuguaauuuuauuccacuguggucugagaagauacuugauauuuuugauuuuuuuuaauuuauugagauuuugcauuuuagccaagcauguggucaguuugggggaauguuccauguucagaugagaaaaacguauauucugcaguuguggguagaaugaucuguaaaugucuguuagguccauuuggucuagauucuaguuuaaguccagaguuucuuuguugacuuucugccucaaugaccuaucuaguguuuucagugggguguugaaguccaccacuauuauugcauugcugucaaucucuucuuagguguagguguuguuuuaugaaucugggugcuccaguguuggguguguauaaaauuaauucuugguuuuguuuuaaacuucgucaguauauaaugccuuucauuuugcuucuuucuuucuuuacuauugucaguuuaaagucuauuuuaucugauguaagaauggcuacucguggccgggcacaguggcuuauuccuguaaucccagcacuuucggaggucgaggagggcagauugcuugaagucaggaguacaagaucagccuggccaacauggugaaaccucgucucuacugaaaauacaaaaauuagccagguguggucgcacaugcuuguaaucccagcuacucaggaggcugaggcaggagagucacuugaaccuaggacggggagguugcagugagccgagguugcaccacagcacuccauccugggcaacagagcgagaaccugucucaaaaaaguaaaaaagaauggcuacuccugcuugcuuuuauuuuucauuugcguaguauaucuuuuuccaucccuuuacuuugagucuguaggugucuuuugucauugagggggucucuucuaggcaauagaugguagugucuuguuuuuuauccaacaugccauucuauaucuuuuuuuuuaagagacggagucucgcucugucgcccaggcuggagugcaguggcgugaucucagcucacugcaaccuccaccucccagguucaagcaguucuucugccucagccuccuguguagcugggacuacaggugcaugccaccaggcccagcuaauuuuuuguauuuuaguagagacagguuuucaccauguugcccaggcuagucucgaacuccugaguucaggcaguccgcccucagucucccaaagugguaggauuacaggcgugagccacugcaccuggccacucuauauauuuuaaguggagcauuuaugccauuucuguucaagguuaauauugaaaugugagguuuucuuccugucauaguguuguggguaguugccuuggggccuuaauuguguaauuauaggaucugugagcuuucugcuugcaugugcuuuuauguuggugagugucauccuuucauuucuauauuuagaacuccuuugagcauuuauuauaggucuguucuaguggugaugaauuccccuugauuugcuugucugggaaauacuuuauuuuuccuucauuuaugaagcuugguuuggcaggauauaaaauucuuggcuggcaauuuuugucuuuaaagagaugaaaaauagacccccaaucucuuccugcuuguaagguuucugcugagaagucugaugggauuuccuuuauaggugauuugacacuucuuucuagcugcuuuuaagauuuguucuuuuauguuggccuuggguggucuggccacuauaugcuuuugugagguuugucuuguaucauuaucucccaguuguuaccuggauuucuugucuggauaucuaucacuguaaugagauuggggaaauuuuccugaauuauuuccucaaauaugcuuucuaaacuuccuacuuuuuuuuuucugccccaggaaugccuauaaguuacagguuuggucacuuuauguauuccauauuucuugaagacuuuguucauuuaaaaaaaaaaaaauugggggcugcgugcaguggcuuacaccgguaaucccagcacuuugggaggcugagaugggcggaucaugaggucaggagauggagaccauccugucuaacauggugauaccccgucucuacuaaaaauacaaaaaauuagccgggcaugguggcacgugccuguagucccagcuacuuggggggcugagacaggauaaucgcuugaacccgggaggcggagguugcagugagccgagaucgcgccacuucacuccagccuggggacaagagcgagacucugucuaaaaaaaaaaaaaacaguucugacuggguuaauucgaaagaccagucuucaagcucugaaauucuuucuucugcuuggucuaguguguuguuaaagcuugcaccuguguuuugaagugcuuuaagugaauuuuucauuucuggaaguucuguuuguugcucuucuaaaaauacaucuaucuggucuuucaucuccugaauuguuuuucugguuucuuuguauugcuuuucaacuuucucuugugucucuuugggcuuccuuucaauccauauuuugaauucuucauccaucauuucaaaguuuucauuuaggaugaaaugaaaucauuaggauccacugauaagagagcuugugugucacaguauucucuuucuucguguugcuggaguugugcucauuccuucucaucuguagcuguugucacuucugauuuuugaauuuacuuucguuuggaugggacucuuccucuccucccaccuugagggugcaacuauacaguauauuggguaggguauuuuuuuggcuguacuucuauagcccuguguauuucuguuauuaggguuuguguuggguaaugcaguucagccuacaggccaguagguggugcuuccagguaagagccagcugugguaaaagcagauggguauguacuugaucuuuguuuacugugugguacucuuuuuuguuucagcccugacggggguggcugguggagcuccuagugaaaugcacugaagucucugcaggggggcugcacuagcuccaagucuuagacaggcagaaaugugaucucuuucccugucacacuccuguacuggggcucauaacucuccaugcagaugcacacugucgucugucuccaggccauagugugauugagaaccgcagaagacaccucuccccuggcucuccacuggagugguuucacgcuggaacuccucacucagcccaauacagacagcucuguggcuuuccuguucuccaaugugguaaugcugcugauugaagcagagagggagaggggcuccaucuuuuggcacaugcaggugggugucagcuguggugcugucagcuggcugggucagccuaagcucagacccgauggaccuaauagacauuuacagauuauucuacccaacaacugcagaauauguauuucucaucugcacguggaacauucccccaaauugaccauaugcuuggccagaaagcaagucucaauacauucaaaaaaauugaaaucauaucaaguaucuucucagaccacaguggaauaaaauuagaaaucaauaccaagaggaaaaaauaaggaguuuuucaauagguagaggaaggagaauggugcccugggguuaagaacacauuaacaaaaguacaagaggcaugaaaaugcaguguguaaaggaagagaaaaguuaaugaugcaccuucaugguaaagggguacaaagccggagguaguggacuggacgaggcaaaccuccaagcccagagccuguaaauggccugcucgaugguguaugggaagccucaggcaguaacagcugaguugguggcagaauacgcagguggugggaaccccaggguugaucacagaccugucagcaugggcucucagaagggcuccagcuggcagcugaaacgguugggugggagcaggguggccgugcugcuguucuuucgcugaggaaggcggacucccucagcuggagcaagggaggcuggcagcugugggaugcguggcccgauugcacuucccuuuuauaggaguggagguguauuucgcuguuggggacaugcaaacgugcucagccucccccucucucccuggccucgagguggcaguguggcaucugugguggccuguggugacaaaaacugcuguggcaggagccaaagggcaggucccuggcuucuuggggcugggcucucacuacacugggccacagccaaaauacacaugcaguggcagggcggcugcacuguggacccagcgcugaagaagcagggaccuguucagcaaacaguagcugaagcagacuuucuucacauucugcugucugccugcugcucuguacuguggcugccguaucugucuuuggguugugugaaaaugccgggucugccugcuccuucccugguggggcaguagcagcuggcaccugacugcucaggggccaaagccugugggauuccacguagacuccagcagcgucucuacagucuucgggcagcucacuguauuagacuggaagccugaggggccaagaggugucggcucccugcugcuaggauuguaaaaguucuuaguaggaguguggaaccccagggaucucucacucacuuauccuuuccccacauccgggagcuucuuccagcuccacacuugcccugguucagcgggcugcugggcuuugcucuccucugcuuuccaugauucccgucgcuucucugaugaauuacagcaugcccucuuaagaugauaauaguugaauuguucauauuuacuuguuacuuugauuccugucugugagagaggcacccacuagcuacuucuaaucaaccaucuugaaccggaaccucaguguuaauauauuaaucuauauuuuuauuucauuuuagauacucuuccuccacaaaguuauaucaaucacauuauaagaauugaugagauuggaagguaguccuguuuaucccccuauaguaaguggcugucaguucugugucauaugaauuaaauuuguggaggcuuacagaaucagaagauauaugcaggugugugcacauauguguauguguguaaaucagaaagcauguguaacacuuuuuuaaaugauuuugagagcgcuucuuuacccuauuuauauacuuuuccagaagagguuacuauauaccuacauauaucauguaucuuccaucagcaacuuuuuuuuguuauuuuuuugagagagagucuugcucuccugcccaggcuggaguacagcggugugaucucggcccacagcaaccucugccuccuggguucaagcaauucuccugccucaacuucccgaguagcugggauuacaggcauccaccaccaugcucagcuaauuuuuguaccacacucagcuaauuuuuguaccacacucagcuaauuuuuguauguuuaguggagacaggguuucacuguuuuggccaggcuugucucaaacuccugaccucaaguaauccacccaccucagccucccaaagugcugggauuacaggugugagccaccauaagucgucacugguaagcagaacuuccauagacuauccagccuuauucaugcuguagcuuuaugauguaaaauauucauacucuuucauguauaacagguuuucucaaucauggcaccucuaauauuucggguuggauaauucuuuguuguggggcuguccuguacacagcagcauguuuagcaguaucccuggcuucuacccauuaaaugcuuguagcaccccuuaccucaguuaugauauccagaaaucucucuagacauugccagaaagucugacgggcagaauuguguugagaaccacugauguguggggauaauauuaagaaauauagaaauaguuuauuacaauagauuccuaaaucgcuaaguagguuagcugagauaaaguuguaaaaaugaaucuauuugugaaguuaaauugaauguaauaucauaguuguaguguauaucaccaagcauaagacuugauucuuccuuucagcagcugugauaccuacaucgucuuuucuauuucagcauccuaguucaggccuuuauucuucccuggacuccugaaaaacgugugucaucuugagcaaauuacuuaaucucagugucuuaguuucuucaucuauuaagaaaaagcguguuaguaauaguaccucuaucucauaggguuuuuguggagauuacacaagauaauauauguaaggcacuuagaggaaucccgacaguuauguuaccuaucauuagcaguugcaacauuaucaucauuccuagcucaauaucccaauaccuuuccucuuaaaauauuuuuauaauuaaaccagaguaaucuuugugauggagcucaccugaauuucuuuccuccuuaaaaaaauucccuucuuaaaaaccuucaaagacuguccagugcuuauaaguaaguuuaugcauggcauucaaaaacauuuugaauguugguggucccaguccaccccuccagcuuuguaccccuuuaccgugaaguugcaucaguaacuuuuccuuuaacauacucauuuucaugccucuuguacuuuuguuaauguugucuccuuaacccaagggugccuuucuccuuccucuaccuauugaaaaacuccuuauuuuucuaagaucagcguauccuccugauaggaugcauuguuucauuuuguuuuguuuucuugacuccuggaacaauuugauuacuuuuccugucuucuuacucuuuuuucuguuuugcuugcaaauaaaauaguucuugucuugaagaagucaucuuaucucugugucuccagaacacuugacaaguacuagaugccuauauuuauauauucauuuaauugugucucugugucacagucacuuucucaaucauuaucuggcuacuauuuaggaaguauuuaauuuaucuccuuuaaucacaaagcccgcagaacuuauuacauuguauaauagcaaaaacacaacaguggagauaaauuagauuuaaauuuccucucaaccagauauuuuauuuccuuugagaacuguuauaccugaccuacugucuucuggauuuaaaauacguauuuuuuuaauaaaaaauuaaagacauuuugguaagauucuuuccuuccuagucugcugguuuauuuuggccuuaauuuuuaguguuccuuuuuuccccuacacuugaauuuucuuuacuugaagaaauuagaauuuaggaugguggcaaaucacauuauauucaaauggaagaggaagauguuuuauacauuaugucuuuuuuuuguggaguauuuauauaauuuaauuccuuuauacuucuuucuacuuuguauagugauuuuacucaucuuaaauucuuugaaaugugccuauuccugugguugaagguguuugucaacccuuguuugacaaaaguaagacacagaaauugagagucuaaaauuacacaggaaauguauucugggaauugugcuguaaggcccugcuacccauuugugugguaauguuuuuaguauuaccauguuacuuuacagcaugccauuaugcuugucaucauuuaugauuuuguguggcacacacugguauauuauuaaauuuuauacuucauuauuguuguggaaccacauaagacucacuguguuuucauuuugaaaagaaggcuaaucaguuuuuauaguuagguguuguaaauucaguaguuuuauaugacuuaguacuucagaauacuaaggauagcguaaaugcaaauaauaacuacaauagguaacacuaauaauaaguucuuguguguuccaugccuuaugccaaaacauagaugaucuaauauccccaccagaccgcugaaauaaauacuauauuuauguauuuuuauuuuauuuuauuuuauuuuuuuugagauggagucuggcucucucacccaggcuggagugcaguggcacaaucucggcucacugcaaccuccaccucccagauucaagcaguucugcuucagccgcccaaguaacugggauuauaggcgugugccaccacacccugcuaauuuuuguauuuuuaguagagacaggguuucaccauguuggucaggguggucucaaacuccugaccucaugaucugccagccuuggcuucccaaagugcugagauuacaggugugagccaccacgcccagccuauuauuauuauuuuuugaaacagucuugcucugucacccaggcuggaguacgguggugcaaucguggcucacuugagauggagucuugcucugucacccaggcuaaauagaguacaguggugcagucucggcucacuugagacggaguccugcucugucauccaggcuggaguacaguggugcaauuucggcucacugcaaccuccgucuccuggguucaagugagucucaugccucagccuuccgaguagcugggacuacaggcgccugccaccacaccuggcuaauuuuuguauuuuuaguagagaugggguuucaccauguuggccaggcuggucucgaacuccugaccuuaaguguucugccggccuuggccucccaaagugcugggauuacaggcgugagccaccacucccagccuuaaauacuauuauugucccaguuuucaugugagaagauugaggcuuauaaaaguuaagagauuuacccaaagucacaugauuguuuucuguggcuccaguaaacugaagcuauagaaauuaaaauuucaaucauuauaguggucugaaagcaaaacuuuauagugaauacuuuugggguauuuuuucuuugguguuguuuguuuguaugugccuugcuuuuuuuccugccccguauuugaacauaaaaauguuuagggacucugcauuaugugugucagugugagcuucugccuccacaauagaagucaauagcgggcagauagucuucuuccagucucuuggcaguuuguguuaucacaaaauauucucagcaugcugauagaauucauuugcuugcuccauguugaauuucccuggccacagcaucugauuugcugaguauaaaucaagccauauccaggucaccuuucaauaaauugcuucuaugagaauugacugccauguagauuaggauuuguuuuuuuuuuuaguggcuuccuucucuuuucuguuucucuggcuagaacuccuacauuaacccuccaguuucuuuaugcuuuccuccuauuuucuaucauuaguuuuccaucaguaaacuaauguauuguuauagugaaucucuuacuguuuucagagugaccacaugcaaaggguggaguugaauguuuaccagaggacuugcuuguguuuugggaaaauuuuuauuuuaucuaaaauguaauuauacaaauuuuauuuuguuaauuuugaucagaagaguuaauuuuguuaucuucacuuaauuuuucuuuggccuaguuuucagauaacuauuaucgugcagaaaugauugaugcccuggccaacucuguuacaccugcagucagugugaauaaugaaguuagaacuuuggauaacuuaaauccugaugugcgacucauucuugaagaaaucaccagauuuuugaauauggaaaaacuucuuccgaguuacaggcauaccaucacugucagguaugauuaaauuccuuacuuuaaaguuauauguucuuauaacuguaaaagaaauuuauuuuuguuauagaaaauugggaaauauaguaaaguaaaaugagaaaacuaaaauucuguaugauucuaccacccacagauaaauuauuaguauuuggagaauguccuucuaaauuuuuucucucuuuaacuacauaaauuuuuaauuacuugagauuauacuguauauguaguuuuguauucuguuuauaucauacuuucucaugucaucacaaauucuucauaagcauugcuuugaugucugcauauucuuuuauuucguuggauuuuauauaaacauucucuauuguuagccuuuuuuuaagaugacuuuucacuuuuaccagcuuuauauggcuaucaugcaguucugccaauuuaagaguuugcuaaaaguugauucaaacauaaacaauuuuaacuuucuauauagugaacaaacuauauuacuaaaacauuuggagaaaauauuuauauuuuaugcuaaauacuucuuuuucuuaaaacuauuccuguaacaaguauaaugacacuugaaacuuugaguuuugggauuuguuuucuuuuuuuuuuuuuuugagaccaaguuucgcucuuguuccccaggcuggagugcaguggcgcaaucuuggcucaccacaaccuccaccuccuggguuccagugauucuccugccucagccuccugaauagcugggauuacaggcaugcaccaccaugccuggcuauuuuuguauuuucaguagagacgggguuucaccauguuagucagguaggucucgaacuccugaacucaggugauccaccugccuuggccucccaaagugcuggguuuauaguugugagccaccacacccagcuggaauuuguuuucuuuuaacagacuuuagauauuaauuuugaauuuuuaucauugcaaaaauuuauuauacuuauaugucacuuaacaacagggauauguucugagaaauuagucuuuaggcaauuuuguuguuuaugcaaaugucacagcauauauuuacacaaacuagaugguguagccugcuguauaccuaggcuuuaugguauagccuguugcucuguugcucuuaggcuauaaagcuguaaagcauguuacuauacugaauacuguggguaauugauaacacaaugguaaguacuuauauauuuaaacauauccaaacauaugaaagguaugguaaaaauacgguauaaaagauaauaaauguuaccccuguauaggacacuuaccauaagauaaauggagcuugcaggccuggaagcugcuguggguuuaucagugagugaguagugagugaaugugaagguauaggacauuauuauuguacacuacaguagacauaauaaacacuguggacuuagacuacacuaaacauauuaaaaauauuuuuucuuuagugauaaauuaauuuuagcuuacuggaccaccauuguauaugcaguucaucauugacuaagaugucuuuuauauggcuugugacucuauuacaaaauugaagguggauuaaaaucacaucaguuuuuaaauugauugccacaaaggauucucuaaugccuaggaaacaaacugauucauaauaccucagugaaaguaguuaacauacguauuuuuuucccuaguuguuugagagccauacggguacuucagaagaacggacaugugccaagugauccagcucuuuuuaaaucuuaugcugaauauggccacuuuguggacauuaggauagcagcuuuggaagcaguuguugauuauacuaaagguaauacuuuagaaauacgugcucauaucauuuuagaaagaacuauuuacuuuuuaaagccaguguuguugggguuuucguaauauguauaacacagauauuuuaauuuuaaauucuugacuuagugauuuagaaaucaucuuugauaaauguagaauucacauaagaguuaauaaaugagggaaaggaauaaaauuauagguaucuuuagccuuuccaagaagucaguuuucauccuguagcuuuaauuggacguuauuuuaggaaauagaauauuuuugagaaauuucuaagaaggauucaagaaaacaucucacaccuguauaaaaauuugugucugugaaaguagaggacuagacauaaacacaaacuucaggaggggaauuaggcaaggcaucaugaauauagaaaaaacauaaggccaaaaaagucgcuaagggaagaauacacauauuuuuuuuuaauuuaggggagaaagauacagagauggaaauguuaaaaagucgugaagaauagagcagguagaagacaagcuguaauccaagaaacaacagaauacucugggggggcguaaaugaagcagaccuacaguaguuucugaugaaauuuuaauuuuuaaggcuaagggaaaaugugugaguuucuaggacuaucagaaccagauuauggugcaaggcaaaagaauaguguggccucugaauucuuuagaauauguagauucaaaagacagugaacaaauggcuaugucauuuuuagggaaaauuaugacccaagauuuucugcuuugccaaaguuguugcucauguagccuuggagaauuaaagcugcaucucuuauguaacauucuuaaaaacauaacucccaaagauaauuuucagcugaccuggaugugagucaaaauaauaacucaagacuggugaaaaugugaaaugaaagaacuagugaugaauaauuaugccugucaaauacuuaagccuaaauauuuguuaaacugguuguaaaauguaaugcauauuucaaaaauaauuuuuaaaaaauaugaaaauagaagaaacauggaaauauaaucuaagucuaaaauuccagauucuagcacuaaaauaugagaggaguaaaaaacuuaaaaguaugcuaaacuuuuaucugacuguggaaggagaggaagggcugagagaaguucuucaguagauacugguucauuuuuaaguaggggaaaguauacuuacaucuuuguaauuuuugguaaauuucuguagaaauacuuguuuacagucagaaaauaaaggguaauaacagcauaauguguauauucuuauguguugacccaacuucgaaaaggacugucauuugugcuuccuuuuuauugaagguuaaaauauccuuuccuguuagaaauaauuauuuauaaaaacagugauuuuguuguuaaauguauuuuuuggcaugaaagaaaauguaauccuauaucucucuccauuucuguuuugacaaguuuugagauccaccaaauaugucauuguugccagucuucuuucccaagauguauggauaguuuuuaaugucucauaaauaugaguaagauuuuauaaguuaguacuaccuuaaaugaaauagaauacuaauauuaggauuuucaaaagaaugcuaaacuuuaauagauguaauuuaauugugacacuucacuuuuguccgugucuaaaugugaacuaugaauauaauuuaauugugacacuucgcuuuuguccaugucuaaaugugaacuaugacuucagacuucauguuuuguuaaacuaugaauuuaaauacugguacucaaguuagaaaauggaagaaaugaaaaguauugcaaauaaaauucugaagacacagcuuuucaaauuaugaaaguaaaacuuguuugaaaaggugaauggaaauagcuagucauuuuaugucaacuauauucauagcacuauuuuuguaacugccuuuuauauuaugcuugaaaaguaaaacuguucuuuagucuuaaauggaagaagccacuugggcaaaaacaguggacuauacuauauaauauaguugagauaccauugagugucaaaccucuccaucauuuaagcaucuaggaagacaauuguauuuaaacagauuuuguccaguuaaucaucuguaauuuaggguucuuaauuacaacuugcuuuauguuaugcuugccauugguuugaacuuuaguaaaaaaauacauuauugaugcaacuuuaugucuuggcucuaauauauagcuugauacuuauaaaaguuacaaaguggccauugcauaaaaauauaagagcuuaccuauaaccuucaacucugauugaaaacucagcuaaggcagaguccuaaauauuaaauguaaacucccugcuugucacucauuauucauuauuuaauuuguuauaauuaacaacaaauauauuuucuuuuauuuucaguggacagaaguuaugaagaacugcaauggcuacuuaauaugauucagaaugacccuguacccuauguaagguuaguuuaugugcuaugaugcuaugauauuuuguaaguccuauagugaacugaguaauuucagauuacacauaaaaugcuuguuuaugauuuuugaaaauaugggaauaucuuuugcauuuauucauguccuuuuuaaauuugauuuucaacauaaaaguuauuuguuuuuuuuuugagauggagucucacucuguggcccaggcuggagugcaguggcacgaucucggcucacugcaaccuccgccuccuggguucaagcgauucucuugcuucagccucucugguggcugggauuacaggcaugcgccaccacaccuggcuaauuuuugcauuuuuaguagagacggaguuuugccauguuggccaggcuggucucgaacuccuggccucaaguuauccacccccuugggcccuugggccucccaaagugcuaggauuauaggugugagccaccgcacucagcuaaaaaaaaaaaaaaaaaaauuauuagcagaccuuacuuggcauuuagaguaauuuaggugacuuggaaagcagccagacagaaacuucacuuuucuucaucaaacaaauuaaaaguauaacaacuuaaaaugcacuaaagaacaaacucacauuuuaaaauauguuauuuaccuauaauacugaucggcucuuagaaauagaguaugaggccugaaggagaggaauuguguuuauauauaaagaugaaaauauggauaugaaauauccauaaagauuuauauccccauuuauauuacauaucuguaaauugcauucuauaauuacauuucacuuuuauucuuauaauccuuccguagucuuauuuuacacagucuuaaauuucaaagcacaagaggauguuagaaucuacaucuuuuagguuuauagacauuaaauugcagccaaaagggguuaaauuacuuacacuacaaccuagcaguuucacuuuucucccaucucuuucucaauuacaaauccaauuuaaugucuuacuacugucaguuaaauguaaaaauuuccccaguucaccuucuuuaaaguuuugcugaccuccauaagaauuacaacccaauuucuuucuuccucacuuauauccaagcauugcaguuacucuuaguaauuucucaaacuuggugcuagagcugguuaaaugcuagacuacugcaguagguuucuucuuacuucuccuuucuuuuuucuagccucuuaauggugucuucuacucauagcaguggauguuuucuuuuccaaauuuuguuuucauugcguugcccuguauuuuagagaacuccauaauauguucagguagccucugauaugagauaaaaacucccaauaggggaguuuaaauguuacccucuuuuaggauacucuucucaaccucagcuuguuuuaaggaaaacuuuuuacaaacuuuauauuuaaaauacuucugcacauuuccauguuuuacaaauacaguaaugacauauauguucauuuuauuaucucaaauacagacuucuuggucuauauguagauuuuuuugcuccauguuaagauuuuuauacuuacugaccagucauuguagauauaucuaagcagaguggaauguucauuuuagaaagugggaugggagagauugguuaggauuauguggagucagguuuuagaagaucucaucacacaguaaggugauuuuagaaagaccaaauccaccagaauuuuuuuuuaauuacucucuuacccaaaccccagaguguuuuagugaaaaaacacguaauaaauauucaggauauaacaucaugucuuuggaaauuaaacuaaauaaacacagagcuagauuuaagagagaaaguguuaaaauaggaaggaggaacuacagauaauuuuucaguguuuauguugucuccuacucauagcaucugucaguaaaaggucagcaaaaauuuaauuuuuuuuaaucuuucaggcauaagauucucaacauguugacuaagaacccaccauuuacuaagaacauggagucucccuuaugcaaugaagcccugguagaucaacuuuggaaacuuaugaauucuggugagagagcagggauuuaaauuguuuuuauuauuacuagaguauuuugauuuuacaacagauuuucaauucaauagcauuuagaacuaaagguaaaaguugagauuuuuuuuuuucuuuuaaguagacuaucacaccuucacagugguggcugugauaacauuuauuaaggauauacucacuuuacuccauagugugguugaggaaacaaaacucuuuauuuguaugaaagugucaaaugguuaaggugcuauaaacaugagccugcaaaguauuauuauuauuucagaaaguuacaaaggagugaaaaguaagucucacgucuuucccuggccaucuaguggccuuuuccagggguaaccaauuucuuguguauccuuccagaggcagguagugcauauagaauaacauacagacuguauuuuuucaaaauacuuauuauuauuguucuauacuguggagaucaugauaucucaucacaguuuuuauuuuuuaauuuauuuuuauuuuuuugagauagaguuucugucgcccagguuggagugcagugguguggccucggcucacugcaaccuccaccuccuagguucaagcgauucuccugccuuacccucccgaguagcugggauuacaggcaugugccaccaugcccggcuaauuuuuguauuuuuaguagagacagaguuucacuauguuggccaggcuggucucaaacuccugauccacccgccuuggccuuccaaaguggugggauuacaggugugaaacacuguacccagccuuaucacaguuuuaauuuauuacuugagugaggucaagagguaagaaaacaguguuuaggagugcuagcucuggaaccauuuugcuaaggguugaaucuuagcucaauuauuuacuuaaugugugauuugucugaacuguuuucauuuguaaaauguaggugauaaugauaccuacuacaaauagaauuaaaugagugucuguaaaacacagugucuggcucauaugaaauacucaaaaauguuaugcuagcuuaaugauaguuacgcuucucaauauuugagcuauuuguauuucuguuuuuccaaauuacucauauucuuugccauuuuauuuaauugaauuauugauucuuuccuauugauuuauaaauguguaccuuuaaagaaaauuugccuuaugucugugauagguugaaauuguaauaaugguuuaaagauucagucagaagcuaggcugaaaugucuuuugcuuaaagagagcaagaguuguugcagauagauagugggagagcaguggauauuuauccauuuuuuuuuuuuuuugagacagucuugcucugucacccaggcuggagugcaauggcacgaucucagcuuacugcaaccuccgccucccaaguucaggcgauugugcugccucagccucccauguagcugggauuacaggcgccuaccaccaugcccagcuaacuucuguauuuuuaguagagaugggguuucaccauguuggccaggcuggucuugaacuccugaccuugugauccgccgccucaucuucccaaaaugcugggauuacaggcaugagccaccacgccuggccuauccaaauauuuaaaagguuugaguaugucacuuuauuugcucucuaugauauuggaaaauaaguuguccugccuaucucauuaguagcuacuucacuggcucacaauuaaauaccaaauuuuaauucuuuuauuuuauuacuuaguucacuaauauugagauguuaagugguuguauaacuucuguuuuucuguuucauaauaacagugcaauaccaccgaguaaaggcaccauaguagguauuuaugugaaauauaauaaaauugaaaauaggauggaccuuguccucagggucuuuagaaaauaacacauaaaaccaguuuauacuaaaauauugcuaauuuuuuuucuaauguuuucuuuaaucucugaaagaaugauugcugcuuuuuacauaauguuuuauauuugcuuccuuuggcuaccuuaaaagauauuauuauuucugcuauuuagacccagggaauuaacacuuaaguucaggaacuuauaaagguucauucaacaguucauauguggcacucacucugcuguauugaauaccuuuuuaaccagaauacaugauuccuugaccaugauagguuacaaauuugaagaaagcauagugaaauaugaagaauuauuuuauuauuuucuaaagaagauguuuuggacaaaauaaauauguguucaagauuaaugagacaauuuuuauaaaacauuugaagcucauuggaagguuugauuguacaaauucaagcugugacugauguuuaguauuuaauuuugauagugugcaguacaguaaaguucugcuuugguuuaaaauucucugccaguauuuaaaccagugagaucagugaggcuauagucauaaacaguuuauuacuuaguuuuucagauuuauaaauaaaugagaacaauaugaacaaugggaguggcaugaauaauugggaggguuaaaaaaauguuuuuauagaacauuggacaauagauaccgaagauggacuacagaguauugucauuuccuuuccaagccugaaccuuugggauaaaugaaugaaucugaucuaagaaauacuuuuuuuauuugauuuaaaaaaauuuaauggcaaaaguaauauaaucauguuacagaguuuaucugaaaaaaacuacaaaaagaaauauuacauaauucuugagaagaaaaauaaacuggcugggcaugguuuauuaagauuuggguauauuuggccuuuaggaaaaaauaauuguguguguguuguguuauauaguuauaguugaaagaaaaguuuuaaaauagcauuuuaucaugagaauuuuucacacugcuauauuaucuucuuaaugguuauuguuuuaagaaaugguaaugaggauuguuuuaagaaaugguaaugaggauucaucaauaacaaaaggagcuagagcaucauuuaaguccccaaauccgcuggaacccugccugcuccucauuuuggggcuucugggcuaucuggucacuugagauaagcguuaucuggaaaacaaaaacugugaacaacauagauguaauuauauuaauuuauuucucuccacaaaguggauuugagguauauugacuuugcauaguuacaaaauuuacugaaccaauuuaaaauaucuagguaagaauaucauggcaguucagaaggaucaucuuaucauguacuuuugaagaauuagaguuuguuuucuuauucugaagaaucaaacuuuucaacgagagagaaauugugguuggauuuauagaaacaggauuugaaaaacugaaaucaauuugagagugagacagaaugauacucaugacuuuuaaaaauucaugugccguucaguuaauacugguacucauuuuagaaauaugcuaggggaauuuggagcugagagacagguacagaaacugagggcucuugguagcugaaucacuuuagugaccauaucccagagggaagguugucagacaaacuuuuugagaucucagggcugccuggucucugccugcuucuugguguguaguaacuccacuuagccuuaaauucugggagguacucuaguaucuuuccaacaguuuuugcuuuguaaauauauacacacacugaccuauauauguguauauucacucauacacguaucagauaucuuaacccauucuauauguaguuuaauuuuucauauauuuuuaucuucagcauuuuguuucuaaaauuuuuaaagcuuaaaaauuuuaagaauaauacaaugcauaaucauauacuuucaguuugauucaccaguuaaaauuuuaccauuuacuuuaucuccuuuuccuucucuuucuuuauauuauauuuauaucugguuguuuucucaaucauuuuaaaauaaaugggaucauuacccucuuuccaaauacuuuaguauauacuccugagaauaaggucauucuacauaucgacaauaugaucauuaaaccccacccaguauauagcccauauucacaguuccccaguuguuuccaaaaaugcucuuugcaauucccaugacagcuuuuaaacuaaugcuccacagaaagauaguaaacauuuuuaaagacaaggaccuuuuacauuauauggucuuuguccaugguugcuuaagauucuuaaauaaauagguuuauuuuuaauugaaaauaucucauuugccaggggcagucguuuuuaaagguuucacauauuaauucacuguuuuuuucuugagcacuuucuguuuguuacuaugcuauguuuucuguguauuaacuaaguauaauggaaagagagacauaggaacagauaaauuauaauaugaagagauaguugcuaaaguaaagagaacaaacuauuuggggaacccaaagaaaggagucaugaacccugucuggaaugcuagaauguucauggagagguagcauuugagguaacucuugaugaauguaaagaaguuuuccagcaggauaaauacauuuuuagguaguagaauuauauauaaaagccuuauguucugaaggaguguuuagaaaauaguauuaucuggaaagauagauuaggaucuaaaugcgaagggccucaggaauuuagauuuuaugcucugggcaaugagggacagguguugcuagaaccaggcugacuuuuguuagcggugugguagcuuuuuuccacacugaaagaaauaauuuuccucuuccaaaggaauauguaucaaaauucagaauauaugugauccugccuuuauagcuucaaguaagauacugaauuacaggccaaaaugacaauaauuuuaaaauacauuaaaaaaauuaaaaccuaagaauuggagauuuuuauuggggcuccauauuuuauuuaagacuuaaauacuuuugcuugucuugccuaauagaguguuuuuuuuauuucugaagaaacagaucuucauugaggagaugguaucuuugacucuuuaucauuaugaaggaaauuuuagcuguugcuuccacauugaccuuuagugucuggcauauuacuauaagaaugacauaaaaauauuaauuguucaagucauugaaugcuguuuauuuacaucauaauuuuuaauguuuggaaauuuacaacuacacucaagggaguagaaugagggacaacuucuaauucaguuugauaggauuugccagguuucagaguaagaaaauaaacaguuuugauauuaacaucagaagguuucaaagcucugucccaccgucucucucccuaauaccuucuuucuuaggaauggaaaugguugaagaaaaugaaaacauauugauucaucugcuuaggaaauuauauauauauacacacacacacauaaauagaaaugaguuugcuguuuuuguuuauuguaagauggacagaacagucaggacaauaauacccagugagaguuguauuucuggcuuaacuguguacaaauuucuaagcuucagccaucaauaaggagugcuggguuuauucagaaguguccugaaaacaguggcuuucaaagugaauuuucuucuuagcagcuuuuuuaguugaucaguuuuuuuuguuuguguuuguuuuuuugagacggagucucacucugucacccaggguggggugcaguggugcgaucuuggcucacugcaagcuccgcuucccagguucaugccauucuccugccucagccucccgaguagcugggacuacaggcgccugccaccaugcccggcuaauuuuuguauuuuuaguagagacuggguuucacuguguuaaccaggauggucucgaucuccugaccuugugauccuccugccucggccuaguugaucaguuuuaauagcaguuaccucagaaaaugaagagaugauuuuucgguaggaucagauuuacuacuuuggugguguuugucucaaggcacuuucugauuugaacagacaacauuaauacuggguuuccuacuucuugaguguuguuguucuaauucagauaaacaggcuuggucucagaguauaacugcuaaugaagacaggaugaauagcaauuuuccugggaggagagacuagugacugucauuuugucaugugaucauucguugccauaagugauggggaaaggggagguagcuggaagauuaaagaugggucuucagaauacuguaacugaaggcagaaaucagaggcuguucagggccucucuccaaugggauugauugacuuggaaucaucagauuuuagaccugaugaggggagucuuaaagaucaucugagugaacuacucugaucaucucaguuauagcccagacagcugacuugcccaaggucacagagcuaacaggcaauuaauuagaaguguuuuuuucccauucugucucucaacuuaagugaaauauacuaauguacuaacgugacaaccaucuuaagauuuuauuccaugauuuugaaauacaaugaaauuuuggcuuuuaucucuauuuuuugcucucuuuuguacuuuuaacaaaaguacuguuauucauuuuuuagcucccuugucuccaauuuuaauauguaaguucauuuuuagaagacagaaaacacuaucaagaaccucccuuaggaacaaaacagugguguucauuccuuuguccaaauuaaaggucuagcaaaaccaaaaagcccacauagaaauaaaaaguaaccaaaaucauauucgagggcuucagugcacuuagcagccuuuacugugcugccuaaucauccuuaagcugacguucaaaaacaaaauaaaagcccuagcucaucaaaauacacauacucaauuugucuuuuaaaauuaacauauauuuuuuaaauguuaagggauucacaauugaaugacucauuuugagaucaucgacagcauacaaaaguucaggcugguuuuuguagcacacauaaucauggcgacauugaucuucaggguuuaguuuucuuccaaacagcaaauguacucuaaacuguucuguucuguuuuuuguuuuuuuuuuuuuaacugauaaaaugccuaagauucacuccuuuucuugcuauacccauggauagagagauacagggccagcugcucuggguugccagacuuuuuauugcucacuccuggcauuucuucccuucccucagaggguugagacccucuagccuuugcuaauagaagccccaggaaucugauaaccuccucuuuguggaacuuuucuauauguaaaaugcuuugaggaggagaaaugaaugccuacaaaauaauacuaccucaagcuauugaaguguccacauaugcauauuccaggaagggaaaauggguuuccaguguaaaauucuugcuuuuacuauguaauguuuuuuccauuacuugguugucuguagcucuugccugucucuugcuucuaccaguguuguaugucacacagcagcaaaacugaaaaugucugaaguaggaaugaugagagcucuuucacaacauuauagcaugcacaguggccuaguacaaugcacuaucuaguaugaaagugaguuuacaauuuuucccauugcagauuugcguauaauuaauaguuaccuguuagaguaaaucugauaagaauuacuauuaguugauaauuuauuuacuuauauuaauauuuguuguggaaaaccacaaaguuuaauauuuaugauauccaaauuuuuuccuuuuuguuucuccuuuuuaaaugugguacucuuuugaaacaacaguucuugguaaaaauuagguauuuaagggccuucccucccccuucccucccucccuuccuuccuuucuuuauuuuuugagacaaggccucacucuguugcccagguucgagugcaguggugcaaucuuggcucacugcagccucugccuccuggguuuaagcgauucuccugccucacccagccaaguagcugggauuacagucaugcaccaccacacccagcuaauuuuuguauuuuuaguagagagugggcuucgccauguuacccaggcuuguuuugaacuucugagcucaagcgaucugcccaccccggccucccagagugcugggauuacaggcaugagccaccaugccuagccgggguuuuuuuucuucucaagaagaauauccacuuuucuucuguucauuuguucuauacucuucaagucauuuaaaauucugacuagaaaccauauagauuguguaacccuagcugacaaauuucaucuuuuuagucaguucuauuugaugacaauaucuacuggaguguuguacuggggagaaaaggaaggcgggaaaacccugguaucaaugugcucugaucugucauugcugugggguacgguaugacuugagaccaaaacuccuauuuuggagaagaaaaaacugagacucagagaaauggaaagaacuugccucuagugugucaaccaggagaaacugaacuucuacccaggcaguuauuuucuggucaaguccacgucuacugcccauugucaugcuugugguuugcuuauuucuguuauuuaaaaaucauaaauaaguucucacugcaguaacacaaauacaaagguguuuagcaaaauauuuuccuccuuuacaauaaguccaauaguaguuguaugguuucuuacuauauguaaaaccugaaaguaguaaguucuagagaucagaaaauguguuuccaugauagggaaugcaaaggcucauggaggcugucuuccuaacaggcuguuaaugaagagaaucagacacgaugaacagagaaugaaugaaugugggauaauuacugaggagaaagaauaaaaaggaagaauuaaggcuauaaaaauacaguuuuuggaauguuagauuuuugguugaugucuaguauucauuuuguaagaugaaaggugugauaaagguuuuuccaguuauaaaguuccuuuuguuguucagguucugggacaguuaaaauguaugaaucaaugugcauauugacucauuucuuuauuacuuacuuuuuagguacuucacaugacuggagguuacgguguggugcuguggacuuguacuucacacuuuuuggccucaguagaccuuccuguuuacccuugccagagcuuggguugguucuuaaucuaaaggagaaaaaagcugucuugaauccuaccauaauuccagagucaguagcaggcaaccaagaagcugcaaauaauccaagcagucacccacagcuaguuggauuucagaacccuguaagaaucacauguauuacagaagacguaguuucauuauauagaggaucuagagaagagaauuguuuccugugaacuagugaauuuuauagccacuaacacaguuucuuguguccuuuuaaaaaaugcuggcugacauuugauuaguacugugccaauuauaaaaugcuacuggcaacuauaaaacugcacauaacgaaugaugugcucccgguccuguuacucguauugugauaaccuaguuauuuuuuuuauacuugagcauagaauuucuucucugaguagcaaaagauagaaacgaauaaccuuuuuuuuuuuuuuuuuuuuuuuugagacagaguuccacucuuguuccccaggcuggagugcaaugacucacucucagcucacugcaaccucugccucccagguucaagcaauucuccugccuuagccuccugaguagcugggauuacaggugacugccaccaugccuggcuaauuuuuuguauuuuuaguagaaacggaauuucaccauguuggccaggcuggucucaaacaccugaccucaggugauccacccaccguggccucccaaagugcuaggauuacaggcgugagccaccacacccagcugaauauuuaaccuauuacauauuaacccaucuugucccauauguguuaaugguaagccacgugaaaacaggggccuugucuuuuuaaaauuguugcucuguguaauaccuagcacaguucuaaacauaugauaaaugccuggcaaaugcuuguugaaugaaauaaauaaugaaugaaugaaugacuagguaaauuaauaaucugcugauuugggaggagacuguguguuacauuuuaaaacauuuuauaucacacacacacacacacacacacacacacacacacacacacacauucguuugccuuuagagaagcuuuuauuucuaccuuuguauuauaaaauuaccagacauuuuguagaaagacuuauaggauacauauuaaucauuuuacuguaauuuaaauaaauuuuuccugaaauguuuuuuuauugaugacaaaaugucuccaauacuucaagcuucauuuuucaccaauauuuagaccagauuacuugccuggcaauucccuacugguguuuugacacuuuaaaaugcagauucucucuaugcuaguuaguaauaguucauuuuaaauuugcuuauucaccuaaauuuucugaaguaucaucauacuuauuuguugucaauuuaaaauauguccuagaguuuggguuaugaagaaguaagacagacauuuacauagaaaaaaaagagucucauuaaagagcucuuucagaucuacauacucaucaaccugugaaaauugauauauuuauaauucuugcucauauauguuaauuuauccacauucacacugcaggcuaagaggagaaaauggcaucaaaggacauguucuuuugggaaaccucuaaaaguucacuuaaauaccucccuucuccccccaaaaagaccagcagacaagaaaagauuacauuuauuuuaagcccauugcugauaauuucuagcacugggcaugcucuaaucugcaugguugcuauagcuauuaguuuucagcuauaauaugagcuacucgucuucagaaaucuaauuuugaucuugaauauugccgcaggaagaugaucaccuugccaaggaagcaucauguaauauaucagcucaucagcagggagugaagaggaagucugauacaccacugggguccccacuagaaccuggucaaauacuggagaagaaugaggauagcaguaaagucaaacucaaaaucagaguaagaaauacagguuaaaccuguauuaacaguguaggauauucaccuucuuguaaaucuuuuugaauacuugcagugguuuuuccuuagcaggaacacacgcaacagacugcauuauaaaacucaaagguccuucugagacauucgaaccaaguauuuaacuuauauuaucacauaauucuucucuguuugggggaggaacuaugugugcacguuccaccacaacucacuacuuuuucucacaaaauaggaguagauuuuaguugcuauuacauuuccaguaauuucuaauuggcuucuuuuagaggcuggaccacauaaucuuuucuuucucuuaauaucuuugaagaaagaaacuacuuuuuauuuuaagauuauauggggguauauccuauggccucucugcuacuuuuccuaagagcuaauauccaaacauaacaugauguaaugguucuuuuauccucuguuuuauguguguguguuuuaguuuuccaguucucaagaugaggaggagauugauauggauacuguucaugauagccaggccuucauuucccaucauuuaaacaugcuugaaaggccgucaacuccagguaagauuaguauucugcaaucauugaggagauggagacauugguugaugucaguauucuaauguguguuacuuuauuuucaaaugaacaacuauacaguuuaaaauuagccagcuuaaaauauuaaauuguagcagauuauaacauaaauuggcaaaauaacaaauagaaaaagugcuucuuuuggcuuuuuuauuuugguccuuuuuaaguauuugcuuguauaaaauccaucauucagauucuuucuaguagcucugauuucucuuuuguguguguaugugguagacuugacuucauguaaccauaguuacauuaauuuuuuuaacugcaguuaaagcugcuuguagcaccacuuucucuuuuugccugccuaucucauauaauauuaugucagucauuuuccuacaucauucaaaaagcauguuuucuuuugaaaauacuaccuaagacaacauagagucaauauauuaagauuuaccuugucauuuccuuauugauaggcauuagguuguuuuucauuuuuauguauuguagguaauucugcacuuuauuuuuuuguuaauuuauguuucuuggauaaauuucccgaaauguauuauuagugaaaagauuaauguuagcuauauugugagauacaugucuuuagauuuucauagcucuugauauguauugccauguuuuuugagagauuauaccaguuuauaucauaagcuuuuucuaauuuuuaaggaauaaaagccuuugauaaaaguugugacauauaguaauaaagcaaguaucuguguaccugccaccaaaguuaacauguacauuauauaucaugcacagauguuucguauaugcuuuuucccugguccuguucuacugccuuuccacuacaaguaacuacuauauugcauuuucuuuuuuuuuuuuaauuucauucuguugcuuuucuuuauaguguuccacauagguaugugauccuguauauuuaguugcacuucuuuuuugaauuuuuuaagaaaugguauaacaugacuugcuuuuuuucacuuagcguuauguuucuaaaauucuuauugguauauaaguuguaauucauuaauuuucauuuaugaccauuaucugucauagcacuugucaucaguguaauaauucagaacuuuuagaguaacuguaaaauaacucagguuuacuguuuuuguuuuuugggguuuuuuuaaauuuuuuuuuuaagauggagucucacucuguuucccaggcuggagugcgguagugccaucucugcuaacugcagccuuugccucccggguucaagugacucucuugccucagccucccaaguagcugggacuacaggcgcgcaccaccaugcccggcuaauuuuuguauuuuuaguagagacggggucuaggcuggucuugaacuccuggcaucaagcgauccucccuccucagccucccaaagcauugggauuaaagaugugagccacuccacccagcuaguauucuuucaauuguuagaauuuuacuguggaugaauugcuucugucuuuaaggcuagcuuauaaaaaccugucagccuuuuuuuuucuuuugggaaacaaagaaauaaaucccucuuuuuucucuuguuuggcauuuuagggcucucgaaauaucggccagcuagcucccgaucugcuuuaauaccccagcacucagcaggcugugacagcacacccaccacaaaaccccaguggaguuuggaacuugcacggaagggaacagguaaaaauaauuaaucagaauuaauauuauuuuguucaagaacaaaucuauaaauguaauagaguuacuucaucaacuuuaaaaaacccuuuaaaaauacagaucuuaggacuuggcuuuucuuguaauacauugagcuuauauugucuaacuuuaaagacuauuuuaaaauagacuucuuuuucaaaaguaauguauuccuauuauagaaaacuuggaaauaaaagaaaauuaggugagaaaaaaauuaucccccauaugccauugaaagauaauuuaaaagauaaugccauuuaauuauaaugaacauuuugcucuuucuuugccaugcuuuuucuaagaauauuaugacaaaugccaacuucaauagaaaccaucuaauuuguaccuuuauaaaaaagauauaaacgcauaaaauaaaaaaucaaccacuuaucccccacucguguauauaauuggugauucacuccugaagacuugaugcuauauucucuuauaucauuucacaguaauugggcuuaaguuugugaaaaguaauuuaauucagauguguuuguuaccuauucuguuucacauuguuuucugcuuauucuguuucaucacuuacaaagagaggauuauaauccaaaugaagugcaaacauuugaugcugaugaacuaccgugaaacaaagauucaguccucaaauucucaaggaacagggagugaaaaaacaagauacauaaacaaaaucauuuuuaaagaauaguuuuuccagaaguagacagacuuuacagucugugaacuucugauuauauuccaguugauggacuuugcuuauauaaauuauguuuuuaucugauauuuuaaagagugcuguuuauugcuuugagaagcuuauaaauuaacuguuauuaacaggggacuucaaacaaaagcagcacauuaaacuguuuugauguugagaccccagacuguugauugcuuaccguuguguguucugugcauuuauuggaauagauucaccuaaaauauguuucagaaagaaaucaguuggggacuuauugcacuuaaugagugaguuuugauauuucuuggcccuuccugauuuuuuguauucuuuugguuuugguguaauuuugaaauuuuacuagauguaaauaauuuucuacauuuuuaaaaauuauaaagcuuagagaauuucaaacuccuucauacaguuugaggaugaugcuucugcuuaccuuuaaaaaaaaauucucucuaaauuuccgagagucuaaucaauuacuguuccaaaaagagucagaauacauuugguuuuucuuagcgguguggcacauuaaccuauguagaagcaaaucugaacacuuuuuuuugugcccaccagugugccuuuuuaucauugauccuuauugcuuuuaaaaauacauuuucacuuuuuuucaguucuuucuuuauaggcuuuuaguucucauggcaucauaugggaagacuggggagaaagaaacacagcccuaaugguggggaauaggaaugcauuaacauuugaguuuuggcugcuauuagugucggguccuuucuuggcaugaggcaaaaauguauaccaguuagauggacugaucuaguaaucuuaacuuugaauauauucuuuaaugugacuguaauuuccuuuaaauguguuuuugcuguucaguacucugaggucacugagcaagucuuaaaauucaacagugauauuacaagaauguagaaaaccuucauuuuacaaauaauaguguuuugaagguuuauuuauaaauauauuuauuuuggaauuuugaaugcaguuuuucuauagguaguuucuucuucuucuucuuuucuuuucuuuucuuuuuuuuuuuuuuuuugagacagucucacucugucauccaggcuggagugcagugaugcgaucuuggcucacugcaaccuccaccuccuggguucaagugauucucguaccucagcuuccuaaguagcugggauuacaggcaugcaucaccacacccggcuaauuuuuuuuuuuuuuuuuuuuuuuuaguagagacaggauuucaccauauuggccaggcucaucucaaacuccuggccucaagugaucaccagccucagccucccaaagugcuaggaucacaggcgugagccaccaggccuggcgacauuguuuuauuuguuaaguaacuuuuccaaacuagccaacaaaagcuuuacaacuccuaccauacaucaggaauacaaauaucaaaccuagcccuuguguguaucaacguuucugugagaagauucacucagagcuccaacuuuuggcaugugggaagcauaacuuuagccuaacccaagucaagucaaauuggcagugaaaaaggaauuucuugucuuccugccucccagcagaagcugaagaucucuuaccauggcagccaccuuucuugggguugagaguugcggguuuaggagggagacagcacuggugagggaagcugugaccucucuucagucucuagggauucuagauuagagaucacaaaugagguuuuuuggccuauauccaguucaucaagcugaggcaucuucuuauaagucucacaaaaguuuuugaaguagauaacuaaaaaugaagagguuacacauaaaaauauggauuuccuuuuacucugauagagacauucaggaaacaaagaaaaaaagcaauucuggauuucuagcuuuucuugaaaaagugugagaggcuuuuuaguaaggcgugugaucucuuaugccgcacccaguagucuguuuacucauuuaugcuguuccucaggacaaggcuuuugaguuucuggccucugcuuuuuauuuuauuuuauucaugagcugagaugaaguccuagauggcccccuuagagccaaggagcccgaugauaauugagaacuggaauguguuacagaccuugucuaggagggauagaaaaagaauauggguuuaaagaagagauggaaacuguuaaguagaggacacauuaugguuuacuuuuuaaccuugcuuccccaguuuucccuuuccuugcauuugauaguagaauauuuuagggcaggaucauauguggguguuagauuaagccauugggaugagaagggagaaauggcaagaguauuuuccuucauuacuuuauuauuuauuuuccuuuuccugagguaaggaaggggauauaaagaaauggccuuuaugguucccacggugauagggaugaacauacaauauucucucccuucucaccacagcagcucccugucuguuacugcagagcuugaggugacuggacugucucccagguuacuguagggauugcagugcuggagaagagaggccgggcaaggggaacaaggagcaagggaauucccuagugguuuuugugggaaagaagcggagaguuucugcagcugccuagcuagggcugcaguauuauguaaugccuucuugcauaagucagaaaaacacaauucugguaaauuuuuuaauuuaaaaaaaaaaaaaaaaaaacuucuuuaaagcuugagagcuugcccuagaggucuuucuuuugaaaccaguacaaaaaacagacuuugauuuuuuuauccuuaaauuauaaugauauaauucuacuuuuuuuuuacagugaucuaaacaaucugaagaacagaacuuacaccuuuccuaauaaaaacugcagguuuuguguuaaauuuaaacauauaccuaaggugaaugaauuuaguagaauuagcagguuauucacaguuucuuaucagcacuuucaucacaugggcugaaauccuuccacauuagacuuacauuaaguaccucuuucuauuuguuuuacauuuguuaacuugacugcagguaacccuuauccauggugcauuuuguuuggucuccaggaaagaguuuacauugaguagaacaauacaacucugaacaucucuuuuguucuuuccauauaacaugaaauaggaaaauuuuuuuauugugaauuaaauguaucuccuuucucugauauauuugcuguuuagaagagugacauguauuucaguuuacuaaaaggacuuuuauuagccuaaagaugaguggugccugugaauggacaauuuagcagacgucuuguaaaucccugaaaggauaugugaaauuaucuguguaaauguuuguaucaagggaugguaauauauguauugucuugauagaguucuauagaugaccucauuaugcuccuaugaaaguaaacuugugugucccaaaucugauuauaaggaaauuaugcuuucuuaccacguuagauuagagcugguaaacauuauuuaggagagauagauaauaagcaaaacauacauacguacauauauagagagagaaaaagaauauauaaacauauauucucuagagagaauaaauaaaacauacuauauauauacaacuguauauauauaguauacuuauauucaauuauaguauauaguaugcaauuauaguuuauaguauaagugaaaacuuaagagcuaaagguuguuggugaugauaggguagcauagaugauuuguucuccuguuacugccaauuaacauauuuguguaugugucuuuucacauaugcaugagcauauuaaugggauuaaauucuuggaaaacuuucuaaaggaauauaggcauguaacacuuucaugguauugccagauugcuuuaauuucuccuuuaaaaaaaagcuuuaggccaggcacgguggcucacgccuguaauccuagcacuuugggaggccaaggugggggaucauuugaggucaggaguucaagaccagccuggccaacauggugaaauccugcuucuacuaaaaauacaaaaauuagcugggcauggugguacgcaccuguaauccuagcuacucgggaggcugaggcaggagauucgcuugaaccugggaagcagagguuguaguaagccaaaaucaugccacuguacuccagccugggcgacagagugagacucugucucaaaaaaaaaaaaaaagaaaaagaaaaagaugaaagcuuuauuauagagaacuguaaaguagucagacaaguauaaugaggccccuguaucuguuacucagcuucaauaauaauugguucauggucagucuuauuuaaucuuacccauuucuacccuucugaauuauuuugaagugaaucccaaauauaauauaauuuuauucauaaauuauuuaguauguaucuguaaaagguagcacauuaaaaagucauaaccacaguaauguuauaccuaaaaaacuuacuaauucuuuuaugucauuaaauauccagucacuguuuaaguuucaguugacucuaaaugccguuauuuauuuuuauuuuuaacaauuuauuuguuuaaaucaguguccacguaggguccacauugcaguuggcugauauagccuuuguaucuuuuugaaucuaacauuuccaguucauaccucuuuucuucucccuuacaauguauuuguuaaagaagccagguuuuuguucuguacuuuucauucuaguguuuccaacucauaccucuuuucuuuuccucuuuuacauuuguuaaagaaacuagguuuuguucugugcuuuucaagucuguauuuuauuaauuuuauacccaugauguaauuaacauguuaaguucucuaguuucuguaaauuuguaguuguaucuagaauucuaauuggauucagguuuacagaggguguguguucuuuagucuggaagcauacaaugucuggucgacucuuuuugagguuaaccacuauagauguucaaacuagauuccuuaauucauuaaguugcaagauagugauauuucaauuuauacuuucauuuuuauuuguaagcuggauuacuucuauaaagcuaaauuucucuucauuuacuauuacccagugguauaagucuauaggaaaacaaagauaaaugcuuaauuuuucuauguauuuaauaauuuucaaaguaaugaguuguugacuagcaaucuccaauggugagcagucauuuucagucuaucacaauuauuguccuuaucaguauucaauuuguuccaucuuuggacugaguucauuugacaagauuuuaacuuccuugcaguuagacccuguguuucaagcucaucuuguaaauauucugucauagaccuggaauuagccauuuguccuaggagcccugguuucuaacuccuuuguccuuggugcuaacuaauccauugucuucuuaguagacuucauguaccucaagagaaaugcaagauuuauuaccaauauuucuuuaaugcaaaguguaaggcuacugucuagacaaaaaauuggauucacuuuugaagugguuguaaguauucuuuuaaaagauuacaccuacaaaugcucaguugcccauuaggcaguugccugugcugagaaguacagguuccaacauaaugacuggcuuucugcaauccaaguaguuugguagguguuuaggauuaaaggauaaaacuucuuucuccucugaaaugcagaagagaaccucaagcucccaagagugcagacagccaacaagaaagcugcaaagucuguugauauagaaugauuaaauaaugagauggaagcuaaaagaauuuguucaugagacuuuaaagcuucuuauuacuucuuaucacccgccuguguauucuguuagguauuggccuauucccauauucauagaaucaggaacauauucaagcaauuuauguauuaaaaucugaauuaaaauaugguagcauauauggcugaaacuaaaucagauaaucucaauauuuuuguccuuuuaaagaauaucuggguaccaguuauuacagaagauacaguucuccaaacuugucuguauauauaaauaauauguuuagcuuuuacuugaguauuaguguuggcuuuauuacaaaguuuaugaauauaagaaauagaauuuugggauacuaaaaugugaauaauaagugagcacagaaacuuugauuuguucacguguucuaaaauauuggagcagugccugacaaagaggaaguacaggagucaaauaccacuugaauggaugagcuauaauaguuuuugugcauuauucuucucuccucaaaaucagugaccuucaaguuauauuuaguuggacuaaguucaccugacauuuaaaaagaaacacaacuguauaauucuguuauagucauucauucauucauuuagcaagcuuuguuagagggggcgggguaggggaugauagauacugugcuauauguugggacacaaagacgaaaaagacaaacuuccuguccucaagaggcuaucaguuuaauggaagagacucaaagacaaaagaaauacagcaguccaucuugggguagaugaacacuguagcaucgugguuaagaguaagacucuggagucaggcucuuuagauuugugccucagaccugccaguaccaccuugggcaaauuacuuaaaucucucuuugacuuaauucccuuaucuguauuaugcuguggaaacaugaacgaaccaguuccuuugggaaauuugaagaaaaccguccaaagaaacauuugaauuagguuuuaaauuauugaagaaacuaagauguucuuuguuuccuuauuucuuccuuuagguugcagcuuaaccauuacuuuccuggagaacuuugcuucucuaaucccccucuucccccaacuaauuuaagugcccuguugugcuccuguuucacuuuauguuuugccuuuuuauuacucagguucacuuacucaauuuauuucuucuuugcuagucuguaagcuccuaggagggaugagggcugauaucugucuaguuuaucaauauuuuccccagucccaauauaguuucugauguuuauuaaaugaguguaucaguuagacaagaaauaaggaaagaaggacaucccaagcauagggaauagcauuuagaaauacacaguguuaugaaagguuuagccuagaguaguauauagaaaggaagaauggaaggcuggaaagguaacuucaggacagauuaugaacugucaauaaauaaaauuaguacugcaauguaauuuuuagaaagcuucuguggugaugucuguuuuggugaaaaccaugauuugggggcugguuuggaucaaacuuagugaugagaaauuuacuuuuuuaaaaaaagaaacuacauugaaaucuauuuuagugaaaagccuuuucuuuuuucuuagcuaguuuggauuaauauauauaauauauuuuuucagaaauuccuucacugaaguccaaggaguuuaucuuuuguacugucaguagaaccaaccggguuuuuaagcagauaaaaagcagcuuuguuuaggaagaccacgaugcagcaggguuucccagccuggacacuguugacauuuuaggcauaauucguuguuggggguauaggggugucuugugcauuuuaagauguuugccagcaucucuggccucuacucguaggaugucaguaacaaaaugucucugaacauugccaaguaacccuuugggggcaaaaucaccccugguguucugagaaccacugcugugaacuacauauacauuagacacuuaauccauaagauacuucaggcagagaaaccuuagugacuaggaggagacuaguaccuaguaucuauaauacuaguacccauaauccagaugaggugagguggucugaauuaauacaguugcagacaggauuaggaugggggggggcggauuuaagagauauuuaugagaaucaacaauauuugguaaccacguaucucuggaagggagggaaucugaaaugaaucuuaggcuuaaguuggcugcauguaaagcaauaccauuaaccuauaaauauagagagagauuuguuucucagaguauggcccaaggauuauaggccugugggucuggaggaaaaagcaaaucuguacacuagaguuggagaacuacuguuauagauuccuagacggauagaauguuaaaacuguagagaaccuuugaggacauuugaucuagauuuuuagaugaugaacuagacccagagagaugaaguauagcuaaaggcuaacaggacaaccuagucuagaguaugggccuucuaauucuguuucuuucuuuguacugacacuacucucaucuguguagagagacagauguucccuuuauagacuccccaccuuuucuggguuucuuaagcugugcauucugaaucuucuuagaguucauuugucuaucccuagaaauugucuuaaggagcuauacaaauguuugauuuucacugagauaccauuaucaguagcuagaauagcauguuuauggguauaucaguuguucuccagauggcacaaagaaaauagagucauccuuugguauacgcagaggggauuaguuccaagaucccucccugguauacgaaaauccaugcauacucaaguccugcagucagcccauaugaaaaaccagcucuucuaucuauaugcagguuuugcauccuucaaaucuguauuuucaaucuguguuugguuaaaaaaaaaaguucacauauaaaugggcucacgcaguucaaacccauguuguucaagggucaacuguacugucaucuuccccucccccauaccuuagagcaauugagugaguuauguaauugagugaguuauguuuucauugaccaauguuggucguuuuuuguuuguuuguuuauuaagauggagucucacucuaucacccaggcuggagugcagugacacgaucucagcucacugcaaccucggccucccagguucaagugauucuccuaccucagccucccaaguaccugggauuacaggcacccgccaccaugcccggcuaauuuuuguauuuuugguaaagauggaguuugaccacguuggccaggcugguuucgaacuccugaccucaagugaucuacccgccuuggccucccaaagugcugggauuacaggagugagccaccgcccccggacccagugugggucuuaaccuauaacaccguguguaauauuguuuuuucauaauacuuagaaaauauuaauuuuuaaaagaugauuugguaacacacugguauauggccaaauuuguauagacuauaaggaacuauauauucaacuuccuggccacaaugcugaaaaacucuguguguaacuaauuacaugucuuauuuagauacuucucccauuccugauagaagugauaaaaacuuaggaaucccucuuuacauacugucaucagcuuccucuuucuuuagucuggcuuuccguaucaucagcaggaauucauuuggguauuuuuaaucuugaagguaaagaacaagcaccuuuggagaugaguaugcauccagcggcaagcgcuccacucucagucuuuacuaaggaaucuacagccuccaaacacagugaccaccaucaccaccaucaccaugagcacaagaaaaagaagaagaagcauaaacauaagcacaaacacaagcauaagcaugacaguaaagaaaaggacaaggagccuuucacuuucuccagcccugccaguggcaggucuauucguucuccuucccuuucagacugagaaggggacaaaaagaccuuuccuuucauguccagaagaauguauguaacuaaagcuuuguccucugugaagaauuauaaaagggaggggggaaaggauucgccucuccuacagaaauucugaauucauuuaaguucuaagcauuugauuuauguuauuuauacaguugggaucuaauuaggaaaauguguuuuguaguucuggauaaacuauuucauccgcuguuuccuccccaaaacacacacacagagcaaacucccuuucauaaaagcccucauauccacuggcaguccccguucgcaucauggucuccauguguaccgccaaagucaauuauguuugaaagccuuugguggauguuauggggcaaaguuaugauuuacacagaagcaacugccaaaucuguggugcaaccacuaucuccagugaaauauuguauaacaccauuuggaacuacugaaaagacaguggcuuuucuacaguacucuuccuuauugcaccauuuuuguauuaacguagaaacuaagcaucagaauuuaugaacaaagaauauguuauuuuuccuuuugcucuaaaauacugagauuuggggaagcaauucuuuuuuaaaaaaauuuugaauaacuaucuuuugauaacacauucggcgguuacgauguuggaauuuagcagaacuaucaaauccaaaauuauuuucaaaucaagauguuuaaauuauaaguuuuuuuguuuuguuuuccaguaaguauaaaugaaaauauucauauguaaaauauguuuugcuuaauguggacaauuuacacacccaacacauacuguuuccaaaauuauuucuauaugacacaaaguaugauaccuuuaaaaaggugagcuuauauauuguuuauuaaccuggaaauagacaauuuggcucucauaccauaagcauuuaaaaacauaugaaauauuuugauuucuuuauauggugguguguuuuuauuucugaauuuuccaugugcuuuaauauuuguuuaagaauauuuuuuauaucuguucaauuuuuaucauuccccuuaucauuagaaaguuugacaaaaauacuugaaucuuggaccucuaaauauacuuuuaguuguguuuaacuuguuuaauaaauaacuuuuuaaguuga

SEQ ID NO: 192545 - RNA, 177258 nt, Homo sapiens
ucuggggccggacuagcccagcgcgucugccuacccauagggauucccucuccagccaauccagucagagcagcggagcugccccgaacaaagauggcgcgggaagcgucugugagggcagacugauccgagcacccaaacccucggcggacagcggagccagugguagccgcacggcccuaaaaccauggaggagggcggcagcacuggcagugcuggcagugacagcagcaccagcgggaguggcggggcgcagcaaagggagcuggagcgcauggcugaggucuuggucaccggggaacagcuacgguaaggcaagagacacagcgggugagcucacgauggcacugccaacgcgugcccgcugcaguccugcgcgcacgcgcucccuggcucguggcuugcgacucgcguggggcgccggaacggcugcgggcgcguggaugguccucggugcgcccgcgcuuagcugcugcagccucggucccugaggacucgcucgccaagcggggcugccuggcagaagccgacgagcggguggugcgcgcugcgcccuagccuggcugcugcaguccugugccgggcaaagucccugccacccaccgcgcuguccgucuucccguguaccuggacgccgccaggccucccggcugacagccugcgccucauccgcgaagagagcaagaggggucgcuguggggucccgaggcgaccccagccccucuacuccuugauaaaaggagcaagaccaacgauagucuucacuagguuuuccuuuuugcugacaagucuuccuucacuccccugagccucgguguuuuacaucuguaaaacagggcugauucaagggcuuuuugugagguuaaacugagagagcauuucugaaacccugcaccuaucaguuaauuggcacaucguccucaaucauuuggguccgcaagggggcguggaggcaccuugucgggcugccuugaggcugugccaacuccccgggcucgcacguuuugggcagcaggauccauggggacccuggcuccugcaagaauuaagacuugcggcgucucacggaacuugggaacaaggacgacccccagaaucccccuugccauucccaucccuguaugguccuuccucuagggcuguuugggaauaguacuuauggucuaacugguucugcagcugcccuucgugugguuauaaaucaguuugccaggaaaaagaaaacccagcucugcagcguuugagccacaacuuguacgcgggccccuguuacuucuaguucuuagccugaauuccccagcuuguuuugguuucuaaaugucuguguuucaggaccugaaagagugucuugcaaaggucucugaaggagaccaauauuggaagucagaauuaacugauuuuuaauguuacaaaaggcaaauugcaccuaucgauucuuuguugauuuuuaaaaauacguggucagaauuaaagggaauaaaaacuuuuuuuccuucaucaaaaguacuuucuaaugaaaccugucacgcggugcccgugugaagagaccaccgaacaaguuuugugugagcaauaaagcuuuuuaaucaccugggugcagguggacugagucuaaaaacggagucagcaaagggagauggggaagggguuguuuuauaggaguuggguagaugauggauagugguguaaguuugugaggugcaguccaagaaggcgggggugacuucauaaagcccuguuguaaagaguagaguaaggaagaagagaccugauaucccuuggagaauaaauguugaaggagcaggagggugucuugcugagaagauucaaaggagaggcuacaaaguagaaggucaucaauauauugaauaaggugagaagcagagggguagaaagaaaguaaaucaugagaaagggcuuggcugaaguaaugagggcuguuccugaagacuugcggcaguacagcccagguaagcugcugggacugaugggugucagggucaguccagguaaaagcaaagagaggcugggacgaggggugcaggggaauagugaaaaaggcaucuuuaagaucaagaauggaauagugaguuguggaggaagguauugaggacaaaagaguguacagguuuggcaccacaggguggauaggcaaaacaauuugguugauaaggugcagaaccugaacuaaccuguaagacuuguccaguuuugggacagguaaaaugggggaauuguaaggagaguuuguaggcuuuagaagcccaagcuguagcaggcgagugauaacaggcuucagucccuuuaaagccuacugugggaaagaaaguuuaauuucucugcucuucauuacugggccaucuuuuuaaaagucuucuguuggauaggguuacuuauuuuucauuuauuuuacaaauauuaaauugcaugauggcucuuuuuguccagcaaguacuuuuuccuucaagaugcaguuuaaaugccucuuccuugcaguccccagagcacuuguuauuccccacuuuucuagcgccucucugcacugcagcaguuuugagagccauccuugucaugcaggaauuagaccuggguuugaaugacugcuccaccauuauguaggcaagugucagcauuaaguuguuucaaggaagacuuuaagcuagacugaaucuuggcuuugcuacuuacuagugugggaccuuggacaagugauuaugcccguaauccuggcccuuugggagaccaaggcaggcggaucccuugaggucuggaguucaagaccagccugaccaacauggugaaaccucaucucuacuaaaaauacaagaauuagccgggugugguggugcaugcuuguaauccuagcuacuugggaggcugaggugagaggauugcuugaaccugggaggcagagguugcagugagccaagacagugccacugcacuccagccugggcaacagagugagccuccaucucaaaaaaaaaaaaagaagaagaaggauggguaauaauggaauuuaccucauaguguuacuaugaggauuagaugaguugcgcuuaggguaguuucugauagauauguaguaagcaccaggucaacauuagcuaagguagaguucugugaccuuggacaaguaaauucacuucucugagucucuguuuccacauuugaaaaagacaaugaagaugaauguauuucauggaguugcgagaauuugccccugggcuucauguauuaaugagcauucaacaaauaguuccuggaauuaauuaguauuauuggucucucugcaucacugcaugugacuuccagccaagcaagauugggcaggaaggauugggugguggugaagagcgcaggauauagaacuaggcugccuggguucuuauucugccuccaccauuuauucuguaacuuuaggacaauauguuuagccucucugugucucaguuuccucuucuacgaaauguuauucugaugacacuucuucaggagcucugugaggauuaaaugagaugcuacauguaaaaggcuuaggaaauguuagccacuuaauucuacuuuggaaaauuuuaaucauugcuguuuuuuaucucaacuguuuuggcacuguaacuagcacauaguaacuacucaguaaguaguuaaaugaauaucguaaguauucaauauacuucuguuaguacagagcaguauaauagucagaauuuaggaauuaaagcggucguaugccugguuuccuaguuauuggaggguuggaaguucagucauucuugucacuuucacaaagaguucuucugucuguagcuccccucucacugcaggauuguaagugcuuugcaauguccaggccuccugccucuaagugcuucacacacucucaguuccccucugcuuucucucacuuugcauuacuuucugggucaucagagaugagguagaggugauaagaggaaaccaaggacugggauuugaaauaaaaaauuuagccucuaggcccaguucuaucaauuucuuuuucuuucuuuaauuguagcuaugcccucuugagcaagucacuuaaccucucuaguccuaagcauccuucccuacagaaugggaauaauaucuucccacauaagauuugugguaguggaucaaauaggguacagcaugggaagaaacuuuguaaaauaaaucgauaaagcaagaagaguguuguuaugacuauuguaaccuccagaugugaaauugggggcuggcuccacaauccugacgcuucuuuuuuuguuuguguuuuguuuuuugagauggaguuucacucuuguugcccaggcuggagugcaauggcgcgaucucggcucaccgcaaccucugccuccggguucaagagauucuccugccucaacgucccaaguagcugggauuacaggcacgcccuauuuucuauuuuuuaaauuuauuuuucuugaagcacaagaaucacuucaacccaggaggcggagauuguggcuaauuuuguauuuuauuuauucauuuaguuauuuauuuuuagaagagacgagguuucuccauguuggucaggcuggucuccaacucccgaccucaggugauccgcucaccucagccucccaaagugcugagauuacaggcaugagcugcaccuggccaauccugacacuuuuuuuuuuuuuuuaagacagcaucuucacuuugucaucaggcuggagugcgguggcacuaucucggcuuacugcaaccuucgccucccagguucaagcgauucuccugccucagccucccgaguaggugggauuacaggugcgugccaccacacccaguuaauuuuuuuugugugugugcuuuuaguagagacagcguuucaccauguuggccagaauggucucgaucucuugaccucgugauccgcccgccucggccucccaaagugcugugauuauaggcgugagccaccaugcccggccaauccucacacuuuuuaaagggcgguugguuguauaaggacaagaaauuaacuaacagaccuaaaaauaucucuugcuuccuuuuucagcuuaacugcaggacccuuuguuuaauuuucuucauguuuuucccuugucauaaaagauuuuacuuccuucucccaauguauuucaauuuuugcaucuuaaagaugcauuuggggccaggcgcgguggcuuaacaccuguaaucccagcacuuugggaggcugaggcgggcggaucaccugagaucgggaguucaagaccagccuuaccaacauggagaaaccccaucucuacuaaaaauacaaaauuagccaggcgugguggcacaugccuguaaugucagcuacucgagagucuaaggcaggagaauugcuugaaccugggaggcagagguuguagugagccgagaucgcgccaaugcacuccagccugggcaacaagagcaaaacucggucucaaaaaaaaaaaugcauuuggauacuacuucacagccuccaggauggguauaacaaaaaagacagucacaaguguuugugaggauguggagaaauuguggagaaauuagaaccccuacacacuacuuggugggaauguaaaaugguacagccccuuuggaaaaauauuuggcagcuccucaaauauuaaacauagaguuaucauaugaccuagaaauucugcuuuuagguauauacccaggagaaaugagaaaacaugucuacauaaaaacuuguacacagauguucauagcaguacuauucauaauaaucaaaaacagggcugagugcaguggcucacgccuauuaaucccagcacuuugggaggcuaagguggguggaucaccugagaucaggaguuccagaccagccuguacaacauggagaaacccugucucuaauaaaaauacaaaaauuaucugugcguggugguacaugccuauagucccaucuacucaggaggcgaggcacaagaauagcuugaacccaggaggcagagguugcagugagcugagauugcaccaugacacuccagccugggugacagagcaagauucugucuuaaauaaauaaauaaucaagggccgggcacggggacucaugccuguaaccagcacuuugggaggccgagguggguggaucaccugagguugggaguucaagaccagccugaccaacauggagaaacccugucucuacuaaaaauacaaaauuagccgggcaugguggcucaugccuguaaucccaggacuuugguaggcugaggcgaguggaucacgaggucaggcauucaagaccagccuggccaagauggugaaaccucgucucuacuaaaaauacaaaaauuagcugggcacgguggcaggcaccuauagucccagcuacuugggaggcugaggcagaaaaauugcuugaacccagauggcagagguugcagugagccgagauugcgccacugcacuccagccugggugacagagcgggacuccgucucaaaauaaaauaaaauaaaauaaaauaaaauaaaauaaaauaaaauaaagaagcccaacaauaucacuauucucuuucuagcaaugguagcaauuauaauaauaacaauaacacuuacauggcaccuauuaccugguaaggacucuucuaagcacuuuauguaugguaaugccuuuaaucuuuauagcaacucuauguagcagauaccuuuauuacuuuuauuuuguagauuaaaaaauugaggaaaagaucauuuaaaccaacaggccauagauuauucagccagaaaguuacgguagaguugaguguuucugcucuuaagcacuaugauaagcuacaauacuguucccaacuagugacuuagaggguuaaaaaaaaugaaacacuaaaacaacuuuaaaacagaaucauguauaugagaauaucacauugcagugugacaacuuugguaaauaaaaaaguagacaaguagcuuuuccauucuguuggggaaaaucugauuuauuccugugaguauuuauauuuugacaagguaggauugucacuuucucuacuaaauauuaaacucaaucuuucugacaugugguuuuaaaaagugaauuuggacuccacugauucagaauuuguaaccauuuuaaugggaagauaaauugcaguucuauuuugccaucugugagaaugggaguaggguaaggaagagaauucagaauguauaauaaagggaaugcuuaaauagagagaaaaugcaucaaucauuaauuucacuuuaauucauuuaauuucauuaauucauaauuaauuucacuuuugcuccucuaccaagaugaagugugcugauuacaacaaucuuauccaaucacuaaggcugacuucccaaaagcaacuuacuaggcuaugaauuuaguuagcuaaguuggaggaaaugcaguucuuucaaauuguuugucaccuuugccuuuuuucuauaacaggcugccuuucaggcucuuacaggcuuacuauugucuuuuuaauaaaaacgucuuuaauaaauauugaauugcuuuccuaaauuugcuuugcaaauguuaaugcaguuuucagaaaaaagguaaaaacaggccagguguggugggucaggccuguaauccuggcacucugggaggccgaggugggcagaucacuugaggucagaaguuccagaccagccuggccaacauagugaaaucccgucucugcuaaaauuacaaaaaaauuagcugggggugguggugcgugcuugcagucccagcuacucuggaggcugaggcaggagaaucgcuugaaccaggaaggcagagguugcagugagcugagauggcaccacugaacuccagccugggagacacagugagacucugucucaaaaaaaauaauaaaaaaaaaaaagguaaaaugggccuuugaaccaaagaucaagcucuaauaaaucgaauaugagauaaggaauuuagagcauacacaacaggacaaggagaaauaauucauuuuauucaaguaggcaccuaaggaacuuuacgguugguauaagaauaucuuagggggugucccuuagaagcuaggauugaaauuuucuucuccuaaacagcagagagauauccuggagucaguaaauuacugccuauacagauuuuugaaaaagaagggcuuuaggaaaugaagagucccuguauuuggagucaauggucaagagccuaauucauguagaauguuuauucuauuuuuauuuauuuauuuauuuauuuauuuuugagauagggucucacucugucacccagguggugugcaguggugcaaucgcggcucacugcaaccucugccucccagguucgagugauugucccgccucagcguccugaguagcugggauuacaggcaagcgccaccacgcccggcuaauuuuuuaauuuuuaguagagaugagguuucuccacguuggccaggcuugucucgaacuccugaccucagguuuucuacccgccuuggccucccaaaaugcugggauuacagggaugagccacugcgcucggccuuguaauuacuuuucuaaaaggccauugcugauauaaguuauggcuuccaucagcuuuggaaucaauaaaacugaaaauaaguuaaaccucaagagaagagaaugcaaggugaaggaaggucauucuucuguccuguuguguuauuucuuuuuuaauuuuuuaaauuuuagaaaaaaauacauuguuuuauaucuuuuuuuauuauuuauuuuuauuuuuauuuuuuuagacagugucucacucuuguugcccaggugcaguggcaugauccuggcucacuucaaccucuggguccugggcucuugugauccuuccaccucaaccucccaaguaucugagacucaaguaucugagacucaggcauguaccaccacaccuggcuaauuuuuguauuuuuuguagagauggggucuugccauguugcgcaggcugaucucaaacuccuggacuccagcaauccucccaccucagccucccaaagugcugauauuagaggccaucagcaccagcuucuuguccuguucuuucuagcuuucauuugagucaggaguucauuuccccuucauugguggcucuuaaaugguugguuuccaugaguuuagugauuaggaaaugacaaaggaaagaacaaucgguccuacuuucuacacgguaauuauacuuuuccguguuccauuaucuaccaaggagagguggguaccaaaucugagauccuuguucuaguauuaucagccuuaacuaaacuuagaaguuuauggcagugauuguuucuauguaucauuagauacacgggggacaucgugaagauggaguuggggagaggauuuagugggacagauaggaugcuugcaaggugguaccuucaggaucaacuugagcuauuuucaucagggcuggcugcagagaaucacuuuuugguagcuuuacaaauauuugugagguuggguggggagaugaggagagaaaacacacccugcagugugagacaagauaugcuuuagggccgggcgcgguggcucaccccuguaaucccagcacuuugggaggccgaggcgggcggaucacgaggucaggagaucaagaccauccuggcuaacacggugaaaccccgucucuacuaaaaauacaaaaacauuagccgggugugguggcagacgccuguagucccagcuacucaggagacugaggcaggagaauggcgugaacccgggagguggagguugcaguuagccgagaucgcgccacugcacuccagccugggcgacagagcgagacucgucuuaaaaaaaaaaaaaaaaaaaaaaagaaggauaugcuuuaguauucccacuuuucagauaacagcuguugcuaggguguagcaaaagggaacaaaugucauggccucuagcuuggggaagcccguggcagcugcagaggaggagguagguagcagcugagggaggcucaaggcucaagucuuuccaccuauaacucucaggcugcuacuuauagaucuguuugacuguguuuguuugcuuugauccuuguguccuccuaucucccugcaauacuuuuaccuacagauuuuggguucugauauuuacccggaagcucucuucauugaguaagccuugggccaguagguaucuaugucuuggccuuguuuagagcauccagcuccaugaggcacuccuuugagugaugaaacuauuacagcuauagagaacagaaccuuguccuuugugugcagagcaggcaggauucagaaggacuaguccuagcacaguacgcucaguagcuacucugaccuugacuuaagguauaagaaacaaaugaacauucucauagccauucucucauugcaugccacccucguuucauuagaguuagguuagaguuagagugagaugaaguuucucugucgcccagccuggagugcaguggcaugaucuuggcucaccgcaaccuccgguucccagguucaagcgauucuccugccucagccuccccaguagcugggacuacaggcaggcaccaccacaccucacuaauuucuguauuuucaguaaagaugggguuucaccauauuggccaggcuggucucaaacuccugaccucaagugaucugcccaccucggccucccaaagugcugggauuacaggcaugagccacugcaccuggccgguugcauuuuauuauguaugaaguuuggcuaacaucuaacaaacauugaaauucuggaggaauacuaugcgagucgugagugguguccgaaagcaaagaagacaguguaguggggggacaguguagaaauaaagaauuauuugcugauuuaaggacaaccaauaugagaaaaggcaauuugcaaagaaaaaaaauacuuuuaaaggauuggcuuuuuuuuuuuuucauguugaaggauugagcacauauuucuauugaggaucuugaguuaguuugcuacuuaaaaugcaaguuccuuauacagauaagguuuguguccuauuuccaaacacauauaaugaguguaguaaagagggaauuucuuuuuuuguuuuucuuuuuuggagauagagucucucucuguugcucaggcuggagugugguggcaugauugcaaccucugcucccaggguucaagcucacugcaaccuccgcuuccaggguucaagcucacugcaaccuccgcuucuaagguucaagcaauucuugugccucagcuuccugaguagcugggacuacaggcaugaaccaccaugcccagcuaauuguuuguauuuuaguagagaugagguuuuaccauguuguccaggcuggucucaaacuuuugagcucaggcaaucggcccguuuuggauuauaggcgugagcuaccuugccuggccugaauuucuugauuugaauaacuauuguuuugcuucuuaguuucuuucuccuuucccaagaggaaaggagaaugggguaaccuuggacccucuuuucacugaauuuuuuuuaaagcgcuacuuauuuuuucucuuuaacuuuucuauauaugaaagugauguacacagaauauauucacugcaaaaagugggguuuauucccuguagugguauaugacuguguuuuacauugaagugugaaaugccccuuaaucaucuuaaguuauauugugguugauaaaauaagacuuuaccaaaucucuuccuauuuuguucugaggaacugacaauaauaaaacuguuuagggaugugguuuugagggaauuaccuaauguaugacucugauucauuuucccucacauugccaauuacauucuacaaaccagucaucaauaaaauaaauucuaacgguagaaacaaauucuacuguuauacagugagcauagccuaggucgucaugagagaggauuagcaggccuugacgccaugauaaggaacauuuuuuucucuuguuauacuugaagagccagaagccaucacauaauauuuaaggacauccaaguauaagcaauaggaguaaguuagagcuuuuuccucuaacauuguauuaugaaaaauuucaaauguacagaaaaguuuaaauaauuuuacagugaauacucauguccaccacuuaagauuccacaauuaacauuucacuguauugcuuuaucacaugacuauccaucuagcucucccucuauccaucugucaauuaauucaucuuuuuuuggaaaguauuucagaguacguuguagacaauaauacacuuuuccuaaaaccuucagcucucgguguacuaacuaguauucacucuuugcuuuugguucuuuuuuucagagauaaaauuuauauacaauaaaauaugccauuugaugaauauugacuaaagcaauugcacaucuauacaacgcaaaucccuauccagauauuuuuuaaugcuuuugacugcaagaaacaaucagcuuaaacuguugccuccuauaaguggaaguucaggagauacaaugccuuaaaauuuaauucauucucugcaauucuuuugguucucucuuguagcuccuucaugugccagcucuuuuauugguuggcuucaucuuccagccagugguagaacaggaaugucaggccucauauggcuuguaauaacaucugggagaaagggaaguauuuccauucaggacuccaaucacaaguccugagguucacccugacuucguugguuaggucacaugccuauuccugagucggugggauuguagccaggggaggggaaugacacaagccaagggggcaucucccccaguacacacacacagacacacacacacauacacauacacauacacacacagacacacacauauacacacagauacacacacacagauacauacauacacacauagacacauacaggagucacuccacgauucacgcacaacccuauucuaccacuuccagaaaaacugcgcugguuaauauaauuuucugcuauuuugagaaagggaaaaacccacuaguacauguuguuuugagaaaaagaaaaauaguguaacaaauuagaaaauacuccagugaaaagacaaucuuauuucuuugcaaauguaaaacuacgaugcgggaggucaacacugugauaguaauccuuaaauuuauaauagacaacuauauuucagcuaauuuuaugagaauuucuuuuaaacaaacccuauuuuuggcaaaugauaccauuucuucacuugcucagcucauauuuacucagugccugcuauuugucgggcaucucaguacuagcugugagagauaccaagugaaauaagagaaggcuuuuauucuugagcagcucaaaauguauccugcccaguuuuaccaaguguguguacuaaguggaauucaugaccuaaaaccacauuauauuaaagacuauggagaaaugguuauguguuuuuaccagucccuuccccuuccccuccccucccccuccccuccccccccccuccccuccuccccuccccuccccuccccucccuucccuucccuucccuucuuucuggaguuuuacucacucugucgccugggcugggguucaguggcauaaucucagcucccugcaaccucugccuccaggguucaagugauucuccugcuucagccuacuaaguagcuggggauuacaggcaugcaacaccauaggcucuuuaucacuuauccuagguuuauggucuuaagcccccuuacccugcacuccuuuccccucccccuauccccauccccucccccccuccccccucccccuccccccuccccucccguucccccuccccuccccuccccuccccucccuuccccuucccuuccccuucccuucucuucuuucuggaguuguacucacucugucacccaggcuggaguucagugguguaaucucagcucgcugcaaccucugccuccaggguucaagugauucuccugcuucagccuaccaaguagcugggauuacaggcaugcaacaccacgcccagcuaauuuuuucauuuuuaguagagaugggguuucaccauguuggccaggcuggucucuaaccccugaccugaccucaagugauccgcccaccucagccuccccaagugcuaggauuacaggugugagccacugcagcuguuuuuguuuucucuuucuuucuuuguuuuguuuuuuggacacauggucuugcucugucacccgggcuggagugcaggggcaugaucacagcacacugcacccuuaacccuacccgcucaagugagcccccugccucagccucugaguagcugggacuacaggugugugccaacacaccuggcuaauuuuuuuaauuuuuaguagagucgacaucucacuguauugcucaagcuguucucaaacuccugggcucaaguaaucuucccaccuuggcuucccaaaauguugggauuacagaggugaaccacuguacugggccucaguuauuuauuuuuuuuuacuacaacaauuaauuuaaaauguuauuuguuuuauuagaaagagaacaaagagaacacaacaucauauuuuucuccuucuaggagaaacaacuccuccaaauagaauaaccaagugaugccacacucguagguaacuauguuucuucugaaauuauacugcuuccuuagaauuaugauacuauacuauuagaauugucauauaucaagcccucuccuccccugccuuuagcucucgacuuggcagaagugucgaaaagcuauagaaaagauuggauuauacauuuugaagccaaaaguugacucaacaguggcauaaagggcucugucuuccuguugaauucugggcaggauuuuucucagugccucaucacuaguuugauaaacagucaacaaucaacaaucuugauggauaaacaagaauucuuuauccaaggcuggcacgguggcucacgccuguaaucccagcacuuugggaggccgaggcaggcagauggcuugaggccaggaguuugagaccagccuggccaauauggugaaaccccgucucuacuaaaaauauaaaaauuagccaggugugguggugcacaccuguagucccagcuacucaggaggcugaggcagaagaauugcuugaaccugggagguagagguugcagugagcagagauuaugccauugcacuccagccugggugacagagcaagacucugucucagcaaaaaaaaaaaaaaaaaaaaaaagacuucuuugucuguucauuuguauuuguccugagguaaaaucaauuuuaugaagggguguauaucauauaggagugggaguugggagaaugccugggcggaaaagggcaaaagcacauauuauggaaaucucaugucucauacauuauucauauaaugaauuuauuuaaaaauuuguacacaauaacuuuaauaaauauacugauaauucaauagauauaaaaacugggaaacauuaaaaugaaguuauucaaaaucuaaggguggaggaguuagggaguauugaagauguuaucaggcauccuuggcaaagaaggacacuuaaaaaaguaagucaugcuucuaacacaagggaagauaacugucuuagaaacuuccacagaagcugggugcaguggcucacgucugugaucccagcacuuugggaggcugaggucggaagauggcuugagccuaugaguuucagaccagccugggcaacacugggagaccccaucucuacagaaauuuuaaaaauuagccagguguguuagugcauaccugugaucugagcuacuugggaggcuaaggugggaggaucacuuaagcccaggaggucgagacugcagugagccauguucgggcuacugcacuccagccugggugacagagcgagagcuugucucagaaaggaaaaagaggagaggagaggagacgggaggggagagaagggguggggagguggggaggggacgggaggggagggaagggaaggggaggggaggggaggauggggaggggaggggaggggagaggaggggaggacaggggagaggaguggagaagggaaagcagugcagggcaagggggcuuaagaccauaaaccuagaauaagugauaaagagccuauguugugggaaaccaggccagaauugacccuuuagcuucuggguugcccuucugaccuaacaagcuuguggcaguagcucaguacaguaugaagucuucucaugacuuuuagaugaauuugggacaaaaaguuagaggugaugauaaucauuguagagaagugaucaaggugucuuuuuuguuguuguuuuguuuuguuuuguuuuguguuuuuagacggagucucacucuguugcccaggcuggagggcaguggugcaaucuuggcucacuggaacaucugccuccuggguucaagugauucucgugccucagccuccugagaagcugggauuacgggcaugggccgcuacacccagcuaauuuuuguauuucgggucaagacaagguuucccaggcugaucuugaacuccugaccugaagugauccacucaccuugaccucccaaagugcugggauuacaggugugagccaucacgccuggcaagguguccauuguuauaugaguuuuuuuguuuguuuguuuguuuguuguuguuguuguuguuguuugagacagggucucacucugucacccaggcuggagugcaguggcacaaucuuggcucacugcaaccucccucucccagguucaagugauucuccugacucagccucccaaguagcugggauuacaugcgcccgccaccaugcccagcuaauuuuuguauuuuuaguagagaugggguuucaccauguuggccaggcuggucuugaucuccugacuucaggugauccacccaccucggccucccaaauuguuaggauuacaggcaugagccaccgugccuggccuauaugugaguuuugaagaaaugcgacaauucagucauuuguuaaauaauagugauagcaauguugucauguccuauuuuaugcuuuuauauguacauuauuuccuugaauucuuacaauaauuuuauuaucuccauuuuaaaauggaagaaaccaaggcaugagcaacuugccauggucacacaugugguaaguaugggagcuugguuuauugguuuugaauccaggccucucagaauacauacauacagcuguggaaguagcccuguaaaauaucaagaaguaaggcuuauucuguuugccuucgggucacagucuaagcaggaugggaaggaggaaaagacauaugcauuuagguacuaauucaaaagggcaauauauagaaugguuuaaacaauaauggggauuucuuaagcuuauguaacauuaaauuucaggagaggguuugaucagaauuucaggucuauuccucccauccaaguacccaggcuggagggcaguggugcaaucuuggcucacuggaacauccuguggacaggccuguaaucacaggauuacaggccugucccugcuuagcuuccgagaucagaugggaucuggcacguucagggugguauggcuguagacucggucuauuucucuuaaauuuccuugauucuacucugagcuuucacgaugucuucaugaagacuucuuuuauagucuuacaauggccacccgcagcaaucaagacugaagacggggcugucugccauucaccauccacaaaaguugugagcucugaucuuuuugaaucaucuuaacucacagacccacuagauauuaaggcacagcaauguccuucauugguugaagaaaauauuccauagaaaaagauacaggcugagaaaacuuaggagauguuaguguacauuuuguucuuuacuacuuacaauguaauuguccugguguaaaccuccucaccgugaggacggccuguucaucaugcucacuccuucaccccaaaccauucccuuacuuggaagauaugccugucccccccagcaaagauuugcucaguaauaaaguaaaauagagcucucaacauaugacugaaguggcaauuggcuuacauucaaauuucauggaaugauuuuuguauuacuugaguuuugaugucuuuccaagaaacaccuccacucagagagagucccagccaaagcuguauaaaagucaucucuuuguauaagcaaagcuacuugaggaauaauuaagaugcagacuucugggaaaacugcaaaauguucuuuacuugcauaacucaacugaguaaaggucuuucaggucauguguuucaauauauuugucauccccucagccucuguuggagcuaccuuuguuuuuuuguuuuuuguuuuguuuuguuuuguuuuuugagacagagucuggcugugucacccaggcuggagugcaguggugcaaucuuggcucacugcaaccuccaccucccggguggaagcaguucucccacuucagccucccgaguagcugggacuacaggcacgugccaccacgcccagcuaauuuuuguauuuucaguagagacgggguuuugccauguuggccaggcuggucucaaauuccugacaucaggugaucugcccgccuuggucucccaaagugcugggauuacaggcaugagcuacuauaccuggccuggagcuaccuuugauuaucaaggugucaauauuuuucuccacuauuaauaagauuaagcuuauaccucaguauaucauugcauugacauuacaacaguaacuuuggcauugauuuuguacugcaucuuaccauaaauauaaguaauaguaaugaauccaaauaaaagugguuuuaugcucagauaauacuguaugaguuuagccuuuuauucuaugaaauggguagcacguguccacaugcagcaaaccuuuuguacucauguacugacaaggaacugugauaugaaaagcaugauuuuucuuaugccuguguugacuacaaaagagagaagcuccaguuaaacccauugagaagcaucuaugaaauacaagaagcugggcuuggagccaacacauuugucuacauguucacuauuugcugagucugcgcuaaugagagcuuuaagccaagaagagcagagucugauuacuaaggacuuuauuauaauuuuuuuuuuuuuugagacggagucucgcccuguugcccaggcuggagugcaguggcacgaucuuggcucacugcaaccucuguuucccagguucaagcgauccuccugccucaguccccuuaguagcugggauuacagacacacgccaccaugcccggcuaaauuuuguauuuuuaguagagacgggguuucaccauguuggccaggcuggucucgaacuccuguucucagguuauccaccugccucggccucccaaaguccugggauuacaggcaugagccaccgcgccuggcagacuuuauuauaauuuacaauuacaucuuucaagugaagguauagugguuaggggcaggaauucuuuagaaaccacuaucccaaugcaccaggauuuauuaagccauuucauuuaucaugggacaaaaaguuauuugauuauuuauaugcuuaauuaaccaggggaaaucucuucaauugucuuccucugcuuugggugguuauucagcugcuagauaauuucuuucccuaaaggggaacacagagaaggagaggaaguugguuuggcuacuugucagcaguucuggaagaacguuuauucagggaggaguuugaaaucugugagaauuugggcauuaucuggacauuuuugguuccuucauguuguuccugucuaucuguagucuaugauuuccuggaugaagccagacuuacugagagugcaugaaguugguggaugaaucucauaaagaucuucucuccuaggccaggccugguggcucgugccuguaaucccagcucuuugggagaccgcaguagguggaucacuugacgucaggaguuugagaccagcuugaccaacauggugaaacccugucuuuacuaaaaauacaaaaauuagugggugugguggcaugcgccuguaaccccaacuacucgggaggcugaggcaggagaauugcuugaacccagugacagagaagacuccgucucaaaaaaaaaaaaucucuccauagguucuugagauucagaacacuacucugucaccuguaacucugcuacccuaccaguguuccuccauugauucuccagccucugccagagaaaacuucuaguggccagaacucuaucucaucuucgugaacuucuaaauagacagguguugagggaaaggccaccaucacuaugguagucauacuaacgggaucuauauacuuuuggggaaaucauugcaaucuuuauuaacagcuugugugaaaggaaauuuuauuaugauauuuauccucacaguuguuuuguuuuuugauacaaggucuuccuuuguugcccaggcugaaaugcuguggugugaugauggcucacugcagcauugacuuccugggcucaagcgauccuuccaccuuagcuuacccuugaguagcugggacaccacacccagcuaauuaaaaauuuguuguuguuguucuugagacagggucucacuauguuguccaggcuggucucaaacuccugggcucaagcgagccucccacgucggccucccaaggugcugggauuaugucuuuggugugaaccacugcaccuggccucuaauaguucuuuuuuauuuauuuauuuauuuauuuauuuuuugagacagagucucgcucuguugcccagccuggagugcaguggcgcaaucuuggcucacugcaagcuccgccuccuggguucacggcauucuccugccucagccucccaaguagcugggacuacaggcacccgccacuaugcccggcuaauuuuuuguauuuuuaguagaggcaggguuucacuguguuagccaggauggucucgaucuccugaccucaugaucugcccaccucugccucccaaagugcuaagauuacaggcgugagccaacgcgccuggccucuaauaguucuuaaaaguuaguaauugaauuuacuauuauuaauagaacauagccacaguuaguuaauaugccuggagaauccugggaauuggacuuucauagaaaguucgguauaguauguaacaaagacaauacuuauuuauaacuacccuggggucuauucagaaucuuucucaaagguuacaucugaaaaaugcaguuugucacuuaaaauuugcauacauuagaagguagacauuuguaccacacgaggccauguggcuuugggaaucgaaucugugugacaugaaaugcauuccaugguagaacguugucaaagugagguauauuuuucucacagggcagauguuuucuacuugaagagccccuaugucccauuugauaaucuuccuggauaaaggucaaggugauugcaggccugucucccccucuccuucagacuuucaggaauggaaaguguaagcaauaguugaaaccugaaagagaaguacaacuguaauugcuggacucauuauucuagugacuuaaaaguaugggugcccuuccugcauugagccuuuuaguaccuuguauagacuuccaucagagggucuacagccuugcacauuucuguccuguuuguguggugaaguagauaaaggugaauaccacaacauuuuaugguccagauuaaggaacagcuuaacugggcacgcauaaauccaaaggaucagcaagaagggacgugcaguccucuguccucuuacuauccuacaaugaguugggcagguacaucaaccugucuggccaagcugcauguuucuguuccucaggggguacccuaucccucugcuguaguauaagcaugagaauggcugaauggcuuuauuucuggaggacaaguauuuugaacucaggcacagaagagccuugggggcuugauugaagcugcaguuucugcuguggaaaggccaggcuacuagucccagcccacccacagccuagcagaucaagcugagccucugaggucacauccaccaauuccuugggucccuccucagcuggcaugucugcacacuuuccaaggugagguaugguguccuauucauucauauauccagggguuccugcuuaaaauccaggaagaggcauaccauuauuuccaugguacaaaugcauuuugacuuacaccgaugcuuugaaaugaggacuuuaaacuuuaccuuaucuuauuagauaaggauguuuagaucaaagguuaaacuagguuauuuuuuuaaccucuuacucuuuuuaauuguuuaacacuuuuuaacacucuauuuuauguccgccaagauacauggcuaauuuauuccuugggaguagguuguaaauuuuguuauuaugcuauuuuuuuugcaguauuuauggauuuuguguuauguagauuuucuuucaaccuucucaauaaauaguaacaacaauaauaaaaauaaaaaccaguauuuauugaaccauacuaugugaccaguaguggcaugcaguuuauuugaacaguaucauuuaauccuggaguaaguaucauuagucccauuuuagaaaugagaaagcaaaggcuuagaaagauuaagaaacuugcccaggguuacaaggugagcaggugggagcugggauugcagcuccaguuucccuccaaaggccaugcucuuugaugguugaggacacagcugggcucagcccuaagcuguuggaguguggcggucagaggcggagaugccccagcuauuguggacauggagccuggaccuuugaacuuugacuuuucuuuguuucuuuguguuuuuguuuuguuuuguuuugagccugagucucgcucuguugcccaagcuggagugcaguggcaucaucucagcucacugcaaccucuaccuccuggguucaagugauucucccgccuuggccucacgaguagcugggauuacaggcaggugccacugucuggcuaauuuuuguauuuuuaguagagacgagguuucaucauguuggccaggcuggucucaaacuccugaccucaugcaauccuccugccucggccccgcaaagugcuaggauuacaggcgugaaccaccgugcccagccuugacuaaucuuugaauauuugugucuguguugggcaaaaauuaaacuuacauagaugauaauaauugugucaacuacauauauggaaaugauuaauaacaacauuaauacaucacaaaugaagaaauauuuauuaauaaaagcuacaaaaacuuggguugguugcaugaauaauuauuuacuuauacuauuauguacgccuaauuaccagacaacauagugaucaguguauguguauauguacacauauaagaagauaucacuauggauuauaauuaacuaaaaauauuagaaguucuagaauaugaguguaguugguuauauuuuagguucucgaagaguuucuaugacaugaaacucuagaaaaaugcauauccccagacuggauguguuuuacacauaagggauagauuauccaacagaauuucauguaaggaucauuaaaacauauuccaggucgggagcgguggcccacaccuguaaucccagcacuuugggaggccgaggugggcagaucacgaagucaggaguucgagaccagccuggccaacauggugaaacccugucucuacuaaaaauacaaaaauuagcuggacaugguagcaggcgccuguaaucccagcuacucgggaggcugaggcaggcgaaucauuugaaccugggaggcagagguugcagugagcugagauugcaccauugcacuccagccugguugacagggugagacucugucucaaaaaaauaauucaaaaaauuauuugguauauuguaguauaagagcuuuucaagauauuucucgauuucuguaagcacuggauaauuaauucaagacccucccacuuucuuuguaggaauagaugaggcaauaauuuuaugacuauaacugaauuuuuucacacaagaccuugagauuugguagaaaauaggaucuguuugaucugcuugccucggccucccaaagugcugggauuacaggcgugagccaccacgccuggcccuuuuacuguucuauaaaauaagaagaauaaaagggguauuugagguacaugcauuugaaguucuuagaaugagaccuagcauguaggaaacacucauuguuaguugcuccugcuauuaauaguaguaaauaggucaacaugacucaguuaacauucaggaaguaacuuuuuuucaauuaugaaaugaagauguacaaauauucauacaucauuuuaaauguagagauguuuaaauuauagaugccaaugugagggauaggcaacaacuauggcuaccuguauaauaaaguuuuacugaaacacagucaugcccacugauuuacguauugucuacaacuacuuucaugcuucaacaacagaguuaaguaguugcaacagaaauuguguggucuccuaagccaaaaauauuugcuaucuggcccuucauagaaaaccuuugccaacccuugguguauaucuaagaaagaaaagauguguguuguguacgugugugaauguguuucugcgguuucuauacgguuaaacuaaggaacauuuacuagaaauuguuggcauucucccaaacaagagauuauaaauuuauaaauugauuuugaaagguuugguguugauuaugauaauuuuaauuuuaaaagccuuguauugggcugggugugguggcuuacguguguaaucccaagaacguugggaggccaagaagggcagauugcuugagcucaggaguucaagaccagccugggcaaugugaugagaccccgcuucucccaaaaguacaaaaaauagcuuggcaugguggcaugugccuguggucccagcugcucaggaggcugaggugggaggaucgcuggagcccaggaggcagagguugcagugagcugagauuguaccacugcauuccagccugggucccugucucaaaaaaaauaaaaacuaaaaaaaaaaaaagccuuauauuuuaggaaagcaagcuuagggacauugugauaguuuugaucaaggguaaauacuucacuuaaauaguuagccacauagaacccuaaaucauuuguuuucuaguuauuuuccccucagcauagaugccuaccacuuauuucauugauacagaagaugacauuaaaaauauaugugccacuaaggacuaauggguucucucugugcagccugugccaaaaccccauauuccuuuuggugaaauucauaugagaccacauguauuguuguuuuagccaaauguggaauacugacuuaauuuucucccaucgcuuuuggugaacccucuaucagccacuauaaauuuaaaaguaguauuguagauagaaagucauacuguucuucagcuuuucccuauccuguaauagagugauuuauucauuuugucauauauuuaucagcugcuuguuuuuguuaauguuaucagacuuccucauguuaugagacaagaaauuacuuuagaaaccuguuauuuagcuggauugcacuuuacuaacacaggagucucuuucgauaucuuuuaauucuuguucuuugucucaggauuuuaucuaggagcugaaugaaggcugaagaaggaauuaccugcucuucauucauuuucauaucuucuuuaagcgggaaaaguuguuugucaauuggacccaaaaggcaugcauacauucauucagaugcuaaacauagacuuauagaagguuaaugccuuaaaucugugcaagaaucuauguguauuuacaaugguagucaaaaauuucaguuaaauaaaguaucugcuuucugagaugaguuuucuggcauuggcaauuggaaugguuuuuguuuuguaaaacauuuuuuuaaaaaucacaaucuguuaugagacaaccauaauuugugcuccgugaaucacuacauagcucagagaaacucgcaaaccuauuucaagaucgugcagucuucaucauguagaaguucuuaaaugucucuggaaauaucuuaccuaucuaauuuuaaaugcuucuagcaguuccuaugcuucccuaaugagacuccugagcauagucacaguuauacaguuauguuuuucugagcuugguuuuuuagcuuucccuugaauuuauaagagccucuauuuccuuucaguaaaguuccucuuugcuuaaauuagccagaauuuguucuuguuucuuguaaucaaagaaccauaauuaacacagagauuaguaccaggaauggguaaauauaaauucuaugugacaaaaauuauagaugucggcugggcgcaguggcucacgcuuguaaucccagcacuuugggagacugaggcaggcagaucauaaggucagaaguucaagaccagccuggccaacaugguaaaaccccgucuuuacuaaagauacaaaauauuagccaggcgugguggcgcacaccugcaaucccagcuacccgggaggcugagacaggagaauagcuugaaccugggagguggagguugcagugagccaagauugugccauugcacuccauccagccugggcaacagagcgaggcuccaucucaaaaaaaaaaaaaagaaaaaaaaaaaaaaacuaaaugucuauuacacaccccucaccuuuuuuuuuuuuuuuuuuuuuuuugggagacagggucucacacuugccuaggcuggagugcaguggcaugaucauagcucacugcaaccuugacccccugagcucaagugauccuaccaucuaaggcuccugaguagcuaggacuacaggcaugugccaccacaccuggcucauuuuuaauuuuuuuuuggaaugacaaggucucacuauguugcccagguugaucuggaacuccugggcucaagugauccuccuggcucagccucucaaaguccuaggauuacagaugugaaucagugcaccuggaccuuacacuuuuuuuucuuuucuaaaagcacaaagacagagcuauuuauauuaaaguauugccugcuacaagguauaagcaaaggcuaauucugcuugauauagaauaaccaucuuaucccucacauuuguaugagcucuaauacccaaaaauguuugacuucuaacuacauuuguuauauaaauggcugaauguuauucuauuuuugcaacucccacagcaucuucacucuucuaggcauagaguagaauauaaauaaaugugaaaugcauguugauugaucccuaguggaaaguaaaauugcuuuuaguuucaaagcauugaaauuucauucuccucuuuccuuuuucaaaaguaggaagacucagagauuuuaagaauugaaucucucugugcuuuggaaucuacauugggaguaagaagcagaguguuuguacuuaauugauuucauuugguuguuugcaguuucagaucuaugcauggacgaggauauuuaugcaauucucucaugagccauuaacuuucuauuggucuuuuuauguuucagucugucacuucagugugcuauugaaacugcuaaauauuuagguacaaacacaaacucccauuucagaaucagcugauuauauaauugcaggugagaagaugcacaaacauauuaauauuuuuagcucucccugaugcuguuagaaagauaugauaauuucagccaggcgugguggcucacaccuguaaucccugcacuuugggaggcugaggugggcggaucacgagaucaggagaucgagaccauccuggcuaacacagugaagccccaucucuacuaaaaauacaaaaaauuagcugugugugguggcaugugccuauagucccaacuacuugggaagcugaggcaggagaaucgcuugaacccaggagguggagguugcagucagccgagauugugccacugcacuccagccugggcaacagagcaagacucugucucaaaaaaaaaaaaaaaaaaagaacgaaagaugugauaauuucacucucauugauucacagcagcuauuuguugauggcuccaaugcuuucugaagcaauggacacaggucauacuguuagccuuuggucuguagaaucacaaggaacacuugcugggugagaugaaaauguaaggaaauuccacuauuucuguauuucuguaacaguuuuccuuuccuuauuuuauuuuauuuauuucuuuuuuauccuuuuuaaacuuuuuuuuucaauuuuccuuuucuugauuuuauuuuugugcuaagugucugugauacauauuaugaacauccgcuaacauuuacacagcaucuuauauuuuggaaagagauuuuauauacaccauucugcugauccccaacauccuacugacccuuaauccuaugagcagagaggaaccugagugauuauguugauucccaauuuagagaugaaaagcuuuacgugaagucuuguaauacuuccuugcucaauguuguguccccaggauuugguacaaagauggguauacaauagacaaggaauaaaaaauaugcuaaguggcaaaauaaauggagcucagagagaaacuaagugacuuggccaugggcacacaugacuaagugauggagacugcucagauuuaggauuuaggauuuuuuuuuugagacagagucuuacucugucucacccaagcuggagugcaguggcacgaucucagcucacugcagccucugccucccugguucaagcgauucuccugucucagccuccugaguagcugggacuacaggcaugugccaccacaccuggcuaauuuuguauuuuuaguagagauggcguuuuacuauguuggccaggcuggucucaaacuccugaccucaggugauccaccugccucggccucccaaagugcugggauuacaggugugagccaccaugucuggcagauuuaggauuuuuugacuccaaguuucauaguuuccuaaugcuuaugcucgaaagaggacaacugaaguaguuuauagugaugcuaagagcuaaaguaaagaaauacauuugaaaucuuaagaugcagauuucuuaaguuggaugaggaauuauuuucagcuaaaauuaaguuguauaguucuuauguguucaaggggaauuuuuuaaaaauaugcaaaauuggagagaacaucuugagggucgugccacuuuggaauuuagagugaaucaucaaauuucaggguuuuuagacacgaaagaaccuguacauuuggagacaagacaagugaaauguacuaaaauugugugcuccgugagggcagggucuaugugugucuguuuacuacucuaugcccagugccuggcacagugcccaauggacagcagugaaguaggaguucaaguaauauucguuggcugggugagguccuguuuuuuugagauagucuugcucuguugcccaggcuggagugcaauggugcgaucucagcucacugcaaccucggccuccuggguucaagcaauucuccugccucagccucccaaguagcugggauuauaggucccugccaccaugcccagcuaauuuuguauuuuuaguagggaugggguuucgccauguuagccaggcuggucucaaacuccugaccucaggugauccacccaccuuggucucccaaagugcugggauuacaggcgugagccacugcacccagccaaaaauacuauuuuuuugcccuaaguuuguugccauaagucacuccuuaaugagggucuuccuaaagguuacucaaaccuugcaugguugauuaacauaccaucuuuaugucaucaacauagugaaguuguugaaacuuaggcuggaggaaacagcaaugaucuaauccagcuccuuuaaaggacucuugcuuggccaucugauuugguauuagaucagggaugagaacugacagucuuggucuccuauuucgucaugucaacuaugagaguacuuauggggaauccagacugacuccucuggagaccgaguggccucugagguaaccuacagagacugagcaggacaugaggcuuacagcuccguccugggcuccuuucugcucaguccugcaggcaucuucacaggacugugccacccaaacacagcauuuuucugcauuucgaauuuggucuucccagcuuuaccagugcuuagucucaaucuuuaauucaagauugaaacugggcagcccucacugguaaauuuaaaauguguagcauucccaccucccuucuguaaauguuauuccugacucugggggccaggaguugcuauucugacaucuugagccugaacacucuuccccaccccaaagugccucuaucccuccacaagaggaggaggaaguaaaaggcacucgauuuaauuggcugugugaaaccucaguucucucucucuuuuuuuuguuuuuuuuuugagauggagucuaacuccgucucccagguuggaguacaguggcacgaucucagcucacugcaaccuccaccucccagguucaagcaguucucaugucucagccgccccgaguaguuggaacuacaggugccugccaccacgcccagcugauuuuucuauuuuuaguagagacaggguuucaccuugugggucaggcuggccuccaacuccugaccuaagaugauccacccuccucagccucccaaagugcugggauuacaggcaugagccacugcgcccggcguaaaccucaguuaccuuuaagucaauugcagguagaaaaaacuggauacauuuuuuaaaaaauuaacuuuauuuuuauauuuauuuauuuuuuugaggcagagucucacucugucacgcaggcugcagagcaguggugugaucuugacucacugcaaccuccaccuccuggguucaagcaauucucccugccucagccucccaaguagcugggauuacaggagugugccaccaugcccagcuaauuuuuguauuuucaguagagacgggguuucaccauguuagccagccuggucucgaacuccugaccucaggugauccaccuaccucggccucccaaagugcugggauuacaggcaugagccauuuugcaccccgccuuuauuuuuaagagaccagagucuuccucuguugcccaggcuggagugcaguggugugaucauagcucacuacagccucaaacuucuaggcucaagugauccucucaccucagccacccaaguagcuaggacuacaggcacacgcuaccaugccuggcuaauuuuugcuuuuuuuuuuuuuuuuuuuuuuuguagagacagagucucacuauguugccuaggcugguuuuuaacuuuuguccucaagcaguccuccugccuuggccucccaaagugcugagguuacaggugugagcuaccaugcccagccagugaaugcaccuuuuaccuaaacugugagucuucuaugugccaggcccugugcuagcccuugauggcaauaugaaaaccauuggaaucuuguccgcaagaagcucacagcaugagauuccagacagcuacagccagagauagaaauguggacagacaauuacaacccagcaugagaauuucugcaauagaaggaugugcaaggugcaaugggagcuccggauggaagugacagacuaccugggagagugagauagccaagacuuccugcagcaggugacagcugagugagguuugaaguuugaagguguuuuuacuaggagugcagugcaggaagggagaagcaccauacagagacaagagcagguggaaagaaagguuugaaauaacaugacauguuuaggaaaguugaaauaguccugucgucuagugguuuuugauguuucugauguuucugcuugcccaucucuuaucuguaaaaauauuuuaggcauagauuuuuccccaauaugggcuuuauaugggcuuuuuuuuuuuuuuuugagacagagucuugcuuuguugcccaggaugaaguacagugaagugcagugguaugaucucggcuuacuacagccuccgccucucagguucaagcgauucuccugccucucaaccuccugaguagcuuggacuacaggaacaugucacuaugcccagcuaauuuuuguauuuuuaauggagaugggguuucaccauguuggccaggguggucucgaacuccucaccucaaaugauccaccugccugggucucccaaagugcugggauuaaaggcgcaagccacugcacuuggccaauuuuuaaaauguuauuuauuuauuuauuuuuacagagacagcaucucgcuauguugccuaagcuggucucgaacucgggcucaagcaggccuccugccucagccucccaaaaugcugggauuauaggcaugagccacugugccuggccuaauguaacaguuacacacauguacuacuauacuaaugcacucuguauaucauaaauauacacacacacacaaauuuugccgggugcaauggcucacaccuauaaucccagcacuuugggaagccaaggcaggcagauugcuugagcucaggaguucaagaccaaccugagcaacauaaugaaaccccaucucuacuaaaaauacaaaaaaaaaaaagccggguaugguggugcaugucuguggucccagcuacucaggaggcugaggcgggaagaucacuugagcccaacugguggagguugcagugagccaagauuaugccacugcacuccagccugagugacagaaugagacccugacucaaaagaaaaaaaaaauuaaaauccuuuuaagaaaaaguauagauaugcugauauuuucuagcugugcaccaaugguuggucuuaggccccuccuuuauagaccacucuuaagacucuaagcccugugagagaggccaggccugucagauucacugcuguauaccccuugucuagcauuacuaggcacccaauaaauauggauuguuggagugaguuugauuuucccuauugcuggaccauaagccuaaagugauggcuggugacaaauguuuauagacuuuacugaaggaaggccuucauaggauuucccagagcucuaugcaggacaccagagcuuugauuuugagcucuagcccucacuguuuaucuuaggguagucaagacccucacauaauuucucugugucuucugagagcauucgcguuguucaucagggccaauaguauuccugugcauuacauggugccuguggugagugauuaauaaaagggauauugugacucucuuggcagggaugaaaggacugucaacaugguaaauagcccuuguauaagcaggcgaagagaaugaggcuauucuuccucccaccguggcucuuacuggugaugauuacaacaccaaaagcauauuuuucuguuugacuuuugaauccaggggucuaugauguuguagcaacaaaacuguuuuuuucacauggcaacaaaacguaagaucuggcccaugacacuaccuuccuacuaauggauggauuggaacaagguugagggguaguguuuugugugaagugcaauuaacauuguauuacagauuaauuugagguuuuuaagaaauauauggggcacagauuucuucacaaaauuucaaagaaaccuagauauuuuuuuaaaaaauauuuucuucccagaaugauuuuuaaaauacauaugccuacggauaauauuuuauguuuaguuaaucagccuauaaauauuuauugagggccugugggaacagcuuuugcuuguacuaaaaucaagaaauagaaagaaauagacaccaugauuccugcccuuagggagaugacuuuuuagguagagaaagaaaauaagggccagugugguggacuuugggagaccgaggcagguggaucaaguuugagaccacacuggccaacauggugaaaccccaucucuacuaaaaauauaaaaauuagcggggcgugguggcgcaugccuguaaucccaguuauuuaggaaguugagacaggagaaucccuugaagguugcagugaacugagaucaugccacugcacucuggccuggcaacagagagagacucugucucaaaaaacaaaaaaaaagggaagaaaauaagaauccaugaaucaauggagggcaauugaguuacugugauauaauaugaaauauauuuagucccugguuccucacagagcuuaaacucucagaauuucccaagugauaagagugucuauuguuauaauaagcccuuauuagcacaacugaauuuauguuaauaaagugacucagggugggacaccuagcuagccucaugaugaggcuggccaucagaaagaccaagugauuagaggaugagaggguuggaacuuucaaccccacccaccaaccacuaggaaaaguggaggccgaaggaguccggagaucaaacuguaagacucuugaacaaugagauuugaugagcuucugaguugcugacauguguaggugcugggaggguggcuggccaagagagggcauggaagcucugugucccccuuucuauaccuugcccuauccaucuccaucuggcauucaucaguauccccucuaauauacuggauaaaaaaccaguaaaugggugaggugcaguggcucacuuguaaccccagugcuuugggaggcccaggcagaagcauggcuugaggccaggaguuccaggccaguuugggcaacauagugagacccugguaguacaaaaaaugaaaaaaaaaauuuuuuuuaaccaauaaauguaaguaaguguuuccaugacuucugugagccuuccuaacaaauuauuugaacuuguggaggagaugaugggaaucuugauuuaaagccagucaguuaaaaguacaggugacugccuacuacuugcaauugguaucuggagugggggcagucuugugggacaaguguagcugggacuacaggcaugcgucaucccgccuggcuaauuuuuguauuuuuaguagagaugggguuucaccauguuggccaggcugcuugcagcucuuuucuuaaaacaaagaaauugaggacuugaguugcuauugaaucaagcuguuugucccugagcuucccuuguguaaucagugggaaaauuacaagucugauaaaugcggacugauuuucuggacauuuuacaucauuggaaaaauaaaucagagaguuaucagauuccuccagggcaaauguaacugugauguaaaucagagucaccaaggaacagagccuuaggcuaaaauagaugccagggccucauuuaaaaaccaugacagccagcccacuaauucucagaacacaaguaucauuuacuucuuggugccuggagugagaguuugucguauuggcuuugcuuccuagcaucucacacaauaacaaaugcuaggauggaaagauauuggagacaggugcaguagugugauuauauuaaauugagaaaagacuuucaaaggcucucuagaaucuuaaugauuuccaaaggguccucuuucagcuucccuaccuugccucugguagccuaauuaauagagugugacuuuuuaguucuugccaagugccaccccaguucaaaugacagcugucaggagaaugcgacagauaacugaugaaaucuuuaguuaccuagcuaucuuuagaagacacugucuuuggcuuaaugagugcuguauuuuauaaguagccacagguguuuggcacccugucagcauucuugggacucuaaauagaguuaaauuuucugucuuuauauaggcaucagcaggguuugaacaccugccuaucuaccauagcaaaguagaaaguuacagagagaaaacagagccuuuaggguggcaugaaagguguaaauaugcaaauuaacucuacagauaaaaccauuaauguaaacaauugcaaaccaugcagaaauauuaauaagacuaaauaugcucuuucaaauaugaguuuugaugagugaaaaaucuuaaguucuagauucuguguguggccuugccacuuacaaacuauucauaaccaauuccaaucaccagaagugaaccuucuucucaucuacagacaaggguuaaucaucucuuaacuagguuacaugcuuguuugccaaaucaaguuuucgcaaaugagaugcaguauguagagguaauuaauaagccauaaugugcugagcacaugaaauuuggauuuauuauuauguagaaccucauuagguaucagauacauagaacacuggauaaucuggagcuaccaccuaaagucucacucacaccugacauaaauuuccacuuggcuguugauaauggcuuuggcgccucuuguauuuuuuucugauccucaaacuguuuaagugaccuggagauccagauagagguguauguagauauaugaaauuuuaucuaccaaagccucaucauauacaggcauauaccaagaguauucaggggcuacauugggaaacagguagucugaaaauuugacucuaaguauauagaacaccugcaaaagucagagcaccuauguuaagaaagggaaaaugcaaaccuggcauaagccaauauacagauuaccagaaggugcuuuucacuggcugugucuaacagacauagaaaagauuuuccugaggguggucagauaugugaaauagcauuuuauuacgcagcccugggaaacauuuuuguuuucuacauugucaguagugaaauauaaauuuuuaggguuuuugaauuuuuuuucaggccuuauuuuuuauuuuuuauuuuuuugagacagagucccgcucugucccccaggcuggagugcaauggcacgaucucggcucacuacaaccuccgccucccgguuucaaacaauucuccugccucagccucccuaguagcugagauuauaggugcccagcuaaguuuuguauuuucaauagagacaggguuucaccauguuggccaggcuggucucgaacuccugacuucaaguaauccacccgccucaaccucacaaagugcugggauuacaggugucagccacugcgcccagcccccaggcuucauuuuaacucacauucuguuagacauaaaaauaaaucacaguaccaaguguauuugaugucugcauugaguaccaaagauggccuaaacauuugacuacgugaguuaaugaugaguaagggauaguuaacccccaaaaugcuuaauguggagugguuugggaucauuugugacuuuuuuguuuccuagagggguguguguguguguauguuuguguauguauguuuccaucacugcgucugagauuuucaguauucagcauuuuuggugggugcuguuuuaucuuuucaacacagcagagcugccuccacccauugccucacaggacuuuagugaacaggagcaccuucaguguuggcuguuuaucuuugggacugaccagauaccguggccuucuaucaauuucccugcuagcuaaugcucugacuucuuugcucagcuauccauugucuccuggagugcccugugaaccagccugagcuacaccuauccagaccugccuggauccugacagcagacagagcuucagccacagccaggaccaugcuauguacacacauucuuuuuuuuuuuuuuuuuuuuuuuugagacggaguuucacucuugucacccuggcuggagugcaauggcgugaucuuggcucaccacaaccuccgucucccggguucaagcgauucuccugccucagccucccaagcagcugggauuacaggcaugcaccaccaggccuggcuaauuuuguauuuuuaguagagacagagcuucaccauguuggucacacuggucuugaauucccgaccucaggugauccacccaccucagccucccaaagugcuaggauuacaggccugagccaccgugccuggccccugcuguguacacauucugugaagaauaacauguuccuuucugaaggaaggguuauguaacauuucuuauccaguggaacuaaacacacacggguaguccaaauacuucuucauauuaauagaaaggugauggcagaaacauucugaaguccuucucuuccauggacaugacagcuaugaacacagcuaucaaaggaccccacacuagaggcucaagguuugcauucuguacuacacuaugguuuccuucuguccagacugaaacaaagaugaaaauccaaaccuuuauacucacgaagugucauuuacccuaagcccugucccacacauuuugggaaauaugaaagaagaaugagauaguuuuuuacucaucaaauuuguaguauaauugaagagaauuaaugcaaauaagauuaaaguaauacaaaauauuauauagguaaacaugagcauuuuagaaaguagaucauaucuguuggaugaaagaacacaucauggaagaaggcugaggcauuugaauuugguggauaaauaggaaaagagggagagcauauucugaaaagggaguagccuaaauauagggaagaggcagaaaggaaggauugggcuaaaauuggaagaggaaaauaauguuggauagauugaguuuuaacauauuaaggaaacuuugacuggcauacacacacacaauucccuaacauauagaauacaacauuuccauuuggaagaaacaacaccuguuucaguuacauaauccuugaacuccagaaacugggccagcaugaacaguuguuuaagcuaugccagguaugcaguugggaaucaauaaauguguuucgguugagaaauuuuugcaagccccuuaacugcaagcugccuccgcgauagcugcggauguuccugagaacacuucugaagauuugaaauauuuuuaaauccagagaaaccuugucuauucucaaguuauagacgugcaacacucaaagccuguggcacuuuggcagccucagcgucuguccugugaacugaaaauagaugaucauaacccuacacaguguuuguacagcaugcuuagcacaagauucacuuuaauguguucauccuuguuuggaagcccaaaggaaaugagauuugcuguuuugugcucccuggccuuguggcuuacgguagaucuuuucaguacaaaaugugcccaacacaguugguucuauuuugaucuugugugugaggauguauccuagaggcugucaaccuaaaauaauaaaaaggaucagaaucuagcuuuguuuuuuuguuuuuguuuuuuguuuguuuguuuuugagauggagucuugcucuguugccccugcuggagugcaguggcccgauauuggcucacugcaaccuccaccuccuggguucaagagauuuucccuccucagcuucccgaguagcugggauuacaggcaccuaccaccacacccaguuaauuuuuguauuuuuaguagagaugggguuucacccaguuggccaggcuggucuuguacuccugaccucaagugauccgccugccucggccucccaaagugcuggggauuauaggcaugagccacugcacccagccagaaucuaguuuaaagaguguuuauucaagcucaaaguuugaggacugcagcaccaggcacuuccaaguugcacuggggaguggucuggaaaacaaaagagagguucacauuuuuaaggaaaaaagaggacgaacaaagagagggggcaaugacaaaaguuguucaucaggcauuuucacugguuuacagaaauaacauugauuggugauuggcuguacauuguugaacuacaggguguauggcauuuuauggcuacuuagugucagucuauagcccacaaaguaaguggcuucaagagguaauuauuuagcucaagugagagugggaugugacugcuguuaccuuuuaaaugucuuucuaagccugauaauuuaaaggggcucauauuccucagauaaaagguuuuuauuucucgugguucaucaggguguccauaaaaaccugagaaguuugaguugagagauuuuagagauaaagccagucaguuuccucaggaagcugaggucuuaguugggugagaggucuccccaggccauguuaccuaaaccagcaaugcacacucuucaguuagguguccugacuccuccuagagacaacacaggcccuggcuucuguuguuccaucgaggcuuggacaauugucaaguuggcuuaccaugcccuagcgucaccucugugcauccuuucccauccuugucccaucagcgggacaagcccuccugcuuuuccuucuaaaucaugaggcuuccuaguuuaaauuccuuccccaucaaaaugggaauggcuuuaauaccuacccagucuuucuuuucuuuuuuuuuuuuuccuuuuuuguucuuuuuuuugagaagucuugcucugucacccaggcuggagugcaguggcaugaucuuggcucacuacaaccuccaccuccuggguucaagcgauucuccuuccucagccucccaaguagcugggacgacaggcgagugccaccaugccuaauuuuuguauuuuuaguagagacgggguuuugccauguugcccaggcuggucucaaacuccugaccucaggugaucugucugccucggccucccaaagugcuggaauuacagacaugagccaccgugcccacccucuuauuuauuucauaaugcaauguuggcucuguuucauuccaacccccugcguuugcaaaguguggucccuaaucaguaucaucagcaucacccaagccuuuuuuuuucuuuuuugagaugaaguuucacucuguugcccaggcuggagugcaguggcacgaucuuggcucacggcaaccuccgccucccagguucaagugauucuccugccucagccucccuaguagcugggauuacaggugcuugccaccacgccaggcuaauuuuuguacuuuuaguagagacgggguuucaccauguuggccaggcuggucuggaaauccugaccucaggugauccgccugccugggcuucccaaagugcugggaugacaggcgugagcuugccaaucccccaagcacuuuugaaaaaugcaaauccuugggcccaccccaaaucuauugaauuacaaaccguaggagguggggcucagccuucuguguuuuacaagcccuucaggugauucuaacacagucuauuugugagaauuacugcucucaccuucucugacuauaauaguugcagcagucugcagauuacuugguguguauuuuuuauauuccaugagggggugguauauugggcaauauuauuauuuuuuuugagauggagucucgcccugucaccaggcuggagggcaguggcacaaucucagcucacugcagccucugccuccuggguuuaagcaauuuuccugccucagccuccugaaugccugggacuacagccaugugccaccacgcccagcuaauuuuuuaauuuuuuaguagagguggguuucaccauguuggccaggauggucuugaucucuugaccucgugauaugccugccucagccucccaaagcacugggcuuacaggcaugagccaccacgcccagccuauuuuaguuauuauuuaaauaauguuuuuauauuugaucuuucuauauauuuugucuuugucuaaaauugucccugagacuguuucuucucagggaagaaguuuucaguuuccaggacuaaacauuucauggcaaugcagugucuuucucaagagugaguauaaucuggguguuuccagaaaugacuugcagggcugucacaaacagauucuaggcuagcucucucaucagcaguccacucuugguuaaagcacuagauuagcaacuucuguuuccacaguggcgcucaaccaauauucugguagcagucaggaggucaagguuuaacucuuaucugggaaaagaggcaaguuaccuaacuucuguaagucuccguuuuuccagcuguaaaacagugauauuggcaaggacuugaacuagauugccugacauuucuuuccaguuaagacaauucagugauuuugguuaucaguuagguugauaccauagaagagaugagguugauuccagcaaaccucgcaguagggaguggccaaguacucucucaccuggacuuuucucugcuuugacuuaccacuccaccagaagggcucucuuucuaauccuuuaacaaaagagaacagccaagucucuccaguaauugccaaucaauuuuuccuugauucaggacuucauuuguuaaaaaaaaaaaaaaaaaaaaaagcugaaaugcuacuuaguggccucuugauggcacuucuggcaaaaucugacucucauuuaauccucucaauaacccuaugagacauucucuaucauucccauuuuacagauaagaaaguaaaggcacugagaaguugaaugcuuuguccaaaguuacacagugaauaacggguggacgcuggagugcaguggcgcgaucucagcucacugcaaccuccaccuucuggguucaagugauucuccugccuuagucucccgaguagcugggauuacaggcacaugccaccaggcuaggcuaauuuuuuuuuuuuuuuuuuuuuuuuuuuuuuuuuuuuagaaauggggguuucaccauauuggccaggguggucugaaaccccagaccucaagugauccacccaccugggccucccaaaaugcugggauuacaggcacgagccacggugcccagccaacagggauauuauaaggcucagcucugauaguguauuauggugccauucagauguaagguuauuacuguuacuaugucugcuguccaccaaagaaaaaguuaagcuuuuaaagaauuaaaguuaguuuuauuuggaaggcuuacugaggacuauagacaggggucagcagcucaggagcagcccuuuagaaagguucuauccaacugccccugcacaguauuucagcccauugcuuauauacaggugguggagguucaguacaugcaaaaucacaucagacuuguucagaaauuacauuaagcugaaucacagcaagguuuggauguaagagugcaucugguuguagauuacagaggcauaauuacuaaccccuucagauguuaucuuauggguaggaaaaggcaaggacuagaguccuuuaucauuuguuuauuuauuuggucgguuguuuguuuaagacagggucuggauuugucacccaggcugaggcgugugccgccacacguagcuaauuuuuaaauuuuuguugcuagagaugggguuucaccauguugccaaggcuggucucguacucuugggcuuaagcaaucugacagccuuggccuccaaagugcugggauuauagacgugagccaugguguggggccucauuuaucuuuuaaaguguacagugacuccggcaagagaucuacggggcugugugcucuauccuguuucgucuucaaaguaucuuucuagagagcuacacauuauuagagucaagggcuuugugaaauuauguuggcaaacagaaaugagcaaacaugcccucuuauauguguuacauugucucacucugcuaauacuccauguugauuucaaagacaguacaugauauaugagauucagaaugaaacaugcuuccuuccuuguggggaaaagaaagaucagauuguuacugugucuguguagaaagaaguagacauaggggacuccauuuuguucuguaaucuauaaccuuacccccaacccugugcucccugaaacauguggugugucaacucaggauuaaauggauuaagggcugugcaagaugugcuuuguuaaacaaaugcuugaaggcagcaagcucguuaagagucaucaccacucccuaaucucaaguacccagggaaagaaagcacugcagaaggcugcagggaccucugccuaggaaagccagguauuguccaagguuucuccccaugugauagucugaaauauggccucgugggaagggaaagaccugaccuuuccccagcccaacacccguaaagggucugugcugaggaggauuaguaaaagaggaaggaacgccucuuugcaguugagacaggaggaagguaucugucuccugcccgucccugggcaauggaaugucucgauauaaaacccgauuguauauuccaccuacugagauaggggaaaaccgccuuagggcggagguggaacaugcgggcagcaauacugcucuuuaaggcauugagauguuuauguguauacauaucuaaagcacagcacuuaauucuuuaccuuguuuaugaugcagagaacuuuguucauguguuuaucugcugacccucucuccacuauuauccuaugauccugccacaucccccucuccgaggaacacccaauaaugaucaauaaauacuaagggaacucagaggcuggcguggauccucugugugcugaacgccggucuccugggcccuuuuuucuuucucuauacuuugucucugugucucuuucuuuuccaagucucucguuccaccuaacgagaaaaacccacagguguggaggggcaacccaccucuuuacuuccuggguguguuuauccucucaauccauugcagugacaagacacagagguugcauagaacuuugcuuuguauuaacuugacgugaguccuggaagggcucuguauaggaguuaggacucugacuuguuuuuuauucacagagccauugcuagugaaacauuuggcauggaccaccuuuauuuauuuauuuauuuauuuauuuauuuauuuauuuagagacagauuucacucuuguugcccaggcuggagugcaauggcacaaucucggcucacugcaaccuccgccuccuggguucaagugauucuccugccucagccucccgaguagcugggacuacaggcacgugccaccaugcccagcuaauuuuuguauuuuugguagagacgggguuucaccauguuggccaggauggucuugaucucuugaccuugugaucggcccuccuuggccucccaaagugcugggauuauaggcgugugccaccgcgcccagccuaauuuuguauuuuuaguagugacaagguuucuccauguuggucaggcuggucucgaacucccaaccucaggugaucugcuugccucagacccccaaaaugcugggacuacaggccugagccaccgcgccuggccauggaauaccuuaugaagugguuacugcagcuauuugcauagugaguguguguguguguguguguguguguguauguguauguguguguguuguccaagaccaauugcuucuggcccuacagaaucaccugugcucuguuuauauaaaccaguucuauucucuuuccuucuuauuucuaucuguauuuguuguuuuguucugaucagguugggagaauucaagcauuuucuugaagcaaaacuacaugaaauguguauuaugauccuauuucauguaaaaaauauacaaauauagccauauguguacacauaccuagaagauuucuguaagaauacauaggcagcuauuauauuagguuccuuuggaaaguggagguggaggaaagccugaaacauauuuuuugcacaguagguagaaacauauagugaccuccuauguccccaucuccuagcuucagcaaugaucaguucauugccaguuaacccagcuuuaauaauugucucuucaucugaaccgagaaaagagacuuuuaauuucauuuuuauauauauuugaauuauuuucuacugugaggauauauuauuuugauaauuuaaaaucugaauuagaaaauaaguucagauauuaaaaggaaaugcaguguauuauauuuccauuuuguuuuuuucuuuuagacucagagucuuucaacggugugugauaaagagugacuuucccuggguucucagauccccaaggacagauauuggcuguugcagaacaucuggaaaggaggagagcuguaguuuaaagcauaucuaugucaguacuguugcccaaaucacaggcucacacugucagccccacuauuuggcuugcuguguuuguuaaacuguuuacuuuggcugagauuuaugacgcuguuuuaaaaugagaauaugugguuucaaucuccccuuuguucccugagucccacaaucugccacaguucucugcaagcuauuuuugaaaaacaauuucuacauuucuuaucagauggacagugauuuugcagguauuguuaacacccugcacccaguaauguuuguucucuuagggcuggaagaggaaauggucugaugcaauuucagcagcugguuagcuggacaggaauagaacauuacagaaucaccuugaaucuaaagccugugaaccagcugucugagaugaauaauaggaagguuuuuuuuuucuuaauuuauauuucauagccagugggauugaaaaugcagcuaaaauacagauggucacucuucccaaugguuuaaugugauugggacucuguugcucagaaaacuauucuaucuaugcuucccaccaugcugaauacauaauaugcacgaauuaacuuucacaucaaugagauuucuaucuccuacuauuugcuaugcacuagaauugcaacaauaaauaagcagcuccccuuuaguaucccuaaugucaucuaguuguaauacagugcgaugaaugcuuuacuguuggcgcuaaaauauugugggacaauagaggagagagaaggcuguuuucuggcuuuggaaggcugggaaaacguucacagaggaggugcccuugaaaagcugacccuugaagauaagucaaaugguuaugaauuauugaaggcaggaagaaggagcauucuaagcagaggcauggagggugauuagcauguucagaggcugaagaagaguucagaauauucagaguacaaagcaggaaugcaugugauugggaggugagagagacaaggaagcucaagaggcgaucuagggucaggguggaaggccuccuuagcuccuggguaggugagguucuuuuggauccagggagucgagucccacucagcccccugaggggauugguagugucuugguuauuauacgagugcacauggcuuggaagagaaacuggaaaacucuaaggaucugaggaacuccugcaacuuguuccucuugcaucccucauuugcugcuucaggggcuuccuguugcuuucuuggcuucucugugcugcccccacuccccucuccuuccuaaugguccaguuuccucgaugacuuuuagcacugagguuuuuuuuuuuuuugagacagggucuugcucugucaccuaggcuggagugcagugguacaaucucagcucacugcaaccuccaucucccaggcucaagggauccucccgccucagccggcauaguagcugggacuaaaggcaugugccaccacacccagcuaauuuuuguauuuuuaguagagaugggguuucaccauauuggccagguuggucucgaacuccugaccucgggcaauccaccagccucggccucccaaagugcugggauuacaggugugagccaccaugcccagcugaaaauaacaucauuucuauuaguguccuuauacauucauuuguucaccaaauauuaaguauuugcugugccaggcaaaacacauacgugugcagugugaaaauuuuuaucucuuuauugggauaguuuuucuggaauauacaauuuucaaagcucauuuuuagaagucuguguuucugacuacaaaagaaaaaagauaauagcacaguucuuauagauuuuaaccccggugacaugucuaaaaauauugaguucuaggcuauauccuggauccaaaauuauuucccccccaucauacucaguuuucuuaaacauggaaauguaccaggacccagugggacaguaggaauaguguguagugcuucuccccuucuacccuugcagggaauugguggaaaucaggaauguucaagaauuagcccuaagcuccagggucauagaaggaugguaacugaaagguucuauucuguaguuuuuuuuuuuguuuguuuguuuguuuuuugaaacagggucuugcucugucacccaggcuggaaugcaguggcaugauaucgacucacuguaaccucugccuucuggguucaagcaauucuccuguuucagccucccaaguagcugggacuacaggcacacaccaccacacccggcuaauuauuuuguaguauuuaaacauaaauaggcugggcgcaguagcucaggccuguaauucccagcacuuugggaggccgagguggguggaucaccugaggucaggcguuugagaccagccuagccaacaugaugaaaccccgucucuccuaaaaauacaaaaaauuagcugggcaugguggcgggcaccuguaauucccacuacucgggaggcugaagcaggagaauugcuugaauccaggagguggagguugcagugagccaagauggcgccauugcacuccagccugggcaacaagagugaaacugucucaaaaaaaaaaaaaaagauaaauacuaucuaauaauucucuuagguuggaaaguuuacaggagcuaaaacucuucucuuggcucauaauauaguccuucuccuacuauauauaacaaauuacauaguagcuuguuccacauuuuaauuucuaaguaaauuggucuucauuauucuuggauuccugacagacaucacaucuaagaauuaauauuuugcauucugccacucugagcauguuaaacaaauuacucagugucguugucacugaauuaauuagaaggauucaugggaugacuuuagcacaccguauguaaacuuguuuuuuuaagcuggugcuuaguuuuuauuauuaauaauuacaacucuacauagguaucauuugugguuuuagaauugacugccucagggaguuguuaugaggauuaaugcccauaaagcaguucaaacugucccuagcacauagaugcauaagauuaucuucauuuuaccaguaaaaacucugaugcucagagguuguagaguuacuggcagcaccagggugagaaccaagucuuuguauuccuaaucccguuuuucucauuauccucagaacugacauuuuggggugaaaucugugauagucagaaaugaacaaaucuguguggaguggaaauguagcaggcccuggugggacaguagggauaguguguagugcuucucuccaggaaguacuucagacccaggaagaguuggugggucugcacuucuugaaacaccauccccgaacaugggcugguugucaaaaggaagaacugaaccucauuggcuugcugggaaauacuccugccaccucuuuuguucugaagaucaccuaggucuucccuggagcugugugcuggagacuauuuuaguugguuuuguuuagacuuauuauguauauugagguaauauuauaaauuaauuuaguggcuuaaaaaaucuccacaucuauuaaccucuaucugcuguauuuauuuauuuguuuauuauuuauuuauuuauuuuugagaugaggucucucuguggugcccgggcuggaaugcaguggcaugaucuuggcucacggcaacuuccaccucccaggcucaagugaugcucccacuucagccucccaaguagcugggauuacagcugugugccacaacacccagcuaauuuuuguauuuuuguagagaugggguuuugccauguugcccaggcugauuugaacuccugaggucaaguuauccucccaccuuggcuucccaaaguccugagauuauacgugugagccaccaugcccagccuaucugcuuuaauugcuuuuucuucuuuauugaaguauuuuuucaauaagaauuucauuuuucagcuaugugauuuauuuguccugacaguuuauaauuugcuugauaaacugucugacauccauuuauuuuccaagaucuauaucucccucuucauaauuauuuuaucuuugaauccuuauuuucuugacuuuauguucuuuuuaaauuguuuuaaaauuuuuuauaguucagaccacuuuaaggaaauuguuucuugaauuguguuuucuuucagacaggguucuucuuaucuacugaaugcucucuuuuucccuucccucuguuuuuccuuucuuuucuuuuuucuuucuuuuuuuuuuuugguauuauuuuugcuucacaguaucacauagcuguuugcuuuuccccaugauguuuaugcuuaaugcagacaguuuuguccaugcuuucaaucuguccauacucuaucugugcuuggaaauaaaggcaggugacaucuccuuagcaccuuccuaagucaucucagaaugucauuuuccccucugagcuaaauuugauagcuaauuauuuguuccauuguuuuacagcuuaagggcuccuggugauggaaggagagagucuugcuucugagguguuguucaacuuccuguccuaggguucauuucacauagucagagauggaucccacugcuauggagggauauuuuugcugcugcaaugguccccaaauuuauuauugaguuugggaggcuucacuguuagagaaaaggucuaguucuucaucuccuucauugcaccuaucuuuccccaacagccauuucaacugucccuaaucagaagacagaaaacucaguuauuuaugguuuuuuuuccuucaaacuuugggguucuuaaugaaaauucugaggauuucauugacuuagcaacaaggcuucuggguggugagagucuacuugccuuaccuugccacucuaaaaucuccugcuuauuuuuuuggcugcuacuuuauuuauguuuucaucuuuucccuuuauucaaaaauuacaaagacuuuuuuuggucauuucaauggguggagaguauuuuaaggcuaaucuacccuaucgguaaaacaggccuaaaucacuuuauuauaucaugauuccuuuuguuuguuuguuuauucauuuauuuuuauuuuauuauuuuuuucuuuccaacuuuuauuuucguuucagggaauucaugugcagguuuguuacaugaauaaacugcauauugcagggguuuggcguacagauuauuucgccacccagguaaugagcauaguaggcaauaggugguuuuuggguccucacccuccucccacccuccacacucaaguaggccccuguauuaguccauucucaugcugcuaauaaaggcauaccugaggcuagguaauuuauaaaagagagagguuuaauggacugucaguuccacauggcuggggaagccucauaaucauggcagaaggcaaaggaagauacauggccgugggcaagaaaacuugugcagcgaaacucccauuuauaaaaccaucaaggcugagugugguggcucacgccuguaaucacagcacuuugggaggccgagguggguggaucacuggaggucaagaguuucagaccagccuggccaacauggugaaaccccgucucuacuaaaaauacaaaaaauagcugggaguggugguacacaccuguaauccccacgacuugggagacugaggcaggagaauuacuugaacaugggagguggagacugcagugagccgagauugcaccacugcacuccagccugggcaacagagugagacucugccucaaaaacaaacaaacgaaaauaauaaaaacaacaacaacgagaacaacaacaaaaaaaacccaucagaucuugagauuuauucauuaccacgcgaacaguauggggaaaacugccccaugauucaauuaucuccaccuggcccugcccuugacacauggggauuauuacaauucaaggugaaauuuggguggggacacagucaaaccauaucagccccagugucuauuguugccuguuuacuuuuuguuuuuuugacacagaguuuugcucuguugcccaggcuggagugcaguugugcaaucucagcucacugcaaccucugccucccagguucaagcaauucuccugccucagccuccuuaguagcugggauuacaggcaugcaccaccgugccuggcuaauuuuuguauuugcaguagagacgggguuucaccauguuggccaggcuggucucgagcucccgaccucaagugauccaccugccuuggccucccaaagugcugggauuacaggcgugagccaccaugcccggccuguuguuuccuucuugaugucuauguguucacaauguuuagcucccuuuuagaagagagaacaugugguauugguuuucuguuccagcauuaauuugauuaggaugccaauuaaaaacauuuauguaguuaggguuucuuuuucuuugucuggcuacuucuguuugcuguuuuuuuaaaaaauuauuuuccuuaauagaagaaagggagauucugugcuccgauuucacuccaccagcuuuaccaauuuauaaucuuuacaguucccauuuccuaccuggucccuggcaaaugaagccuagucuggcuccaagcacauggguugaaguaucuucuggaauacucagauaaacaugaugauucaggugcucuaaaaaaaucacacaacuagcuuucccuagaagaggaagcccuaaggacucaaagugucuucuggcaucaguguaguuuccuuucuuuuuuagcauaaaacauuaauccuaauguacuaaccuucaagguuaauaaaauauaucccccauaagguugucagaaaaugcagagugcccucuaaaauuugaauuauagauacaguauaauaaauuguuuuuuuaaaguauaaguaggucccaugcaauauuugggucaagcuuuuacuacacaaugguuugcuguuuaucugaaauucaaauuuaacuggguuuccugucugguuuuuccuuacuaaaccuggcagcccuacucuaucaccaccaucuuaugagaauguuuucugggucuacuggauaccucuccuuuaguauuuuccugauaucacugauauccucaucucuguuacuaguggauucauugcuauguccuuuccuuagccaauccuauaguaugacuugacucuuaaguuuuagauaauaaauauuugcagaugguagaacauuguacaguaaauaagcaucauuaacauucauucccaauuauuuagcacucagccaaagagcaguaauaaagcacauaagauagccuuugagugaccaaaauagaugucauaaauuccaugcccaaaaugcucauuuucuuucuucguagauguucauaucaggcuuuugcucaaaauauuuuaaauccuaaauacugacuacuuagcagaccauggcagaagagaaacagcagauuaggggaacugcuugaguuuaggaacaaggacaacauaugcauaucacagcaggacagggaaaggagauaggagaaugagaaacagacccuaugaaguucuggaaccacugggugcagaguacagagcucuggccguuuacguggucucugaaggcaccacuguggcaacauuccgugccauggagccacaagcuagcauucagcucgaggguguauugggacaauauugguauuaguaacagauaccugaauaaacucacuaaagcacagggaauguaucgauucauguaauuuaaacccagguuagguggcuucaugaacuguugaauucaggugcucaaauagaguuguuuguaaucucucugucucucucuuuugucucuaucccuuuaucucuaucuaucugguccacuuugcucuguguuguauuucuuucuaggcagauucuuccuuuaugauggcaagauuggcuaguaguagcucaagacacauauauacauauauauauacauauauauuauauauauauaaauauauauauuauauauauuuuaagacggaguuucacucucguugccuaggcuggagugcaauggcacgaucucagcucacugcaaccuccaccucccagguucaagcgauucuccugccucagccucuugaguagcugggauuacaggcaccugcuaccacaccuggcuaauuuuuguauuuuuaguagagauggguuuucacuguuggccaguguggucucaaacuccugaccucaagugauccuccugccucagcaucccaaagugcugggauuacagauaugagccaccacacccugauguaugucuguagugccuagaaguaccuaacaggcagguaguagacauucauuaauauuuuuuauaugaaugaaugacuacaaguagggugggcccugaacaauuugugauaaagagggugcacuuuguuucagugcauuucuaggguuuuuguuugcugguugaaacaauaaccccacuggagagagaaaaagcagggagugaggcagaguaggggauggagagcuuuucucacucucaggaguggcaggaggguucuggguuggcugugauuguuucacccucauauuuaccucugucaucuagaucagaggcuggagucacuuucuggagccuuugaacucugacaguauggaaaucaccaagcgagcuaaagauauucaaugacaccuucaugccuuuagaacuucuguuauguuauuacugucugggauugguuuaauaauuugugcugucaucagaauuuccaaaguaauugcuaauuuuucuuucaggcucaggcugcacgaagaaaagguuauuaaagauagacgucaucaucucaagaccuacccaaacuguuuugucgcaaaagaacugauugacuggcugauugaacacaaagaggcuucugacagagagacggcaauuaaacucaugcagaaauuagcagaccggggcauuauucaccauggugagugcgguggcgagucaaggugacuugagagaaauggaaggacuagaucuuuucaugaacauacccacuuaagaaagaaaacauuuugcuuuauuuuaucuccaguguaccucucccugauugcauuuucuuccugccucuaagaggcauuuggguucuuucuuuuuuuuuuuuuuuuuuuguauuuuuaguagagaccggguuucacccuguuggucaggcuggucucgaacuccugacuuugggugaucugcccgccucagccccccaaagugcugggauuacaggcgugagccacuguguccagcuggcauuuggguuauuucuauguacugcuuuauaccugucuguauauacaucuuuaaggaaugcaucauauuguuuuaaaaguuuucuaucauuauagaagugcauauuuaugcuuuugcaacuugaucaacacacugugagcuucauccacauugauaguauaugucuuauuuguuauuuuugcuguuguauaauacauauguauaauuaugccacuauacauuuuucagugggcauuuacaugguuuccaaguuuuugcuguuacucucaguggguucaaugaagauucaccaacaugucuucuugaaaucucucauccuggccucgaccuuugcacaugccaucguucucuuggaauacccuuucgccucauuuuuugcccaauuucgauucauucuucaggucuccacuuacaugaaaacucuucagggaagcuuucuuuuucaaaagcugugucacuguguuccuggggcacuggguacucuuccuuugggcucccauugcacucucuccuuaccucuguagccuuaucacaccauauuucaauuacaguugacauuucuccuuaccucacuagauuucacauucuuugaggcugaugcaugccccaauaugcuuuagaagaauuuguggauugcaugaugaauugaauugugugaacuuccuaaauaugaugaugaugaugaugaugaugaugacuauggugauggugauggugauaauaauagcuaaaaauacugaggacuuacucuguaccaaguacuauguaacuauuuuacaaguauuagcucauaugguacauauuugcaugcaugaagaaugugauagugaaauaauucuuaauuagcaucauacuucgcuugaguaauuaaauaagagcgauuuuuuuucucauuugcuucucugugcauauuguguuucagugugugaugagcauaaggaauucaaggaugucaaacucuucuaccgcuuuagaaaggaugacggcaccuucccauuggauaaugaagugaaggccuuuaugagaggacagaggcuauaugaaaaguauguuccgcaugaaauccccccuguaaucuugacuuauagaaagaagcagaacugugccagucucauuauguugauuucagcguggcuuuucuaugugggcugguuacauaacuguucuuuuccauaugagaaaacuaucaagcauuugcugucucuuugccagaaaauaagucaauuucauaagguucuuaauaaagaauuuacuuaaaucuuauuuucuguauuuaaguugauucuacaaagcuccagaauuuuuguuuaccaucaaaugauguggaugccccuuuccucucuuauuuuuauuuuuuauuuuuuggcacugagucucacucuugcccaggcuggagugcaguggcaugaucucggcucacugcaaccuccgucuucuggguucaagugauucucgugccucagccuccugaguagcugggacuacaggcaugagccaccacaccuggcuaauuuauguauuuguaguagagacaggguuucaccauguuggccaggcuuuucucaaacuccugaccucaggugaucuaccaacuucggccucccaaagugcugucauugcaggugugagccaccgugcuuggcccccuuuuuucuuuuaaauacuguuguuuuguaaauuggaguuucaggcuuguaagugacuggagaagcagcaucgagagcaggggaauuggucaggccaggagaugaguagugagagaacuucagauagcuggaugucuaugaggaacaaguuucagcccuuucaagagauaaguauaguguagcacaggaguuuuugguuggugggucucgaaucuucugaguggccaucucuggguugaucugcuacuucuguggccucuuuaccauucugccuuccucauuuaguuuuccagggcaaccauuagaaaaaggggugcagaagcaauggcacgugcuuuguaacccuggcugccuuacaagacuugagggaauugaaaaauacguauuuaucggccaggcacgguggcuuaugccuguaauccuagcacuuugggaggccgagguggguggaucacuugaggucagggguuggaaaccagccuggccaacauggugaaagcccgucuccacuaaaaauacaaaaauuagcccaccaugguggugagugccugucaucccagcuacuugguaggcuggguacgagaaucgcuugaaaccaggaggcagaggcugcagugagccgggaucacguuacugcacuccaaccugggugacagagugagacaucaucucaaaacuaaaaaaaaacaaaacauauuugucacauaaaagagccuguuguacagugguuggggguaagggucugggugggugucugaguggucagauuaauuggcaugaugguuaaaagccagacagaguuugaaguguagcccugucaccuuaccuuuguaaagcucaguguccucauuagugacaugacagcagcaauagaaccuaccuccuagugcuguugugggaguuaaacgauagcugugucaagugcuuaaguauuuagcucagggucucugguguguaguaagaccucacagaugauagccauuccaaauacgagcacaguacugacggccacccucgacuguguccuuccuguguuaugcgcucugucccaguucuugucuccguuucuugagguggaaugaucaccauuugauguccuaauuuguacucagucuacuaucacuugcuuucuauacugaaauggagaaacucucucaucuuucugacucacaugaauuugaauggaagggauccaucagaaccuccauuuguuuacuugaacaugugcauuuguuuuguugcuacuuucuuuuaauuucuuaguuccuuuuguaaaauucuagcagguguuagguauuucaauuacaaugauguuccuuucaaacaaugauucuauguuggccaaaacaugcaugucaucuccaaggaugaaggccaguggauucuguaaacgcuuuuccuuuuuuuuuaauuaaaaaagauuauuauuauuauuauuauuauuauuauuauuauuuuauaaagacaggagcuugcucugucucccaggcuggagugcaguggcauuaucauagcucacuguaaccuucaauuucugggcucaagugauccuccugccucagccucccaaguagcugggaguacagacuuaugcuaccauguccagcuauuuuuuuuuuaacuuuuuguagagacaggaucucauuauguuguucaggcugauaucaaacucugguccucaagugauccucuugccuuggccucucaaagcacugggacuacagccaugagcuacugcaccuauaacacucuucucuagcuacagcuuaucucuugggaucugcauaaccacacuguggggcagggaucagcuauaauugaaaaugucuggcagagaacuguuauugcuuaaugggauaguuaugauggcaagacaguaagaagaguuaaaguugcucacaucuucuagaaagcagacuuacuccagccucauguucuguuggaucucccuuccauccuaugggccagucacacagcacuguguaucucugagcaucuucuuucccuucaggagaugcauuaaugcauuaauuauucaacaaauauagauugagcccuuuccacaugcuaggcacagcuaaagacaccagaaaugccuguagcaaagccccugccuucaugagcuugcacuucaguugaagaggcagacauuaaaggcacagacacaugaagaugugacagaguauaauacaggugucgucggugcaagaaagaaaaauagacuuacugaggguggugggguacuuuaaauaggggcaucggggaagacguuuuugaagagacaacauuugaauaaaggaagccuugcagauaucugguggaagaacaucccaggcaaagggaacgguaaggauaaaggcuuugagaugggaaugugcuggacauauuuaagggcaguaaugagaccagaguguccagagggcagaaguaaagaggagaguagcaggagaugagacagggccaguucauaauaaggcccuuaaaaccacaguaagaacuggugauuuuaaauguaaugggaggccguuggagaggagggaguggggaaguggcaaucugauauacuucugcaugugcuguucccucugccuagaggacucaugccgcucucaccccuuucccuaaaucacugacuccuguggcuuccaguuaauugugaagguggcucaaguaauaugugguggcucaugccuguaaucccagcaccuugggaggcugaggugggcagaucaccagagggcaggaguucgagaccagucuggccaacauggcgaaacccuaucucuacuaaaaauauaaaaauuagcugggcgugguggcuggcaccuguaaucccagcuacuugggaggcugagaggcaggagaaucgcuugaaccugggaaguucaagcccccuuucuuugagacagagcaagacacacacacacacacacacacacacacacacacacacacacacacaauguuuauuauuuguaaguuaagcuucuuaaugcacuuccuuuagauuauuuuaccuaagcuucuuuuuaaaauagauggagcauuacuuuacuggcccauuuucagagggagcaucugggauccaaugcauuuaaguaauuuauaugugauguugacacaguuugcgagggacagggugagacaugaaccugggguggcagguguuggggcugcugcugucucagcagcucugagggggugggcguauugucaguauuucuuuuuggcucuuuucuugcuuguuuguucuguguuauaaauaggacuuugugaaacuuugugguuucugacugagguuuugcugaaccauguugauuuuugggaacccuggcuuucuuuuuuauuuuuauuuuuauuuauaagagucucacucuaucacccaggcugaagugcaguggcaugaucucggcucacuacaaccuucaccuccuagguucaagcgauucucaugccuccgccucccaaguagcugggacuacaggcgugugccaccauaccuggcuaauuuuuuguauuuuuaauagagaugggguuuuaacuuguuggccaggcugaucucaaacuccuggccucaagugaucuguccgccucggacucccaaaguguugggauuauaggcgugagccacugcgcccggccuggguacccuggcuuucuaacccauagugguguuucucagucugcucguugguaggauaaacccaggucucaaaacuacaauuucaguaacucugcuggcucuuaguauguaugucacucuaguuaccuuacuugagacaugcuggaacaaacacuaaugaagaagcaagaagcuggcccuuucaaguugccccagugugagugaggaaagcuuuagaggaacuggaggcauggaucguccugcacagugaguggcaauggcuguaggcucuggagucacacagccugggucuuccaucccagcuucacaacuugcuugcuuugugcccuucagcaggcugacuaaaucucugugaucugcagucuaccguggagauaaggcugggacccacugcuggaaaaggcuguugggaggacugaccgagauccaucuguacagugcugagcacacugcuugacauggacugagagccuaggaaauguuagcuguuguuauuagaguaguaaauaauaauauaaauacgugacaccuauucuuguuuucucaaauuauuuuaagaugcagcuuugcauagcagauaacagcccaggagcccagcuaccugggugugaaucuuggcuccaugccuuggggcauguggcuuucucucucucugucuccauuugccuaucuaguaaauggagauacugaccauccugaccucauagacuuguugugggaguaaaauggacuaaugaguaugcacacaggacagggcccgcaucagauaugaguguaugcuauugcucaccuccugcugccagcugugggggaguaugagaaagagugugugcuuauggauugaugcccugauguugucauuuugaggaauucaucuaaguacauucagggcacaauacacuuucaucaacaagcucuaagcucugcugagucuucauuauggccagcaaauggacugagggugcaaagaauaaggcauagcauuuugucucuucgggaggggcuuacagcucuccacuuaauuuugcaugggcacaaguacccaagacacucaacacaugaacauaagucacauuuucccaaacaguacaauuuuuacuucucaaaggaaaccuuuauaagcaggauaguacucauaacuuaaaagaacaauguugaaucucuauccgcggccuuaagaugguagaaaggguuuugagugcauguuccccacugcaaaacuugauuggcaaaauagauuuauuuaagaaaaaagcuggccagacacgguggcucacaccuguaaacccagcacuuugggaggccgaggcgggcagaucccuucaggucaggaguucaagaccagccuggccaacagggugaaacccugucucuacuaaaaauacaaaaauuagccaggcgugguggcaugcaccuguaaucccagcuacucaggaggcugagacagaaaaauugcuugaacccaggaggcggagguugcagugagccaagaucgcaccacugcacucuagccugggcagcagagcaagacuccaucucaaaaaaaaaaaaagaaaagaaaagaaaagaaaaaaguugaauucaggauuaucaaguccucuguauaguaacaaauaaaaucagcuauaaaagugaguguguguuugagguacaauuugguuuuuccucacuaaacccaguaguugaaauguauauuuuaaacuaacuucgauuuuaucuucaaacuuagaagagacuucuuaauuuuaauucaaccucaguuuugauauggaacuaaauccccucuuaaucugguucauagacacauuagucuaguuguuuuuuuuuuuuuuuuuuuuauccaaagggccuugauuuucucagcagcaggaguuucuaucuccagcuacuauuagucucuuuauccugcuuaggaguuuagaccugaugaagaauuggcuuaacaagcccguaugccauuagaugucuauugaauuccuacugcuuccuucaauuucuuuuccacaggaccaaagagaaauaaaagggagagaguacauccaaagaggcaaagcccuucugcguguuuuaucuuaucagaaguuucucuacccuguguguuaggaucuuucuccuguucucucccagugccugggacaauaaauauuuguugaaugaacaaagggcucuacauguugugaucgcuauaagcugcugagccuguaccaugagcuacacagagcuugcuuuuaauaacaagcaacaauagccagaauucaccuugucuggccucuuuagagcccacaaaccaucauauacauuaauuuguuugauccucuguacaacucugugaguuauauccagcaggcauaauuauucccauuauaaaaaugggggacaugagcuguggagagagguuuaaugacugagauagacccuagguaaggaacuggagugaaaaacaaacaaaaaaagucuucaagcuuuugucuccaucuuguucuauuuccaguauagagguguuuuucaggugaccagccugggcagcauagugagacuguuucuauuaauuuuacaauaaggccaagcguaguggcccacaccuguuaucccagcacuuugggaggccaagguggguagaucacuuuacaucaggaguuugagaccagccuggccaaccuggugaaaccccaucucuacuaaaacuacaaaaauuagcugggcaugguggugggcaccuguagucccagcuacuugggaggcuggggugggagaauugcuugaaccugggaggcggagguugcagugagcugagaucacaccacugcacuccagccugggugacagagugagacucugucuaaaaaauaauaauauaaauaaauaaaguaauuuuuuaaaaagaaauguuucuuaaacugagauccugaguuuuacaaauugcaaacuguaauaaaaauauuuucuggccgggcucacgccuauaaucccagcacuuugggaggccgaggcaggcggaucacgaggucaggaauucaagacuagccugaccaauauggugaaacccagucucuacuaaaaauaccaaaauuagccaggcguggugaugggugccuguagucccagcuacuugggaggcugaggcaggagaaucgcuugaacccgggaggcagaguugcagugacccaugauugcaccacugcacuccagccugggugacagagcaagacugucucaaaacauauacauauuuucuaauauaugcauagauaugcacuuucacaguuuacuugugcugcccuagugguuacauauaauuuuagaaugaauguucccggccuucuugguuuauuugaacaauguccuaagauugcaaugugaguggguuaaaguuguuaccuuuuguaacuuucuguuugugugaccagagauguuuacacuauguaacuaaugucaagaacuguuaggagucugagauuuuuacccuacuugcaagcucacaaguuugcugccaccauuuuguggauacuggcagaaaacagaagaccucuggacaaagacagcucauuacucucaggaagagcaacagccagaguaucaucaauuuuaaugaaucaauucccaagccauaguucucacagaacagcacagugaggggcaagugauaccugcacaugcagugggcugugugacagcagaggaacccuaagcuucaggaaccugaauauuuuauaauggucuucaagaaaacuugcccucugucugagauaaggaagauguuaucuucauuaugcuggcagaaaacaaaucugcccuguugcuccagaaagaaauacuaccuuuaucucuuaggucuguucacuuuacaaaaauucuugaaaagcuagucuggaacaaaagcugucagugcuucugcuuauaagacauaaagaaaucugagagacccauaaagaguuaucuucuaacaacuaccgcaaaauguacaaguaaauuggauuccguagcugaucauuggaguaacuguaauuauccucaccaauccucuuauuucuuuauuuuuuguguaaucaagacuaccuuauagguuucucuguuuaacuuuuauaaguaaaugucauaaacaugaaauuugaaaauggauuauaugaaagauuucagaaaagaaguuaguuuuaaaaguuuuaagccuaugcuaauuuuaaagggccaucaucucuucccacaggguauuuaauaacuuuagaacaaaauuuaagugguuuuauuguucaugugcagcuuagagccaugggaaauuuuucaccuagaaauacauguuuguuagaugcuccugaaaucuguaucuuucuuuuuucaauuuuuuuuuaauugagacagaaucuugcucuguugcccgggcuggaguacaguggcacaaucuuggcugguugcaaucucugccuccuggguucaagugauugucuugccucagccaccccagaagcugggauuacaggugugcauuaccacaccuggcuaaugguuuauuuucaguagagagcguuuugccagguuggccagguuggucucagaguucuggccucaagugaucugccugccucggccucccaaauuguugggauuacaggugugagccaccacacccagccugccugccugccuuccuucuuuccuuccuuccucccucccucccuccccguuucucccucucugccuuccccucucucucucuuucucuuucucucuuucuuucucuuucuuucuuuucauuguguuccuucuugcucucucucucucucucucucucucucucuguguuucucuaauuucuuuauaggaagccaugcaaaguugucuagccugacagguuauucagaugcuuuguaauuugcccaucaggggucuuggggacugaagagacuacauaaagcaaacucaguguuuuauaacucuaaauuucaacaaaaaguuuauacuguauaauuucucuauguaaacaaugucucauaaauuauaagugucauuuaaaguaugucaaagagugugcuugcauguugcaaauaaccagcccuaggucaccuaacuuuguuggcucgcucaucuucuguagcggcaagcuuggucugccggggaagggccgucucaggaggcagccucaugucuaguuucauccagguagcugagcucaguccucuuuccucagaguagaacaacuagucagugucuacauauuugguuauaccaagggacuggugguaaaaugcaugugugaacacagagcuauuggaaaacaaguggugggaggcaaccucuucacaucuauuaguauggcuuuuuucguuuuugagccagagucuuauucugucacccaggcuggagugcauuggugcgaucucggcucacugcaaacuccaccucccggguucaagugauucucuugccucagccucccgaauagcugggaguauaagcaugugccaucaugcccgguuuuaguagaggugggguuuugccauguuggccagguugaucuugaaauccugaccucaagugauccgccugacucagccucccaaagugcuggaacuacaggugugagccaccacacccggccaguguggcuauuauuuuaaacaaacaaacaaacaaaauuuguguuggugaguaaguggggaaauuagaacccuugugcauugcuggugggaauguaagauggugcagcaguuaugacaaaugguauagaagugucuuaaaaaaguaaacauguaauuaccaggccaggcgcaguggcucacaccuguaaucccagcacuuugggaggccgaggcaggcagaucaccugagguugggaguucgagaccagccugaccaacauggagaaacucugucccuacuaaaaauucaaaauuauccaagcuugguggugcaugccuguaaucccagcuacuugggaggcugaggcaggagaaucgcuugaacgcaggagguggagguugcagugagccaagauggcaccauuacacuccagccugggcaacaagagugaaacuccaucucaaacaaaacaaaaccaagcaaaaaaaacauguaauuaccaugauccagcaauccuacuuuuggguauguacccaaaaguagaaaagcaggaucuugaagagauauuggcacacccauauuucuaaacagcauuauacagaauagccaaaaaguggaaguaacccaaguguucacugaugaaugaauaaacaaaaugugauagccacauauaauggaauauuauucagccuuaaaaaggaaaaauauggccgggcacaguggcucacgccugucaucccagcacuuugggaggccaagguggguggauaaccugaggucaggaguuugagaccagccuggccaacuuggcaaaaccucgucucuacugaaaauacaaaaauuagucgagcgugguggugggugccuguaaucucagcuacucaggaggcugaggcaggacaaucacuugaacccgggagguugcagugagccgaaaucgcgccauugcacuccagcgugggugacgagugaaacuccgucucaaauuaaaaaaagaauaauaauuuuaaaaaaaagaaaaauuauucugacacaugcuucacaacagagauggaccuugaagacauuaugcuagguggaaugagcucaucacaaaagggauaaauauuauaugaucuuacuugugugaggcaccuagaacaguuaauucauagagauggaaaguagaauggugguugcuaggagcaggggaaaggggggaauagggagucauuguuuaauggguuuaaagguacaguuuaggaagaugaaaaaguuguggagagggauggugcugaugguuguacacugcuaugaguguacuucgugcuacugaacuuaaaaaugguuaaaauggggcugggcgugguggcagaugccuguaaucccagcacuuugggaggcugagguggguggaucaccugaggucaggaauucaagaccagccugaccaacauggugaaaccccaucucuacuaaauacaaaaaauuagccaggcaugguggcauaugcuuguaaucccaguuucuugggaggcugaggcgagagaaucacuugaaccugggaggcagagauugcagugagcagagaucgcaccauugcacuccagccugggcaacaagagcaaaucuccaucucaaaaaaaaaaaaaaaaaaaaaaaagguuagaaugguaaauuuuauguuguguauauuuuaccacaauaaaaaauaaaguaaaucaauauuuuaaaacacacaaaaaggcagggaguggggaacauacaggcuuaucuuaucaguguacuggcaagcaagagaaagccaaaaugauaucuaaacaguuggggccagauguuuuugaucagaggaguugaagagauagcagaguaagccuggagauguugauaaugaugaaggcagcaaacccagggcgaguagcccuuacugaugcuuauuguauaccaagaacuuuacaaguaucuucuaaaagcuucguucuaaaccaagaagauaaauaugguuauucucccuuuggaaaauagggaaauugagucuagagaguuuagcuaacuugccuaaauucacacagcuggaaagugugggagagcaucuucaaacccugguuuccagcucuaggacccaugaucuuaacuuuuuccuucagucccaggcagcaacaguaaugaacccacuaaauaaagauaaacgguaugcagcuuaaucaauuuuuaaaugagugggggaaaaagugucugucacuuggcucaugccaacuuuuugggucuaguuuuggaaaucacauccuucuuaccguuucuuuguaaugccccccucccccugcuguaacauauauggcaauuuguuaacaugcaaaacaggcagccggccagcugugcuugccagaagccaucagcccuagauugucaucugcagauuucuagcucuggcuuaguauguagaagugacuugauuuauuuuuuauugauuuauugauugauuuuuugagacggagucucauucugccacccaggcugaaguaugguggcaugaucuuggcucacugcaaucuccaccuccuggugaguucgagcaauucuccugucucaaccuugugaguaguugggacuacaggugugugccaccacgccuggcuaauuuuuguauuuuuaguagagacgggguuucgcaguguuguccaggcuggucacgaucuccugaccucaggcgaucugcccacccuggcuucccaaagugcugggauuacaggcgugagccaccgcguccggccgugacuugauuuaaagguaaauauauugcuauuugaaugguagacuggacucauugaugguggagauugacugugcuggcuacuuccgccaaguuuuccuaauccuauguaaugucagggcuaugaaccaaguuucuguaacacugauuuugcuaauccaucucuguaguaauuuuucaacuugauagaaugcagaaaucauuuaaguuuucuggaguugaagaaggacaugucagaguucuuauccugccccuuauuagcaagacauucagcuuuucugagucucuguuuuuucaugggaaaaugggaagaaaaugcauacuucacaggcauauugugaggacaugauaaaauccaguggaguuucaucuaaugcaggauaugcuagguuucuaauaaacaaggaaaaaugcaaugcauguagucuaaaguauccuugugcuacccaagcugcauaaaaaacacaugccuuccuauacuagaauuguauucagcauggugagauauucagcuuguaugugggacauuucuguuuguccuuccagauccauucucuauccuuuuccaaccugcuguguccccaagaggcugacuuacauggacgguuucaccggaguccauugcccuuuggcuucugguucagcucagucagugggaggcacuaguaggaaguagguggaaggaaggagauuggggugagcguauuuauuccccugcuuccucccugccauugaaggccacuguauuaguccauucucacaccgcuguaacgaacugccagagauuggguaauuuauaaagaaaagagguuuaauugacucacaguucugcaugacuggggaggucucaggaaacacaaucauggcagaaggggaagcaggcacaucuuacaugacagcaggugagggugagagagauaguaggaggaacucucaaacacuuauauaaccaucagaucucgugagaacucacucacuaucacgagaacagcaugggggaaacugcccccaugauccagucaccucccacccaggucccucccucgacauguggggauuaugaggauuacaauucgaggugaguuuggguggggacgcagagccaaaccacaucagucacgguuacugucaugcagcccucccguuaacaucuguccccuuugggcucuggaaacuggucucucucuacaauccugaggccuaaaguuguuaaugaccaccccaccccguucugucagaccaggagcuucaccguccuuuauaauuucccuuaacccuacccauagcuuugguaguuccuuuauuauaaacugucuuuuuaauuuuuauuuuauuauuauuauuauuuuuugagacggagucucguuuuguugcccaggcuggagugcaguggcucaaucuuggcucacugcaagcuccgccucccggguucacgccauucuccugccucagccucccgaguagcugggacuacaggcgcccgccaccaugcccggauaauuuuuuguauuuuuuuuaggagagacaggguuucaccguguuagccaggauggucucggucuccugaccucgugaucugcccaccucggccucccaaagugcugggauuacaggcguuagccaccgcucugggccuaaauugucuuuuuuauuaacccauuugcauagccuuguuauuucuggcugggagccugugaaauccacuuggaaagugagacgaguucaucucccaucuccuugaguggacaggcaggcagaauuauccacacucuauaaauggaaaagccacuugcucuuuuuguuuuguuuuguuuucuucugauuguguacuaugcaugaugugaugguugaaguuggcacgugauacacuuaguggccacuguuguaagagcauggaauauggcuggauuauaaugaauuauuuugacauccuuccucuuugcuucuguaucaccuuggguuccagcacagcagccaucucaacagggugauugagucuugauauuucagucuguccagcuugacuauaagcucucugaggucauguaccuugaggccucacacaacuuugguauacguacauagcauaugccccauaaauguucguugaagacaugaauggauaaaugauugcaugguaauucuuucuuuucuuuuuuuuuuuuuuuugagacagagucuugcuguuucaccaggcuggagugcaauggcacaaucuuggcuuacugcaaccuccgccuccuggguuuaagcaauucuccugccucagccuccugaguagcugggacuacaggugcgcaccaccaagcccagcuaauuuuuuguauuuuuaguagagacaggguuuaaccauguuggccaggauggucucaaucucuugaccucaugaucugcccaccucagccucccaaagugcugggauuacaggcgugagccacugcgcccagccuauaaugaauuauuuugacacccuuccucucugcuucuguaucaccuugggucccagcacagcagccaucucaacagggugauugagucuugaugugucagucucuccagcugaacuauaagcucucugaggucaugcaccuugaggccucacacaacuuugguauacauacauagcauaugccccauaaauguuuguugaagagaugaauagauagaugaaugcaugguaauucuuaauuaggaaagaaaucaauaggcagucccuuccuccuuuuccuaaccugaagaauguugaaauuucaguaaaacuaguagaagauauugauuauucuaggucacucuauuuguguuuauugguuguggguucugaucauaaaaauucagaagauaagaauaauaaucuuagccaucauuuacugaggauuucuauguucuaggcaccuuccuaaguauuuuuuacauauuaguucauuuaauccuuccuacaccucuaagaagaaaauauuuucaucaccaauuuacaaauaaggaagguuaauuugagaugggcuaaguagaugcuuucaauacuccauuugcuaaagagugauucuggccaacaguugcucauggcauaggcucuucacuuucccacaauucugcauuaaaaauaaaaaaguuaaauuccuugcagugaaccuauagaaauugaaugccauguucagcauguuuugaauccaagaacccuagcugccacagagggucaguugauuccaucuggaagagagacuaaaacucagagcccuuccuagaggaaaucccucuuguuuauuuuuaaguguggagauucuagagccaauggaugaaggcacacgggucagcguuaggcugugcuaaacguucuaagacacagacagagcagcaacgggguuggggccuucugagagaagaggcacguauugaaguaaaaguggauauuugaagagugauaccaguggaaggcauggcugggagguuuuaaaggaggaggauauucuuccaugaugaaaggcuuuguccacgcaaaccaaggcucccucgguuggucgggcgcuuuguuguuaagcgcagagaugauuccaagggguguaguugcuguauuguuuuucuugcuuuguuugcuaaaugaaaacauccccgcuuaauugcagucccuucacacagagcuucggagggaaaacaaaggcauuguuccaccaaauggaaaaaggcaccaaauugacaaaaaacauuuaauaauuucagacccccuaacaaaagaguguuucaguccagaaagaaagaaaaucugaauaacauuuuuaacuuuauuaaaguuaaauuuguaauuaaauuuuaaugauaaaguuaaauuuauugaaauguaaucuccauaaacugaacauaucauaagugugcagcucaauucauuuucacaaacugaacauaccuguggaaccaccacccaaauaguguuugguuuuuuuuuuuuuuuaauguucucugaggccgggugcaguggcucaugccuguaaucccaguacuuugggaggccaaggugguagaucacuggagaucaggaguucaaccugaccaacaugcugaaaccccaugucuacuaaaaauacaaaguuagccgggugugguggcacaugccuguaaucccagcuacucgggagguugaggcaggaggaucacuugaaccugggagguggagguugcggugagccgagauuguaccauugcacuccagccugggcaacaagagcgaaacuuugucucaaaaaauaaaauaaaaaaaaaaguucucuguguucuaccaagguuuaauaugcuaaacaaaauuaacuuuugcauugguguuaguuucuucuagaauauaaaacauucuuuuaaguaacuuaacuucuuggcuuuucucuguuucaccugccaccugaugcugcccuucuucccucacccucuccagaugccuggaauuuguuauucuggccaguucagacugucauccagccucugcaagggucagcucugaggggcguguguguaugaaccuuguauaucacuuguucaugcuacuuuaugcuaggcaauaugcuagaugcuuuaaacagauuagcucuaauuuucacaaugauucuguuaagguaaguauuauuguccucauuauguacaagaagcagcucaggaucauagcacccaacugcaguuuagaaguccuaggauggcuucccuccugccgcuaccucuccggagccauggauguucauaggcaagaaagggggacaagguaauugaccagaucaucccaacaccuuuuguguggcucuggaguacuguuuuguacucauuauauuuccuuccugugcuaggacagauguauucagaaagaacugugaaguuuucccuuucaaucauauucugcuuuugcaagccauuccuuucuccuaguccaugcugagaugguugagagucaccaagcaucugccugcacaccaguggcuccugcuugcuguuucuuuuucccaucgacccuagacugaaguuagucacugaugcuuuggcucugaugaaccccuucugguuucuagccagugggugaaaucauuauauauaagagcaguucccagcuuucaagagguuuguuuacuuugcuuccuccugaucuuccaaaguggaaauuuugccuuaucuuuauauucccagugacuagcacagggcggcguauccaguaugugccugagacacuugcugaacugaaagcacuguugccauaaugaaagugaaaaggugauggauaaucacaguacaaaaggaucauuaugcugucaucuuuauccugauugacacucuugagcucagaauuuuuccauggcuaucaccuauaggcaaugaagcauuucugaccuaaucuuuaccugcugcccaugcuuagcucccugugcuuugcucuccugcccucccccauccucucccugcccaguaccacaugauuuguccugaccucucauuugcaccaugcauuuguacuugcuccuugauccuguguccucucaccaucucgaaggaccaacuuccauuucuucuuaacuuggaacuugaaagugcccucugacacuuaaguauuucauucucuugcuuccccuucaucuuguauguaccuguaccucuguuacagcauuuaucugucuugcacauagguuuuuuaacauuugcuuccccaucugauaguaggcaacuuaagaguaagggccacgucuuuucauuuaugcauauccugggagacagaugaugcucaauagauauuuaaauggucuaggcaucauggcaggugccuguaaucccgcuccuugggaggcugaggcaggaaaaucucuugaacccaggagauggaggcugcagugagccaagaucgugccacugcacuccagucuggguggcagagugagacucugucucaaaaaauaaaauaaauaaauaaaaacuaaaauaaaaauaagaauuaaaaaauauauuuauuaaaugaaugaacaaaugaaaguacuaaauacugauuuuuaacagcuuuaugaagacauaauucacauaccauacaauucgccuauuuaaagcauauaaguuaauuuuauacuuuuuaaaaacuuuguuuauaguauaaucacagauguaugcaaccauuacgacagucaauuucagagcauuuucaucacuucaaaaagaaaccccuuaccccauagcuaucacuccccuaugccuucaucuacccccucaucccuaagcaaacauuaaucuacuuucugucucuauacauuucucuauuuuuuuaauuuuaauuuuuauuuauuuuuuuuugagacggaguuucacucuuguugcccaggcuggagugcaauggcgugaucucaguucacugcaaccuccaccucccagguucaagcaauucuccugccccagccucccaaauagcugggauuacagacaugcgccaccacacacagcuaauuuuguaacuuuaguagagacaggguuucaccauguugcccaggcagucucaaacuccugaccucaggugauccacccgccuuggccucccaaagugcugggauuacaggcaugagccaccaugcccgaccacauuucuguauuuugauaauuuuauaucaauggaauaauacaauguauggccuuuugugacugucuucuuucacuugguauaauauuuucaagauuucuccauguuguagcuuguuucaguacuucacuucuguuuauagccaacuaauuccuuguaugcauacaccacauuuucaguuucaucaguugauggacauguggauuguauuuacucuuuggccuuuauaaauaauaucguuaugaacauucauaugcaagguuuucuguggauauauguuuucauuucucuugggcacauaccuagaaguagaauggcgggaucauacaguaacucuguguucaacgauuugaagaacugugagacuauuuucugaagugccugcaccauuucaaauucccaccaacaguguaugaggcuucuaguuuauaucacugucaaaacuuguucucugucuuguuucuauccaacuagcggauaugaaauguuaugucauuauaguuuuuauuugcaguucccugaugcaaaucuuucuauguaauuauuggcuaauuuuuauauuuccuuuaguuuauucagaucauuugcccguuuuuauuuuuguuuuuauuuugagacagagucuuacuuugucacccuggcuggagugcaguggcgugaucuuggcugacugcaaccuccaccucccggguucaagcaauucuccugccucagccuccugaguagcugggauuacaggugcacgccaccaugcccagcuaauuuuuguauuuuuaguagagacaggguuucacuauguuggcccggcuggucuugaacuccugaccucaggugauccacccaccucagccuccuaaagugcugggauuacagaugcgaaucacugcgaccagacuguaaucccagaagaaggguaguuuuagcuuuuacauuuagcuuuuaaaucuauuuaggcuuauuuuuucuguguaguaugagguuaaggauccaacuucuguauuuugcaugugacuaucuaacugucccugcaccaucugucgaaaggacgacccuuuccucguuauauggccuuggcacccuuguugaaaucaguugaccauagauauaccaaaguagugauuuaaaauuuguguuuagauaauaauauaaaacaccuugguugaauaaugaaagcggagacugcuucucuugucuuuuuauacugcuuccacaaauaugagggacagagaagcccugcuaucaccuaaccuguuauuauguagaaaggcaguuccuacugaucauuguguucaauauuuuaucauuguuucuuuuuuuaaauuuaaauuuaauuuaauuuaauuuuuuuugagacgaagucuugcucuguugcccaggcuggacugcaguggugcgaucucagcucacugcagccuucaccucccagguucaagcaauucucuugccucagccuccugaguagcugagauuacaggugugcaucaccacaccuugcuaaucuuuucuuuucuucuuuuucuuuucuuuuuugagauggaaucucucucugucacccaggcuggagugcaguggugcaaucucggcucauugcaaucuccgccucccguucaagcaauucuccugccucaaccucccgaguagcugggauuacaggcgugcaccacuaugcccagcuaauuauuuuuguauuuuuaguagagaugggguuuuaccauguuugccaggcuggucuccaacuccuggccucaagagaucugcccaccucggccucccaaagugcugggauuacaggcaugagcgacagcacccugccauguuucuuauaucuuuuaaauauauuuggcauggugaaguggcucacaccuauaacuccagcacuuugggaggccaaggugguaggauugcuugagccuggaaagucaaggcugcagugagguguggucacaccacugacgggguuagacacuaucuaauauacacacacacaaacacacacacacacacacacacaucaauuuucccagauugucaucaguuuuccuucaucacuucaucuuaccucuccuaaguaucuuuauuuacuccuccuuucuuucucuguuuugguaucaauuucuucuauuuucuaauaauuaugaaagcauucagaauaaauaauaaccauuccugucaaaugagccuuuauaauagguuuuagaacccagcuucccuugacauuuguuugaaaaggcucaccgagguuugaauuguuuugaauugaggguacaagcacuugguuucucuccuucuuauauaauuuuguggugaugaaaccauaguugaauguggccuuuuaggauggccauggccugagaauccacacuuggcuucuaucuaaagcugauucagauucugaaaauggcuguugaaggcaacacuaaaacccauggggaaugugaaaauuacaacuuuccagaauaucagucucuucagaguguaaaaccaacacuaaaaaguucucaucuuucuuucagcuaauuugaaauagcaagcaaagaggaagggauuuuauuuccaaaaacaaauaacacccuccauuacuguugcuuaugguauucacuuaguuuuuagucaguugauuagaagauauuuguugagcaccuaauguauaccuccucccugggcucaguuuucuaagaaauaaaaacauuuaagacauggugccuguucuucagaaaguucuaguuucacuggagggauaaaaauaguacguaaaaauugagaggaaauucaagcugagugugguggcucacgcuguaauuccagcacuuugagaggaugagauggguggauuaccugagucaggaguucaagacaagccugggcaacauggcaaaacccugucuacuaaaaauacaaaaauuagcugggcauggaggcacacgccuguaaucccagcuacuggggagaccgaggcaagagaauugcuugaacccaggagguagagguugcagugagcugagauccacaacacugcccuccaaccugggcgacagagugaaacucugucucaaaaaaaaagaggaagucaaagaauuucuuuaaaagaaaaaaaaagagaggaaauucaaagagagggcaagaccuguauggauugcuccuuaguugggauauguucacagagaccuuagggcuuaaucuguccauuuaaaauagucccacuaucuccauugacacuuuauaugaaugacagccaggcaccuucugcucuuuccgucaugcuggugcagccccucaccuccacacaggacacaggacuggucaugaaggccuggaguuggauuucagccccugaaccuagguucccuuguacagugaacaaccuguauuacuguacaaggagccccuaaaguuccaagauacaugugcagaacgugcagguuuguuacauagguaauagugugccauggugguuugcuggcaccuagguauuaagcccugcaugcaccgugcccucccacugcuacuggccccaguauguguuguuccccccgggccguguccauguguucucauuguucaguucccacugaugagugagaacauguggguuugguuuucuguuccuguguuaguuugcuggggaugauggcuuccagcuucauccaugucccugcaaaggacguguaguuucaauuucuucagggaagugaaaaugggaagaagugagggaacaccaugaguaaggaaccaaggugagauugaguauguucuauucagugucugauaugcaggcuggugaaggaggguagaagauccucguugucagacuauaaaguacuguuucuucccuuguuccucaccuuuuccaguaugcaguaguuuuacucauaaauauuaacugagcagcuguuuauuaguuccaaaccaaauuauuaugaaaauuauaucaauuuagcuauguaacaugugcucuauagacaauagcauaguacuuaaaaauaucaaugcucaugugagcauuucucccuaauuaauacuuucuugcugucaaggccaagggaaaacuuucccuuucuugcuguuggggccaagggagaaaaggcauauauauuuauggauaguuuuaugugacauaggaaccuuuaaaaugaagacccaaagauacaggggaaauuguccauuuuuaugcuaggguucaagaaauuaugaacaguuguguagaaauaugacuggaggcugggcgugguggcucacgccuguaaucccaguacuuugggaggccaaggcaggcagaucacuugaggucaggaguuugagaacagccuggccaacauggugaaaccccgucucuacugaaaauacaaaaauuagcugggcaugguggcacacgccuauaauccuagcuacuugggaggcugaggcaugagaaucacuuaaucacuugaauccaggagguggagguugcaguaagccaagauugugccacugcacuccagccugggugacagagcaagacucugucucaaaaaaaaaaaaaaagaaagaaagaaauaugauuggacaaaaaggguaugaucuacgguuaauagacucaguggggaaacccaguaaagcccgucuaucuagauucuucuuggccuuucugagcaugcauuccuucugagugugggguaagacccucucuggaaugggggucuuaugaccuacagucaaacaagauaggucagauagcuucuuuuuuuuuuuuuuuuuucuuaagacagauucucacucugucacccaggcuggaguucaguggcacgaucuuggcucacugcaaccuccaccuccccaguucaagcaauucuccugccucaaccucccgaguaucugagauuacaggugcccaccaccacgcccggcuaauuuuuuguauuuuuaguagagaugggguuucaacauguuggccaggcuggucucaagauccugaccucaggugauccacccgccuuggccucccaaagugcugugauuacaggcgugagccaccaugccuggccaagguaaugguuuuaauauuugggugaaugaauaauuaacuuuuuuuuuuuuuuuggagacagggucucacucugucauccagacuggagcacaguggugcaaucacagcucacugcagccucaaacuccugggcucaagugauccucccaccucagccuccugagcagcuaagacuacaggcaugugccacuacacccaacuaaucuuuugguauuuuuuguugagaugggguuuugccauauugcccagguuggucuugaauuccugggcucaaguaauccucccaccuuggccucccaaacugcugggauuaaggugugagccagcaugcccagucuguuuugcuuuuaaaaauaauugaucauauuaacacaugacuuguuuuuuaaagcucucuuucuaaauucugaagcaucuuuuugaccuaagccccacaggccauuuugucucccucccuggcuuuugcuccuguacaucauucacaucuauucccagguuacacagggccuccucagcucuuuugaauuuuuuuucccaguguacaaggagaucgcuaucagcuuauuucuauucuuguacuggccccuaaauguaguaguuccuucuauuguagugcugccuucccucuagguuaauacgggucugggaaaucugagucagauauagauccaggaaagguggaaaucagcucacaugcacaagcaaaaccuggugagugcuugcagcaggcaaauauugguguguguguguguguguguguguguguguuuugagacagucuugcucuguugcccagacuggagugcaguggcacaaucuuggcucacuggaaccuccgucuccuggguucaagcgauucuccugccucagccucuugaguagcugggauuacaggugcccgccaccacacuuggcuaauuuuguauuuuuaguagagacagggauuugccauguuggccaggauggucuugaacuuccaaccugaggugaucuaaccaccucggccucccaaagugcugggauuacaggcaugagccacugcacccggccucuaugauugaauuuuaagaguuauuauguucuggaugcaaaucuguuauuagacauagucuuugcaaauauuuucucccauucuguucuugaugguauuguuuguagcacaaaaguuuuuaauuuugaaauaguccaauuugucuauuucucuguuauguugcuugugcuuuuggccuccuaucuaagaaaacaugccuaauccaagccuauggaaacuugcuacuuacguuuucuuucaaacauaggaguuuuauaauuuuagcucuuaauguuuaguuccauaauccauuuugacauaauuuuuuuccuuucuuuuuuuuuuugagucaaaguuucgcuguuauugcccaggcuggagugcaauggugugaucuuggcucaccgcaaccucucccuccugaguucaagcgauucuccugccucagccucccaaguagcugggauuacaggcaugugccaccacgcccagcuaauuuuguauuuuggguagagacgggguuucuccauguuggucagguuggucucgaacucuugaccucaggugauccacccaccuuggccucccaaagugcugggauuacaggugugagccacugcacccugcugacauaauuuuuauauaaggcaugagguauauauuaaaaaccacugaauuguacguguuaaauagguuaauuguaugguaugugaauuaucucugaguaaagcuggaagaagaaggaaggggagggugcgggagaagagaaggagaagaacucaucuuggcagcaucugcuuccucuuucuugagccccgcaucaccagguccagacuuccuuacuggagagaggcuauuuugagggguaccgcagagccaacgauccacuucuggccaucaucugcauguaauugugagugaucccaagcuagagucauagaggagcugcccaggugaaccccagacaaugcauacaauacuaacauauaauuaaaugaugguuauuuuaagccaccaaguuugggaguagcuugucauauggcaaaaauaauugcaacaaguaguaagucaaacucuugcuuuaacauugcgacuacauauuaauccuaaaauaaaaucccacgaaaggcguggucuucaaaauaagaaccuggauggggacauuaguugauuauaaggggaagugaaauaaggaagcgcuaaggcugguggagcauguuguaaauggcaaguugauccaauccaggcaggcaugccagcuggccucaguccuaaagcucacacuggcagaagcagcuaaccagucacuuguccagaggccaccagauacuuaguaggagcucuagagggcuggcaggucauguuucuaguuacaagaaaugacacaaguuaaccccauccacuggcccuccccauucccugaaaggaaauucacugaacuggaagggacagaguggucagaaccagggauaaaggccaggagucugugucugugucuuaaauggagacuaucaauagugccaaagucucuugauuaucuccacacaggucuccuuuuuuuuuuuuuuuuuuaagagacaggguuuuuuguuuuuuuuuuuuguuuuuuuuuuuuuagaugaagucucauucugucacccaggcugaagugcaaugucacaaucucagcucacuguaacgucugccuccuggguucaagugauucuccugccucagccucccaagcagcugggauuauaggcacccaccaccacacccagcuaauuuuuuuguguuuuuaguagagacgggguuucacccuguuggucaggcugaucuugaacuccugaucucaggugaucuaccugccuuggccucccaaagugcugggauuacaggcaugauucacugucccuggccagagacagggucuugcugugucauccaggcuggagugcaguggcacaaucauagcucacugcaacuuugaacuccugggcucaagggaucuuccugccuuagccucccaaagugcugggauugcaggugggagugagcaacugcacccagcuugggguuguuuuuaguauauacuuggauaaugauguauagcaggagaaugcauauaauuaaauuuaauuuauucacuuagcuuuuugaaaaccuacugugcuaggaaaaaacugugaaccacauagacagggacucuggucucaaaaagcuucuaaucaagugagcaaguaauuccccuaggcuucgagagggaccuuagaaaugguacaugguccagauuuguaggaauugcagauuucuuagagaaagugauaucuaaaaccagaaaacugaggacgcuaguuuuucuuccauuuuguccuccaagacagcuuauuugagggucaaaagaaaugaaggaauggugguauuucuugccugggcaugcacauggguccuucuauuuuuuuuuucuuucuuucuuucuuuuuuuuuuuucagacagagucuugcucugucgcccaggcuggagugcaauggugcaaucuuggcucacugcaaccuccgccuccuggguucaagcgaugcuccugccucagccucccauguagcuggaauuauaggcacgcgccaccaugcccggcuaauuuuuguauuuuuaguaaagacaggguuucaccauguuggccaggauggucuugaacuccugaccucaagugauucgcccaccuuggccucccaaagugcugggauuuuacaggcgugagccccugcucccggccucuauuuucuuuucuagauucuugucaucauuccauguggcuuuauucuauucaguuuauucccuggaacuucaguguucauccaucauucuguugugacuuuccgagcuauguaacaugccucagugugugugguuucauguaucuuugccacugcuuauucauacaaauguguuccagcuaucuauuccuacaaaacaagucauacuaagauuuagcagucuaaaacaacaaugauguguuauuucuucugauuacaugguuugcguggugguuacucuauugguuucaugugggcacauucaucugcuugcugaagggucagcugggcuggaagguccaggaugcccucauucacaugucugagagcuggugcuugcuguugcuuggacaaccugguccuccuccuguggccucuuccccucuaauaagcuagaccugcccccuuucauggugauuucaggagggcauuccaaggggcaaagguggaaguuguaaggccucuuaaagccucaccuuagaaguugcauaaugucacuuucauugcauccuguuggucaaagccagucacaaagcuaggccaaguuuaucaccuuagaaguugcauaacguggccgggcaugguggcucacaccuguaaucccagcacuuugggaggccgagggugaaucacuugaggucaggaguuugagaccagccugaacaacacgguaaaaucccaucucuacuaaaaauacaaaaauuagccaggugugguggcaugcaccuguaaucccagcugcucaggaggcugaggcaggggaauagcaugaacccgggaggcagagguugcagugagccgagaucacgucaccguacuccagccugggugacagaucgagacucuaucucaaagaaaaaaagaaaaagaagaagaauaaccucacuuucacugcaucccguuggucagagcaagucacaaagcuagcccaaguucaagggaaauagaaauggacucagcaucuggaugggagaagcaaugaagucacacuggaagacacaugaggaacuacuguguccaucuuugcauacaguuuccuagagaguguuuuuauguuucugucacuuguguugacauacgugugacaguuguccuuaccaccuucuaagaagggguuguccauuauuauauuaaauaaaauucauaucgcuuauaccaacucugcuguuacuaacuuugggaaagaagccuguugccuguuggcuauuucuuuuucuuucuuucuuucuuuuuuuuuuuuuuuuuuuuuugagacagaaucucgcucugucacccaggcuggagggaaguggcgccaucucggcucacugcaagcuccgccucccgggcucacgccauucuccugccucagccuccucagcagaugggacuacaggcgcccaccaccacgcccagcuaauuuuuguaaauuuaguagagacaggguuucaccguguuagccaggauggucucgauuuccugaccuugugauccaccugccucggccucccaaagugcugggauuacaggcaugagccacugcgcccggccaccuguuggcuauuucuaagcauggauuaaagugcagaagagguuugauuugggaaaauaucuaaauaaucuuuuuuuuuuuuugaaacggagucuugcucugucacccaggcuggaguacaguggugcgaucucgguucacugcaaccucugccugccagguucaagugauucuccugccucagccucccaccacaguagcugggauuacaggcaugcaccaccacacccaaccaauuuuuguauuuuuaguagagaugggguuucacuguguuggccaggcuggucuuaaacucaugaccucaaguaauccacccuccuuggccucaaaaugcugggauuacaggugugagccucugugcuuggccucuaaauaagauuuuuaaaugacuucuguuacaugcugaaugagaaggucuuuaaugaguucuauuagaugcuuauaccuuguauacucuuauacucuuaauaaggguguacauucaugggccaggcgcaguggcucacacccguaaucccagcacuuugggaggcugaggugggcagaucacgaggucagaaguucgagaccagccuagccaacauggugaaaccucauuucuacuaaagauacaaaaauuagacaugguggcacacgccuguaaucccagcaacucaggaggcugaggcaggagaauugcuugaagcugcaaggcagagguugcagagagccaagaucaugccacugcacuccagccuggguaacagggcaagacucccucucaaaaaaaaaaacaaaaaacaaaaaacaaaaaaacaguauacauucauauacuuagaacuucacuugcccccaagauuuuugaugauaacaacaauuuagugaaggaaguggaacagguauuaucuuccucauuuaauaugaguuugggagacagugagaagguacaugacuaguuuguagcagagcuguguuugggucccaggcaccuaauuucuaauccugagucccuuccauggauuucaaauagaacucuaaucauucuucuaggaagagagaagggaccuuaaaggaaucuccauuuucaucaguucauagcuaugaaggcagaaauucaucuugccccaauguagguacaaugauuacuuacauagcauaacacuuuauguacacuguacauuauuucuuauuacaaaguuguuucauucacacucaugauuuucacaagagcuggguaaggauaccauuauagucuugagaaaaacaaggucgaauaaaagaaaaguggcucccagcacguuggaaggcugaggcuggcggaucaccugaggucaggaguuuaagaccagccuggccaacaugaugaaaccccgucucuacuaaaaauacaaaaauuagcugggcuugguggcacgugccuguaaucccagcuacuugggaggcuaaggcaggauaauugccugaauccgggaggcggagguugcacugagauugcaccauugcacuccagccugggugacaagagugaaacuccaucucaaaaaagaaagaaagaaagaaagaaaaguggcuugccuuacaucucaaaguuauuaagugacucacugggauaaacuuaaaucuuugaaugcauagucaaauguucuuucuaccauuauauucuugagaaaaacaaggcugaauaaaagaaaaguggcugggcacaguggaucacgucuguaauccccgcccuuugggaggcugaggcggguggaucaccugagguugggaguucgagaccagccugaugagcauggagaaaccccgucucuaugaaaaacacaaaauuagccaggugugguggugcaugccuguuaucccagcuacuugggaggcugaggcaggagaaucgcuugaaccugggagguagagguugcggugagcugagauugcaucauugcacuccagccugggcaacaagagugaaacuccguaucaaaaaaaaaaaaaaaaaguggcuugccuuacaucucaaagcuacuaagugacucacugggauaaacuuaaaucuuugaauuccuuguccaguguucuuucuacagcaugguugggcucugagucuaaaagcauugaaaauaaacaucauauggcauucagguacagggcuuaauuaccuccaaaugcaaugauugauagguauagagugaguguuugcaugaccuugagcaaguuuccuucccaccacacugaaagcugcaguuccauuuuucucauuugaaugggaacuacauuuuucucaugugaauaaagaggguuuggacuacaaugaucuccaagguuucuuccuacucuagaaugaaauaguucaauuuguauuguauauuauuauuaguuucaaaggaaaugaaaguuuuuaaaagagacagccagacuuucauauggaagacaggaacucaucaggaauaauuuuacagaggaagaugacacaaugaccgugacauuuuauaugguucaauuuuuaauuuaacaaaguuuuaugggccaggugugguagcucaccccuguaaucccagcacuuugagaggccaaggccagcagaucacuugaggucaggaguuugagaccagcauggccaacauggugaaaacccaucucuacuaaaaauacaaaaaaaaaaaaaaaaaaaaaguagcuggacaugguggugcaugccuguaguuccagcuacuugggaggcugaggcaggagaaucaccugaacuugggagguggagguugcagugagcugagauugcaccacugcacuccagccugggugacagagcaagacucugucucaaacaaaacaaaacaaaaacaaaaaaccccaaaguuuuauggacaaacauggacucaaccuucuuggagccuauaauugaccugucuuuaaucugauaaucacagaaacuguacagggagcaaugagauggucuaauugagaccugaccauaaccgagaugcaaaacaagaagucaaguaggcaugggagggugugguggggagaagagagggagagcauucuagccauggggauggcaaauucaaaggccugugguagauggggcaugguauguuugaggaacugaaagagggcaggaucacgcauacuuuauaggcuaugugaagaauuuuggucuuuauccuaaaagcaaugagaagcuauugaaguguauuuucaacaggggaaggacauuaucagguuugaauuuuuaaaagauaauuuaauagcuauguguagacuuagggguccaagguuggguugagaauaagaguggaugcauaguauagucaauuaagaaaacacuguaguugucuagguuaaaguauugguguuuuagacuaagguaguggcagugccugagaugggaaggcuuagacauacaugagagagauuuaggaguucaaguucacaguucaugcugaugacugggcagggggugaggaagagagaggggccaaggacaaugccucauuuucuggcuggacaauguaagcauugacuggcacaggaccggguuuggaaggaagaacgugagcucaguuuugggcuuguugauuuugagauggcuuugagaaaucuauguggaugcaaagcuguaggguugggaguauaggccuggucugggaauauaaauuugggaaucuggaauguggauaguaaucgaagacaggaaauggaggagcucacuagagagacuauggaaugagaaaagagguauguagggacugaaucucaaggaauuccagccuuuaaaguccagggagaugcagauaagccaacacaaggauggcugaguaagagguaggagcagagggcaggucgaaaaccaauagagugugauugaugucccccuagccaagggcaguggucaguaccuucuacuauuggguuuuguuuuguuuuuuuuuuugagacggagucucccucugucacucaggcuggagugcaguggugugaacucggcucacugcaaccucugccucugggucaagcaacucuccugccucagccuccugaguagcugguacuacaggcaugugccaaugugucuggcuaauuuuuuuguauuuuuaauagagaugggguuuugucauguugcccaggcuaaucucaaaccccugaccucaagugauccaccagccucagcuucccaaggugcugggacuacaggugugagcuaccaauccuggacccauauacugguauuaaagucaaccagaauaaggacugacauuuguguuacauugcaucauauauggaugcauaggggaacacuuauaggcccaguuggagcuauuuuggagaugugaaaauggaauccagaggaguugaggaaugccugggaagacaggugugagaagcaagcuauguggguaugggaggauuucaaaagagucaccuauguagucgucuuaguucaggcuacuguaacaaaauauaccauaggcugaguagcuuaaacaacaaacauuuguuugggagguccaagaucaaggugccagcagauccagugacaccugcuucuugguuugcagguggcugcuucuugguuugauccugcuucuugguuugcagauggcugucuucuggcuauguucucacguggcaagagcagagagagagaaagagagcaagcucccuuuugucuguuuugauaagggcacuaaugccaccacgauggcuccagccuuguaaccuaacuaccucccaaaugugccaccugcaaaugucaucacauuagcgacuagagauucaccauauguaauuagcacggaccgcugggcacgguggcucacgcugguaaucuuggcacuuugggaggccaagaugggcggaucacgaggucaggaguucgagaccagccuggacaauauggugaaaccccgucucuacuaaaaauacaaaaauuagccggguguaguggcaugugccuguaaucccagcuacucuggaggccaaggcaggagaaucgcuugaacccaggagguggagguugcagugagccaaggucgcaccauugcacuccagccugggcaacaagagugaaagcccgucucaaaaaaaaaaaaaaaaaaaaaaaaaaaaaaaaauuagugaggacacacucaguucacagcacuugucuucuuagcacagaagugaaauaaugcaauuaggaaagaaauacuagcuuuuucagaaugguagaauagaacaugaaauuguaaccucuuuucaagauugcuaacuugaauacagucugcuaaucguagaguuuuggauugcauuuccaauuuuuuuuuugaaauuacuaggagaaaaugcaucuuguuugcuucugaagcaauuagaaauuacaugugugguaggcugggcuuguaaucccagcacuuugggaggccgagacggguggaucaccugagguugggaguucaagaccagccugaccaacauggagaaaaccugucgcuacuaaaaauacaaaauuagcuggguguggugacacaugccuguaaucccagcuauucgggagaucaagguagaagaauugcuugaacccaggaggcggagguugcagugagccaagaucacgccauugcacuccagccugggcaacaagagcgaaaaucugucucaaagaaagaaaaaagaaauuacaugugugguggcaccugacagcugcaucugucugucugacaacuuugcuguaguacuucauggaaaucuaugauuucaaaugagcuguuuuccuuucguauagguuuacuuuucuuuucccuuuuuuucuucccaggcugaugagcccugaaaacacacuccugcagcccagggaggaggaaggggucaaguaugagcgcaccuucauggcaucugaauuccuggacuggcugguucaggaaggugaggccaccacgaggaaagaggcagagcagcuuugccaccggcuuauggagcauggcaucauccagcauggugagcguauugggcagcuuuugcugcaggaacaaacagccagccccaaaucuugugucuuacaacaacacguacuuauuucucacucaugaaucuguaagucagcugcaccucugcuuauguucagcuugucuccaaguugggggucaaauucaggucugugcuccacgccuuuccauucugggacacagacuaaaggaauauccacugucugugauguguuguuuuuaauaaauuauugcagaugcuaaagagggcaggcagguucuuauagcgcuuccaaaaguugcugcuuggaugugauguaacaucacaacuuuguaucuaacuggcuaaagcaagucaugaagucaaguauaauauggaguugggaaguggaugccucccagaagguugguuguuagagaauaaacauuuccugaaccaugauguaagcugccacagugaagaguuaagccaaagagccuucauaaaaguaucacuuuccguuuagggccaaaucauaaugaugcaauguaaguuacugguuaagaaguguuuuagucagcccuuuguaucuguggguucugcaucuguguauuuaaccaaccaugaauuuaaaaucuuuggaaaaaagucgugucugaacuacacacacacagacauuuuuucaucauuauucccuaaacaguacaauguaacaacuacuuacagaguguuuacauuguaucggguauuuuacauuguaucugaccuacguugguuaacuguaggucaugagacucccauuccaaguccggcacgguggcucacacuugucaucccagcacuuugggaggcugagguggguggaucaccugaggugaggaguucaagaccagccuggccaacauggugaaaccccaucucuacuaaaaaauacaaaaauuagcuggguguuguggugcacgucuguaaucccggcuacucaggaaguaaucuagagaugauuugaaguauacaaaaggaugugcguagguuauacauguaagggccaagagaacacuuuccccuuugcccucugaagguuugcugaaaaucacugacaagaggcagauuuguuuuguuuuguuuaaggcagagucuccuuccgucacccaggcuggacugcaaaggcaccaucucagcucacugcaaccuccgccucccagguucaagugauucucaugccucagccuccugaguagcuggaauuacagugggauuacaggugcacuaauuuuuguauuuuuaggggagggauuugccauguuggccaggcuggccucuaacuacuggccucaagugauccacccaccuuggccucccgaagaacugggauuacaggcgugaacaaccaugccgggcccaagaggcagauuaauaggagaaaaggcauacaaauuuauuaacauguauggcagccuucagaaugaaaagccagagauacagggaaaaucauccauuguuaugcuuauguucaacaaaguauggacaguuauguagaaauaugauuggacaaaaaggguaugaucuaaaguuaauagacugaguagagcagcccaacaaggccugucuguauagauucuuuuuggccucucugcagcauucauuccuccuggguguagggcaggacccuuucuggaaugggagucuuuuuuguuuuguuuuguuuuguuuuguuuuuuugagauugagucucucuuugucacccaggcuggagugcaguagcaugaucuuggcucacugcaacuuccgccucccagguucaggugaugcuucuaccuuagccuuccgaguugcugagauuacagacgugcaccacaacacccagauaauuuuuguauuuuuuaguagagaugggguuucaccauguuggccaggcuggucuuacagucuucaccucaggugauccaucugccucagccuuccaaagugcugggauuacaagugugagccaccaugcccggcuuggaaugggagucuuaugaccuacaguuaaccaacguaggucagauaauuucuuuauggccuguuuuuacacagaaaggcagagggaaaguuagaguaauauuuuaagauuuuauguaaucccagcacuuugggaggcugaggcugguggaucaccugaggucaggaguucgaaaccagccuggccaacauggugaaaccccaucucuacuaaaaauacaaaacauuagcugggugugguggugugugccuguagucucagcuacucaggaggcugaggcaagagaaucgcuugaacccuggagguggagguugcagugagccaagauugugccacugcauuccaaccuggguggcagagcaagacuucgucccaaaaaaaaaaaaaaaaaagaguaaguauuguuuuacaguacuuuuauuucauuuagauauacacuauaaaacauagggacauaugcagguguauauugaguuacaaccuaaaaauuauuuguuacuguguauuggagucaaauauuuuggaagccauggaucuagaggcauugcuuggagugagugacacuguauuccaggcugcuuucuccugugcaguucugccacaguuggacucacagcugucuguugguggccuaacaugucuagcucugguuuaaguucacugaggaaaggaagauggacagggaagcacagugcuggugugaucccugaccuuaagcaguucauaguauugucaggacuaugagaugguuauagaagcaauuagagaacaguagaagaugugcuaucuauuucauuuauuuauuuauuuuauacuauaugccaggcacugugcuaauccuuuuacccuuauuaacuuauuaauaaauaaacucuaugagguagauauucuuuuuuuaaaaaauguauugugauaagaacauuaauaugagagcuaccuucuuuuauuauuauuauuuuuuuuuugggacaguuacugcucugaucaugcaggggcagaucucggcucacugccaccuccacuucccagguucaagggauucuccugccucagccucccgaguagcugugcaccaccacacucagcugauuuuuguauuuuuaguagaaacaggauuucaccauguuggccaggugggucuugaacuucugaccucaagugaugcgccugccccggucucccaaaguacugggauuacaggcguaagccaccaugccuggccugagagcucccuucuuaacaaauguuuagauguacaauacuauagggccaguauuuuuauuaucuccauuuuacaaaucagaaggugaaggcaccaauaggauaaaucacuugucugaggccacucagguaguaauguccaaauggauauuacugcuaguaagugugaccuuggaguugggugggaugacugggguuuuccccagugaaaaaugguagguuuggguuacaguugguucuuucauaucuuugcucuacagagaaaaaguaagaugaggcugggcaugguggcucagcgagcuggccaacauugugaaaccccgucucuacuauaaaaacaaaaauuagccgggagucaugguggaugccuguaaucccagcuacuugggaggcugaggcaguaagaaucgcuugaacccuggagguggagguugcaguaagccaagaucacgccacuacacuccagccugggcgacacagcaagacuccaucucaaaaaaaaaaaagucagaugauaccaacuucuaggagaaaaccagccucuuauacuaugauguacugacccacacuguauauccuuggcuuuagaaagaagauagaggaugcugugaaugguuucuaaaugauuuccaagggauaaguaauuaugcuucaauuacaguguaacucuguaaugcuauaaacagaaacaccauaaagguacaauguaaaggauaaaacaaaugcauuuuugauaauaaaucuguuuuguuuuuuuuuguuuuuuuuuuugagauggaguuuugcucuuguugcccaggcuggagugcaauggugcgaucuuggcucacugcaaccuccaccucccagguucaagcaauucucuugccucagccucccgaguagcugggauuacaggcaugugccaccaugcuuggcuaauuuuuuguauuuuuaguagacagaggguuucaccaugucagucaggcaggucucgaacuccugaccucaggugauccacccaccuuggccucccaaagugcugggauuacaggcgugagccaucgugccuggccgauaauaaaucuuaaccaccgaaguaugcuucccgugauuguaggaguacugaauauucuacauagcaacugggguuucugagggaguuucaguuucccagcacaguaauucauugauaggucacagguuguaacuuggaguuaugaaaauauggcuaccauaccuguguauguuagagcucaugguaaguaccaguuagugucuugagcaaagcuuuuaauugucuggcuaauaauuaauuucauagguuaaacauuaaggaaagucagccuuuaggcuuugagcagaagguuucuggauaaaagugguucccuauuuugaaaccaguaaguguaaaaaucaggcuuaccugugaaauccuaacuagcuucaucuaugaauggugacuggugcgcuuuacucaaggcagaaauuguuagaugaauaauuaacaugcauguguauuuauguggauauauauauaugcauguauauguacauauuuauacaaaugucuguauguugaccacaucuauacauauuugucuagcuuuuuaauuuauagauguguaccaucuauaaaggcauuaggcuacuuuauagaucuuaauauacuguauauuuaauaugugugugcuucacacauaugcuuuguauguuguacuuauuaaauccucacagcaauuuuguggcauuaguauuauuauugcagauuuacagugaagaaaucuggucuucaaauccuuuaacagauuuuucucaaguuccagagcuacccuguagcuacuagguguugugucuuagaaagaagcuugccuuggucugggaugugacuggguauggcugccuggcaugauggaaugagcacagucuucggaaggagacagacuggauuuagaugcggcuuuuucaccuacuaaguggccacgucugcaucuuauaacuuucccauuccucggauuuugaaacuauaaaauuagaguuacauaauagaccuuugagaguuuguuuuuucagagaccuaugaacauccacaaguucaguguguacuagaaggguucaacguguaguuguguucguggcuaagauuuauuacagugaaaggauacacagcagggucagcaagagaaaagggcacaucggguggaguguggagaaauccaggcacaguuuccuauguucuuccuucuugaagggacucccuucucuagccgugaaaugcaguaacacgugugcaauaucuccaccggggagcccucggaggggccaagggaaaacauccccuuugccaucugaagguuggcugaaaaaucggccgggcacaguggcucacacccguaaucccagcauucugggaggccaaggcgggcggaucacaaggucgggagaucgagaccauccuggcuaacacggugaaaccccgucucugcuaaaaauacaaaaaaacuuagccgggcaugguggcaggcgcuuugcagucccagcuacucgggaggcugaggcaggaugauggugugaaccugggaagcggagcuuguagugagcgaagauugcgccaccgcuccagccugggcaacagagcgagacuccgucucaaaaaaaaaaaaaaaaaaagaagguuggcugaaaaaucaacucacaaaagacagauuaauuggagaaaaagcaaaccaauuuauuaguguguacaccaggagaaccagagugauuaccuaauauuccaaugggguacagaggcuaccuauccuacuucuuagaggaacgggagaugaggaagugugauugauuuuuaggaggcuucaguaggcuugaagaauauacaagggccugcuacuaaguccauugggucagcagagcagaccuggcaaaagucugaccagguuuguccacagacuucagucuuucuuccugucauaugaguucaguuaaugaaaacucagggaaggaaccagagguaaauuguuuucuucuuuggcagguccagacuuaggcagguaaggaacuucagagaccuuuauccagugcuuugggggacacagaggauugaggggcagaagcggggagaaggucggagacaucguagauuuuucuucaguucagcauaucaaagugcuauauuuuggggugucuguuucugaguccuaauacccauguugaggugcagagccaaagauucuuacugggggcuuuucucauagguauacucugcuugcucagccagccacaaccagcaacauugcagacucucagaaggaaagcaaguauucuccauaaaucacacuguuuguacagucuaggcaggccgauacaacacaauucagugcaccaggugggcaagguccuuaucaguuagugacuugggaaccuuccaaaagccaaguucccaggugcuagccaugggccagccccauaagccggcccuuccguauuggggcugcuaugguaacucuuuccugcacagaauuguugggagaauuaagugauugcacuuggcaaaagcuuuuaacacagcaucuaccucuuauggcccucaaaugcuagcucuuguacaugaucugaucuacucuaaauaauaggugaaauguauagagcucuuacuauaucccagccacuguucuaacaacucuauucacguauguauuucccugucaguuagguaucauaaucauucucauuuuugagaugagguuaaguaacaugcugaaggcugggcauuguggcucaggccuguaaucccagcacuuugggaggcugaggcagacggaucacuugaggucaggaguucaagaccugcuuaagcaacauagugaaacucugucucuaccaaaaauacaaaaauuagccaggugugguagcaugugccgguagucccagcuacuugggaggcugaggcaggaaaauugcuggaaccaaggaggcagagguugcagugagccgagaucaugccacugcacuccagccuuugugacagaguaagacucugucucaaaaaaaaaaaaaaaaaaaaaaaguaaugugcugaagaugagagcuagugagugguagauucaagauucaaaucaagacagucuagcuucagagccugcacucuuaaccgcuaaagaagaugagaugcuaacugcaggccccacuagaaaaaaauucucaaguucuauugcaucagcugaaucagccgacauagccuggcagauauuuauacuauaaagauuauuaaccucugaaaucuacaauauucucuuccuccaaacaaugaccagggaccuugagauuuuuggguaacauuugcaaaugggaaaugggauaaauaccuuuuuuuuuuuugagacggaguuucgcucuuguugcccaggcuggagugcaauggugugaucuuggcuuaccacaaccuucgccucccagguucaagcaauucuccugccucagccuccugaguagcugggauuacaggcaugagccaccacacccggcuaauuuuguauuuuuaguagagacaguguuucuccauguuggucaggcugcucucgaacucccgaccucaggugaucugcccaccucagccucccaaaguguugagauuacaggcaugagccacugcaccuggacucuuuucuuuuuuugaaacagguuuuugcucuguugaccaggcuggagugcaaugacaugaucauggcucacugcagccuugaccucccaggcuaaagcaguccucccaccucagcuccugaguagccaggacuacaagugcucaccaccacacccggcuaauuuuuuaauuuuucauagagacggggguuguugccaaguugcccagguuggucuugaacuucugggcucaagcgauccuccagccuuggccucccaaagugccaggauuacaggugugagccacugcaaagggcccgaacacacuucuuuacucacauaaguuaucuuucccaacucccuuaguugccauccagcuauuuuagcagccuuaaauggagggagauggaaaccagauaaucauguggguaaauugcucacagcugcagcagcugacccuggccuaccaggcuaccgcugcugugucugcguggauaauuuccuguuuuagaacuuuagucagagcacuucaacaauuucaacacuaagcccucuuucuuuuucuuuuguuuuaaacauauauuuauaucauacugugccauauacaaagcaguuuuacauacauuaucuuuuuaauccucccaguugcuugagaguagcuaugauuaucucauccuucaguggaagacaguagcagagacauuugcucugcuggccaugaagagagaauuugggaucugcagcaaaggaagcuagaggccacauccagacagaaauuaacugcaucucuccaauaauuaagauaauugauagagaucagccuaagccuggaauagcccagcuggaaaggaaaggggaaaaaggggaagaggagagggaaggaaggaaaagaagguacuaacugggugugguggcucaugccuguaaucucagcacuuugggaagcugaguggggaggauugcuugaggacaggaguucgggaccagccugggaaacauagugagaucuugucucuuuaaaaaaaaaaaaaaaaaaaaaaaaaaaagagaaagaagguacugaugauugaggcuaaaggcaagauuacaccgaggaggaaaaauaauuuuuucuuuacuuuucaugaguucuuaauugagaccugcuguaacaaaggacggacuaacaagagaaaaaugaacagaaguuuaauauguaugcccucuguaaauaugggugaaaauccagagaaaugaguaaaucucuaggauagaucucaaaagaguaguucaggccaggcgugguggcucacaccuguaaucccagcacuuugggaggcugaggcgagagaaucacuugaggccaagaguucuagacuagccuggcugacauggugaaaccccgucucuacuaaaaguacaaaaauuaggcaggcuugauggugugugccuguaaucccaguuacuugggagguugaggcacaagaauugcuugagcucagcaggcagagguugcagugagcugagaucgugccacugcacuccagccugggcgacagagcaagacucugccucaaaaaaaaaagguggggggguggguaguucagacuucaggcuuaaauaccauuauucccugaaacaaagaaaaaaagauguaacccaguuaaaaccagagggucagaaaaagaccuuauacaaauguaugguuuguuaugcagacuuaggucaacaccuucuuuauuuauuacgagucucuagugacuuaauuuucuuucuguuccuggugcagagagggagagaccuuuacagaggggcauuuccuagcucugcaugguggcucacacuuguaauccuaacacuuuuagaggccaaggcgggaggacugcuggagcccaggaguuugagaccagcuugggcaacauagcaaaaucccaucucuaaaaaaaaaaaaaaauuuuuuuaaaaaggacaaaaggacauuuccuuuacagauguacauuuuugaaaggacaacuuuuuggagcuacugcugugucugcagcuucucaaaauaaccaguaccaaacaauccuuaugccagguagccauauuucaggguggcauguccugagccccaucaauugcaacuuucucaagacuauauggcauuaagaaaaaaauuauugacacuuguuagaaaaguaaggaaaacuuuguuuaagauaauuacaauagggguauugcaauaggggagacagauugggcucaacuuaaaauauagggacaaguagggauuuagagucaaggagcacagugcggagucggucaguggauggaaaauuacuaaauaggagacuuagggcagagagauucuugcucaagacaggccaaggacuuagaaaucaaagguggagauaacaaacuugauuggguaucaagggugagggauuuucaguauacugacuuaucaggguuauuugcuaaaacugggcuggguaagccaagacagcaggaugagggguggaguggaggggaagggagcagcaagguggaggcccaguagaaaagagggcucaaaggagccugacugaagcuugguccaggggagcgucuaacagugccgaccuagccuugcuugcccacccgcccuuccucucuaucauggcucuccugcucuccuacucaugcuugcuccuuuuuuuuuuuuuuuuuuuuuuuuuuuugagauggagucucacuuuguugcccaggcuggagcacagugaaccgagauugugcuggguucaagugauucuccugccucagccuccugaguagcugggauuacaggugugugccaccacacugggcuaauuuuuguauuuuuaauagagacgggguuucaccauauuggccaggcuggucuugaacuccugaccucaggcaauccaccugccuggcccucccaaaaugcugggauugcaggcaugagccaccacucccagcccccuacucaugcucucugguuugcauuugcuaacuucuugccaagaggacuugcaagucaagaagaagaaauggaggagacuucuuuacagauggcacccugugucuuagccuuucuuuaccccuaacuagagaguaaauguuuuaaggauagagaaguuguuuuguucauuucuguauuccuauugguuuggcgcauauauaugucguaucagcaaaaaauacgauauauauauaucguaucagcaaaaauguauugaaugaacaagugacaaaagugaccacuuacugaggacuuggccuuugcugggcacaauacugguguuuauaccagcaagcuuucuuugaauagaagcagcuccaaucaucacuuccuuuaaauauauggcagagccagcugauaguuaaaggaaauguugaaaacaaggcuaccugaagaagagaaacugaagcaacucuggggauccaggaaccaggaacuagugacuaaaaacuaaucccuuccagccaccuauggccaggugaaucagcucuguuuucugcauaugcaguugccgucuccagaugcuaauguucuagagaggacccuuauuggcugggucgggucacaggcucaccucuugacccuggguggggacccuuugacugacagauucaccaagugggagaauggggguaguuguuccacccuccccccgcacacccugcaaagaaaaaagaaaaagcaagcccuguuuccacaggaaaaugagugcuuggcaggcuguucuuuacugcuauuaacucauuuaaucuucacaagcaaucaaugcacuugauacuguuaucucucuuuuuaaauuuuaugccauuuuuuauuagauggagucuuacucuguuacccaggcuggagugcaggggugcaaucuuggcucacugcaaccuccgccucccggguuguagcgauucuccugccucagcuucccaaguagcuagaauuacaggcacgugccaccacacccagcuaauuuuuuuguacuuuugguagagacgggguuucgccauguuggccaggcuggucucaaacuccugaccucaagugauccgcccgcccuagccucccaaaguauuggaauuacaggcaugagccacugcacaugaccaugucucuguuuuuuuuagaugaagacguugaggcauuugcaacugguauaaucauucuuagcuccuaaauguucaacuuugaacagaaaaaaaaaagcuggguagaguauuuucucaaucuacuuucaauauuuaacauuucaaguguaaucuuagcagcagcuguaaucuaaucuaauuuuuuacuuuccgaauuuagacuuucugggcauuuucccacugugcucucucauaugcuuuggcccuguguuacuuucuauuguagcugaauccaaugcaggaggaagaauagacacagccagaaugcuguuguaauguaaauagaaaggaacagguugcuugauagagggccaagacauuggcacacaauaaaguauugguuuauguuaaaggaaaauguaccuauaacggcaucaagccuuaacuuuucagaaaguaugaaaggaauacaggaugccuuaucuuauguaauauuuugaaagaagaguguuaugcacacagacgagagguuucuuucucucucucuuuuuuuuaauuuaaagauggggucuugcuauauugcccaggcugaucuugaacuccuggggucaagugauccucccaccucagccucccaaaguucugggauuacaggcaugaaccaccaugcccauuugagguuuuucuuuuguaaacagugucauaccuaugaauauuucuuuccuucuugacauuaguagaaucuuuguccauuguauauaaacugcuucucgagguacaaccuaugcuugcuucugaagccuguguuccuacccaccccugccucaguccugacagcucgucacccaguguccccugcaguaugagguccucacuuugcccaagcaugaucuuuuacaacagcacacagaagucuuaaaacgccagcacaauaucucuaugcaguugagguauauugaaagugugcuccuacugagugcucagcuuggccuuaucuggucauuuaaauccucagcaggguuuaaguggucauuuucaguggggccuguagaaugaggucucaggcucgcuagaagagcauaucagguuucucagucuccuggguggaacagagaguucaaacuucagauucugauaugcuucaucucucuccuggucaaagagugcugugguauuaaguuccaguuccugaugaacgugagcuagaucauacucgucaaugggaggcgggggcugaggagacaaggggaccaaaaguugagaggcucuccuuuaagcagugaauuguuuccauucucuuuccaucacagaccuuuuuucuagcccugacccuugugucaaccuugggugaguuucuaguaucagcccccucccagcuggguggcuaggggguuugggcugggauuccugucugggacccaggcucuccuuaugcagguauaaacaaugauuacucucagcuguuucagccuugcugcacugcugucacucaugauucuuccucuaaaaguuuuuccacuagcugcuucuggcuuuugauucugagccgcucacuauaauucaguuucucuuagcugauaacucucaucucaguacaucugggucgucuuuucuguuuggcucucugauucuuuggaaaaacuccuucuuucuaucuucccucucccugcucccugcucccugcucccugcucacccccacuccagccaggaauggauaaacaaguccaaguauguuaaugccagggaguaacuaccaggaauaaaacugagcauaagcaaacucaucagugugaccacggaacgguaugaagaugaaauuuaagaaggaaucucacuuacacucacauacaucuauccugacuaugauuggaaaaauauguguguugauuaauauucauaaucaguuuugauuuagagaguaauguuuuuaaaaauuauuaauuaguauguuauuuuaaaaucaacauuuuaaaggcuagaacuuuucauccagcuuuuuuucuuuuucuugagguggagucuugcucuguugcccaggcuggagugcaguggcaugaucuuggcucacugcaaccuccaccucccaagcacaagcaauuuucccuccucagccucccaaguagcugggacuaugggcguggcuaauuuuuguauuuuucauagagacaggguuuugcaauguugcccaggcuggccuccaacuccugaccucacgugaugcacccgccuuggccuccuaaagugcuggaauuacaggugugagcuacugcaccuggcccagcuuuuuuucuagaaagcuucccuuuacuuuuuucuccucugagugaugacacuuaacccaacaaagagcucaccccacccccgcuuccauccaaggaaggccugcguaucaggguucauauucuuuaaauuuuauuuuagccacuccccaagcugucccagguuuuggucauauuggcaguuggcaaagccuccaggccacuggggaagggguggguguugguuuugccccacuggcucacuccugugacucugaaauccuucuuggugcugaaaucauaaccucaaugggggauuccucuuaagugggaacaaaaugugcuuccucaucaaaauaagggaaaugggaugggggagauagugugagaaaaacuggaaaaacucuugaucauuugcuuguucaggacaaggaucaucuucuauggcaaauggcuuucaaaguacuguacccaaugaaaggggugaacuuguuuguugguuggcuguucuguucuugugggaaaucagccaccagaccagggcuacccaaugaaaauaugcuaggagccaccaagacaaucuacauaugugauuuuaaauuuucuaguagaaauagcaaaaaaaaaaaaaggaggaauggguuaaauuaaucuucauaauauacuuuaacucgccaucuccaaaauauuaucauuuaaaaaugcaaucuauaugaaaaauacaaauuagcuacuuuacauuuuguuauacuaagucuucaaaauccaguguguuuuuucauuuuaaucagacucacauuucaaggcucacguggcuaguggcugccaucuuggagaacacagcucuaggccguuuugaaaccagcagagggcagcaugguguccugaccugugugcauuucauuuuucuuuuuucuuuucuuuucuuuucuuuucuuuucuuuucuuuucuuuucuuuucuuuucuuuucucucuuuguguuuuuuuuuuggagauggaguuuuguucuuguugcccaggcuggagugcaaugguacaaucucggcucacugcaaccuccgccuccuguguucaagcaacucuccugccucagccucccaagcagcugggauuacaggcaugugccaccacagccugcuaauuuuuguauuuuuaacagagacaggguuucaccaucuuggccaggcuggucucgaacuccugaccucaggugauccacccgccucggccuuccaaagugcugggauuacaggugugagccacugugcccagccgcauuucauuuuucagucccuuaucucugugaucuuuguuccucuaugucugagauuucugauaucuguauuuuuacagugccaguuuggacauccauauaaaguggguaccagccacauagguaacaacaaauguucucccuuccccagcaccaugauuucacaauccuauuuucuuucucucucaguuuuugaugaggaagcuaaagcccaaagguauuaggaagucacccaaagaaaacacaguaaauggcaugaggaaaauagaacuauagugucugacuccagaauccaaguuccaaacaacuguucuauggccuccaugagaaacaauuccugugcuuguuuaacagguucuccuaaagaaucgaaacaauguccaucaaacuguuaauguauggcuuccaaacugaauuaacaccaaauucuacacuaccaauuauauuuuagggggagucuauucaggucaauuugcagcuuaaauuuucuacuuuuucuuuccacuccguuuuuacuuuaccuuugauuuuuuaauauuuccagaagucaaaaauguaggaugggcacaguggcucacgccuguauucccagcacuuugggaggccgaggcaggcaaucguuugaggccaggaauucaagacaagccugggcaacacagugaaacuccaucucuacaaaauaucaaaauaauuagccaggugugguggugcacaccuguaguuccaacuacuaaggaagcugagaugagaggaucacuugagccuggaaaagucaaagcugcagagagcagugauugugccacugcacuccaagcaacagagcaagacccuaucucaaaaaaaaaaaaaaaauguaguuggcuauuauuauuuagacuggacuugauuuuggcaauucucuuaaauuccuagucuucaggcugggcgugauggcucaugccuguaaucccagcacuuugggaagccaaggcaggcgaaucacaaggucaggaguuugagaccagccuggccaacauggugaaaccucguucuacuaaaaauacaaaaaauuagcugggagugguggcgggcgccuguaaucccagcuacucaggaggcugaggcaggagaaucacuugaccugggaggcagauguugcagugagccaagaucaugccacugcacucuagcccagucgacagugugagauuccaucucuaaaaaaaaaaaaaaaaaaaaaaaaaauucuaguuuucauuguggggguccuuuggaguuuuacugacagcagaacaauauuauuaaugcuauauuagcauuauggagaccaugucuuucagggagagauugguuucuacauauuuauuacuuucacuugcuuuggauaaaagaauacaguaucguaauuucucuuccacagauggaaaaauugaggccuaaggacugaacauaacauaacugaacauuccccuguucuguugcaggggaaucugagccacauugcuagaagccaugucuucugacagcuugacuuccugucuaagcagcuucguggcuucugagucaagcauaguuucuuacacgauaugggcuucaaagagauagaaaguguuuguuuccuaagcuuuugaucuuaugucucuagacuugaauuugggaugcuagcuggguuguguuuagcaacaaauaacagaaagugcaguaaagauaguuuaagccucuagacuugaauuugggaugcuaucugcguuguguuuagcaacacauaacagaaagugcaguaaagauaguuuaagcagugagguuucucugccuccugaagugagaugcccccaggucuagaaucccaggcugacacugagacuccccacaaaggcgcuguccaucucucucucuccuguucuuaguguacaccaggccucaugucugcacucugggcaggaagaacagggaauggcaaagaguuaagagcagagaggugucaccuagcaagacuuugcuuuuuaucugggaagggcagucugucccagggauuucauccuacaucucaugggccagaacugugucacauggucaccccaugcuggaaggcagucggugacucauaugguuuuggcugggcacacuacugcccugagcaaaauucuuaaggaggaagaaagagagauuggguuugaauaagcagcuggcacugucagcuacaaggacaaaugucuuuuucauuaaauaacuaagcaaacuuccuuaugaaacauacgcuuuuaaggaacagcuuucuuccugugucaacacaaauagcucuaagcuagauuuaaaagcagauggguauaccgauguuaaugucucaguuucaacaaauguaccauaguuauguuaacauuugggggugcuggaugaagggcauaagggagcuaucuguacuaucuuugcagcuuuucuuuuuuuucuuucuuuuucuuuuuauuuuuuuuuugagauggagucuuucugugucucccaggcuggagugcaguggugcaaucuuggcuuacugcaaccgaguagcugggauuacagguguguagcaccacgcccagcuaauuuuuguauuuauuuacuuauuuuuuugagacagagucucacacuguuacccaggcuggaguggaguggcgccaucucggcucacugcaaccucugccuuccagguucaagcgauucuccugccuuagccuguuuaguagcugggauuacaggugcccgccaccacgcucagcuaauuuuuguauuuuuagcagagacggguuucaccauguuggccaggcugcucuugaacuccugaccucaaguaauccgcuugccuuggccucccaaaguucugggauuacaggcaugagccaccgugccuggccuucuuugcagcuuuucuauaaaucuaaaguuauucuaaaauguaaaguuuauuuuuuaaaaaguagguggguuuuuuuuuccugcaucuucuuuuuuaaagcuaugaacaauauagaaaauauauaaagacaguuaaaaaaaagacuaugucuugccacugcuaucuuccuuuucugaacuuuagccucuuccuccuuugagggucuguugacauacugacuuuaucucuucagucucaaaagcagcaccugauaaauuacugugcaguaaagcaccagcaaguuaauaugguaaccuuccugggaauacuaagaaaaugccaugcaggagugagccuuugggaagaaacuuucacauccugggguuccugggaaggauuuuauuucaguaccccacugucuguuccccgagaccaccuagaguuacuucuagacccuucuauaaaaauaaggucugaaaaggcuucuaccuuggaaagauauccuuuuggcccugacacccugggcccuugcauggaagcacacauggcuaauauuuauggaauccuucuauggaccagggacgcuacuaggccuuuuauuuuauuuuuaaauuuuauuuuauuuuuaauuuuuguuauacuucaaguucugggacagguuuguuacauggguauauaccugccauggugguuugcugcacccaucaaccugucaucuacauuagguauuucuccuaaugcugugccuccccuaacuccccacccaccaacaggccccagugugugauguuccccucccuguguccauguguucucguuguucagcucccacuuaugggugagaacaugcaguguuugguuuucuguuccuguguuaguuugcugagaaugaugguuuccagcuucauccaugucccugcaaaggacaugaacucauccuuuuuuauggcugcauaguauuccaugguguauaugugccacauuuucuuuauucagucuaucauugagggacauuuggguugguuacaagucuuugcuauugugaauagugcugcuauaaacauacgugugcaugugucuuuauaauagaaagauuuacaauccuuuggauauauaccuaguaaugggauugcugggucaaaugauauuucugguucuagauccuugaggaauugccacacugucuuccgcaaugauugaacuaauuuacacucccaccaacaguauagaagcauuccugggcugggcacaguggcucaugccuguaauuccagcacuuugggaggccaaggcaggcggaucaugaggucaggaguuugagaccagccuggccuacauagugacuaaaaauacaaaaaauuagcuggguguaguggcaggugccuguaaucccagcuacuugggaggcugaggcaggagaaucacuuggacccaggaggcagagguugcagugagccaagaucacgccauugcacuucaacccgggcaacagcaugagacucugucucaaaaagaaaaguauuccaauuucuccacauccucuccagcaucuauuguuucccaacuuuuuaaugaucgccauucuaacuggcaugagaugguaucucauuaugguuuugauuugcauuucucuaaugaccagugaugaugagcuuuuuuuuucauguuuguuggcugcauaaaugucuucuuuugagaagugucucuucauaucccucaccuacuuuucaaugggauuguuuuuucuuguaaauuuguuuaaguucuuuguagacucuagauauuagcccuuugucagauggauagauugcaaaaauuuucacccauucuguagguugccuguucacucuuaugauaguuuauuuugcugugcagaagcucuuuaguuuaauuagaucccauuugucaauuuuggcuuuuguugccauugcuuuugguguuuuagucacgaagucuuuacccaugccuauauccugaauggucucuaagaacuugcuuuaugaaucucaguucuccuguauuguguguauauauauuuaggacaguuagcucuucuuguugcauugaucccuuuaccauuauguaaugcccuucuuugucuuuuuugaucuuuguugguuuaaagucuguuuuaucagagacuaggauugcaaccccugcucuuuuuuuuuuuuuuuuuuuuuuuuuuuuuuuuuuuuugcuuuccauuugcuugguaaauauuccuccaucccuuuauuuugagccuaugugugucuuugcacaugagaugggucuccugaauacagcacaccgauggguuuugacucuuuauccaauuugccagucuguaucuuuuaauuggggcauuuagcccguuaacauuuaagguuaauauuguuaugugugaauuugauccugucauuaugaugcuagcugguuauuuugccuguuaguugaugcaguuucuucauagugucaauggucuuuacaauuugguauguguuugcaguggcucguacugguuguuccuuuccauauuuagugcuuccuucaggagcucuuguaaggcaggccugguggugacaaaaucucucaacauuugcuugucuguaaaggauuuuauuucuccuucacuuauaagcguaguuuggccugcauaugaaauucuggauugaaaauucuuuucuuuaagaauguugaauuuugcccccacucucuucugucuuguagaguuucuucugagagaucugcucuuagucugaugggcuucccuuuguggguaacccgaccuuucucucuggcugcccuuaauauuuuuuccuucauuucaaccuuggugaaucugaugauuaugugucuugggguugcucuucucgaggaguaucuucguuguguucucuguguuuccugaauuugaauguuggccugucuugguagguuggggaaguucuccuggauaauauccugaagagugauuucuaacaugguuccauucucccugucacuuucagguacaccaaucaaacauagguuuggucuuuucacauagccccauauuucuuggaggcuauguuuguuccuuuucauucuuuuuucucuaaucuugucuucaugcuucauuucauuaaguugaucuucaaucucugauauccuuucuucugcuugaucgauucagcuauugauacuuguguaugcuucacaaaguucucaugcugugauuuuucagcuuuaucagguuauauauauucuucucgaaacugguuauucuaguuagcaauuccucuaacauuuuuuucaagguucuuagcuucuuucacugggucagaacaugcucuguuagcucagaggaguuuauuauuauccaucuucugaagccuacuucugucaauuugucaaacucauucuccauccaguuuuguucccuugcuggugaggaguugugauccuuuggaggagaaggggcauucugguuuuuggaauuuucagucuuuuugugcugguuuuuccucaucuuuguggauauaucuaccuuuggucuuugauguuggugaccuucggauagaguuuuguguggauguccuuuuuguugacguugaugcuauuccucucuguuugcuaguuuuccuucuaagucagaccccuuugcuguagcucugcuggaguuugcuggaggucuacuccagacccucuuugccuggguaucaccaguggaggcuacagaacagcaaagauugcugccuguucuuuccgcuagaagcuuugucccagaggggcaccugccagaugccaaccagagcucuccgguaugagaugucugucgaccccugcuggcauaugucucccagucaggaggcaugggauucagggacccacuugaggaggcagucuauuccuuagcagagcucgagugcugugcugggagauccagugcucucuuuagagcuggcagacagggagguuuaggucugcugaagcggcgccaacagcugccccuucccccaggugcucugucccagggagaggggaguuuuaucuauaagucccugacuggggcugcugccuuucuucagagaugcccugccucuagagaggcagccuggcuacaauggguuugcauagcuguggugggcucugcccaguucaaacuugcugguggccuuguuuacacugugaggggaaaaccaccuacucaagccucaguaauggcagacacccuuccccccaccaagcucgagugucccaggucgaccucugacugcugugcuggcagugagaauuuaaagccaguagaucuuagcuugcugggcuccauuggguugggaacugcugagcuagaccacuugucucccuggcuucagcccccuuuccaggggagugaacaguucugucucgcugguguuccaggcaccacugggguaugaaaaaaaccuccugcggcuagcucagugccugcccaaauggcugcccaguuuugugcuugaaacccuggugguguaggcacccgagggaaucuccuggucugcggguugugaagacugugggaaaagcauuguaucugggcuggaaugcacuguuccucauggcagagucccuuagggcuuccguuggcuaaggaagggaguucccugaccccuugugcuuccugggugaggcaaugucccacucugcuucugcucgcccuccaugggcuacacccacuaucuaaccagucccaaugagaugaaccggguaccucaguuggaaaugcagaaaucacccaccuucugcguugaucucacugggaguugcagaccagagcuguuccuguucggccaucuugcccaggucuaaauuuuauuuuacaaauauuuuuuugagauggagucuugcucuguugcccaggcuggagugcaguggugugaucuugguucacuguaaccucugccuccuagguucaagugauucuccugccucagccucccgaguagcugggauuacagguguguaccaccaugccuggcuaauuuuuguauuuuuaguagagaugggguuucaccauuuuggacaggcugaucuugaauuccugaccucaagcgaacugcccgccucggguccccaaagugcugggauuacaggugugaaccaccguguccggccuacuaggccuuuuacauauguuguuucauuguuccuccaauucauuuuauagaugaagaaaacuaaaauucagagcaguuaaguaauuaaguaaaucguuaaacuggcauucaacccugggcuaucugagaucagagcaauguuuucugugcuauagccauauccuuuuuuuuuucuuuuuuuuuuuuuuuuuuuuuuaauagagauggggcuuuaccauguugcccaggcuagucucaaacuccugagcucaaguaaucugccuaccuuggacucccaaagugcuaggauuacauauaugagccaucgugccuggcugccacauucuuuugguaagcaauuccaaaguaauuagcauuuuaugguggugaauauuucuuuaaaaauuauuuuaaauaaauagagacaaggucuuacuauguugcucagguuagugucaaacucaugggcucaagugacccuugugccuuggccuccuaaaauauuaggauuacaggcaggagccaccgugccgggccauugguuaagaauuuuauggaaaacauuuccagccaaauuaccgucuguaaccuggaaacaggaauaaaugugggcaaagcagacuccacucucuuguuuugcaagcuugucugccuccucguuuccaugaucacaccuugaaaugggaggcagucuaguguggagguucaggggugagaccuggagugaguccgucagcacuucucucuuggaucuucuuguuagugacucugagauacaugggcaaguuugccuugucuaagccccaguuuccuuaucuguaaacugggaaucauaauaugggaauauaauauauaugggaauauaauaacucucucauaguacuguuuugagaaguaaaugauauaaaccuguaaugugcuuggcacagggccgugcacaggcuaucuaucacucaguaaaugauaauuaucauuauuuuuaucaucuacauucucauuaucagaugccugagugggugaagcuuaauguauuugaugaccucauccauugcuggucuugaacaguaucuuauacauacucucugcuauuacgugcuuguuaaguaaaucaacacugaaauacuuugaucgggccuuuggguuuaauuauuuugccaauaauuucaaaagaucuagaauagaguuacagauuucuuuuguugaauuauguaucugagauauuccauuugccggaugaaauaauuuuguuuuuaggcuucucugcacuuacaguacaaucuaguuucugauaaacaagauuaucuuugaaaauccuaccccuuguucugcauguuaucacuaacaguagagguucuuucuagucuuuggaauguacccagcuauuauuuuuauuuguuuauuuaguuuuuuuuugagacggagucucacucugucgcccaggcuggagugcaguggcgcaucucugcucacugcaagcuccgccucccagguucacgccauucuccugccucagccucccgaguagcugggacuacaggcgcccaccaccaugcccagcuaacuuuuuguauuuuuaguagagacgggguuucaucguguuagucgggauggucucaaucuccugaccuggugauccgcccgccucagccucccaaagugcgggauuacaggcgugagccaccaugcccggccaccccagcuaucguuuaaugauacauacagaagaauaaaacauaguuugacuuuccaucuguuuauugccuuuacauuucuggcaguaagacacagaagcugcagcacucagacaaucacagugucauguuugguuuucuaucuuuacuaaaguuacuuugaauccuuuuacuucuuuuccauccucuugccucccuucaaucaauuaaauaaguguaaguggguuauaacuuugugaaugugaaguauuuuguuucaguaauaucaguuaauaggacuuuauguccuacaaucaauuuccugcuuucauauccucuuguuaauguugucagugcuaaggaaguaauuauuuuaguccucugacucacuguuguuauugccuuuuggagaguuuuguaucccaagcagcuagcaccguuuuuauggaguaggcacuuaaaaacaauugcuuacuguuuugaaaagucgauucaaggacuuuugcugcuuuaggaaauagggcuccuucaacuauugcuuccauuuaggauggcuugagaugguugagauggccuuaaguacagcucggguuuucuuuucuuucuuucuuucuuucuuucuuucuuucuuucuuucuuucuuucuuucuuucuuuuucuuucuuucuuucuuucuuucuuucuuuuuuuuuuaaaucuuuuauucuugguuuggggguacaugcgaagguuuguuauguaaguaaacauguauuacgggggguuauuguacauauuauuucaucacccaggauauuaagcccagugcccaauaguuaucuuuucuucuccucuccuccucccaccuccaccuuaccccucauguaggccccagggccuggucuuuuuuuguuguuuuuugaaacagugucucgcucuguuucccaggcuggagugcaguggcacaaucuuggcucacugcaaccuccuccucccggguucaagugauucuugugcuucagccucccaagcagcugggauuacaggcgugugccaccacaccgggcuaaucuuuuuucauuuuuaauggagacgggguuuugcugaguuggccaggcuggucucgaacuccuggccucaaguggucugccugccucagccucccaaaguggugagauuacaggcaugagccacuacgcuuggcuuggcuauuguuuccuucuuugcauucauaaguuccuaacauuuagcucccauuuacaagugagaacacgagguauuugguuuucuguuccugcauaaguguacuaagguuaauagccuccagucagauuuucuuuaaaaaaaaauagcuucaacuuuucuauuguaacuaauucuuaaauaagguuuuucuacaaaugcaugauuaaaaagcauguuaugaauauuucuucagucuugaccauuuuuaaauuaugaaauauacuaaaugauaucagaugcuuggacucugucagacugugaucuagcaggacccagaagacaaaauacugcaaaucuaucccuggaugugugaaagaaguuaaagcuuaagucuugcuggcagggaaaccacaguacuuuuguaugcagaauuuacucaccuucuagaaacaccaagucuaaggaauaggucuaccauccauuuauccuugcaguuuaucugugauuugagcaaugucuaucagggcuagucuaucagagaucaguaguagcuaagaaaauaagaggaaaaggagugaaugguuggauagagugccauccuuggugaccaaaaaaaugauccuucacagaagccccagccacccuugugcacuuggugaagcagugagcuggcagcuagugagggucuuaugucuuuaaggugaucuugaugaccucuguaacuuugacacugguuugcaguuagccccaucuugcugaccuucuucuuccucaguaggauaaucaucaucuuuauucccucucuguuuaagucuguuuucagucuacuaaguuguuuacgugaccguaaguccaagaccaccuuuuaaaaauuuuugaugaugugucauccagggcacaguugaugucugcgcauucccuauauggugcuaucguagugcuggauucaguucacaugcuucaugaugccuguuguguuauaucauuuaugagcaagcauuucaaggaugaaugaaaguaugugaccuuccuccuuccaacuagauaaguagaguaaauuuuuuuuuuuuuuuuuuugagacagagucuuacucuaugcccaggcuggagugcaguggcaugaucuuggcucacuacaaccucugcuuccuggguucaagugauucucgugccucagucucccaaguagcuggaauuacaggugcgcaccaccaugccuggcuaauuuuuauguuuuuaccugagacaggguuucaccauguuggccaggcuaguuucgaacuccugaccccaggugacccaccugccucggccucccaaagugcugagauuacaggugugagccacugcgcccaacgaaaauaguuuuauauucaggagaaccuguagaauucaagaugauacauuuuuauauucauccuuggacuacaugcaugaguugaaugggagccaauuuccccccuuuuaaguaaucagcuucuauuauuucuuugucugcuaaaaucauccuaauaauauauaagggaggaaaauguagucacguuauccccagaaagaagaauauaucuguaccaugucacuuuauuauuuugguaaacuacaugacauuucccucaugauuucugcaguuaaaccuaacgguguauagggaucuguuuuucuuugaccaaauagugaauugagugcuucuaaaguuccaacuuuccuaaacagagauccuguuguauuuauguggcucuagcuuucuggcuacaucugcuuuucuuccuaguuuaaaucccauuuaauacgaagucaagacaaggcccuagagaauucuaccaaagcaaaagggaaggcuuggaaagucccagaaauuaucaauuggaugaguaacaaauugucaguuuucaauuacaacugguaagaucacaacuggaacauuagauauugaauguagauguugaacacugccucuuugaaucuuuguccuguuuacagauaaauaguuccaaggagcaaaaaaugaaauuuaucaaaugguauguauuauauuuacuauaauacgaagguccuguauaucacugggaucugagaaauguagaauuggaacaaauuuaagacuuacaggcacaaacuguuccccaugcuuuuuucuuccuucucuuuacuuuuuuuuccauaucauggauuuuuuuuuuucuguguuuaacaaaaaguaaguuguuuauguagcaaggauuuuuauauucaguauggaguauugcauguuaauguguaggaaaaaaucaggcugaggccgggugcgguggcucacaccuguaauccuagcacuuugggagacugaggcagguagauuaccugaggucaggaguuugagaucagccuggcuaacacggugaaaacccaucucuacuaaaaauacaaaauuaguggggugugguggcaggugccuguaaucccagcuacucgggaggcugacgcaggagguggagguugcaguaaucugagaucgcaccauugcacuccagccugggcaacggagcaaaaacuccaucucgaaaaaaaaaagaaaaagaaaaaaaaaaucaggcugagcguguuggcucaugccuguaaucccagcuacuugggaggcagaggcagggcaaucgcuugaacccuggaggcguaaguugcagugagccaaaaucgcaccacucuggaugacagagcaagacugucccaaaaagguguacaaaaaaaaucaacuuuucucccucuggaauacaaacucuaugucauuuagcuguuguuaauucuugagccucuacuuauauaauuuaugacuauaaaaacgaucuuugacuuucauaaucuaguuacuucccaaaccuuacugugucuuaauacacugcuuuauuuuuugcuuucugucaacuucucaaguuugaauaucuuccaguggugcacucacuaaacuuuagcuguauaucugguuaugauuucauacguuuuucauagguaaaaggauaacaaacugcucggagaagggcaauguguucuuuaaagaaaguuaggccaggcgcaguggcucacaccuguaaugccaguacuuugggaggcuaaggugggcagaucacgaggucaggaguuuaagaccagccuggccagcauggugaaaccccaugucuacuaaaaauacaaaaaauuagccgggcaugguggugcacgccuguagucucagcuacuugagaggcugaggcaggagaauugcuugaacucagcggguggagguugcagugagccgagcuugcaccaaugcacuccagccugggcaacacagugagacucugucucaaaaaaaaaaaaaggaaaaaagaaaaagaaaaaaaaaagaagaauuagaagaauuagaauuucagaauaaguaguaaauuaaaaaaaagaaaaaagaaaggcagaaaagauagaggaaaugaguucugcauaggaacuuaaaugagcaaagugugaagucaaucuuuagaagucuaaaaugaagaaggcuuacaacacucuaugucagaugccaugccauaucucuuacauaaauuaucucauuuuuccuuugcauggaauauauucaaaaaauugaacaaguugcccaaauacucagauaguaaauguggcagagcuaggauugaaacugaagauaccuggcuguaaaacuuguacuuuucauuguaugauaaauuuucuaaaaguaggccgggcacgguggcucaugccuguaaucccagcacuuugggaggcaaggcgaguggaucaccugaggucaggaguucgagaccagccuggccaacauggugaaacccugucuccacuaaaaauacaaaaauuagccaggccuggugguaggugccuauaaucccagcuacuugggggacuaaggcaggagagucacuugaacccaggaggcggagguugcagugggccaagaucacgccacugcacuccagccugggugacagagcaaggcuccucugucucaaaaaaaaaaaaaagaaaagaaaagaaaaagaaauuucucaaaguuacucagcauaaaaauugucaauaaaguuccaacuuaauugccauguucuugugugaaaugaugucucuuuuagcaggcuuugguauuggugagcauaaagagaugagcagaugaaggugucauauuucaaucacaauguuaagaucaguagcugggauggaguaugauacuuaguaggugcucaguuugucaaaugaaugaaugucacgugugauuuauuggugccauaauauggcugucuaccugcacucuuucagcuuuugaagcugugauuauauauauuaaaccuaaaacuuuacucacacacaaagcaaaugugugaaacucaauguuuaugucauuaaacuguuuauaucauuaaacuuuuaaugaaagacagaaaaaaggcaaaauauuaauaacuuauuggcaacaaugcaagugauacauacaauugucacuuuuguaugcugagagaacucgauuccaucugugccagccacacagcuaggugaauaaacacguggcaaccuucauuucagggaggguggcugcuccugagacacucggauccaaauccauccuugaaaauugaggaugaauugaaaauucuugaaaauccuugaaaauuaaauauuauaucccauaaaauugaauucuccuaggccaaaugucagcauaucaucaauaggugaugauaacaguaaaaaacaacagugguuguaaaauaauaaauguauaauuuauugaguacuuacaauguauuuggcauuaugcugaacacuuauaguugacuaucucaucuggcccucauguuaccugacuuccucauguuugaggucaccuguucuauuggggagagaaugugaugaagaaggacuauauaaaguugacuuuuguauuugaucuuagauaguauguuugcccuguugguuauaggugguauagagguggggagguauaagcuggagacuggauguaaacuaaacacugggucaguaauuaaagcuggaggagauacauaauuaggucagcagucaaauuucuauuucauuuaaaaauaaucucaaaguacuuugaagucugcuauagauuuuuuuuggauuuagaaugcuuuucuggauuuauuuauacagagccaauauuuuauguaauucacugugcaaagagaaaacaguaggucuuaauaaauguauacagggcuauauauuugcagguuauaauuuuaagauacuguugccaaagccaacuugaggauuuuuuaaaaaucucaauaaacucagaagguugccagaaauaacuuaccuacaaaauuuuauuauagcauuacugaguauagcgauguagugaauuuauguaaaaauuugacuauccacaagagagccacauugguagcuaucauaucaaagugugauugacuuauuuuuugguccagguugcauuaggugagccucuccugaauccaagaaugguugguuuauuuaugauuuuauuauauuuuauauuuuauuuuuugagacagagucucacuauguuucccaagcuggucuugaaugccuggccucaagcgauccucccauuucagccucccaaagugcagggauuacaugcaugagcauucacugaugacugguugauugagacaggaucucacucuguugcccaggcuggaauguaauggugugaucacggcucagugcagccucaaccuccugggaucaagcgauccuccugccucagucuccugaguagcugggacuauaggcaugcuccaccaugccuggcuaauauuuuaauuucauuuuauuuuuggagacagaauauguugcccaggcuugucuugaacuccuggccucaugcuauccucccaccuuggucucccaaugugcuggcauuacaggugugagccaccacaccuguccagauuauuuauuaagaacauguagaaauaccacugaauuaacuauacuugucuuugaggccaacuuuauucauuuggccaaagugaauaucaccauuuaaaaacuguggaauacccauauggauuauuagauuaaaugcuggcacuggugcucucuuaguagggacccagguugugagacuugauauuuaugugaccagaauaauuguuuauuaacauauguagauaauaaauauaguuacaacccuagauugcauguguugauguugaccuagagaggaugugaugcuguuugugaaauagaaaagagacuguugaaccaguuagcaugauugauaaaugcguuaauaugauucuuaauggguuuuuauuaucuagauuauuuuccuagugguuuauaacauuuugaauuuuacaauccaaaaaaaguugccaggauugaauuuuuuguuuaacuucuguuuuuaccaucuuuuccuaaaacacugggcaagaaaaguaccugguauauagucaaccuaacucaauacaugguaguugaauaaauggauggaugaucaaacaacaaaaaaauaguggagucuugcucugucacccaggcuggagugcaauggagugaucuuggcucacugcaaccuccaccucccaggcucaagcgauccucccagcucagccuccugaguaguugggacuaaagacaugcaccaugccuggcuaauuuuuguauuuuuagcagaggcuggguuucaacaucuuggccaggcuggucuccaacuccugaccucaagugauucaccugccuuggccucccaaagugcuggaauuacaggcaugagccaccgcaccuggccucauugugggguuuuaauguguauuuccauauugacuaaugagguugagccucuuuucaugugcuaauuagauauuugugugucuucuguuuuugugucaucuauucaaguuuuuugcuucugggggaaaguugcaugagacuuccgcaugauggugaccaguuugcagagucccugaugacucuacagacagaaaugauccaggaacauggcuuuuggggccugauguacaaccugcacuauagcuccaagaaucaugaacucaaaguauaaaauugaggcaauaaauaaaucucaauggauuucuaagauauaaaugguauagaauuggauguacguccagacuaauagucauacaugagcaguuuuaugggacaugguuuugauuuuuaugaugaucuggagaaggaauuguuucucacagaagcaguaagagcagugguuuggaacuuggacucuggaaucagauacuguauuauauuucuaccucugccauuuacuaugucuucuuugggugacuuccuaauaccuuuggacuucaguucccucaucaaaaauaggaaaaaaaaaaaaaaagaagaagaagaaauaaaauaggccgggcacggaggcucgugucuguaaucccagcacuuugggaggucgaggugggcagaucaccugagguugggaguuugaaaccagccuggccaacauggagaaaccccgucucuacuaaaaauacaaaauuagccagguaugggugugguggcgcaugccuguaaucccagcuacuucggagccugaggcaggagaaucgcuugaacccgagacucgguggagguugcggugagccgagauugugccauugcacuccagccuggaaaacaagagugaaauucugucucaaaaaaaaaagaaaaaaaaaggaaauaaaauaaugguaccuauaucccaagcuguugugauaauuaaaggaauuagaacauauaagacacuuacuuaaggucaugcuggguuuauaggacaugcuguaugagggcuagcucuuguuauuacugacuucaaguugacacacuggcauguuuauaucacucuaaaguguggauuuuggcugggcacaguggugugugccugcaguccuagcuacuugggaggcugaggcaggaggaucacuugagcccaggaguucgaggcuacagugagcuaugaucgugccacugcacuccagccugggcaacagagugagucucuaucucuaaauaaauuaguaaauaaauaaaguauagauuuccuuagggacuaagcaggcuuuauuauuggguaaccauuuauuuauguauuaaacagcaaacauaaauggcaacagauaguaugauuccacuuacauaauguucucaaagugauaacauuguagagauggagagcaaaggugguugccaggcaucaggaauucagugaaggaggccauagaggggaaacacagggagagaguucuucugccaugauuguuguggugguuacagaaaucucuacgugugauaaaaccgcacugaacuauaugugcuccugcacacacaugcacacucacacacacaaaucagugcauguaaaagcuggugacaucugaauaagggccguagacuguaccgaugucaacauucugguuugauauuauacuauaguuauuuauguaagggguuaccauugggaaaaucugggugaaggguacccaggaacucucuguacucuuugccgauuuuuuuuaacagcuuuaugaagauauaguucacauaccaagcaauucauuaaaguguacaauugagugguucuuagcauauuuacagaguuuuguaaucaucacaacaggcaauuuuagaacauuuucaucaccucaaaaagaaauugugugcuguagcuaauaccccucccaaaccaaccccaaggccccccuccagccccuggcaaccaccaguauacuucugucucuagaagugucuuuguuuuggacauuccauaugaauggaaucauacaguguguggucucugcauuuucuuugcaacucucuguaagucuauaauuauuucaaaauaagaaguuauuuugguuuuuucugagacagagucuugcccuguugcccaggcuggagugcaguggugcaaucucagcuaacugcaaugucugccucccggguucaagugauucuuaugccucagccucccaaauagcugggauuacagguguaugccaccacaccuggcgaauuauuguauuuuuaguagagacgaggauucaccauguuggccaggcuggugucaaacuccugaccucaagugauccauccauccuggcuucccaaagugcugggauuacaagcuugagccaccgcaccuggccucaaaauaaaaaguuuuuaaaaaugaauugaggggcugggugugguggcucacaccuguaaucccagcacuuugggaggcugaggagaguggaucaguugaggucaggaguucgagaccagccuggccaacauggugcaaccccgucucuacgaaaauacaaaaauuagccaggugugguggugggcaccuguaaucccagcuacucgggaggcugagacaggagaaucgcuugaaccugggaggcggagguugcagugagccgagaucaugccauugcacuccagccugggugacagagcgagacaccaucucaaaaaaaaagaaaaaggaucgaguguggcuaugagacaagcucucugcugggcaauggggacacaugaguaagugaagccaugaucacugccccaacaagcuuagaguuuagagggaaagagaaggggcagacagugagggugcaguguuaucagugcuuugguggaagcagcacaggagccaggagaacacuaggaagaauagaacucagauugaaagcaaggucaggcaaaguuccccagaggaauugguuagcaaauuuuuaaagugcaugucacguggaaagaacuuggaaccaugggcggaugggcggcagcucauguggcaucuguggaagagaagucuuucuugagacuuuugccgcuguugccugcaguccuuuggcuguagcgcucaguggccaggaugccagauaguccucauugguuguuuuuuuuuuucuccccaguguccaacaagcacccauuuguggacagcaaucuucucuaccaguucagaaugaacuuccggcggaggcgaagacugauggagcugcucaaugaaaagucccccuccucccaggaaacucaugacagucccuucugccugaggaagcagagccaugacaaucggaaaucuaccagcuuuaugucagguaugccaucccggcauuuauuggagcucaaguguuugucuuuugagaaauaguggagccaugacucaccuuugugaaauucuguucucuaucagagcguagaauuuuuacuuauucauaaccaagaagcaugaaaaaaauucugaaacccuaaguuuuucuugcacagccaacuuagaugccaggacucuguuuuauaaaauuauguauuugaauuauagaaguccucuaggcucucacucaaaccucauuuacuuuucauuuacaagccauucuugccuggcaugguggcacacaucuguaaucucagcuacuugggaggcugaggugggagaaucacuugagaucaggaguuugagacuaggcugagcaauauagcaagaccucaucuguccaaaaaauuuaaaaauaaauaaauaaauacaaguuuuuguuuguuuauuuguuuagacagagucucgcucuguugcccaggcuagagugcaguggugcaaucuuggcucaccacaacuucugucucccggguucaagagacucuccugccucagccucccaaguagcugggacuacaggcacgugucaccaugccuggcucauuuuuguauuuuuaguagagauaggguuucacuauguuggccaggcuggucucaaacuccugaccucgugauucuccugccuuggcaucccaaagugcugggauuacaggugugaaccacugcgcccggccuuacaaguaguuuuuauauaucauuuaauuauucaguuuuguaaaucacaacuuugcaaagcuauccauuucaaagaugaauaagaagauuauuucugugggcauuuacaccaguaaccacaaaaaagugacugguuauccacccguuaucaggggugacagagaacaaaucucuacuaaaaguacaaaauuuagccgggcgugguggcggacaccuauggucccagcuacucaggaggcugaggcaagagaaucgcaugaacccaggaggcagagguugcagugagcccagguugugucacguacuccagccugugcaacagggcaagacuccaucucaaaaaaaaaaaaaaaauauauauauauauauauauaauauaaaguaaguggcagagcugcaacucaaguucuuguuuuucugccacuaagaccagugugcuuucuccuggccccucuggaccuugcaguugaaagccuaugugcucuagugagccgagaccacccccuuggugacuguguguguucucuggccuacacagugagccccagcaaggagaucaagaucgugucugcagugaggagaagcagcaugagcagcuguggcagcagcggcuacuucagcagcagccccacccucagcagcagccccccugugcucugcaaccccaaguccggugagugcccaaaagguggccccgcuccuaagacuguggggacuugggcaggucccugggaagcagaaucugagauagcgggagacuaguguguggguucuaauaaguuagagcaugcucuugggguccacacguguugaauggaagggaaggaagaauugggcugaaggagaaauuggguuguagcccagucucaaugaaggcuaucauugacccaguaagaccucuggagcugggauggcccuuccaaguugccuggaguuguguugagggggcugggccuuuagauccacauguuggccacuuauuagguauuggcugccccugggaggagggcaugaccuugggcaaagcaggugucuucagagagauggucuccaagacagcugagggcugucaccauuagcacucucggagcugggagaagucccugagcccugaaggguguuuugggcaguaugugacagugcucacagcaggggaaacagcacuuccccagaaugcagccgaugcauaagaucuguuggggcccaacacccuuaaggaagaagcauggaugugugcaaacccagcuaucccuggaauugacccugggugucuugugguuucaaaaucugcucaucaaccuccauggccuuuauauuccaggaaaaaaaucuaggcacaaaauuguuggugaacauguacuuagaaacaauccuuccuccacccaaucaguucaucaaccacccaggaacugguaauccauugaaacuacccuuucucaccaucccuuacccaccuaauguccucacuugccaggaugaggaugugugguccaucacuacaguaaccgccagagaacacucucaaacccauuuguuuaaggcacuguccacccccaguucaguuugucaccuucgaggaagaggcucuguuccuuuuguucauguuguuuccucaucaucagaucuuggggauacaaagaugacaggucauaacccccaacucaaugaaaacaccaccucuuuggagaaaaaaacaaaacauuucauguuaguaagaauaagcacuaauugaugcaguucaaaaggcuuugagagaaaacucugucaucuaaugguauuaucuaggaagguggcucuuuuuccugaucuaacuuuuuuucuuuuuuugcugccuucuggaguguuagcagcaggaauaaauguaaccuguaagugaaugaagaagcuugcuuccauacuguccuggcugaagagucguugaguacuggguuuuucaauuacuggagcuugcugcuaaaguagaaugaaaaaggagaacugaauucuuagaaaugggauguuugaagccuuuguagaaaucugacaggcauccucaaaguuaaaagcaaaagaucucaguuucaauaaaagggucaguggugccauaaccauuuuacaaguuuuugauugcuuaugauggaguaugaaaaaaguguuaauuacugaaauuagcaacaaaauccauguucccugagguagguuagcauguuuccucuuucuccuugccucugggucaaagggaagaguuuacuguuaugcaggcagaagaaaaaggucucguuuccuuucguggguccccaaggacaagagcugucaggacugaguugugguuuguaaauuccacuucuuacccauaguuugacaagcuucucucucacucuuaagaggauucccaagacccagugaguucaucugugauuuuuuuuucucaagcagaugaucaggccuucacagugaugcauuuaaaaauuaauuaucugaaauacaccaggauauguuuuuuuaguacuguauauaaaugcccuaagccagacacaaaaaacaguacuaaagauauugauguuaucaguaucauugugauaagcaaauaagcuuccaaggauaugaaaagaaaaaaguuuucccuaggccucaaaguuucuauauuuuucaacauaauaaagagaagugcauuaaaaugaauggucagcucugcugccaaauaguacagugugauucauguauccaaauucauaagcccccugaggguuuauggggaguggagagagaguuaccugacagggaauaaaaaagaucucaguccucaaauacugaccacuuuucuuaccucccauccaucugcugagagauucuguuuccaucuugauauuugaccuacucccucuuguuuggcgaacauaaauuaauuuuugcuuuuaugagauuucugaaagcaaaggugauaagaucagcaaccugucaccucaacaagaagcacuggauugccuuucacugagagggugcuucucaggccagaaggccguucauguaaccagugggcgagguccagcugccugguagaucaucacgccuugccccacgcugccuuuccuugucugcugcacacucuuuccaggacugguaccuggccucugacugucacuagcaaaggggaucggaggaugccaccucaccagguuaggccccuuggcuggggccuuuucuguuucucuguggcacuucaaguucacaaugucugcagagcuggauuagaauggucucuguccccugacccccuggcuacuuggggaggauacgacagccccucuccaguucuuagugagcacaggauggauggggggguucauuaucgguggguuuuaggcagccgcaagucaggaauuggcugcugucugccaucuuggugggcaacagcagugagcugaugugaacgggugucucaggaggacagcaugccacuaucuuccugagcuucuagacccuuucuuuugcuugcaggacagcauggcccagaguaaauguggcacaguagcugagagugugggugcuggugucuaaugccugaguuugauucuacuucugccacccauucgcucugggaccuuggacacaaucaauuuaacuuuucuaagguuguuuuugcaguuauaaaauggggauaacaaugauccuaacucauucauucuugugaugauuaagugaguuaauauauucaccucacauggugccucucuagcauauguugaguacucagaaaaguucacuagcauuauuacucauggcagaaagcaguggguacaugcaguccuagguguuaagaaggaagugaggcugggcggcucaugcguguaaucccagcacuuugggaggcugaggcaggcagauugccugaggucacgaguucaagaccagccuggccaacauggugaaacccugucucuauuaaaaauacaaaaauuagccagauaugguguugggugccuguaaucccagcuacucaggaggcugaggcaggagaauugcuugaacccaggaggcggagguugcagugagccgagaucgcaucauugcacuccauccugggugacaagggcaaaacuccgucuuuaaaaaaaaaaaaaaauugaccugcccccuuauccccaccccuggcacucuugcuuuccuucucuuucuuuuuuuccuuagcuuuguaagguagguuuaggguuauuuauguuugcugcuauuuacugucuccauucagcuaaaauauaaacugugaggcagggaucuuugccacuuuuucucacugauggucaccuacgagauaucaauaaauagcugcugaaugcauggauagaggacuuggaagugcuuaugucuugacauuguguuugucugccagugcugaagagaccugucaccucugaggaacuccuuacucccggggcuccguaugcaaggaagacauucacgguaggcugauggucuggccuuuuucucccgugcugcccauuuuucugcaccguguccaugugucaauggguagcuuauagacugaaaugaaaacuacuuuucuaauuuucuuuuuguuuuuagcguaauuaugauacuaggcuuucuugaccucaaggcacuaaggugcauuaggacuucacaugcguuauuauuaauauaccauuuaaaaauuuuuugauguguucuuuguuaaagaaaagauuuccauuaugcauuuauucuaauuuaauugcaaauuucaagauuggcaucauuugcacuugcauuuaccuuaaaaucuaauaauuuuagauuuuauuucccaccauuagucauuuaaauuauuauuagauuuuauggcaaauggaagugcaaaugaugccaauaaucccuucugcauuaggauuaauucuagaaauuauuuaaaacauuaggggaguguuaagcuagagaaaggaaacugugggauaaacuuuucuaccguaggcagggugcuucgacaaugugugcaugccuugagguacacgagccucugacuugcugugagcagcuccggaccaccugccccuucuuggagguccuuuagguuccuaaugccuacguuggauuucuucaaauggaaugaaagugcucuuuucagcaucaccgcacccacuccccuuccugugucuccuucugucaaucuccucaaauucacguucauacccucuucaaaacacuucuccuccuucaucuucuaacuuuaguggcauugccucaggcugggggagaauucuauccacacucagucaugcugcaaacauuugcugagggcuauuucacauucugaaugcugaggaguuaauaggagaaaggcgcugacaacaugucuguaccagaggaaaagauaaacuccaccuucggaagugaaauugaguauaauauacaaauaacagcaaacuguaaaguaacggaagugccugaaaaucuugagcauuuccacaaaaauuuucauuugccucccuguuuuuccucagucuccagcauucaagagagguagauuguuauuuugaaaguauuuauuuuugauuuuuaauuuaaaugccaacauuguuaguaauugauugugaauguguuucagcuguguuuugguugggauaugugugaaagauguggcuaggagcuguccagggaauuaaacugccagcucuaauaaugauuucuauagaaaaggccuucucuaauuccaaacaacuuuuggauuagagucuacuuguacauugugaacuuuauguacuuuuucacuucuuuuccccccuugguggagaaaggggcaugguggagcccuugguggagggcucccuugguggaggcugggcaugguggcucacgccuguaaucccagcacuuuggaggcugaggcagguggaucaccugagcucaggaguucgagaccagccugaccaucauggugaaacccugucucuacuaaaaauacacaaaauuagccaggcaugguguugcaugccuguaaucccaguuacucaggaggcugaggcaggagaaucgcuugaacccgggaggugggguugcagugagcugagauugcacuacugcacuccagccugggugacagagcaagacucugucucaaaaaaaaaaaaaaaaaagccaggucucuuuauuucccaccauuaguaauuucaauaauuaugcuagacuucaaugacguugcaggaucaagaguguaucauuuggauacuggggaaaagaacaaacuuagagcagaaauuguaucuggagagacauuucaaccacguuacgacuuuuucuaaaccuucuauuggagucugacauuaaauuguauaacagccuaagaaagagaaaaucuuccaguuguuuauugaaucaugcccucaugggagcaucuucuuucugccaaacagguuagauuuuuuuuaccaccuuuucuacagggagaugcccggguuugugauagaagcaguguuccaauccccuggcagggaagagagaaacggaggaaaauaugucacaguguauacuuaauccugggcugguuuucucucccucagaagaauaagcaaauugccggagacagucggcugcuugcuaauugugguuuuccucucuagauuguuggugacgcgguuggcugggguuuuguggugcgaggaaguaagccaugccacauccaggcuguagaccccaguggcccugcagccgcagcaggaaugaagguacuaacgggucuuucucacccucuuuuauaucugucuuggguucuucaugcuaaauuggccaugauucuuacuagggauccaaacccaucuuauuuuguguccuuuucuauuucugcccucucuuucuuguucuccaaagucuuuaaccuuucccugggucuucccucuccucuaauaaacauuuagaagugucuagccaggcgcgguggcucacaccuguaauuccagcacauucagaggccaaggcagacauaucacuugaggucaggaguucaagacuagccuggccaccguggcgaaacccuaucccuacuaaaaauacaaaaauuagccgggcgugguggcacacaccuguaaucccagcuacucaggaggcugaggcaggagaaucgcuugaacccaggaggcagaaguuguagugagccaagaucgcaccacugcacuccagccugggugacaaagcgagacucugucucuaaaacaaaacaaaacaaaacaacaacaacaacaacaaaacaacauuuagcagugucuaaauaccucuagcuuaauuucauuauuuggugccauguguacuuuuucucccuaagcguuuuggcuucauuuuugucaaauuuccuuuucccuuucugaaugggguuaaaaugaagccaagcacauaugauauaggaaccaggagagcaaguuuuacuaccucccugguguuuggagguuuggucuccaaaccuccccugguguuuuacauguuuccccucaaccaauacugaauuugaaaaauuauguauuucccuuugcuuaaaucuuuguguaagaacuccaaugcuucuauucuaugcaagguguauuccugugggguuuauguaaccgguagcacauaauagaccauacgacauagccaauacugagaaaaagaaaacaaaaaccaugaacuuuggcagagaucuggagaucuagaucucgguccuguuagcuacuagcucguugacuuugaacaaguuuuauagcaucucagagucuguuuucuccucucugaaaugacaaucauacuauuucccguuguuuuauggauuaaauguguggaaaccuugauaaaguacaaagagcuacacaaacaacaauucauuaaugaaugaauuauggaagauuuuugaaaauaacuguuacauauuuuuuaguacuaaaaugauacauauacgugccagguaugguggcucaugccuguaauuccagcaucuugggaggcugaggcggguggaucacuuuaggucaggaguucaagaccagccugaccaacauggugaaacccggucucuacuaaagauacaaaaaauuagccaggcguaguggcucauuccuguagucccagcugaucaggaggcugaggcaggagaauugcuugagccugggaggcagagguugcagugggcugagaucgcaccaauguaccccaaccugggugacagagugcaagacucugucucaaaaaaaaaaaaaagaagaaaaaaacacacauauacagucaagaaaauuuggaaaauauaugcaagcaggaaaaaaauuaaaauuacuucuaaucuucccuaacucagagaugacuacuguuaacauuuuuuaagcagcuuuauuugaaguguguaauuggcauccuauaaaaccuagccauuaacauuuugauuuauauucuucuagacuucuuguguguguauauauacuauuuacauuguuuuuauuuaagaggauguugagguuuucugcuuugaaauaccuuuauauagcacagcuuuguucuauugucugugaaauguuucacaaaaggguauuucugucuugauuauccaaaaccauaagaggaugcagaaggcuuaaaagcuaaagaucauuccccuguucauuuauucaauacuuucauccucuuccaucagucuuuuccuagaguagcaauaagcaugauugggaucgccaccucucugauuuccagcaugagcucucuggcauugguuugcaugcuggaaaaaauaagugggcaacagaaaauggcucaaggaagcaaagagcacauuuacugcuugcccagguaaucagcgcugguaugauuaggggcugcuuccaccuuuugauuugaacaccucacucaugucagggaggcacaggcccugggguccugugcucuggggcagccauggaagcccugcuugcgaaggcggugcauggcagagcccuucuaccuucccaggacugcagcaggcacagcaccaaagcaacucagaguaggaauguuggccaggaucauaaaaaagcaagcauuuguguccaugccaaggcugaauuuuucauuuucuaauggaacucuuggcuggggaaggauuuuauauuuuauuuccacaauaaaguaccugguauaaauuuuuuuuggcacaaugcuucaguucugagugugcacucacucgcaugaugcuuuggcuuaaagagcauuucuuuugaggaaagcaaugaauuuauuuacauugcaacuaaagaccuuguuuugcuuagccaaauguacagugaaauuaauugauuuaguuuaucuuuguugauguacauacauaaccguucugggcauugucaacucauuaacuaacucuuuaacguauauucccugaucgauguuuuaccugauauauuuuuucaauuucauaagcuaauacuucauaugguuuauauguuuaguuucuucagagguacacagugguuuucuuauguuauagagcuuuacagaguucauuagagcagccuuuccaucacuguauuauuacacagcucccugguccagcaaaacaucuguccugagguucucugaucaaagcaguuuuaaacugccacauacuuuaucccccucuuagaaauuuacaaagcacauuagcauauugaaaacucugacaaaccuggcaggaggaaaaaaaaaccuuguuuaaauuguuuaacauaacauuuuaucauuuaagagaaacaugcaaaaggaaucuuuaucaguguuguuguuaagauauagcccuaaaacccuucuaagauuuuuggccaaacaguauuggaauugauauaaagucauacaccacuuaaugacaggguuauguucugugaaauggguuuuaaggcaauuuugucauugugugaccaucauggaguguacuuacacaaaccugggugguauagccuaccacauaccuagauauagccuauugcuccuaggcuauaaacacuguacagcauguuacuguacugaauacuguaggcaauuguaacacaaugguauuugugugucuaaacauagaaaaaauaaugaauugagcuauaauauuaugacaacugugaugucacugggcaaugggaauuuuuuuuuuaaagcauucuuuguuuuuguuuuuguuuuuguuuuuuugagacagagucuggcuuuguugcccaggcuggagugcaauggugcgaucucugcucauugcaaccuccacuucccagguucaagcaauucuccugccucagucucccaaguagcugggacuacaggcacgcaccaccaugcccagcuaauuuuuguauuuuuaguagagacaggguuucaccauuuuggccaagauaguuucgauuucuugaccucgugauccgccugccucggccucccaaagugcugggauuacaagcgugagccaccacgcccagccgaauuuuuuagcuuuauuacaaucuuauaagaugaugggaggccaggcucaguggcucaugccuguaaucccagcacgcugggaggcugaggugggaagaucacccaaggucaggagauugagaucuaccuggucaacaugcugaaacccagugucuacuaaaaauacaaaaauuagucaagcaugcuggugggugccuauagucccagcuacucaagagacugaggcagaagaaucacaugaacccgggaggcagagguuguagugagccaagauugcaccauugcacuccagccugggugacagagcgagacugucucaaaaagaaaaaaaaaaaaaaagaugaugggaccaccaucacauaugcaguucauaguugacugaaacaucauuaugcagugcaugacuauacagagauauacauuuuuaguauuacuguuuguugguuaaauuacaaugauagcaaauaccauguccuuccguauaguuuagcugcuuauauucauuagaaauuauuuuguacauuauuuucuuaccgaaaauacugacucaauuauuuccuauuuuaccauuugucauagaauaauuucacuuacaaagaagccauuuguauaaucuauucguaaaggcuuguucccagcaagcugucauugcugcuaucuucaacucagaaaacugcagaguuugggguguguagucgucaagaggguccuggggugcccugugggaaggauccgcccacuugggcacugauuaaccugcuaggucugagugguggaaauuuuccagcauucugaccacaugccuccuuuuggcaucucugacuguccagagcugaccuaggauaguguaaagugccucagugucccuuccugcacugaaugucaggcucucccuuuagucaggguucucauuuuccccagguuuugaaugggggcagagcccugcaucugggccuuuguggccacuccauccagugagauuuucacacuuuugcuaugacuacuuuuuuuuuuuuuuuuugagauggaguuucacucucgucgcccagcuggcgugcaguggcgggaucucagcucacugcaaccuccacauccuggguucaagcgauucuccugccucagccucccgaguagcugggauuacaggcgugccacuaugcccagcuaauuuuguguauuuuuaguagaaacgggguuucaccauguuggcuaggcuugaccaagcaucuuugaauuugagcuacucuuauuuugaaaguucuuuuacuuaaaaaauaaaaucuguaaacgucgggcuuggaggacuuuuguuuggcacuacaauucuagaauggagcaugaaauauggaaaucaucaaaaguuucaucaacccaugcaaugcauuuacaucaagaaguuguuuccugcauuuuuccuuugaugacuuuucacucauccuugaagaauuuuauauccagggcuuuugguuuccuuucaaugcaaaggggaaaggagcaaacgagagaaggaacugucucuucuauguaccugacccugagccgugcaaggcucuuucgcuacaggagcucauuuaaugucagcauccagauacucauauccuagaggaagaaaucauuccaggaggaaaaaaaucugucucuuaucucuuugcugcuacuuugaaagggaagccaguuccuuccccaagcuauuuuuuuuucccuuuuuuuagacagagucucacucuguugcccaagcuggagugcagugguacaaucuuggcucacugcaaccuccgccucccggguucaagcgauucuucugcuugagccucccgaguagcugggacuacaggcaugugccaccaugccucauuuuguauuuuuaguagagacaggguuucaccauguuggccaggcuugucucaaacuccugacuucaagugaucugcucaccuuggccucccaaagugcugagauuacaggcguaaaccaccaugcccaacccccaagcuauucuguagguuacaguauaaugaauauuguguaaacguuaacguugguuucaugucacaaccuugaaugauauaaucuuuuuuuuuuaaucacaucaagucuaaacccauuucuggacaauacuaucuaugauaaccuuauuuuacaugauccucuagaagacauccucugcuuuagucagggagaauuuuuacauuuccguaauacaucaugauuaugccuaugucugccucucaagaaaaucuaauuaagugacucaggcacucaaaauacucuaauggcuccccaucacaauaggaauaaacucagauguuuucuguagucuacaaaguuuauaauccgggcccugcuuaucauaccuuuaucuccuucccuggccuucugucuguuccucccagacacuggguuuucuccugccuagggcugaauagcugguuccauuguuguccuucaagucucagauuaaauguuaauuuuucagagaaaccuuccuugaauacccugugauauuccucccgucuuucuccaaucacuucuccucauaucaccauguggucuuagucauuuuaggcugccgauuagaauugauggcuuaaaugacaaacauuuguuugggaaguccaagaugaaggugcuggcaggcccgguguuugguaagggucugccuucugguuugcaguuggucaucuugcuauaucccaacaaugaugauauggcuccaaugaguggaggaacaccagguucuuugucucuagucaaauuggaaaaaacgacauggacacacguggagugguuuuaagaaguagagagucuaauaggcaagaaagaugggaggaggccgaagauagaugcucacccguacagagacagagggaggggggcuccaaagccgaaagaggagaccccaggugccauggauaccagccaguuuuauaaguaggcuggcggagguggugucugauuugcacagggcucaggggauugguuugacgaggcaugucauucacguagcccgaaaaagcuugcccucccacccuagccuuuuaauaugcaaaugcagggcacccugauguucuacacacucugggauaggugggggcggccauguugccaggaacauguggggcaggggcaagaaggccagggaaucgccauguuuguauggacccaguuucuaauggccuccauuugcauauuaaagguugcuggccuggcucuaagagcugcuuuaaaaacaaaaacuucccuaggaccccuuuuccucucuaucugccuaaaauaacuucuuaauaacucuuucaacaaugauauaguacagagagagcaagagcaaguucucuagucucugcuuauaaaggcacuaaucucauucauuugggcucaaccuucaugaccuaauuaccuuccaaggccccaccuucuaauaccaucacacuggggguuagaauuucaauguaugaauuuuuuuuuuuuccuuuuuuuuugagauggagguucgcucuuguugcccaggcugaaguguaauggcccgaucucagcucacugcaaccucugccucccgaguucaagugauucuccugccucagccucccaaguagcugggauuacagguguguaccaccacacccagcuaauuuuuuuguauuuuuauuagagacaggguuucaccauguuggucaggcuggucucaaacuccugaccucaagugauucacgugccccagccucccaaagugcugggauuguaggugugagccaccaugccuggccauggaauuuuuuuuuuuuuaaagaaagaguuucaccuugucacccagucuggagugcaguggccugaacauggcucacugcagccuccaccuccugagcucaagcgauccuccugucagccuucaauguagcuuggaccacaggcacaucaugccaccaugccuggcuaauuuuuuuacuuuuuguagagauggaguuucaccauguugccuagguuguucucgaacuccugaccucaagugaucugcccaccucaggauaccaaaaucuccauaaaguugagauuacaggcuuaagccaucaugcccaaccucaauguaugaauucugggaauacucaaacguucagucuguaacaccugucucauugucuccaucauauuuuuuagaauaugauuauauguauuuauauguuacuuguccaucuguucucaacggcugucuaaauguagagcccuugucugucuuaacuacuauauucucaauaccuagcacaauucuuggcuuuuaguacgugcuggaagcaaauuuacuaaaugauucaaugaacugauacuuccaaagaaaggcucaggaaauacacuuagugaccacuagcauugugucccuaugaucucucacuguuccaacaacugcugaagcuggguggguaguguucgccuuacuuuacaaaugaggaaaccgagacccagcuuauccauuucccaaggucacccagcuuguaaaugucagaguuagauucaaaucugauuuaucucccccaacacccacaugcuuccuauuguauuauuucaaaaaaugcaaacccaugagguggagcccaagagaugacauauucuauuaaacccugaaaucccuggcaaacugcucauagaugcgugaccuuucgugucuuccgcagagagaauuuguauucuuguuggaguggucacguguucaccuggguuguuuuggagaagaucaaauaaauaauuuucauucuuggcaucagcugcucacuuaggucaggacuagaucuagcagggucauccaagugaaaaaucccaaauccucacuuuugguaguuuaaucaaacacucgucagagcaaaccauucagccuucaagcucugaaggaauuugagcccuacuuacaaaucaggaacaaaagauauccuugcucuuuucuggaaaguuuauuuuuucuuaugggaauaauuaaauccugugagaguguucaaguuuucaugcuacccugugccaagucucagagggauuucaagccuccuggcuucuuuucuuguuuccugccgugaugaauugauggauguggacuuaacggggccuuuuuucucuguuuaucuguuucuuugcauauuuacauagaaacagaaccaucugagucagaauaaagaacuaguggccaugauguccuuuuuuuccucuuucaaaauuucuuauuuuucauagcaaggaaaaaaaugucaaaauccugcuuuuuggucuuucccucugauggcaacauaacugucuauuucauggaauuuucccccugaaccaagagaggccagguuccuaauuaauuuggcuaagauaauuugggaacuaaagaagcaaauugugaaguaacuauccacacaaaugagaaaaugccuucugugauuuuuuuuucccuaagacauagauccugaagugauguuuuaaaaauauguaguuauaaccgggcgugguggcucaugccuguaaucccagcacuuugggaggccgaggcaggcggaucaccugagaucaggaguucgagaccagccuggccaacauggcgaaaccccaucucuacuaacaaauacaaaaauuagcacggccugguaacacaugcccacaaucccagcuacuagggaggcugaggcaggagaauugcuugaacccgggagguggagguugccgugaaccaagaucacgccacugcgcuccagcuugugcaacagagcaagacugacucaaaagaaaaaaaaaauguaguuccuuuccaguggaguucaggaaagucauaugggauaaacagcauuguuuuguaugcagugcuaugucucacuuuugcagaguuguagcuucucaguuaacagaaaaugauagggucaaugagccacugcccaccacugggcaugacugggaggagcaagaugaccacuuugcugugaagcgguggccugagauggcagcuucucagggucucagcacagagcccuuuucugcucuguguccuuccuuugcagggauucuucugugccaggcucugaugcccucaguaauacagcgauaacagugcacaguuccuuguucacucacuauucacugaccacuaccaugugcuaggcauuauguuagaccuucaugggguuuauagccuagagaggaagaaggacauuuuuuaaaugcacagcuuuuggccagcugugguggcucacaccuguaauuucagcacuuugggagacugaggcggacggaccacuugaggucaggaguuugacaccagccuggccaacauggcgaaaccccgucucuacugagaauacaaaaauuagccuggcaugguggcccaugccuguaaucccagcuacucaugaggcugaggcaagagaaucacuugaacccaggaggaggagguugcagugagccgagauugcgccacugcacuccagccugggcaacaaagugagacucucucaaaaauaaaaaauaaaauaaaauaaaaugcauaccuuuuaaguguauagauugguaaguuuaucagaugugcacacuggugucacucucaaucagaacacagaacacaucucucccuccagagacccccuugugccucuuucaagucagccucuuucagcagaggcaaccacugacgcgauccugucacgagaaauuaguuuaggcucuuagagucagacagaaucuuggcuccauuccucacgcccguguaacuuuuggcaaauugucuccuuucucugggcuuccuucucaucuguuaacuagggauauguguggugucuuccucauaggguuggugaaggauuaaaggaaguaaugcuugcagggccccucaugccggucagccaugucguccuucccuccuucgccacagucugaguacaugggcacaucucagaggcauaaccagcuugugaaauaaaucugaauaauucuucagucuuagaaauaugucuugaguucucugagguucagcuuucccagaucgaguugcccucugcccugucacccuggaauccugcccacuccuuccaugucccccaaguuccuguuccuaaccucaucuaagucacugccacacugcucguuacugaggaccaagguccuuucugacugauuucauuggauuucaccuucaccccgguaucccccaucaccagcacugcauguuccccacuuuccgaaaucuccagaagcaucucugacuucuccugccaguucuucucauuuuuuuuuguuuguuuuuucuuguuuguuuguuuugagacagagucucacucugucacccaggcuggaguacaguggcaugaucuuggcucacugcaaccucugccugcuggguuuaagcgaucuuccuuccucagccucucaaauauagcugggacuacaagugcaugcccagcuaauuuuugcauuuuuaguagagacgggguuucaccaguuggccaggcuggucucaaacuccugaccucaagugauccaccugcuucagucucccaaagugcugggauuacaggcgagagacaccacacccagcuuguuuuguuuuuugagacagggucgcacuuuguuacccagacuggagugcaguggugcaaacaugguucacugcagccuccaccuccugggcucaagcaauccucccaccucagccucccaaguagcugggaccacaggcaugagccaucacaccuggccuccuucucauucuuuucaucugacacaucacauucccuuugucuuccagcccauguuuguguucacguagggcuugaguuucuaguuugugacuggcaggagggcugcugucgaagaggcuugccuuaagugucagacaugggggguuugagucuuagcuucaccacuuuuauaggacaaaaaauaauuacuuaaacuaaucuaagccucaaauucuucaccuuuaaaaugaugcuggccagacacgguggcucauuucuguaaucucaguacuuugggaggccgaggcagguggauuacuagaggucaagaguuugagaccagccuggccaauguggcgaaacgcugucucuacuaaaaauacaaaaaauaguugggcaugauggcaugugccuuuaaucccaacuacucgggaggcugaggcaagagaaucacucgaaccuuggaggcagagguugcagugagcugagaucacaccccugcacucuagccugggugacacagcgagacucugucucaaaauaaaauaaaauaaaauaaaauaaaauagggcugauaauagucaugauuaaauggaauaugugggccaggugcgguggcucacauaauccuagcacuuugggaggccaaggcgggcagauuaccugagguuauuaguucgagaccagccuggccaacauggcgaaaccccgucucuacuaaaaauacaaaaaauuagccgggcaugguggcaggcaccuguaauccagguacuugggaagcugaggcaggagaaucaccugaacccaggaggcagagguugcagugagcugagauugcgccacuguacuccagccugggcgacaagagugaaauuucgucucaaaaauaaauaaauaaaaaauaaauggaauauguguccuagcucaguagcugcugcauaaucaacaauaaauauuucugggugucauuuauuauauugcuuauuuaaauaauuguguuacucagagucuucuggcugauuguugcuuaaauacgcuuauauuugcaaacaaaacacaaaguaacagaauaguagcuaaaaggggauaacagagggagagagucuauguaaucacauguuucugccauauugcaguauacuauuccaauucuuucuagucuuagaaaaacuaagucuagguuucucauuuuuaaguagcaauaauaauugcuucauggcacagucauggggauaaauaaaaaaguguguaugagguaucaagcccaugcccauaucaugugauggacacucagugaacacugucuacuauauuucaucaaauacaagaugcauggauuguggcugggugucguggcucaaaccuuuaauugcaacucuuacggaagcugaggugggaggaucaccugaagccaggagucugacgaccaaccuaggcaacauagcaagaccucaccucuacagaaaaaguuagccagacuugguggcacguagucagccacuacuggcacguaguagucccagcuaccugggaggcugaagugggaggaucacuugggcacaguaguucaagguuacagcgaacugugauccugccacugcacuccagccugggugacagagcgagaccccaucuuaaaaaaaaaaaaaaaaaaaaagaugcauggauuguaagauacgcuuugauuucagaguugcuaaaaugugcaucucaaaaucagcaaaugcugguauuacaaguucaagccccauugacuacuacauucguaucaguggguucauuuuugcuaauugcuaaguuuguuuaacguuuuguugacacuaaacauuuuuauucacaacaguaggaaaaguucucuuuuccaaagcagauacauggaaauuuuuuuaaacaucuugguacaauccugugcuucuccuaaauugaucugcuauggguuuuuacucugccuuuuaacucuuuguguuggauccuuaaagacaguaagaagggccaguucugagaaagggucagucuugaggcuccuaaguccucagaacuuaggcagcuacucuguuuuuccaggucacauccaaauaacuagugugaggccaaaucugucaccccuuugaaggacucuucaaagcuagauaaguccuaaaauuguccccacuuuuuguuuuuuuauuuauuuaaucuauuuuaauuuuuuuuucuagagaugggacucucccuauguugcccaggcugcucuugaacuccugggcucuagcaauccuccugccuuggccucucaaagugcugggauuccaggcgugagccacugcacucagcugaaacugcccccacuuguaaagucagggacuacacucaacugaccuguaccuggaagagauucaaagcugauccaacccaaguuagacaucuuuuuucaaagauguacucuugaauuuauccaugacaguaucggucaguuaggaaugccauaauaaaccacagacuggauggcuuaaacaacagauuaauuugcucacaguucuggagaauggaagucugaagucaggagccagcauggugaggugggccugucuccugacucacagagggccgguuucucacuguguguccacaaggaagauagagacagugagcuguuuggcaucuuuucucauuaggccacuaauccuauagggucccaccuuuauaaccucauuaacuuuaauuacuuucuuuucuuuucuuuucuuuuuuuuguuuuuugagacagucucacucuguggcccaggcuggagugcaguggcgcaaucuuggcucacugcaaacucugcuucccggguucaagugauucuccugccucagccucccaaguagcugggauuacaggcacgcacuaccaugcccagcuaauuuuuguauuuuuaguagauacggggccaccacgcccagccuaauuauuuucuuauuccacauacagucacauugggcauuaagacuucaacaucugaguuuggggugggagggcacaguccauagcagugaccaacccaagaaucuugggaaguaaagauaaacaugagagugucuuuacuauaucugcugggauguuaccuagauaagauucuauauaucaguuacaauuagcuucauuuaugagugucauaaauccuccaaaacaaugauuaagauuaguauuuuaguauuuuggauuuuuuuguuuuuuuguuuuguuuucaugucaaagccagaaggaagccaguucagggcugagcugugucuccaugguuucagucaccuauuuuguuuuuuuuuuuuuacuuugcuuggcuuccauucccaagguuacuucaaggucugagacagcugcuagaacuguagugauuagguuugcauucuagccacccaggaggaaagaagggaagcagagggcacuguccuuuuuuaaaaaacacaucucauugggcaugguuguucacgccuguaaucccagcacuuugggaggcugagaugggcagaucaccugagguuaggaguuugagacuagccuggccaacauggcaaaacccuaucuguacuaaaaauacaaaaacuuagccgggcaugguggcaugaaccuguagucccagcuacuuggaagacugaggcaggagaaucgcuugacccugggagguggagguugcagugagccgagauugcgccacagcacuccauccugggugacagagcaagacucugucucaaaaaugaauaaauaaacaaaaauaaaagacaccucuggaaguggcacacaugacuucuuuuacaucccauuagcuaggacauaaccacacauggguguacuuaggugugagggaaucugggaaauguagaauuuauucuggauggcuguuaggggcugaauuuugucccccaaaaagauauguugaaguccuaaccccgaguaccucaaaaucugacucucuuuggaaauaggggccuuacagagguagucaaguuuagaugaggucauaagggugggccuaauccaauaugacugauguccuucuaagaaggggaaauuggccacagggacagacauacucagaagaaagaucauguaaagacgcgaaggggaauuguccaugugacuggaguggugcaucuauaagccaaggagugccagggauugugggcaaacuccaaaagcuggaagacacaaggaaggaugcuccccuagagccaucagagggagcauggccugcccugcugaaccuuugauuucauacuucuagcauccagaaugugagacaaaaaaaaauuucuguuuuuaaaaccauccaguuuuugguacuuuguuacuguaguccuaggaaacagacacaguggccaugugcccagaaaaauaauggggguucuauuagaaaaggggucagggcauuggauacaggggagaaaccaauaguuucugucauugaccggaaaaaaauguacaaacauccuucaacaaguauuuauugauuaccuaccacauauaguacacuguggcagguacugaggauccaguugugagcaaagccagugaggucccugcccucagggggcuucagaucuagugacaagacagauauuaaugacaugcaaauauuuaauuacaagcuacguuaauccacacagauuuuaauuaaauguaauguuuaauuaaagacugugauaugugcauuuggcaggaacguuacuggguaaaagacggauucucaaauacauauuuuggcauauuuggacauuucacucauuuucagaauuuugugaugaagacuguaaagucaaguguugggucugucauuuugccuuuagcuucagagucucuuaauuccacccaccauuuuuuuuuucugccagaugaaaucaaauauuguuggcauucuaguuacagcuuaugguucuccaaggagagccugugagagagagagaaaugauggaaagccaaaaugggaaaacauuuguuuggcagagggucagauuacuggaacaggaauuauggagcuucaguugauugaaugcuuuguuuugcacauuccuguuccuccuccagucucuuccagcucaguaaauaucauugccauccacccaguuacuggggccagaaaccuagaagucaugcuugcuuuucucuuugcccuccgauuauagauacuuccagaaugcuucucgaaugcaucuuucuucauuucccaaaauccaaaccacagucaucucuuaccaguacuacuguggcucuagcugguccccuuucgucugcucuugcacccuuaucauccauuccccaccaagcaaccaaaggaaaucaggaaaugaugccacacuccugcuugagauccaucauugguuucccacugcauccuuaccuuggcccaaacgguccuaccugaucugccuuccuccuacguuaccuccauuauagcuuuuuagcuccugaaaccagugguagcuuucucucuuaggacuuuugauuuuuuuuuuuuuuucugagaccgaguuucacucugguugcccaggcuggagugcagugguaugaucucagcucacugcaaccucugccucccggguucaagugacuguccugccucagccucccauguagcugggauuacaggcaugcaccaccauguccggcuauuuuuuuguguuuuuaauauagacgggguuucgccauguuggucuguagcaguguagauuuaguagauuucguggauugcuguagcagugugaugagacagauggaaaacuuucauggcauuucugcucacagcuuguugguuggaauuguguugcguggucacuuuaaggggggcagagaacucaaguauucuaauuuuuuuuuuugagauggaguuuugcucuuaucacccaggcuggagugcaauagugugaucucggcuuacugcaaccucuaccuccuggguucgagcgauucuccugccucagccucccaaguagcugagauuacagguauccacuaacaugccuggcuaauuuuuguauuuuuaguagagacaggguuucaccauguuggacaggcuggugucgaacuccugaccuccggugauccacccaccucagccucccaaagugcugagauuacaggcaugagucacugcaccccgccaagcauccuaauuuuauagguaaggaaaguaaggcccagaauugaaaugacuuauccagggccaacugagauaaacaaaaguggaaucuggucacuccugaccaugcuguuaaguaaguuguaugaaauagacucacuucagggcuuggcccaucgggcacucauaauauaaauuuuccaucccuucucuguccucuguuccacuucuacuaucauaguuguuucagagacuaauaugaucuagacuuuuuaaaguuuauauuauauucaacuguucuuaauaauaguaaugccuaccgggugugguggcucacgccuauaaucccaguacuuugggagaccgagguggguggaucaccugaggucgggaguucaacaccagccuggccaacauggagaaaccccaucucuauuagaaauaaaaaauuagugggguguggugaugcaugccuguaaucccagcuacucgggaggcugaggcaggagaaucacuugaacccgggagacggagguugcggugagccgagauugugccauugcacuccagccugggcaagaagagugaaacuccaucucaaaaaaauaaaaauaaaauaauaauaauaauaauaauaauaaugccuuucuuuuguaaaacauuugucagaggaugucacauuucucauuguauuuucccaacuuucugaaauagaggugaguaaguaccaccaacucaguuucacauguaagaugauggagacccaaagagguuguucaggaccaaguuaagaguaaauucuaggccgggcucagugguucacaccuguaauccuggcauuuugggagggagaggcggguggaucaccugaggucaggaguuugagaccagccuggccaacauggugaaaccucaucucuacuaaaaauacaaaaauuagcugggugugguggugcaugccuguaaucccagcuacuugggaggcugaggaaggagaaucacuggaacccgggagguggagguugcagugagccgagauugcaccacugcacuccagccugcgcaaugggagugagacuccagcucaaaaaaaaaaaagaguaaauucuaacugucucaugccaugaauuccauuuucagguacugggcuggaauagaauccucuuauuuaaaacaagcauaaacaagaacacagagauccuugagugaaugcccagacuagauuuucucaacuuuuacuacaugucagaaucaccugggaaacuccuagaaaauacccaaagauacagacucaguuggucugggguaaggcucagacaucagcacgguuuggaaacucccaggcaauuuuaaaguggagcuuagagacagccuacuggcucagaccucuuaaagauggauaugaugcugcguaauccggucauguuguuggauaaagggcugcauugauuuucaugccucaaauucaaacggaaggugguguuccacaguuuguuuaugaaauauauugugaaggcauuuagaugauguacuuuuuuuuucuuuuuuuuccuggagauggagucuugcucugucacccaggcuggcaugcaguggcuugaucuuggcucacugcaaccuccaccucccagguucaagcgauucuccugccucacccucccaaguagcugggauuacagacaugagccacuacgccuggccuaaaugauguacuuuugacauugcaguauuucuuugcacaguaucauuuacacacacauuugggaauuuauuagcuccacuugauguaaaaauuuucuuggagcaaaccaagcaaagaaacagcuccaaaucuuuuuuuuuuuuuuuuuuuuuuccugagacggagucucucucugucacccaggcuggagugcaaggcacgaucucggcucacugcaaccucccccuuccagugaaucaagcaauucuccugccucagccucccaaguagcagggauuacaggcgccugccaccacacccagcucauuuuuuguguguuuuuaauagagauggguuucaccauguuggccaggcugguuucgaacuccugaccucaagugauccacccaccucggccucccaaagugcuaggauuauaggcaugaaccaccaugcccagccccuccaaaucuaaaaacaguuuuuuaaaauuaaguauugcagccgggcacaguggcuccugccuguaaucccagcauuuugggaggccgaggcaggaggaucaccugaggucaggaguucgagaccagccugaccaauauggugaaaccccaucucuacuaaaaauacaaaaacuagccagacgugauggcaugugccuacuugggaggcugaaauaggaaaaucgcuugaaccugggaggcagagguuguagugagcugagaucgcgccauugcacuccagccugggcaacaagagcaaaacuccaucuaaaaaaaaaaaaaaucaauauugcucaugcacucaucuugguuacuuugaauugucauacuugugccauaugacaugcaggacaccuggcccgucuaacugccaauguaaaacauagcucuuguuucauguaccauaccuagugaagguacccaugaauggcuuuggucuuguauccuagaaagccccuacuguucucuuugggcaacggacauuuuuuuaaagaauaggaaaauauccuucauacuauccugaggaagguucaaggagggcaauaucuuauuaauucaaauaugcuuugagucuugaguuuuauuuuauuuauuuauuuauuuauuuauugagacggagucucacucugucacccaggcuggaguacaguggcaugaucucggcucacugcaaccucuaucuccuugguucaagugauucuccugucucagccaccgaaauagcugggacuauaggugcacaccaccaugccuggcuaauuuuuguguuuuuaguagagacaggguuucaccauauuggucaggcuggucuugaauucuugaccccaggugauccacccaccucggccucccaaagugcugggauuacaggcgugagccaccgcacccagccaaguuuuaaaauauggauuuuuuucugcugaaaagaaaauguuuacuucuccccaccccucuccauaauaccuagacccauauccaguccguuuuggcaggaguuugugcugacuggugaaaaguucacagagcaggguauuaaaugggccuuacucuugggauggagagagugcagaaugccagcuaucugcauaagggaggcccagagaggcccucugcaucucugaggagaaagcugucuuuaucauggccagauguggccagcuguguaauugcugaucgcuggggccuuaacugcccugugcucuggguggagugacugccugcauguacccacagcuggguuaaugagaucaaguuucacuuuuuagagccagaguaaucaggaccaggcacaaaccauauccucguaagccugggggugcauggguguccccugccuuggccaagccaggggaggccaaauacuauggcggacccucaucuguguaagcuggaauccugggcugugauguaucugcggagaacagacuuuagugucuccaauccugcaggagucaaauguccuuccucuuccguuauuucugauauuguggaaauaggauauguauuaaaagaaauuacuaaaaaaaguaccuguuugaauguuuagggcaggggcacuacucugucugauacuauaaugguggguaccggucauuauacauuuaaccagagccauagcaugugcgacacuaagagugaccccaguguaaaccauagacucugggugauaaugauguauuguguagguucaucaguuuuuuuuuuuuuuuuuuuuuuuuuuuuagcuggagucucacuguguugccuaggcuggagugcaguggugugaucuugguucacugcaaccuccgccuccuuguuucaagcaauucucaugccucagacuccccaguagcuaggauuagaggacugccaccacacccagcuaauuuuuguauuuuuaguagagaugggauuucaccaugugggccaggcugaucucuaacuccugaccucaaguaaugcacucgccuugugcugggauuaccgguguaagccgccaugcccagccucaucaauuucuuuguuguugagacagggucucgcucugucacccaggcuagagugcaguggcuugaccuaagcucacugcaaccuccagguucaucaguuguaacaaauguaccacucagguaggggguguugauaaugggggauaccgugccuauguggggcaggaggcguauggaaaguccuauagcuuccucucaauuuugcuaugaaccuaaaacuaucuuaaaaaauaaaguuuacuuuaaaaauacuagugaggcacagugacucaugccuguaaucccaguacuuugggggcccaaggugggaggaucaccugagccucaggaguuucagaccaaccugggcaacauagugagaccccaucucuacaaaaaauuauuuuuaaaagccaggcacaguggcucaugccuguaaucccagcacuuugggaggccaagguggguggaucaccugaggucaggaguucaagaccagccuaggcaacauggugaaaccgucucuacuaaaaauucaaaaauuagccaagugugguggugugcaccuguaaucccagcuacuugagaagcugagacaggagaauugcuugaauccuggagguggagguugcagugacccaagauugcgccacugcacuccagccugggugacagaguaagacucugucucaaaauaauaauaauaauaauaaaaugcauauuugcauuuacuuaugugcuccaucgugcuguaaggauuucaugcccaucccuuccauuuuauccaucaccucccaaagcugacugcaccccaugcuuccucagagcuccugcccauauuccaucccaucccagacaucagugccagcacaucucaucaacacagugaugccucuaagucucuacucaucuuugccuuaaacuuccuucuccuguuaauccccucccccauuuccaucauugccaacauuuuucuucaaauuaggcagccuugauacugggagcucucuugucuccucagccucccugcucaaaccuggggagcuuccauuuuuuaugccuccuuucaauucccacugcugugacuugaguucuggcucuuucauccucugucucaagucugagggaugaguccuuuuuuaccagucugggaaaaggaaaggaccugguggugagcugaggcuucucccuguuagcagggcuggcaguugggaugaagagcuggacacagagugcgggagagugagaacaacuuggaaacuaacagcacuuccgccuuuaccucucacuucagagaacagguuguaacccaucagcaucuagccucuguauuaauaacuuccuuuucuaauauuuauuccauauucccugagcccucaggaagcacuucaguuacuuauacuuuccaaaacuucauucuaauaugacacuaacuuucuuuuuuuuuuuuuuuuuuuuuuuuugagacaaagucuugcucugucacccagguuggagagcaguggcacgaucuuggcucacugcaaccuccgccuccuagguucaagcaauuccucugccucagccucccgaguagcugggcuuaaaaggugccugacaccauucccaguuaauuuuuuguauuuuuaguagagaugagguuucaccacauuggccaggcuggucucaaacuccugaccucaaaugaucugucugccucugccucccaaagugcugggauuacaggcgugaguuaccacacccagccaacacuaacuuucauuccugaagguucccgagugggaccacaagugaagcuggugaugaaggcugugaccuuguuggcuggugggggccuugaguccacuguuggucaguagggccaucagcuggggagcagaacugcauguggagcaauggagggcaaagccgagcugaaauccuucagcaccucugcgucuaccucucacuacauuuaaccauaacagccacgagugaacagccaugguggcugcuucacuuccaccuuccagguauuauggaaaauucuuucuggccaacuugaaucuggaacugugcaggaaagggaaucugaaaaauguagcucuguuuuggccaaguugacaccaaaaagcuccaccuucuuauuugauucauguucuuccucauaacugguccagaaaaugugcuuggugcaagugugagccaggaauggggagaaugaaugugagagucauccaguaaaagagaagugaggaugggcugauaagggggcuagagagcuuuuggugaguaucauaccuaauacaugcuacuggauauggaauucuuuuuuuuuuuuuuuuuuuuuuugagacaaaauuucacucuuguugcccaggcuggagugcaaugaugugauuucaacuuacugcaaccucugccucccggguucaagcaauucuccugccucagccuuccauggaguugggaucacaggcaugcacuaccacgcucagcuaauuuuguauuuuuaguagagacaggguuucgcccuauuggucaggcuggccucgaacuccuaaccucagguguuccacccaccucugccucccaaagugcugggauuacaggugugagcaacugugucuagcugugagcuauauuuuauaguugaggccgaaagaguuugagucacagccucuuguuguguaacuacauggcagagccagaagccaagcuagcccaggucugucuggcuccagagcccuuggucuuuucauuauaucacagcacccuucaaaugugugauauuaccugacuuuucugauccucagcuuuccaucaggcugauauuggcaaaauguuuuucacucugccagagguuagauguucucuaggaacgaagauuuggagggaucucaaucuccaaauccauagauuucucugacuggugugcuaggcuccuaaagaugacaagacacagaugacucacugguccacauccacguuuuaauugccaggcaaggauuuacucccaaucuuuagccaagucaguauggagcacucucuuaagccuuuagagugacuucuugaacugagucaguccugaguagcuugauuggcaaccccaaucccugucccacaacuugcuugguccugaauauggcuauguacugguagacaaaugaaggggcgggugacucacgccuguaaucccagcuccaccgggggcugaagcaggagacuuguuugaacucaggagguggaggcugcagugagccgaggucacacuauugcacuccagucugggugacagagugagacaaaggggcucuggagcagaaaccagcuacuuggcucucuccccugggggcauccagcaaaggauguugaagguugcuuagucccgaucucaucacacccaaaaagagguugcuccaugcucaguccuauuuauaauccucuuacuuuucccaccaaaacacuacgaacaagauagugguauaacugugugucucugcaaagcauguacacacacacacacacacacacacacacacacacauuguauucguagcugagaucagagcagugccaccuuggaggaagaauaaggagaaucggauauguugacucacccuuacagguuagauaaugucaccaacacauccuaaaucaguaacuuuuuuuuucuuuuuuuuccuuuuucuuuuuuuuuuuuuuuuuuuuuugagauggagucuugcucugcugcccaggcuggagugcaguggcgcaaucucagcucacugcaaucuccaccucccggguucaagcaauucuccuuccucagccucccaaguagcugggauuacaggcgccagccaccacgccuggcuaauuguuuuguauuuuuaguagaaaugggguuucuccauguuggccaggcuggucuugaacucccgaccucaagugauccacccaccucagccucccaaagugcugggauuacaggcaugagucacugugccuggcuaugauuaguaacuuuaauacugcaucuuguuuaguacuuaaucuuuuaaaaccuuuguuauguuaauuuugccuuuuuggcauaauccggaaaaaagaaaaauaauuucuggguguuaaauaguuauugauaaacauuuauuaaagccaaacagauaauugggcaaaagauucuuacggaggaaaaaauuugagaucagggaggaaguuuguccuuguggaaucuauuuccucuuugcuauaagcuugugugggagugauacauguguuaagacucugugucucuuggccaggcacaguggcucaugccuggaauucuagcacuuugggaggccgaggcaggcagaucacuugaauccaggaauuugagacuagccugggcaacauggcaaaacccugucucuacaaaaaauacaaaaaaauuagccagccaugguggugcaugcguguagucccagcuacucaggaggcugaggugggaggaucgcuugaacuugggaggcagagguugcagugagcggagauggcaccacuacacuccagccugugagacagagugagacccugcccagaaaaaaaagaaagaaagaaagaaagaaaagaaugugucucuugcuguuggaaccccuccuucccaucccacucaaaauuacaggguauucuaaagaacuuccuauauccacaguaaaagcaaauuuuguaugggggugugggaauguaagagugagaauuuguucuuaggugauagauaccuuuccuucagugguaaaggagggaguccacagaaucuugugguuauaguguguaaauuuugccuucuuuucagcaacuggagugcaguggugcaaucuugguucacugcaaccuccgccucccggguucaagugauucucaugccucagccucccaaguagcugagauaacaggugcccacuaucauguccagcuaauuuuucuauuuuuaguagagaugggguuucgccacguuggccaggcugguuucgaacuccugaucucaggugauccaccugccucggccucccaaagugcugggauuacaggcaugagccacugggccuggccaugcaacugaacacuucuuauaacguucagaaaccaccagauagagagaaugcugucuguccuuaaugcaagcagcccuuggaauuguuucuagagcugucaugagcugccgaugggaaggugacaucagugucggucacaaauucucccuucagccugaucuaugccucuagagagaauucccaggaaggcaaguuuuugcccuaacuuugggaauccaguauguauggacugaaccaggguuccccauaacuaccccucuuuuauguacaccacaaucacccugugauugacccauuugcugagcagagcguaccaagagggagccuagaucuuaaacagagcuuugauugauuggggcugaaagggggcagauucuguaugagaccagcaggcauuacaaacuucucaauuugaaacaaaaaugcuuuaaugcuacuuauuguuguugucuuauugugaaaguuagucauucuuauauaugguuggcuuucuuucaaggucaauugcacagucuguucuuugggggcaccgcauagcccuauagcaugcuuaaaaugcauaaagcuuagaggaagacuaguucucuggagagaauucuguguuuguccaagaacuggaucccugccuccucccacacagucacuccacagccaguugcauacuugcagagagauuuauggggcugaacauacagcugcaaguuuucuuuucuucuacuuuuuuuuucuuccaggaacaguguccugcugucaggucugugugcacuagacacaaacacauaacuuauuuacuacagcaguauccaaaacuccuaaguaguguccuugcugaaugugaguguuuucaugaauaugaaacauucugaagauguaaggaauuccuagauacaagccaaucuugacucaguuuacaucucugucuaauauuuuggugaaggaccauccaggagucuaguuacacuguacagcuguuucaguucuaaagcaacuugguuaccuuauggucaagaucagaaauuccuuaacggaauuugacugcucuguuuccuuuaaaaguaugcugauuguuuauaguagcuucuggauucucuguccuugggagguucucuuagauugaagcaaauucucucucauaccuuguguugguuuuuguuuuuauuuuaauuuuuccuuugugaucugaaugaauaacaucaucacuuaacaccuauugccauuucaaagacagaaucccaacaggcuuuucuggguauggacccaugcaaugguuugucugccuuucaacaauuuguaucaucuuggccauuuuggggaacagggauugugcauggggaaggauggaagaggaaaaccaauauuuauuuaacauucagugguaguaaacacugggauuaguacuuaauuagaguugauccucauaauaaacuugauccccauuuuacagaugaguaaauuauaacucagagaauuucuaacuugcccaaagucauacaacuaauaaauuguaaaggugggaguuaaagcaauuuuuuauugaacuauauagaaaauguacaaauuauuuauacacaucuccaguuauuacaaagugaacugcuaggaaugugaguggaauugguaaugucaguuaaaggcagagauuaggugaugccaucagucacugugacaaaugguguguggggggagcuugcuggcugaagcauugucaccguggguaauuauacacuuaauauucauguguuaucguuccaccuggaaucuuuaaacucuucauccaggagacacuaaucuucaccuuauuauuacguccuaaugucacucuagcagaagaauggggcugccaacagggggagagaacuuccuccuucuccucuagguuguaauaaacaugguuauuuguuauuugaacucuggcugaagauaagacgcuauaugccccugccagauauggcccagguguagagaugaguccagguuauuguuaaaagagugaaaaugccccugucacauuccccaucguuuucuuccaucuauaaagaugauggcaaugguguuggcaaugguggugauaaugaugauuaucaagugagcauuauuccauuuuuaggcaugauggaaggaaaagucaaaugcaguguucuuaagaaauucugcugggcccgguggcucacaucuauaauccuagcacuuugggaggccaaggcggguggaucgcuugaggccaggaguucgagaccagccugggcaacaugaugcaaccccugucucuacuaaaacacaaaaaaauuagccagaugugguggugcacaccuguagucccagcuacuagggaggcugaggcacgagaauugcuugaacccaggaaguagagguugcagugagcugagauugugccacugcacuccagccugggugacagagcgagagucugucucaaaaaaaaaaaaaaagaagaagaagaaaguaaaaaaagaaauucacuauagccuggcacaaaggcucaggccuguaaucccagcacuuugggaggccaaggcagguggaucgccugagcucaagaguucaagagcagccugggcaacauggcaaaauccugucucuacaaaacuuagcuuggcaugaaugcacacaccuguggucccagcuacucaggaggcugaggugggaggauauagcuugaacuugggaggcagagguuucagugagccaagaucacaccacugcacuccaaccugugugacaaagugagacccuaucucaaaaaaaaaaaaaaaaagaaaaaagaaauaaauaaacaaauaauaaauaagaagaaaagaaaagaggugcuuagacaccaggcuaggaugcucaucuaugugguaucugugccuauuugggggaagcugauuauccacugcucagggggcagaguagccgaggucuuaaguguacaaguuucgagucagauccugguuucaccacuuacuagcucugugaacuugggccaauuacuuuacuuucugaaucuacccccucaaucgugagauggaaauaaaaauaauaggaccugcguugggaauuuuuaaugaaauuacacauguaaagaguuuuggaaaauuguuagauguucuuauuagcuauuauagcacugcccaugcugacuggcaaguugugaccuaagaaguagucuggggauaugaacuacuaugguccgaauguuuacacccccuccaaauucauaugcuaaaauccuaacucucaaagcgaucagguauuagaaggcagggccuuugggaaaugauuaggucacugggucagagcccucaugaaugggauuagugcccuuaugaaaguggcuggaaagagauuccuugccccuucuaccaugugaggacauagaaggugccaucuacaaagaggcagcccucaccagacaccugccagcaccuugaucuuggacuuaaccaagauccagaaaugggagaaguaacuauuuauuguuuauaagccacucaguuuaugguauuugauguuuguuguagcagcccaaacagacgaagacauggauggacccaauggcuaggcuuccucagguauaggacagagaggagaaauaacaaauuauaagaagauagugcuuuaucuaaauguguaugacauugcuuucacaaucugauaucauguuaugaaagccagaugugugauuuggagcaaaguuuaaagaaauaggaauaaucaaaauaauuuuucuuucaaaaaucuaaauuucaacggcuuucaaauauuucuuaaucuacucaugauuuuuguugcucugcuucagucucagccuuuuucuuuuugauauuuuggcugccaaaaagccugaguccuuauucucaggagccugauuauuaucuccgauaaugguucuaaacuuagucauuuuuguccaucauuauuauuauuaguuuugaaguuuaaagaauagcaaaauuuggcucuaaaaaugaaacagacuuucaucaaguaauacuuuuauuguuuuuuauuuguuuuuuguuuuuugagacagagucucgcucuguugcucaggcuggagugcaauggcacaaacucgccucacugcagucucugccucucgguucaagcaauucucgugccucagccucccaaguagcugggacuacaggcacaugccaccacgccuggcuaauuuuuguauucuuaguagagaugggguuucaccauguuggccaggcuggucucgaacuccugacuccaagugaugcgccugccucggccucccaaaguucugguauuacaggcaugagccaccaugcccgaccuuuaggcaaguaauaauuuuaauaacuaaaacaucagccuucuucuugcaugaggcaguuaaugcucauggugaaagaaugcucucuuauaauacuaacagguaugggaugagcauuuaaacuaacuuuugguagaaaaaaauccuagcagggcugagcuugguggcucacgccuguaaucccagcacuuugggaggccgaggcgggcagaucucgaggucgggagaucaagaccauccuggcuaacguggugaaaccccaucucuacuaaaaauacaaaaaauuagccgggcgugguggugggcgccuguagucccagcuacucgggaggcugaggcagaauggugugaaccugggaggcagauuugguaggucuuggauaagaucugagaagucauacuuagaaugggaucccaaaggugacucauauuuacacuaugguuugagagccacuuuuuuuguauuugguugugcuuuuucacuugagcaauugcgcagugaaaaauggcccaaauguuaaccaaaaaugcauagcuagaacuucuaauaugcaacuggacuccaaaagucuuccucauuaaguggugcauuuccuaacguaaguauucuagagagaugggcuggauaccuaguagggacguguaggaaagaauuccacuuuuuaugggaguuggaucaggaugaucucuagaacacaaaugagugcucuacuugauuaagauuuuaguaauggcuugcuacuuaacaucuuguucugcuuucuguaucauuuaaucgggcagccuuuccuacucuacuaagcagaucucagcucucccuggucauuuuccacaucuauuuguguguaucuuaucauucuuuucugucugagucuuucucuguauuguuaaauguuuuauguuauuuucagggauagucagaagcagccuuccccuucaauccuucauucuccuucaagaucagaaagaaaaaaacaagaagguauugacaugaaugcaacaauuucugggaugcaaauuucuuggugaauacagacuuccaugacagugagaagacaauuauguaaucauagguguaguguuucuccccaacuucacucccacuuuggaugaaacaauugaaucauugugaugggacgccagccuauaagaacaaaugugcaauugaacaaucccaugggcacucagucuauccagaggauuaucguacaucugccaggacuggcgcagggagaggaauuguaggcaagauuauuuaguaaguuuggcuuccuaucaggaggaaggcuggaguucagccuagguauuuaucccagccugaucacacccugaaaugugcugaguccugccuccugcuuccuguuaacucuuacgaggcuaacuuagguucuuauaacuuuuuuuuaaauucuucaaauagggucucacucuguuacccaggcuggagugcaguggcgccaucucagcucacuacaaccucugccucuuggguucaagcaauucuugggccucagccucgagaguagcugggauuacaggcaugcaccaccacgcccagcugauuuuuguauuuuugguagagacgggguuucaccauguuggccaggcuggucuugaacucaugaucucaggugauccacccaccucgccucccaaagugcugggauuacaggcgugagccacugcacccagcgguucuuagaacuuuccuccagugcccacuugcuuggagacauuacuuaccuaggcuucauauuacuugugaaaguuuuguucuuccuuuucauucaagaauuugcuccuuaucccuucauuugaaggugaagguacuaccucuuugugggagaugaguuacagagcaguuauaugagcucaugauugaucccuuuuccaagaacuagggaaaugcaaucccaucuuuggaaacagauccgauaaagauaauuauaaggaaaaaaaaaaaaaaguauugcaaccuuacuugaacucuuguuaccaccaguggguggcaucuaagucaccccaccucaaguagaagguaauaaguuccuaagguggccgcccgccauucagagguagucacgcguucuguguguuugugccugugugcuuuugaauacagaggagaaauaauuucccccaggcugagugcuuccugugguuacucauaauguguguugauuugcaacacauaguguaccauagauguuaaaugaaaauucauuauaacugaauauguuacauaguaauaccuacauuucuagaucauuuuguacauuuuuacuaacaggacauuggaauugcuggaaccacagcaguuguucagaccacuuagggacagaugacgucuuuucuaacagccuaaaucuauuuuuauuuuauuuuuuauuuuugagaccgaguuuugcucuuguugcccaggcuguagugcaauggcacuaucucggcucauugcaacuuccgccucccagguucaagcaauucuccugccucagccucccaaguagcugggauuacaggcaugcaccacgaugccuggcuaauuuucgcauuuuuaguagagacagggucucaccauguugggucaagcuggucucgaacuccugaccucagaugauccaccugccuuggccucccaaagugcugggauuacaggugugagcacugugcccagcguauuuuuuuauuuuuauuuuuuuaauuuuaaaauuuauuuuauuuuaucgaggcagagugucacucuguugcucaggcuggagugcaguagugcaaucuuggcucacugcaaccucugccucccagguuccaagugauucuccugccucagccucccgaguagcugggauuacagguauguaccaccaugccuggcuaauuuuuguauuuuuaguggagacuggguuucaccauguuggccaggcuggucuagaacucuucuuuuuuuuuaaaauuuuuuauuuauauagguaauuggggagcaggugguguuugguuacauaaguaaguucuuuaguggugauuugugagauuuugguacacccaucacccauggucucaaacucaugaccucaagugaucugccugccucagccuuucaaagugcuggguuuacaggcaugagccaccgugacuggcccuaauagccuaaaucuaaaauuacuaccuugaauauuaacaugauaaauguuuugaaggcauuauuuuuugccuuauucaaggaaaaaguuugaaauaaguaucuaaguuuacauauuauucagaguuuuuagugacacaaaaagaaacccaaaaccuuaauugaauaaaaaccuucuuaagaagcugaaagaagcuaaacaucaacaccguaagauauuugaguggcccuagggacuguuuaacaguuaaagagaagaaacguuugucauccacuauucugugcaugccugagaacuugcauauacauauuuuacuuuauaaauuuguucuuauguaggccuguagaguauccuggaggucagauuccagaugcagcacuuaguugugugaacuugagcaaauaauuuauccucucugacauuuagcuuguuuauaaagauugcacugggggccaggcaugguagcucaugccugcaauuccagcacuuugggaggcugagguggguggaucaccugaggucaggaguucaagaccagccucgccaacauggugaaaccccgucucuacuaaaaauacaaaaauuagcugggcgugguggugugugccuguaaucccagcuacuugggaggcugaggcaugagaauuguuugaacccggguguaggaaguugcagugagccaaaauccugccacugcacucuugccugagggacagcgcgagacucugucuuaaaaaaagagauugcauuggggaugguggguugccagugacagaaaucagcuagccuaacaaaaaaaaaaaagaaaaaagaaauugauuagaaagauauuaaguauguaaaacaaaggcagauccagagaaccaagcuuuuuauuuuuauuuauuuauuuauuuuuuugagauggggguuuugcucuuguugcaaccuccaccucccagguucaagugauucuccugccucagccucgcaaguaucuggaauuacaggcaugcaccaccaugcccagcuaauguuucguauuuaauagagacaggguuucaccauguuggucaggcuggucucgaacuccugaccucaggugaucuaccagccuuggcuucccaaagugcugggauuacaggcaugagccaccgugccuagccuggagaaccaagcuugauaaaggacaggaaccaaggcagaucuggggacccaaauaccagagcaaaugaacuuuccuguguuacucagcuccacagucagugguccaggagacagagucugacuggccaagcuuagggucagaugacccugugaauagggggagggcagggcauguugguugacauuccuauccauacugcccacagcagaggaaaggugauaccugaaaagaauaucaagucaacuguagugaaaugaagcuggauaaccaaaaaccaacagaugugucaccauaugacuuuuaggacaauuuuuauuaaguguguaaaguacuuggauuggcacuugagaaauacuagguuuuucaauauaugacugaauugauugagagguugccugcuauuuugaaaaggauccugccugugauacucugccuccuaaacuaaauuguaagcuucgugaaggcaaagaugcugguauuuauuagguuggugcaaaaguaacugcaguuuuugcaauuaaaaguugcaaaaccacaauugcuuuugcaccuaccuaauaaaucuuauuuaaguucuccacacacuaguugguacaagaugucaugggcuuuuucuccagaacaccugugacagagggucuucaccugauccucuauaccccuagagaugugcucagguggcagcacaaguaagaagguuugugugaaaugagcaguucacggugugcuugcucugaccccacucuugacuggcugcucuggacagcaugugggaacgcaagggagugagacugucuuuaugccuaggguagcccugaaucagccuuacuuuaugaaagagugaauuagucacaaacuuuggcauuugagaaaugugugugugcauacacuuagaaaacaaaaacaagaaaugaccuuuuucuguuuuucuaauuuuuuuauuuuuuaucuuuuauguuuuuuaggcaggaucucacuuugucacucaggcuggaaugcaguggcaugaucuugguucacugcagcuucaaccgccuggguugaagcgauacucuugccucagucccccaaguagcugggacuacuggcgugugccaccacaccuggcuaauuuuuuauuuuuauuuuuguagaaacagaguuucgccauguugccuaggcuggacuugaacuccugagcucgagugauccgccugccuuggccucccaaagugcuaggauugcagacgugagccacugcacgugcccggccuguuuuucuaaaauuaaauucaguugaagugaccaucaccaagguugaugacaaguucaaugucagaucauuuuggugucccuugccuauguccuucccguuugagaucaugugcaccauaacccaccacagcccccaucccagggcuuuuaggcaguccaguaaaaugaacccugaccaguauuagugacuggugccacuggcccuuggccagacagcccugcugacugcccuuuuccuaccccugaacaccuggguaaagguccugugcagaguucaccaggugcucauccucccacacauacagccuugaccauccuagcuucugaggccuccaagagcucugcaaucaagaggugcacaggaccccaucuugaaccaaaccagccucucccuucuagacagaagggagauccuuguagaccaagaaucuacccacuguuagcaucagggcccucuucccuucaauguuuauuguuuuguuuuguuucauuacuuaacuaagagcuuuauggagauauaguucacauaccaugcaauuuauccauguaaacuguagaauucaguaguuuuuaauauauucacagauuuaugucacuauuacaacaauuuuagagcauuuuuaucaccccuaaaagaaaccccguacccauuaccaaccacuuccaugccccaccccaccaccccugcucccaacccuaaguaaucaauaaucuacuugcugucucuguggauuugccuacucuggacauuucauauaaaugggcucuuacacucuauggucuauucugacuggcaucuuuuacuuagcauaauguuuucagggcucacccauguuguagcauguuguauguuccauuuuauggccgaauaauauuccacuguauggauauacugaauuauauuucuccuuucaucugucuuuuuaaauuuuuuaaauauauagauauauauauuuuguagagacggagucucacuauguuguccaggcuggcucaagcaauccuucugccucagccucccaaaguguuaggauuacaggcaugugccaccacgcccaaccuccuuucaucuguugacaaacauugggguccuucaguucuugaagcuucaagccacccugucuucaacgcuuuucccucugguggccauagaucagggaccacaaacucacaugccugucagccagguguuaggaagauaggaagccguaaggacuguggcaaaugaguguccaugccauguguagaacaggcaggcucuacucagccauggccacauggccaucuacaccugguaugaucacagcuucugauugucccagagaagccagagucuggguuuuuauuuauuuauuuauuuugagacagagucuugcuuuguugcccaggcuagagugcaguggcagaaucucggcccacugcaaccucugccucccagguucaagcaauucuccugccccaggcuccugaguagcugggauuacaggugugccacuacaccuggcuaauuuuuguauuuuuaguagagaugggguuucaccauguuggccaggcuggucuugaacuucuggccucaggugaucugcccgcuucggccucccaaagugcugggauuacagaugugagccacugcacccagcccagagucuggauuuuuaugcaaagauuuuccaaauuuuauuuuauuuuuuacuuuuauuuuuugaaauggaguuucacuguuguugcccaggcuggagugcaauggugugaucucggcucacuacaaccuccaccucccggguucaagugauucuucugccucagcuuuccaaguagcugggauuacaggcauccgccaccacgcccagcuaauuuuuuuguauuuuuaguagagacgggguuucaccauguugaccaggcugauccacccgccaggcugauccaccucaagugauccaccugccucggccucccaaagugcugggauuacaggcaugagcuacugugccuggcagauuuucuaaauuuuaaaugcuggucaauuaaaacaaacaugaugugugacagaggacacacaauugugguuaagacuaaaugcugaggccaagugugguggcucacaccuauaaucccagcacuuugggaggccaaggugggaggaucaccggaggucaagaguucaagaccagacuggccaacauggcgaacccccucucuaccaaaaauacaaaaaauuagcugggcaugguggcacacaccuguaaucccagcuacucgggaggcugaggugggaggaucgcuugagccugggagauggaggagaucgugccacagcacuccagccugggcaacagagggagacuccaugucaaaaaaaaaaaaaaguaaauggugaaaugugaucccugagcgaugcggagacauggcuaaucucagggagccugcgaagggucagcuggagagggcacucaccuggcaacuccugcccucuuauuuggcagugcaaaaaggcuauucaucuuuuuggaaaaagaaaccccuguaucuguggaaaagacaagggauuugaaauuuccaagucuagggucuaaagcucuggguugggaaggaggugaaauucuucucauucuuuggcucaugagucugcugcagcagaaaaaaacaaagcccaggcugaugccugcuaaauugcaaauuacugcuaaauugucuugcaaauuacuguggccuaguucaggauagauugugaccuguuugugugaccuugauuaugacugugaccuccaccaugguugaaaacugcugauuuuguauaagauguacccugaauccaugaagacaaauuuguggaaccaagaaaagagaaacaguaauagugugaucuuauguggagaaaacacccuaguagguuggggagugcaaaguaucaagguuuaugacaacagcgaguguuuauugaguaaauaagcagucuguguacuacugcccgcuuuccauuuuguuuugccugugaccgugaaagaaguggguauuuuuugaaaggaaagagauuaauaguacucagcaucgguguagugcuugguguuugcaaagagguuucaaaugcacuaucuagugugagccugugagaauaggcguuuuuaccuguuguacaagugaggcauuuauaucguugaaacauagaagaggagaaauuacuugauuaauguauuccaccaaagggaccuauaacuuaaaucuguaucuuugauucuaaguccccucaucuuuuccacagugacagagcuuuccaauacucuucccaguacucuccaauuuuguuguaucuaaguaauaaguauagauauuuuuggacuuaauaucauguuuaaguuuacaucgauauuacccacacagaaaacaauaaaaggaaaugaugguucccaagguguuuugguauuuuuuacauucuuugguugaguccucaacacuaauaauuaauaauugggagcaagcaugccugugaauuacugcaaguagaaacuauauaugucauuaauucuuacaacagucuuauaagguagguauuacucuuauuauuauuauuaauucuuauuuuaggguugagggaaauaaagcucagaaauuuaaauaccuagcuaguauuuaaauacuagcuaaagcuaguaugucucugaguuaggauuuaagccaaauuuuguaaaacacuaaaacgauuuuuuuuuuuuuaaauuauacugccuuccagaaaauguguagcuccuuggaaauuauugaauuggagucgucagcuggauacauuuggauauuuuaagaaugaaguuaccuguuagggcuacacacugucuuuauuaaagcuuugugcaaaaccaggcgcuauaauagaugcucuuucuuugcaucuuuccuuuaggucugucaguuugucgucucugucaacgggcucaauguccugcauguagacuaccggaccgugagcaaucugauucugacgggcccacggacgauugucauggaagucauggaggaguuagagugcugagcuccugggccucccagcccuccaguggccugugggugagggaagccagaaugacacaaagcaaugcaaagacaagauugccaugcaaauggaugguuuuggacauacgagucuucuccgcacauacaugucuaaaguugaguuuuauacacugaauguggaagaaccggguaucauaucuuuuuuaaaaaaugucaguguagaaaacauuugggaaaccauuuuccuacaugauagaacugccuuacuagauuucuauuuguagcucucauucauuguuuuuuaucuuaguuugcagaaagguguugaaaugcuucucuagcccaaacagcgacaugcuaaaguccccuucuucagagucaauagaguaguuguuaaagguuuuaaauuguacuuucuccaaaauuagcaugcagcuauuuaauagggaaucuagauuucaccaagauucaaaucaaagcaacauuuaaaggaauaagaccuguucacuagcauuuucaaggggguucuaaagcauucaagugcuuaaaagccauaaaaaaugacuucuuaauuccugccuuuagugucaacuuuuaaguuaauacagguuucaauuguggcauuaggaaaaaaaaaaaccuugugaugcuaugguuggggguaguuagggagagacuacaugaaauugugugccccuauuuucuuucugauccuaaaucauuuuguuuuauaaaucagcuauagcaucuuucuagaauuaauccugaauauguugaauguuaaaauagagaaguuuguauauacacauaauuaaaaaucaacccuucuggcaagauuucacuuugaaggugucuguuuuuaagggaaggcuaaaacuuugcugauaugugauaaaacuugaacucuaaauugccuccuuagccugaauuuuuacuagcuuucuaguguaacauauucuaaggacaugacaugcugcuuauuuggggggauuauuuuucaccaaaaugaucaucuuguguuguaacuuuucagcucacuuguauauacgcacguuuucauuuuuggucuagaaaauagugcauuuuggggcucagcgugcagaggaaauuccucaaagugccaaauuaggcagucaggaaauacuaaauucuucauuccaaauaauggaucugaaugaugacguuaauuuuuuaucaugcauuaacaaaauaaaauaugagaauuguaccaca

SEQ ID NO: 192546 - RNA, 177258 nt, Homo sapiens
ugugguacaauucucauauuuuauuuuguuaaugcaugauaaaaaauuaacgucaucauucagauccauuauuuggaaugaagaauuuaguauuuccugacugccuaauuuggcacuuugaggaauuuccucugcacgcugagccccaaaaugcacuauuuucuagaccaaaaaugaaaacgugcguauauacaagugagcugaaaaguuacaacacaagaugaucauuuuggugaaaaauaauccccccaaauaagcagcaugucauguccuuagaauauguuacacuagaaagcuaguaaaaauucaggcuaaggaggcaauuuagaguucaaguuuuaucacauaucagcaaaguuuuagccuucccuuaaaaacagacaccuucaaagugaaaucuugccagaaggguugauuuuuaauuauguguauauacaaacuucucuauuuuaacauucaacauauucaggauuaauucuagaaagaugcuauagcugauuuauaaaacaaaaugauuuaggaucagaaagaaaauaggggcacacaauuucauguagucucucccuaacuacccccaaccauagcaucacaagguuuuuuuuuuuccuaaugccacaauugaaaccuguauuaacuuaaaaguugacacuaaaggcaggaauuaagaagucauuuuuuauggcuuuuaagcacuugaaugcuuuagaacccccuugaaaaugcuagugaacaggucuuauuccuuuaaauguugcuuugauuugaaucuuggugaaaucuagauucccuauuaaauagcugcaugcuaauuuuggagaaaguacaauuuaaaaccuuuaacaacuacucuauugacucugaagaaggggacuuuagcaugucgcuguuugggcuagagaagcauuucaacaccuuucugcaaacuaagauaaaaaacaaugaaugagagcuacaaauagaaaucuaguaaggcaguucuaucauguaggaaaaugguuucccaaauguuuucuacacugacauuuuuuaaaaaagauaugauacccgguucuuccacauucaguguauaaaacucaacuuuagacauguaugugcggagaagacucguauguccaaaaccauccauuugcauggcaaucuugucuuugcauugcuuugugucauucuggcuucccucacccacaggccacuggagggcugggaggcccaggagcucagcacucuaacuccuccaugacuuccaugacaaucguccgugggcccgucagaaucagauugcucacgguccgguagucuacaugcaggacauugagcccguugacagagacgacaaacugacagaccuaaaggaaagaugcaaagaaagagcaucuauuauagcgccugguuuugcacaaagcuuuaauaaagacaguguguagcccuaacagguaacuucauucuuaaaauauccaaauguauccagcugacgacuccaauucaauaauuuccaaggagcuacacauuuucuggaaggcaguauaauuuaaaaaaaaaaaaaucguuuuaguguuuuacaaaauuuggcuuaaauccuaacucagagacauacuagcuuuagcuaguauuuaaauacuagcuagguauuuaaauuucugagcuuuauuucccucaacccuaaaauaagaauuaauaauaauaauaagaguaauaccuaccuuauaagacuguuguaagaauuaaugacauauauaguuucuacuugcaguaauucacaggcaugcuugcucccaauuauuaauuauuaguguugaggacucaaccaaagaauguaaaaaauaccaaaacaccuugggaaccaucauuuccuuuuauuguuuucuguguggguaauaucgauguaaacuuaaacaugauauuaaguccaaaaauaucuauacuuauuacuuagauacaacaaaauuggagaguacugggaagaguauuggaaagcucugucacuguggaaaagaugaggggacuuagaaucaaagauacagauuuaaguuauaggucccuuugguggaauacauuaaucaaguaauuucuccucuucuauguuucaacgauauaaaugccucacuuguacaacagguaaaaacgccuauucucacaggcucacacuagauagugcauuugaaaccucuuugcaaacaccaagcacuacaccgaugcugaguacuauuaaucucuuuccuuucaaaaaauacccacuucuuucacggucacaggcaaaacaaaauggaaagcgggcaguaguacacagacugcuuauuuacucaauaaacacucgcuguugucauaaaccuugauacuuugcacuccccaaccuacuaggguguuuucuccacauaagaucacacuauuacuguuucucuuuucuugguuccacaaauuugucuucauggauucaggguacaucuuauacaaaaucagcaguuuucaaccaugguggaggucacagucauaaucaaggucacacaaacaggucacaaucuauccugaacuaggccacaguaauuugcaagacaauuuagcaguaauuugcaauuuagcaggcaucagccugggcuuuguuuuuuucugcugcagcagacucaugagccaaagaaugagaagaauuucaccuccuucccaacccagagcuuuagacccuagacuuggaaauuucaaaucccuugucuuuuccacagauacagggguuucuuuuuccaaaaagaugaauagccuuuuugcacugccaaauaagagggcaggaguugccaggugagugcccucuccagcugacccuucgcaggcucccugagauuagccaugucuccgcaucgcucagggaucacauuucaccauuuacuuuuuuuuuuuuuugacauggagucucccucuguugcccaggcuggagugcuguggcacgaucuccuccaucucccaggcucaagcgauccucccaccucagccucccgaguagcugggauuacaggugugugccaccaugcccagcuaauuuuuuguauuuuugguagagaggggguucgccauguuggccagucuggucuugaacucuugaccuccggugauccucccaccuuggccucccaaagugcugggauuauaggugugagccaccacacuuggccucagcauuuagucuuaaccacaauuguguguccucugucacacaucauguuuguuuuaauugaccagcauuuaaaauuuagaaaaucugccaggcacaguagcucaugccuguaaucccagcacuuugggaggccgaggcagguggaucacuugagguggaucagccuggcggguggaucagccuggucaacauggugaaaccccgucucuacuaaaaauacaaaaaaauuagcugggcgugguggcggaugccuguaaucccagcuacuuggaaagcugaggcagaagaaucacuugaacccgggagguggagguuguagugagccgagaucacaccauugcacuccagccugggcaacaacagugaaacuccauuucaaaaaauaaaaguaaaaaauaaaauaaaauuuggaaaaucuuugcauaaaaauccagacucugggcugggugcaguggcucacaucuguaaucccagcacuuugggaggccgaagcgggcagaucaccugaggccagaaguucaagaccagccuggccaacauggugaaaccccaucucuacuaaaaauacaaaaauuagccagguguaguggcacaccuguaaucccagcuacucaggagccuggggcaggagaauugcuugaaccugggaggcagagguugcagugggccgagauucugccacugcacucuagccugggcaacaaagcaagacucugucucaaaauaaauaaauaaauaaaaacccagacucuggcuucucugggacaaucagaagcugugaucauaccagguguagauggccauguggccauggcugaguagagccugccuguucuacacauggcauggacacucauuugccacaguccuuacggcuuccuaucuuccuaacaccuggcugacaggcaugugaguuuguggucccugaucuauggccaccagagggaaaagcguugaagacaggguggcuugaagcuucaagaacugaaggaccccaauguuugucaacagaugaaaggagguugggcgugguggcacaugccuguaauccuaacacuuugggaggcugaggcagaaggauugcuugagccagccuggacaacauagugagacuccgucucuacaaaauauauauaucuauauauuuaaaaaauuuaaaaagacagaugaaaggagaaauauaauucaguauauccauacaguggaauauuauucggccauaaaauggaacauacaacaugcuacaacaugggugagcccugaaaacauuaugcuaaguaaaagaugccagucagaauagaccauagaguguaagagcccauuuauaugaaauguccagaguaggcaaauccacagagacagcaaguagauuauugauuacuuaggguugggagcagggguggugggguggggcauggaagugguugguaauggguacgggguuucuuuuaggggugauaaaaaugcucuaaaauuguuguaauagugacauaaaucugugaauauauuaaaaacuacugaauucuacaguuuacauggauaaauugcaugguaugugaacuauaucuccauaaagcucuuaguuaaguaaugaaacaaaacaaaacaauaaacauugaagggaagagggcccugaugcuaacaguggguagauucuuggucuacaaggaucucccuucugucuagaagggagaggcugguuugguucaagaugggguccugugcaccucuugauugcagagcucuuggaggccucagaagcuaggauggucaaggcuguaugugugggaggaugagcaccuggugaacucugcacaggaccuuuacccagguguucagggguaggaaaagggcagucagcagggcugucuggccaagggccaguggcaccagucacuaauacuggucaggguucauuuuacuggacugccuaaaagcccugggaugggggcugugguggguuauggugcacaugaucucaaacgggaaggacauaggcaagggacaccaaaaugaucugacauugaacuugucaucaaccuuggugauggucacuucaacugaauuuaauuuuagaaaaacaggccgggcacgugcaguggcucacgucugcaauccuagcacuuugggaggccaaggcaggcggaucacucgagcucaggaguucaaguccagccuaggcaacauggcgaaacucuguuucuacaaaaauaaaaauaaaaaauuagccaggugugguggcacacgccaguagucccagcuacuugggggacugaggcaagaguaucgcuucaacccaggcgguugaagcugcagugaaccaagaucaugccacugcauuccagccugagugacaaagugagauccugccuaaaaaacauaaaagauaaaaaauaaaaaaauuagaaaaacagaaaaaggucauuucuuguuuuuguuuucuaaguguaugcacacacacauuucucaaaugccaaaguuugugacuaauucacucuuucauaaaguaaggcugauucagggcuacccuaggcauaaagacagucucacucccuugcguucccacaugcuguccagagcagccagucaagaguggggucagagcaagcacaccgugaacugcucauuucacacaaaccuucuuacuugugcugccaccugagcacaucucuagggguauagaggaucaggugaagacccucugucacagguguucuggagaaaaagcccaugacaucuuguaccaacuaguguguggagaacuuaaauaagauuuauuagguaggugcaaaagcaauugugguuuugcaacuuuuaauugcaaaaacugcaguuacuuuugcaccaaccuaauaaauaccagcaucuuugccuucacgaagcuuacaauuuaguuuaggaggcagaguaucacaggcaggauccuuuucaaaauagcaggcaaccucucaaucaauucagucauauauugaaaaaccuaguauuucucaagugccaauccaaguacuuuacacacuuaauaaaaauuguccuaaaagucauauggugacacaucuguugguuuuugguuauccagcuucauuucacuacaguugacuugauauucuuuucagguaucaccuuuccucugcugugggcaguauggauaggaaugucaaccaacaugcccugcccucccccuauucacagggucaucugacccuaagcuuggccagucagacucugucuccuggaccacugacuguggagcugaguaacacaggaaaguucauuugcucugguauuuggguccccagaucugccuugguuccuguccuuuaucaagcuugguucuccaggcuaggcacgguggcucaugccuguaaucccagcacuuugggaagccaaggcugguagaucaccugaggucaggaguucgagaccagccugaccaacauggugaaacccugucucuauuaaauacgaaacauuagcugggcaugguggugcaugccuguaauuccagauacuugcgaggcugaggcaggagaaucacuugaaccugggagguggagguugcaacaagagcaaaacccccaucucaaaaaaauaaauaaauaaauaaaaauaaaaagcuugguucucuggaucugccuuuguuuuacauacuuaauaucuuucuaaucaauuucuuuuuucuuuuuuuuuuuuguuaggcuagcugauuucugucacuggcaacccaccauccccaaugcaaucucuuuuuuuaagacagagucucgcgcugucccucaggcaagagugcaguggcaggauuuuggcucacugcaacuuccuacacccggguucaaacaauucucaugccucagccucccaaguagcugggauuacaggcacacaccaccacgcccagcuaauuuuuguauuuuuaguagagacgggguuucaccauguuggcgaggcuggucuugaacuccugaccucaggugauccacccaccucagccucccaaagugcuggaauugcaggcaugagcuaccaugccuggcccccagugcaaucuuuauaaacaagcuaaaugucagagaggauaaauuauuugcucaaguucacacaacuaagugcugcaucuggaaucugaccuccaggauacucuacaggccuacauaagaacaaauuuauaaaguaaaauauguauaugcaaguucucaggcaugcacagaauaguggaugacaaacguuucuucucuuuaacuguuaaacagucccuagggccacucaaauaucuuacgguguugauguuuagcuucuuucagcuucuuaagaagguuuuuauucaauuaagguuuuggguuucuuuuugugucacuaaaaacucugaauaauauguaaacuuagauacuuauuucaaacuuuuuccuugaauaaggcaaaaaauaaugccuucaaaacauuuaucauguuaauauucaagguaguaauuuuagauuuaggcuauuagggccagucacgguggcucaugccuguaaacccagcacuuugaaaggcugaggcaggcagaucacuugaggucaugaguuugagaccaugggugauggguguaccaaaaucucacaaaucaccacuaaagaacuuacuuauguaaccaaacaccaccugcuccccaauuaccuauauaaauaaaaaauuuuaaaaaaaaagaagaguucuagaccagccuggccaacauggugaaacccagucuccacuaaaaauacaaaaauuagccaggcauggugguacauaccuguaaucccagcuacucgggaggcugaggcaggagaaucacuuggaaccugggaggcagagguugcagugagccaagauugcacuacugcacuccagccugagcaacagagugacacucugccucgauaaaauaaaauaaauuuuaaaauuaaaaaaauaaaaauaaaaaaauacgcugggcacagugcucacaccuguaaucccagcacuuugggaggccaaggcagguggaucaucugaggucaggaguucgagaccagcuugacccaacauggugagacccugucucuacuaaaaaugcgaaaauuagccaggcaucguggugcaugccuguaaucccagcuacuugggaggcugaggcaggagaauugcuugaaccugggaggcggaaguugcaaugagccgagauagugccauugcacuacagccugggcaacaagagcaaaacucggucucaaaaauaaaaaauaaaauaaaaauagauuuaggcuguuagaaaagacgucaucugucccuaaguggucugaacaacugcugugguuccagcaauuccaauguccuguuaguaaaaauguacaaaaugaucuagaaauguagguauuacuauguaacauauucaguuauaaugaauuuucauuuaacaucuaugguacacuauguguugcaaaucaacacacauuaugaguaaccacaggaagcacucagccugggggaaauuauuucuccucuguauucaaaagcacacaggcacaaacacacagaacgcgugacuaccucugaauggcgggcggccaccuuaggaacuuauuaccuucuacuugagguggggugacuuagaugccacccacuggugguaacaagaguucaaguaagguugcaauacuuuuuuuuuuuuuuccuuauaauuaucuuuaucggaucuguuuccaaagaugggauugcauuucccuaguucuuggaaaagggaucaaucaugagcucauauaacugcucuguaacucaucucccacaaagagguaguaccuucaccuucaaaugaagggauaaggagcaaauucuugaaugaaaaggaagaacaaaacuuucacaaguaauaugaagccuagguaaguaaugucuccaagcaagugggcacuggaggaaaguucuaagaaccgcugggugcaguggcucacgccuguaaucccagcacuuugggaggcgagguggguggaucaccugagaucaugaguucaagaccagccuggccaacauggugaaaccccgucucuaccaaaaauacaaaaaucagcugggcgugguggugcaugccuguaaucccagcuacucucgaggcugaggcccaagaauugcuugaacccaagaggcagagguuguagugagcugagauggcgccacugcacuccagccuggguaacagagugagacccuauuugaagaauuuaaaaaaaaguuauaagaaccuaaguuagccucguaagaguuaacaggaagcaggaggcaggacucagcacauuucagggugugaucaggcugggauaaauaccuaggcugaacuccagccuuccuccugauaggaagccaaacuuacuaaauaaucuugccuacaauuccucucccugcgccaguccuggcagauguacgauaauccucuggauagacugagugcccaugggauuguucaauugcacauuuguucuuauaggcuggcgucccaucacaaugauucaauuguuucauccaaagugggagugaaguuggggagaaacacuacaccuaugauuacauaauugucuucucacugucauggaagucuguauucaccaagaaauuugcaucccagaaauuguugcauucaugucaauaccuucuuguuuuuuucuuucugaucuugaaggagaaugaaggauugaaggggaaggcugcuucugacuaucccugaaaauaacauaaaacauuuaacaauacagagaaagacucagacagaaaagaaugauaagauacacacaaauagauguggaaaaugaccagggagagcugagaucugcuuaguagaguaggaaaggcugcccgauuaaaugauacagaaagcagaacaagauguuaaguagcaagccauuacuaaaaucuuaaucaaguagagcacucauuuguguucuagagaucauccugauccaacucccauaaaaaguggaauucuuuccuacacgucccuacuagguauccagcccaucucucuagaauacuuacguuaggaaaugcaccacuuaaugaggaagacuuuuggaguccaguugcauauuagaaguucuagcuaugcauuuuugguuaacauuugggccauuuuucacugcgcaauugcucaagugaaaaagcacaaccaaauacaaaaaaaguggcucucaaaccauaguguaaauaugagucaccuuugggaucccauucuaaguaugacuucucagaucuuauccaagaccuaccaaaucugccucccagguucacaccauucugccucagccucccgaguagcugggacuacaggcgcccaccaccacgcccggcuaauuuuuuguauuuuuaguagagaugggguuucaccacguuagccaggauggucuugaucucccgaccucgagaucugcccgccucggccucccaaagugcugggauuacaggcgugagccaccaagcucagcccugcuaggauuuuuuucuaccaaaaguuaguuuaaaugcucaucccauaccuguuaguauuauaagagagcauucuuucaccaugagcauuaacugccucaugcaagaagaaggcugauguuuuaguuauuaaaauuauuacuugccuaaaggucgggcaugguggcucaugccuguaauaccagaacuuugggaggccgaggcaggcgcaucacuuggagucaggaguucgagaccagccuggccaacauggugaaaccccaucucuacuaagaauacaaaaauuagccaggcgugguggcaugugccuguagucccagcuacuugggaggcugaggcacgagaauugcuugaaccgagaggcagagacugcagugaggcgaguuugugccauugcacuccagccugagcaacagagcgagacucugucucaaaaaacaaaaaacaaauaaaaaacaauaaaaguauuacuugaugaaagucuguuucauuuuuagagccaaauuuugcuauucuuuaaacuucaaaacuaauaauaauaaugauggacaaaaaugacuaaguuuagaaccauuaucggagauaauaaucaggcuccugagaauaaggacucaggcuuuuuggcagccaaaauaucaaaaagaaaaaggcugagacugaagcagagcaacaaaaaucaugaguagauuaagaaauauuugaaagccguugaaauuuagauuuuugaaagaaaaauuauuuugauuauuccuauuucuuuaaacuuugcuccaaaucacacaucuggcuuucauaacaugauaucagauugugaaagcaaugucauacacauuuagauaaagcacuaucuucuuauaauuuguuauuucuccucucuguccuauaccugaggaagccuagccauuggguccauccaugucuucgucuguuugggcugcuacaacaaacaucaaauaccauaaacugaguggcuuauaaacaauaaauaguuacuucucccauuucuggaucuugguuaaguccaagaucaaggugcuggcaggugucuggugagggcugccucuuuguagauggcaccuucuauguccucacaugguagaaggggcaaggaaucucuuuccagccacuuucauaagggcacuaaucccauucaugagggcucugacccagugaccuaaucauuucccaaaggcccugccuucuaauaccugaucgcuuugagaguuaggauuuuagcauaugaauuuggaggggguguaaacauucggaccauaguaguucauauccccagacuacuucuuaggucacaacuugccagucagcaugggcagugcuauaauagcuaauaagaacaucuaacaauuuuccaaaacucuuuacauguguaauuucauuaaaaauucccaacgcagguccuauuauuuuuauuuccaucucacgauugaggggguagauucagaaaguaaaguaauuggcccaaguucacagagcuaguaaguggugaaaccaggaucugacucgaaacuuguacacuuaagaccucggcuacucugcccccugagcaguggauaaucagcuucccccaaauaggcacagauaccacauagaugagcauccuagccuggugucuaagcaccucuuuucuuuucuucuuauuuauuauuuguuuauuuauuucuuuuuucuuuuuuuuuuuuuuuuugagauagggucucacuuugucacacagguuggagugcaguggugugaucuuggcucacugaaaccucugccucccaaguucaagcuauauccucccaccucagccuccugaguagcugggaccacaggugugugcauucaugccaagcuaaguuuuguagagacaggauuuugccauguugcccaggcugcucuugaacucuugagcucaggcgauccaccugccuuggccucccaaagugcugggauuacaggccugagccuuugugccaggcuauagugaauuucuuuuuuuacuuucuucuucuucuuuuuuuuuuuuuuugagacagacucucgcucugucacccaggcuggagugcaguggcacaaucucagcucacugcaaccucuacuuccuggguucaagcaauucucgugccucagccucccuaguagcugggacuacaggugugcaccaccacaucuggcuaauuuuuuuguguuuuaguagagacagggguugcaucauguugcccaggcuggucucgaacuccuggccucaagcgauccacccgccuuggccucccaaagugcuaggauuauagaugugagccaccgggcccagcagaauuucuuaagaacacugcauuugacuuuuccuuccaucaugccuaaaaauggaauaaugcucacuugauaaucaucauuaucaccaccauugccaacaccauugccaucaucuuuauagauggaagaaaacgauggggaaugugacaggggcauuuucacucuuuuaacaauaaccuggacucaucucuacaccugggccauaucuggcaggggcauauagcgucuuaucuucagccagaguucaaauaacaaauaaccauguuuauuacaaccuagaggagaaggaggaaguucucucccccuguuggcagccccauucuucugcuagagugacauuaggacguaauaauaaggugaagauuagugucuccuggaugaagaguuuaaagauuccagguggaacgauaacacaugaauauuaaguguauaauuacccacggugacaaugcuucagccagcaagcuccccccacacaccauuugucacagugacugauggcaucaccuaaucucugccuuuaacugacauuaccaauuccacucacauuccuagcaguucacuuuguaauaacuggagauguguauaaauaauuuguacauuuucuauauaguucaauaaaaaauugcuuuaacucccaccuuuacaauuuauuaguuguaugacuuugggcaaguuagaaauucucugaguuauaauuuacucaucuguaaaauggggaucaaguuuauuaugaggaucaacucuaauuaaguacuaaucccaguguuuacuaccacugaauguuaaauaaauauugguuuuccucuuccauccuuccccaugcacaaucccuguuccccaaaauggccaagaugauacaaauuguugaaaggcagacaaaccauugcauggguccauacccagaaaagccuguugggauucugucuuugaaauggcaauagguguuaagugaugauguuauucauucagaucacaaaggaaaaauuaaaauaaaaacaaaaaccaacacaagguaugagagagaauuugcuucaaucuaagagaaccucccaaggacagagaauccagaagcuacuauaaacaaucagcauacuuuuaaaggaaacagagcagucaaauuccguuaaggaauuucugaucuugaccauaagguaaccaaguugcuuuagaacugaaacagcuguacaguguaacuagacuccuggaugguccuucaccaaaauauuagacagagauguaaacugagucaagauuggcuuguaucuaggaauuccuuacaucuucagaauguuucauauucaugaaaacacucacauucagcaaggacacuacuuaggaguuuuggauacugcuguaguaaauaaguuauguguuugugucuagugcacacagaccugacagcaggacacuguuccuggaagaaaaaaaaaguagaagaaaagaaaacuugcagcuguauguucagccccauaaaucucucugcaaguaugcaacuggcuguggagugacugugugggaggaggcagggauccaguucuuggacaaacacagaauucucuccagagaacuagucuuccucuaagcuuuaugcauuuuaagcaugcuauagggcuaugcggugcccccaaagaacagacugugcaauugaccuugaaagaaagccaaccauauauaagaaugacuaacuuucacaauaagacaacaacaauaaguagcauuaaagcauuuuuguuucaaauugagaaguuuguaaugccugcuggucucauacagaaucugcccccuuucagccccaaucaaucaaagcucuguuuaagaucuaggcucccucuugguacgcucugcucagcaaaugggucaaucacagggugauugugguguacauaaaagagggguaguuauggggaacccugguucaguccauacauacuggauucccaaaguuagggcaaaaacuugccuuccugggaauucucucuagaggcauagaucaggcugaagggagaauuugugaccgacacugaugucaccuucccaucggcagcucaugacagcucuagaaacaauuccaagggcugcuugcauuaaggacagacagcauucucucuaucuggugguuucugaacguuauaagaaguguucaguugcauggccaggcccaguggcucaugccuguaaucccagcacuuugggaggccgaggcagguggaucaccugagaucaggaguucgaaaccagccuggccaacguggcgaaaccccaucucuacuaaaaauagaaaaauuagcuggacaugauagugggcaccuguuaucucagcuacuugggaggcugaggcaugagaaucacuugaacccgggaggcggagguugcagugaaccaagauugcaccacugcacuccaguugcugaaaagaaggcaaaauuuacacacuauaaccacaagauucuguggacucccuccuuuaccacugaaggaaagguaucuaucaccuaagaacaaauucucacucuuacauucccacacccccauacaaaauuugcuuuuacuguggauauaggaaguucuuuagaauacccuguaauuuugagugggaugggaaggagggguuccaacagcaagagacacauucuuuucuuucuuucuuucuuucuuuuuuuucugggcagggucucacucugucucacaggcuggaguguaguggugccaucuccgcucacugcaaccucugccucccaaguucaagcgauccucccaccucagccuccugaguagcugggacuacacgcaugcaccaccauggcuggcuaauuuuuuuguauuuuuuguagagacaggguuuugccauguugcccaggcuagucucaaauuccuggauucaagugaucugccugccucggccucccaaagugcuagaauuccaggcaugagccacugugccuggccaagagacacagagucuuaacacauguaucacucccacacaagcuuauagcaaagaggaaauagauuccacaaggacaaacuuccucccugaucucaaauuuuuuccuccguaagaaucuuuugcccaauuaucuguuuggcuuuaauaaauguuuaucaauaacuauuuaacacccagaaauuauuuuucuuuuuuccggauuaugccaaaaaggcaaaauuaacauaacaaagguuuuaaaagauuaaguacuaaacaagaugcaguauuaaaguuacuaaucauagccaggcacagugacucaugccuguaaucccagcacuuugggaggcugagguggguggaucacuugaggucgggaguucaagaccagccuggccaacauggagaaaccccauuucuacuaaaaauacaaaacaauuagccaggcgugguggcuggcgccuguaaucccagcuacuugggaggcugaggaaggagaauugcuugaacccgggagguggagauugcagugagcugagauugcgccacugcacuccagccugggcagcagagcaagacuccaucucaaaaaaaaaaaaaaaaaaaaaagaaaaaggaaaaaaaagaaaaaaaaaguuacugauuuaggauguguuggugacauuaucuaaccuguaagggugagucaacauauccgauucuccuuauucuuccuccaagguggcacugcucugaucucagcuacgaauacaauguguguguguguguguguguguguguguguguguacaugcuuugcagagacacacaguuauaccacuaucuuguucguaguguuuuggugggaaaaguaagaggauuauaaauaggacugagcauggagcaaccucuuuuugggugugaugagaucgggacuaagcaaccuucaacauccuuugcuggaugcccccaggggagagagccaaguagcugguuucugcuccagagccccuuugucucacucugucacccagacuggagugcaauagugugaccucggcucacugcagccuccaccuccugaguucaaacaagucuccugcuucagcccccgguggagcugggauuacaggcgugagucacccgccccuucauuugucuaccaguacauagccauauucaggaccaagcaaguugugggacagggauugggguugccaaucaagcuacucaggacugacucaguucaagaagucacucuaaaggcuuaagagagugcuccauacugacuuggcuaaagauugggaguaaauccuugccuggcaauuaaaacguggauguggaccagugagucaucugugucuugucaucuuuaggagccuagcacaccagucagagaaaucuauggauuuggagauugagaucccuccaaaucuucguuccuagagaacaucuaaccucuggcagagugaaaaacauuuugccaauaucagccugauggaaagcugaggaucagaaaagucagguaauaucacacauuugaagggugcugugauauaaugaaaagaccaagggcucuggagccagacagaccugggcuagcuuggcuucuggcucugccauguaguuacacaacaagaggcugugacucaaacucuuucggccucaacuauaaaauauagcucacagcuagacacaguugcucacaccuguaaucccagcacuuugggaggcagagguggguggaacaccugagguuaggaguucgaggccagccugaccaauagggcgaaacccugucucuacuaaaaauacaaaauuagcugagcgugguagugcaugccugugaucccaacuccauggaaggcugaggcaggagaauugcuugaacccgggaggcagagguugcaguaaguugaaaucacaucauugcacuccagccugggcaacaagagugaaauuuugucucaaaaaaaaaaaaaaaaaaaaaaagaauuccauauccaguagcauguauuagguaugauacucaccaaaagcucucuagcccccuuaucagcccauccucacuucucuuuuacuggaugacucucacauucauucuccccauuccuggcucacacuugcaccaagcacauuuucuggaccaguuaugaggaagaacaugaaucaaauaagaagguggagcuuuuuggugucaacuuggccaaaacagagcuacauuuuucagauucccuuuccugcacaguuccagauucaaguuggccagaaagaauuuuccauaauaccuggaagguggaagugaagcagccaccauggcuguucacucguggcuguuaugguuaaauguagugagagguagacgcagaggugcugaaggauuucagcucggcuuugcccuccauugcuccacaugcaguucugcuccccagcugauggcccuacugaccaacaguggacucaaggcccccaccagccaacaaggucacagccuucaucaccagcuucacuuguggucccacucgggaaccuucaggaaugaaaguuaguguuggcugggugugguaacucacgccuguaaucccagcacuuugggaggcagaggcagacagaucauuugaggucaggaguuugagaccagccuggccaauguggugaaaccucaucucuacuaaaaauacaaaaaauuaacugggaauggugucaggcaccuuuuaagcccagcuacucgggaggcugaggcagaggaauugcuugaaccuaggaggcggagguugcagugagccaagaucgugccacugcucuccaaccugggugacagagcaagacuuugucucaaaaaaaaaaaaaaaaaaaaaaaaagaaaguuagugucauauuagaaugaaguuuuggaaaguauaaguaacugaagugcuuccugagggcucagggaauauggaauaaauauuagaaaaggaaguuauuaauacagaggcuagaugcugauggguuacaaccuguucucugaagugagagguaaaggcggaagugcuguuaguuuccaaguuguucucacucucccgcacucuguguccagcucuucaucccaacugccagcccugcuaacagggagaagccucagcucaccaccagguccuuuccuuuucccagacugguaaaaaaggacucaucccucagacuugagacagaggaugaaagagccagaacucaagucacagcagugggaauugaaaggaggcauaaaaaauggaagcuccccagguuugagcagggaggcugaggagacaagagagcucccaguaucaaggcugccuaauuugaagaaaaauguuggcaaugauggaaaugggggaggggauuaacaggagaaggaaguuuaaggcaaagaugaguagagacuuagaggcaucacuguguugaugagaugugcuggcacugaugucugggaugggauggaauaugggcaggagcucugaggaagcauggggugcagucagcuuugggaggugauggauaaaauggaagggaugggcaugaaauccuuacagcacgauggagcacauaaguaaaugcaaauaugcauuuuauuauuauuauuauuauuuugagacagagucuuacucugucacccaggcuggagugcaguggcgcaaucuugggucacugcaaccuccaccuccaggauucaagcaauucuccugucucagcuucucaaguagcugggauuacaggugcacaccaccacacuuggcuaauuuuugaauuuuuaguagagacgguuucaccauguugccuaggcuggucuugaacuccugaccucaggugauccacccaccuuggccucccaaagugcugggauuacaggcaugagccacugugccuggcuuuuaaaaauaauuuuuuguagagauggggucucacuauguugcccagguuggucugaaacuccugaggcucaggugauccucccaccuugggcccccaaaguacugggauuacaggcaugagucacugugccucacuaguauuuuuaaaguaaacuuuauuuuuuaagauaguuuuagguucauagcaaaauugagaggaagcuauaggacuuuccauacgccuccugccccacauaggcacgguaucccccauuaucaacacccccuaccugagugguacauuuguuacaacugaugaaccuggagguugcagugagcuuaggucaagccacugcacucuagccugggugacagagcgagacccugucucaacaacaaagaaauugaugaggcugggcauggcggcuuacaccgguaaucccagcacaaggcgagugcauuacuugaggucaggaguuagagaucagccuggcccacauggugaaaucccaucucuacuaaaaauacaaaaauuagcugggugugguggcaguccucuaauccuagcuacuggggagucugaggcaugagaauugcuugaaacaaggaggcggagguugcagugaaccaagaucacaccacugcacuccagccuaggcaacacagugagacuccagcuaaaaaaaaaaaaaaaaaaaaaaaaaaaacugaugaaccuacacaauacaucauuaucacccagagucuaugguuuacacuggggucacucuuagugucgcacaugcuauggcucugguuaaauguauaaugaccgguacccaccauuauaguaucagacagaguagugccccugcccuaaacauucaaacagguacuuuuuuuaguaauuucuuuuaauacauauccuauuuccacaauaucagaaauaacggaagaggaaggacauuugacuccugcaggauuggagacacuaaagucuguucuccgcagauacaucacagcccaggauuccagcuuacacagaugaggguccgccauaguauuuggccuccccuggcuuggccaaggcaggggacacccaugcacccccaggcuuacgaggauaugguuugugccugguccugauuacucuggcucuaaaaagugaaacuugaucucauuaacccagcuguggguacaugcaggcagucacuccacccagagcacagggcaguuaaggccccagcgaucagcaauuacacagcuggccacaucuggccaugauaaagacagcuuucuccucagagaugcagagggccucucugggccucccuuaugcagauagcuggcauucugcacucucuccaucccaagaguaaggcccauuuaauacccugcucugugaacuuuucaccagucagcacaaacuccugccaaaacggacuggauaugggucuagguauuauggagagggguggggagaaguaaacauuuucuuuucagcagaaaaaaauccauauuuuaaaacuuggcugggugcgguggcucacgccuguaaucccagcacuuugggaggccgagguggguggaucaccuggggucaagaauucaagaccagccugaccaauauggugaaacccugucucuacuaaaaacacaaaaauuagccaggcaugguggugugcaccuauagucccagcuauuucgguggcugagacaggagaaucacuugaaccaaggagauagagguugcagugagccgagaucaugccacuguacuccagccugggugacagagugagacuccgucucaauaaauaaauaaauaaauaaauaaaauaaaacucaagacucaaagcauauuugaauuaauaagauauugcccuccuugaaccuuccucaggauaguaugaaggauauuuuccuauucuuuaaaaaaauguccguugcccaaagagaacaguaggggcuuucuaggauacaagaccaaagccauucauggguaccuucacuagguaugguacaugaaacaagagcuauguuuuacauuggcaguuagacgggccagguguccugcaugucauauggcacaaguaugacaauucaaaguaaccaagaugagugcaugagcaauauugauuuuuuuuuuuuuuagauggaguuuugcucuuguugcccaggcuggagugcaauggcgcgaucucagcucacuacaaccucugccucccagguucaagcgauuuuccuauuucagccucccaaguaggcacaugccaucacgucuggcuaguuuuuguauuuuuaguagagaugggguuucaccauauuggucaggcuggucucgaacuccugaccucaggugauccuccugccucggccucccaaaaugcugggauuacaggcaggagccacugugcccggcugcaauacuuaauuuuaaaaaacuguuuuuagauuuggaggggcugggcauggugguucaugccuauaauccuagcacuuugggaggccgagguggguggaucacuugaggucaggaguucgaaaccagccuggccaacauggugaaacccaucucuauuaaaaacacacaaaaaaugagcugggugugguggcaggcgccuguaaucccugcuacuugggaggcugaggcaggagaauugcuugauucacuggaagggggagguugcagugagccgagaucgugccuugcacuccagccugggugacagagagagacuccgucucaggaaaaaaaaaaaaaaaaaaaaaagauuuggagcuguuucuuugcuugguuugcuccaagaaaauuuuuacaucaaguggagcuaauaaauucccaaauguguguguaaaugauacugugcaaagaaauacugcaaugucaaaaguacaucauuuaggccaggcguaguggcucaugucuguaaucccagcuacuugggagggugaggcaggagaaucgcuugaaccugggagguggagguugcagugagccaagaucaagccacugcaugccagccugggugacagagcaagacuccaucuccaggaaaaaaaagaaaaaaaaaguacaucaucuaaaugccuucacaauauauuucauaaacaaacuguggaacaccaccuuccguuugaauuugaggcaugaaaaucaaugcagcccuuuauccaacaacaugaccggauuacgcagcaucauauccaucuuuaagaggucugagccaguaggcugucucuaagcuccacuuuaaaauugccugggaguuuccaaaccgugcugaugucugagccuuaccccagaccaacugagucuguaucuuuggguauuuucuaggaguuucccaggugauucugacauguaguaaaaguugagaaaaucuagucugggcauucacucaaggaucucuguguucuuguuuaugcuuguuuuaaauaagaggauucuauuccagcccaguaccugaaaauggaauucauggcaugagacaguuagaauuuacucuuuuuuuuuuuugagcuggagucucacucccauugcgcaggcuggagugcaguggugcaaucucggcucacugcaaccuccaccucccggguuccagugauucuccuuccucagccucccaaguagcugggauuacaggcaugcaccaccacacccagcuaauuuuuguauuuuuaguagagaugagguuucaccauguuggccaggcuggucucaaacuccugaccucaggugauccacccgccucucccucccaaaaugccaggauuacaggugugaaccacugagcccggccuagaauuuacucuuaacuugguccugaacaaccucuuugggucuccaucaucuuacaugugaaacugaguuggugguacuuacucaccucuauuucagaaaguugggaaaauacaaugagaaaugugacauccucugacaaauguuuuacaaaagaaaggcauuauuauuauuauuauuauuauuauuuuauuuuuauuuuuuugagauggaguuucacucuucuugcccaggcuggagugcaauggcacaaucucggcucaccgcaaccuccgucucccggguucaagugauucuccugccucagccucccgaguagcugggauuacaggcaugcaucaccacaccccacuaauuuuuuauuucuaauagagaugggguuucuccauguuggccaggcugguguugaacucccgaccucaggugauccacccaccucggucucccaaaguacugggauuauaggcgugagccaccacacccgguaggcauuacuauuauuaagaacaguugaauauaauauaaacuuuaaaaagucuagaucauauuagucucugaaacaacuaugauaguagaaguggaacagaggacagagaagggauggaaaauuuauauuaugagugcccgaugggccaagcccugaagugagucuauuucauacaacuuacuuaacagcauggucaggagugaccagauuccacuuuuguuuaucucaguuggcccuggauaagucauuucaauucugggccuuacuuuccuuaccuauaaaauuaggaugcuuggcggggugcagugacucaugccuguaaucucagcacuuugggaggcugagguggguggaucaccggaggucaggaguucgacaccagccuguccaacauggugaaacccugucucuacuaaaaauacaaaaauuagccaggcauguuaguggauaccuguaaucucagcuacuugggaggcugaggcaggagaaucgcucgaacccaggagguagagguugcaguaagccgagaucacacuauugcacuccagccugggugauaagagcaaaacuccaucucaaaaaaaaaaauuagaauacuugaguucucugccccccuuaaagugaccacgcaacacaauuccaaccaacaagcugugagcagaaaugccaugaaaguuuuccaucugucucaucacacugcuacagcaauccacgaaaucuacuaaaucuacacugcuacagaccaacauggcgaaaccccgucuauauuaaaaacacaaaaaaauagccggacaugguggugcaugccuguaaucccagcuacaugggaggcugaggcaggacagucacuugaacccgggaggcagagguugcagugagcugagaucauaccacugcacuccagccugggcaaccagagugaaacucggucucagaaaaaaaaaaaaaaaucaaaaguccuaagagagaaagcuaccacugguuucaggagcuaaaaagcuauaauggagguaacguaggaggaaggcagaucagguaggaccguuugggccaagguaaggaugcagugggaaaccaaugauggaucucaagcaggaguguggcaucauuuccugauuuccuuugguugcuugguggggaauggaugauaagggugcaagagcagacgaaaggggaccagcuagagccacaguaguacugguaagagaugacugugguuuggauuuugggaaaugaagaaagaugcauucgagaagcauucuggaaguaucuauaaucggagggcaaagagaaaagcaagcaugacuucuagguuucuggccccaguaacuggguggauggcaaugauauuuacugagcuggaagagacuggaggaggaacaggaaugugcaaaacaaagcauucaaucaacugaagcuccauaauuccuguuccaguaaucugacccucugccaaacaaauguuuucccauuuuggcuuuccaucauuucucucucucucacaggcucuccuuggagaaccauaagcuguaacuagaaugccaacaauauuugauuucaucuggcagaaaaaaaaaaugguggguggaauuaagagacucugaagcuaaaggcaaaaugacagacccaacacuugacuuuacagucuucaucacaaaauucugaaaaugagugaaauguccaaauaugccaaaauauguauuugagaauccgucuuuuacccaguaacguuccugccaaaugcacauaucacagucuuuaauuaaacauuacauuuaauuaaaaucuguguggauuaacguagcuuguaauuaaauauuugcaugucauuaauaucugucuugucacuagaucugaagcccccugagggcagggaccucacuggcuuugcucacaacuggauccucaguaccugccacaguguacuauaugugguagguaaucaauaaauacuuguugaaggauguuuguacauuuuuuuccggucaaugacagaaacuauugguuucuccccuguauccaaugcccugaccccuuuucuaauagaacccccauuauuuuucugggcacauggccacugugucuguuuccuaggacuacaguaacaaaguaccaaaaacuggaugguuuuaaaaacagaaauuuuuuuuugucucacauucuggaugcuagaaguaugaaaucaaagguucagcagggcaggccaugcucccucugauggcucuaggggagcauccuuccuugugucuuccagcuuuuggaguuugcccacaaucccuggcacuccuuggcuuauagaugcaccacuccagucacauggacaauuccccuucgcgucuuuacaugaucuuucuucugaguaugucugucccuguggccaauuuccccuucuuagaaggacaucagucauauuggauuaggcccacccuuaugaccucaucuaaacuugacuaccucuguaaggccccuauuuccaaagagagucagauuuugagguacucgggguuaggacuucaacauaucuuuuugggggacaaaauucagccccuaacagccauccagaauaaauucuacauuucccagauucccucacaccuaaguacacccaugugugguuauguccuagcuaaugggauguaaaagaagucaugugugccacuuccagaggugucuuuuauuuuuguuuauuuauucauuuuugagacagagucuugcucugucacccaggauggagugcuguggcgcaaucucggcucacugcaaccuccaccucccagggucaagcgauucuccugccucagucuuccaaguagcugggacuacagguucaugccaccaugcccggcuaaguuuuuguauuuuuaguacagauaggguuuugccauguuggccaggcuagucucaaacuccuaaccucaggugaucugcccaucucagccucccaaagugcugggauuacaggcgugaacaaccaugcccaaugagauguguuuuuuaaaaaaggacagugcccucugcuucccuucuuuccuccuggguggcuagaaugcaaaccuaaucacuacaguucuagcagcugucucagaccuugaaguaaccuugggaauggaagccaagcaaaguaaaaaaaaaaaaacaaaauaggugacugaaaccauggagacacagcucagcccugaacuggcuuccuucuggcuuugacaugaaaacaaaacaaaaaaacaaaaaaauccaaaauacuaaaauacuaaucuuaaucauuguuuuggaggauuuaugacacucauaaaugaagcuaauuguaacugauauauagaaucuuaucuagguaacaucccagcagauauaguaaagacacucucauguuuaucuuuacuucccaagauucuuggguuggucacugcuauggacugugcccucccaccccaaacucagauguugaagucuuaaugcccaaugugacuguauguggaauaagaaaauaauuaggcugggcgugguggccccguaucuacuaaaaauacaaaaauuagcugggcaugguagugcgugccuguaaucccagcuacuugggaggcugaggcaggagaaucacuugaacccgggaagcagaguuugcagugagccaagauugcgccacugcacuccagccugggccacagagugagacugucucaaaaaacaaaaaaaagaaaagaaaagaaaagaaaguaauuaaaguuaaugagguuauaaaggugggacccuauaggauuaguggccuaaugagaaaagaugccaaacagcucacugucucuaucuuccuuguggacacacagugagaaaccggcccucugugagucaggagacaggcccaccucaccaugcuggcuccugacuucagacuuccauucuccagaacugugagcaaauuaaucuguuguuuaagccauccagucugugguuuauuauggcauuccuaacugaccgauacugucauggauaaauucaagaguacaucuuugaaaaaagaugucuaacuuggguuggaucagcuuugaaucucuuccagguacaggucaguugaguguagucccugacuuuacaagugggggcaguuucagcugagugcaguggcucacgccuggaaucccagcacuuugagaggccaaggcaggaggauugcuagagcccaggaguucaagagcagccugggcaacauagggagagucccaucucuagaaaaaaaaauuaaaauagauuaaauaaauaaaaaaacaaaaaguggggacaauuuuaggacuuaucuagcuuugaagaguccuucaaaggggugacagauuuggccucacacuaguuauuuggaugugaccuggaaaaacagaguagcugccuaaguucugaggacuuaggagccucaagacugacccuuucucagaacuggcccuucuuacugucuuuaaggauccaacacaaagaguuaaaaggcagaguaaaaacccauagcagaucaauuuaggagaagcacaggauuguaccaagauguuuaaaaaaauuuccauguaucugcuuuggaaaagagaacuuuuccuacuguugugaauaaaaauguuuagugucaacaaaacguuaaacaaacuuagcaauuagcaaaaaugaacccacugauacgaauguaguagucaauggggcuugaacuuguaauaccagcauuugcugauuuugagaugcacauuuuagcaacucugaaaucaaagcguaucuuacaauccaugcaucuuuuuuuuuuuuuuuuuuuuuaagauggggucucgcucugucacccaggcuggagugcaguggcaggaucacaguucgcuguaaccuugaacuacugugcccaagugauccucccacuucagccucccagguagcugggacuacuacgugccaguaguggcugacuacgugccaccaagucuggcuaacuuuuucuguagaggugaggucuugcuauguugccuagguuggucgucagacuccuggcuucaggugauccucccaccucagcuuccguaagaguugcaauuaaagguuugagccacgacacccagccacaauccaugcaucuuguauuugaugaaauauaguagacaguguucacugaguguccaucacaugauaugggcaugggcuugauaccucauacacacuuuuuuauuuauccccaugacugugccaugaagcaauuauuauugcuacuuaaaaaugagaaaccuagacuuaguuuuucuaagacuagaaagaauuggaauaguauacugcaauauggcagaaacaugugauuacauagacucucucccucuguuauccccuuuuagcuacuauucuguuacuuuguguuuuguuugcaaauauaagcguauuuaagcaacaaucagccagaagacucugaguaacacaauuauuuaaauaagcaauauaauaaaugacacccagaaauauuuauuguugauuaugcagcagcuacugagcuaggacacauauuccauuuauuuuuuauuuauuuauuuuugagacgaaauuucacucuugucgcccaggcuggaguacaguggcgcaaucucagcucacugcaaccucugccuccuggguucaggugauucuccugccucagcuucccaaguaccuggauuacaggugccugccaccaugcccggcuaauuuuuuguauuuuuaguagagacgggguuucgccauguuggccaggcuggucucgaacuaauaaccucagguaaucugcccgccuuggccucccaaagugcuaggauuaugugagccaccgcaccuggcccacauauuccauuuaaucaugacuauuaucagcccuauuuuauuuuauuuuauuuuauuuuauuuugagacagagucucgcugugucacccaggcuagagugcaggggugugaucucagcucacugcaaccucugccuccaagguucgagugauucucuugccucagccucccgaguaguugggauuaaaggcacaugccaucaugcccaacuauuuuuuguauuuuuaguagagacagcguuucgccacauuggccaggcuggucucaaacucuugaccucuaguaauccaccugccucggccucccaaaguacugagauuacagaaaugagccaccgugucuggccagcaucauuuuaaaggugaagaauuugaggcuuagauuaguuuaaguaauuauuuuuuguccuauaaaaguggugaagcuaagacucaaaccccccaugucugacacuuaaggcaagccucuucgacagcagcccuccugccagucacaaacuagaaacucaagcccuacgugaacacaaacaugggcuggaagacaaagggaaugugaugugucagaugaaaagaaugagaaggaggccaggugugauggcucaugccuguggucccagcuacuugggaggcugaggugggaggauugcuugagcccaggagguggaggcugcagugaaccauguuugcaccacugcacuccagucuggguaacaaagugcgacccugucucaaaaaacaaaacaagcuggguguggugucucucgccuguaaucccagcacuuugggagacugaagcagguggaucacuugaggucaggaguuugagaccagccuggccaacuggugaaaccccgucucuacuaaaaaugcaaaaauuagcugggcaugcacuuguagucccagcuauauuugagaggcugaggaaggaagaucgcuuaaacccagcaggcagagguugcagugagccaagaucaugccacuguacuccagccugggugacagagugagacucugucucaaaacaaacaaacaagaaaaaacaaacaaaaaaaaaugagaagaacuggcaggagaagucagagaugcuucuggagauuucggaaaguggggaacaugcagugcuggugaugggggauaccggggugaaggugaaauccaaugaaaucagucagaaaggaccuugguccucaguaacgagcaguguggcagugacuuagaugagguuaggaacaggaacuugggggacauggaaggagugggcaggauuccagggugacagggcagagggcaacucgaucugggaaagcugaaccucagagaacucaagacauauuucuaagacugaagaauuauucagauuuauuucacaagcugguuaugccucugagaugugcccauguacucagacuguggcgaaggagggaaggacgacauggcugaccggcaugaggggcccugcaagcauuacuuccuuuaauccuucaccaacccuaugaggaagacaccacacauaucccuaguuaacagaugagaaggaagcccagagaaaggagacaauuugccaaaaguuacacgggcgugaggaauggagccaagauucugucugacucuaagagccuaaacuaauuucucgugacaggaucgcgucagugguugccucugcugaaagaggcugacuugaaagaggcacaagggggucucuggagggagagauguguucuguguucugauugagagugacaccagugugcacaucugauaaacuuaccaaucuauacacuuaaaagguaugcauuuuauuuuauuuuauuuuuuauuuuugagagagucucacuuuguugcccaggcuggagugcaguggcgcaaucucggcucacugcaaccuccuccuccuggguucaagugauucucuugccucagccucaugaguagcugggauuacaggcaugggccaccaugccaggcuaauuuuuguauucucaguagagacgggguuucgccauguuggccaggcuggugucaaacuccugaccucaagugguccguccgccucagucucccaaagugcugaaauuacaggugugagccaccacagcuggccaaaagcugugcauuuaaaaaauguccuucuuccucucuaggcuauaaaccccaugaaggucuaacauaaugccuagcacaugguaguggucagugaauagugagugaacaaggaacugugcacuguuaucgcuguauuacugagggcaucagagccuggcacagaagaaucccugcaaaggaaggacacagagcagaaaagggcucugugcugagacccugagaagcugccaucucaggccaccgcuucacagcaaaguggucaucuugcuccucccagucaugcccaguggugggcaguggcucauugacccuaucauuuucuguuaacugagaagcuacaacucugcaaaagugagacauagcacugcauacaaaacaaugcuguuuaucccauaugacuuuccugaacuccacuggaaaggaacuacauuuuuuuuuucuuuugagucagucuugcucuguugcacaagcuggagcgcaguggcgugaucuugguucacggcaaccuccaccucccggguucaagcaauucuccugccucagccucccuaguagcugggauugugggcauguguuaccaggccgugcuaauuuuuguauuuguuaguagagaugggguuucgccauguuggccaggcuggucucgaacuccugaucucaggugauccgccugccucggccucccaaagugcugggauuacaggcaugagccaccacgcccgguuauaacuacauauuuuuaaaacaucacuucaggaucuaugucuuagggaaaaaaaaaucacagaaggcauuuucucauuuguguggauaguuacuucacaauuugcuucuuuaguucccaaauuaucuuagccaaauuaauuaggaaccuggccucucuugguucagggggaaaauuccaugaaauagacaguuauguugccaucagagggaaagaccaaaaagcaggauuuugacauuuuuuuccuugcuaugaaaaauaagaaauuuugaaagaggaaaaaaaggacaucauggccacuaguucuuuauucugacucagaugguucuguuucuauguaaauaugcaaagaaacagauaaacagagaaaaaaggccccguuaaguccacauccaucaauucaucacggcaggaaacaagaaaagaagccaggaggcuugaaaucccucugagacuuggcacaggguagcaugaaaacuugaacacucucacaggauuuaauuauucccauaagaaaaaauaaacuuuccagaaaagagcaaggauaucuuuuguuccugauuuguaaguagggcucaaauuccuucagagcuugaaggcugaaugguuugcucugacgaguguuugauuaaacuaccaaaagugaggauuugggauuuuucacuuggaugacccugcuagaucuaguccugaccuaagugagcagcugaugccaagaaugaaaauuauuuauuugaucuucuccaaaacaacccaggugaacacgugaccacuccaacaagaauacaaauucucucugcggaagacacgaaaggucacgcaucuaugagcaguuugccagggauuucaggguuuaauagaauaugucaucucuugggcuccaccucauggguuugcauuuuuugaaauaauacaauaggaagcauguggguguugggggagauaaaucagauuugaaucuaacucugacauuuacaagcugggugaccuugggaaauggauaagcugggucucgguuuccucauuuguaaaguaaggcgaacacuacccacccagcuucagcaguuguuggaacagugagagaucauagggacacaaugcuaguggucacuaaguguauuuccugagccuuucuuuggaaguaucaguucauugaaucauuuaguaaauuugcuuccagcacguacuaaaagccaagaauugugcuagguauugagaauauaguaguuaagacagacaagggcucuacauuuagacagccguugagaacagauggacaaguaacauauaaauacauauaaucauauucuaaaaaauaugauggagacaaugagacagguguuacagacugaacguuugaguauucccagaauucauacauugagguugggcaugauggcuuaagccuguaaucucaacuuuauggagauuuugguauccugaggugggcagaucacuugaggucaggaguucgagaacaaccuaggcaacauggugaaacuccaucucuacaaaaaguaaaaaaauuagccaggcaugguggcaugaugugccugugguccaagcuacauugaaggcugacaggaggaucgcuugagcucaggagguggaggcugcagugagccauguucaggccacugcacuccagacugggugacaaggugaaacucuuucuuuaaaaaaaaaaaaauuccauggccaggcaugguggcucacaccuacaaucccagcacuuugggaggcuggggcacgugaaucacuugaggucaggaguuugagaccagccugaccaacauggugaaacccugucucuaauaaaaauacaaaaaaauuagcuggguguggugguacacaccuguaaucccagcuacuugggaggcugaggcaggagaaucacuugaacucgggaggcagagguugcagugagcugagaucgggccauuacacuucagccugggcaacaagagcgaaccuccaucucaaaaaaaaaggaaaaaaaaaaaauucauacauugaaauucuaacccccagugugaugguauuagaagguggggccuuggaagguaauuaggucaugaagguugagcccaaaugaaugagauuagugccuuuauaagcagagacuagagaacuugcucuugcucucucuguacuauaucauuguugaaagaguuauuaagaaguuauuuuaggcagauagagaggaaaagggguccuagggaaguuuuuguuuuuaaagcagcucuuagagccaggccagcaaccuuuaauaugcaaauggaggccauuagaaacuggguccauacaaacauggcgauucccuggccuucuugccccugccccacauguuccuggcaacauggccgcccccaccuaucccagaguguguagaacaucagggugcccugcauuugcauauuaaaaggcuagggugggagggcaagcuuuuucgggcuacgugaaugacaugccucgucaaaccaauccccugagcccugugcaaaucagacaccaccuccgccagccuacuuauaaaacuggcugguauccauggcaccuggggucuccucuuucggcuuuggagccccccucccucugucucuguacgggugagcaucuaucuucggccuccucccaucuuucuugccuauuagacucucuacuucuuaaaaccacuccacguguguccaugucguuuuuuccaauuugacuagagacaaagaaccugguguuccuccacucauuggagccauaucaucauuguugggauauagcaagaugaccaacugcaaaccagaaggcagacccuuaccaaacaccgggccugccagcaccuucaucuuggacuucccaaacaaauguuugucauuuaagccaucaauucuaaucggcagccuaaaaugacuaagaccacauggugauaugaggagaagugauuggagaaagacgggaggaauaucacaggguauucaaggaagguuucucugaaaaauuaacauuuaaucugagacuugaaggacaacaauggaaccagcuauucagcccuaggcaggagaaaacccagugucugggaggaacagacagaaggccagggaaggagauaaagguaugauaagcagggcccggauuauaaacuuuguagacuacagaaaacaucugaguuuauuccuauugugauggggagccauuagaguauuuugagugccugagucacuuaauuagauuuucuugagaggcagacauaggcauaaucaugauguauuacggaaauguaaaaauucucccugacuaaagcagaggaugucuucuagaggaucauguaaaauaagguuaucauagauaguauuguccagaaauggguuuagacuugaugugauuaaaaaaaaaagauuauaucauucaagguugugacaugaaaccaacguuaacguuuacacaauauucauuauacuguaaccuacagaauagcuuggggguugggcauggugguuuacgccuguaaucucagcacuuugggaggccaaggugagcagaucacuugaagucaggaguuugagacaagccuggccaacauggugaaacccugucucuacuaaaaauacaaaaugaggcaugguggcacaugccuguagucccagcuacucgggaggcucaagcagaagaaucgcuugaacccgggaggcggagguugcagugagccaagauuguaccacugcacuccagcuugggcaacagagugagacucugucuaaaaaaagggaaaaaaaaauagcuuggggaaggaacuggcuucccuuucaaaguagcagcaaagagauaagagacagauuuuuuuccuccuggaaugauuucuuccucuaggauaugaguaucuggaugcugacauuaaaugagcuccuguagcgaaagagccuugcacggcucagggucagguacauagaagagacaguuccuucucucguuugcuccuuuccccuuugcauugaaaggaaaccaaaagcccuggauauaaaauucuucaaggaugagugaaaagucaucaaaggaaaaaugcaggaaacaacuucuugauguaaaugcauugcauggguugaugaaacuuuugaugauuuccauauuucaugcuccauucuagaauuguagugccaaacaaaaguccuccaagcccgacguuuacagauuuuauuuuuuaaguaaaagaacuuucaaaauaagaguagcucaaauucaaagaugcuuggucaagccuagccaacauggugaaaccccguuucuacuaaaaauacacaaaauuagcugggcauaguggcacgccuguaaucccagcuacucgggaggcugaggcaggagaaucgcuugaacccaggauguggagguugcagugagcugagaucccgccacugcacgccagcugggcgacgagagugaaacuccaucucaaaaaaaaaaaaaaaaaguagucauagcaaaagugugaaaaucucacuggauggaguggccacaaaggcccagaugcagggcucugcccccauucaaaaccuggggaaaaugagaacccugacuaaagggagagccugacauucagugcaggaagggacacugaggcacuuuacacuauccuaggucagcucuggacagucagagaugccaaaaggaggcauguggucagaaugcuggaaaauuuccaccacucagaccuagcagguuaaucagugcccaagugggcggauccuucccacagggcaccccaggacccucuugacgacuacacaccccaaacucugcaguuuucugaguugaagauagcagcaaugacagcuugcugggaacaagccuuuacgaauagauuauacaaauggcuucuuuguaagugaaauuauucuaugacaaaugguaaaauaggaaauaauugagucaguauuuucgguaagaaaauaauguacaaaauaauuucuaaugaauauaagcagcuaaacuauacggaaggacaugguauuugcuaucauuguaauuuaaccaacaaacaguaauacuaaaaauguauaucucuguauagucaugcacugcauaaugauguuucagucaacuaugaacugcauaugugaugguggucccaucaucuuuuuuuuuuuuuuucuuuuugagacagucucgcucugucacccaggcuggagugcaauggugcaaucuuggcucacuacaaccucugccucccggguucaugugauucuucugccucagucucuugaguagcugggacuauaggcacccaccagcaugcuugacuaauuuuuguauuuuuaguagacacuggguuucagcauguugaccagguagaucucaaucuccugaccuugggugaucuucccaccucagccucccagcgugcugggauuacaggcaugagccacugagccuggccucccaucaucuuauaagauuguaauaaagcuaaaaaauucggcugggcgugguggcucacgcuuguaaucccagcacuuugggaggccgaggcaggcggaucacgaggucaagaaaucgaaacuaucuuggccaaaauggugaaacccugucucuacuaaaaauacaaaaauuagcugggcaugguggugcgugccuguagucccagcuacuugggagacugaggcaggagaauugcuugaaccugggaaguggagguugcaaugagcagagaucgcaccauugcacuccagccugggcaacaaagccagacucugucucaaaaaaacaaaaacaaaaacaaaaacaaagaaugcuuuaaaaaaaaaauucccauugcccagugacaucacaguugucauaauauuauagcucaauucauuauuuuuucuauguuuagacacacaaauaccauuguguuacaauugccuacaguauucaguacaguaacaugcuguacaguguuuauagccuaggagcaauaggcuauaucuagguaugugguaggcuauaccacccagguuuguguaaguacacuccaugauggucacacaaugacaaaauugccuuaaaacccauuucacagaacauaacccugucauuaagugguguaugacuuuauaucaauuccaauacuguuuggccaaaaaucuuagaaggguuuuagggcuauaucuuaacaacaacacugauaaagauuccuuuugcauguuucucuuaaaugauaaaauguuauguuaaacaauuuaaacaagguuuuuuuuuccuccugccagguuugucagaguuuucaauaugcuaaugugcuuuguaaauuucuaagagggggauaaaguauguggcaguuuaaaacugcuuugaucagagaaccucaggacagauguuuugcuggaccagggagcuguguaauaauacagugauggaaaggcugcucuaaugaacucuguaaagcucuauaacauaagaaaaccacuguguaccucugaagaaacuaaacauauaaaccauaugaaguauuagcuuaugaaauugaaaaaauauaucagguaaaacaucgaucagggaauauacguuaaagaguuaguuaaugaguugacaaugcccagaacgguuauguauguacaucaacaaagauaaacuaaaucaauuaauuucacuguacauuuggcuaagcaaaacaaggucuuuaguugcaauguaaauaaauucauugcuuuccucaaaagaaaugcucuuuaagccaaagcaucaugcgagugagugcacacucagaacugaagcauugugccaaaaaaaauuuauaccagguacuuuauuguggaaauaaaauauaaaauccuuccccagccaagaguuccauuagaaaaugaaaaauucagccuuggcauggacacaaaugcuugcuuuuuuaugauccuggccaacauuccuacucugaguugcuuuggugcugugccugcugcaguccugggaagguagaagggcucugccaugcaccgccuucgcaagcagggcuuccauggcugccccagagcacaggaccccagggccugugccucccugacaugagugagguguucaaaucaaaagguggaagcagccccuaaucauaccagcgcugauuaccugggcaagcaguaaaugugcucuuugcuuccuugagccauuuucuguugcccacuuauuuuuuccagcaugcaaaccaaugccagagagcucaugcuggaaaucagagagguggcgaucccaaucaugcuuauugcuacucuaggaaaagacugauggaagaggaugaaaguauugaauaaaugaacaggggaaugaucuuuagcuuuuaagccuucugcauccucuuaugguuuuggauaaucaagacagaaauacccuuuugugaaacauuucacagacaauagaacaaagcugugcuauauaaagguauuucaaagcagaaaaccucaacauccucuuaaauaaaaacaauguaaauaguauauauacacacacaagaagucuagaagaauauaaaucaaaauguuaauggcuagguuuuauaggaugccaauuacacacuucaaauaaagcugcuuaaaaaauguuaacaguagucaucucugaguuagggaagauuagaaguaauuuuaauuuuuuuccugcuugcauauauuuuccaaauuuucuugacuguauauguguguuuuuuucuucuuuuuuuuuuuuuugagacagagucuugcacucugucacccagguugggguacauuggugcgaucucagcccacugcaaccucugccucccaggcucaagcaauucuccugccucagccuccugaucagcugggacuacaggaaugagccacuacgccuggcuaauuuuuuguaucuuuaguagagaccggguuucaccauguuggucaggcuggucuugaacuccugaccuaaagugauccacccgccucagccucccaagaugcuggaauuacaggcaugagccaccauaccuggcacguauauguaucauuuuaguacuaaaaaauauguaacaguuauuuucaaaaaucuuccauaauucauucauuaaugaauuguuguuuguguagcucuuuguacuuuaucaagguuuccacacauuuaauccauaaaacaacgggaaauaguaugauugucauuucagagaggagaaaacagacucugagaugcuauaaaacuuguucaaagucaacgagcuaguagcuaacaggaccgagaucuagaucuccagaucucugccaaaguucaugguuuuuguuuucuuuuucucaguauuggcuaugucguauggucuauuaugugcuaccgguuacauaaaccccacaggaauacaccuugcauagaauagaagcauuggaguucuuacacaaagauuuaagcaaagggaaauacauaauuuuucaaauucaguauugguugaggggaaacauguaaaacaccaggggagguuuggagaccaaaccuccaaacaccagggagguaguaaaacuugcucuccugguuccuauaucauaugugcuuggcuucauuuuaaccccauucagaaagggaaaaggaaauuugacaaaaaugaagccaaaacgcuuagggagaaaaaguacacauggcaccaaauaaugaaauuaagcuagagguauuuagacacugcuaaauguuguuuuguuguuguuguuguuguuuuguuuuguuuuguuuuagagacagagucucgcuuugucacccaggcuggagugcaguggugcgaucuuggcucacuacaacuucugccuccuggguucaagcgauucuccugccucagccuccugaguagcugggauuacaggugugugccaccacgcccggcuaauuuuuguauuuuuaguagggauaggguuucgccacgguggccaggcuagucuugaacuccugaccucaagugauaugucugccuuggccucugaaugugcuggaauuacaggugugagccaccgcgccuggcuagacacuucuaaauguuuauuagaggagagggaagacccagggaaagguuaaagacuuuggagaacaagaaagagagggcagaaauagaaaaggacacaaaauaagauggguuuggaucccuaguaagaaucauggccaauuuagcaugaagaacccaagacagauauaaaagagggugagaaagacccguuaguaccuucauuccugcugcggcugcagggccacuggggucuacagccuggauguggcauggcuuacuuccucgcaccacaaaaccccagccaaccgcgucaccaacaaucuagagaggaaaaccacaauuagcaagcagccgacugucuccggcaauuugcuuauucuucugagggagagaaaaccagcccaggauuaaguauacacugugacauauuuuccuccguuucucucuucccugccaggggauuggaacacugcuucuaucacaaacccgggcaucucccuguagaaaaggugguaaaaaaaaucuaaccuguuuggcagaaagaagaugcucccaugagggcaugauucaauaaacaacuggaagauuuucucuuucuuaggcuguuauacaauuuaaugucagacuccaauagaagguuuagaaaaagucguaacgugguugaaaugucucuccagauacaauuucugcucuaaguuuguucuuuuccccaguauccaaaugauacacucuugauccugcaacgucauugaagucuagcauaauuauugaaauuacuaauggugggaaauaaagagaccuggcuuuuuuuuuuuuuuuuuugagacagagucuugcucugucacccaggcuggagugcaguagugcaaucucagcucacugcaaccccaccucccggguucaagcgauucuccugccucagccuccugaguaacugggauuacaggcaugcaacaccaugccuggcuaauuuuguguauuuuuaguagagacaggguuucaccaugauggucaggcuggucucgaacuccugagcucaggugauccaccugccucagccuccaaagugcugggauuacaggcgugagccaccaugcccagccuccaccaagggagcccuccaccaagggcuccaccaugccccuuucuccaccaaggggggaaaagaagugaaaaaguacauaaaguucacaauguacaaguagacucuaauccaaaaguuguuuggaauuagagaaggccuuuucuauagaaaucauuauuagagcuggcaguuuaauucccuggacagcuccuagccacaucuuucacacauaucccaaccaaaacacagcugaaacacauucacaaucaauuacuaacaauguuggcauuuaaauuaaaaaucaaaaauaaauacuuucaaaauaacaaucuaccucucuugaaugcuggagacugaggaaaaacagggaggcaaaugaaaauuuuuguggaaaugcucaagauuuucaggcacuuccguuacuuuacaguuugcuguuauuuguauauuauacucaauuucacuuccgaagguggaguuuaucuuuuccucugguacagacauguugucagcgccuuucuccuauuaacuccucagcauucagaaugugaaauagcccucagcaaauguuugcagcaugacugaguguggauagaauucucccccagccugaggcaaugccacuaaaguuagaagaugaaggaggagaaguguuuugaagaggguaugaacgugaauuugaggagauugacagaaggagacacaggaaggggagugggugcggugaugcugaaaagagcacuuucauuccauuugaagaaauccaacguaggcauuaggaaccuaaaggaccuccaagaaggggcaggugguccggagcugcucacagcaagucagaggcucguguaccucaaggcaugcacacauugucgaagcacccugccuacgguagaaaaguuuaucccacaguuuccuuucucuagcuuaacacuccccuaauguuuuaaauaauuucuagaauuaauccuaaugcagaagggauuauuggcaucauuugcacuuccauuugccauaaaaucuaauaauaauuuaaaugacuaauggugggaaauaaaaucuaaaauuauuagauuuuaagguaaaugcaagugcaaaugaugccaaucuugaaauuugcaauuaaauuagaauaaaugcauaauggaaaucuuuucuuuaacaaagaacacaucaaaaaauuuuuaaaugguauauuaauaauaacgcaugugaaguccuaaugcaccuuagugccuugaggucaagaaagccuaguaucauaauuacgcuaaaaacaaaaagaaaauuagaaaaguaguuuucauuucagucuauaagcuacccauugacacauggacacggugcagaaaaaugggcagcacgggagaaaaaggccagaccaucagccuaccgugaaugucuuccuugcauacggagccccgggaguaaggaguuccucagaggugacaggucucuucagcacuggcagacaaacacaaugucaagacauaagcacuuccaaguccucuauccaugcauucagcagcuauuuauugauaucucguaggugaccaucagugagaaaaaguggcaaagaucccugccucacaguuuauauuuuagcugaauggagacaguaaauagcagcaaacauaaauaacccuaaaccuaccuuacaaagcuaaggaaaaaaagaaagagaaggaaagcaagagugccagggguggggauaagggggcaggucaauuuuuuuuuuuuuuuaaagacggaguuuugcccuugucacccaggauggagugcaaugaugcgaucucggcucacugcaaccuccgccuccuggguucaagcaauucuccugccucagccuccugaguagcugggauuacaggcacccaacaccauaucuggcuaauuuuuguauuuuuaauagagacaggguuucaccauguuggccaggcuggucuugaacucgugaccucaggcaaucugccugccucagccucccaaagugcugggauuacacgcaugagccgcccagccucacuuccuucuuaacaccuaggacugcauguacccacugcuuucugccaugaguaauaaugcuagugaacuuuucugaguacucaacauaugcuagagaggcaccaugugaggugaauauauuaacucacuuaaucaucacaagaaugaaugaguuaggaucauuguuauccccauuuuauaacugcaaaaacaaccuuagaaaaguuaaauugauuguguccaaggucccagagcgaauggguggcagaaguagaaucaaacucaggcauuagacaccagcacccacacucucagcuacugugccacauuuacucugggccaugcuguccugcaagcaaaagaaagggucuagaagcucaggaagauaguggcaugcuguccuccugagacacccguucacaucagcucacugcuguugcccaccaagauggcagacagcagccaauuccugacuugcggcugccuaaaacccaccgauaaugaacccccccauccauccugugcucacuaagaacuggagaggggcugucguauccuccccaaguagccagggggucaggggacagagaccauucuaauccagcucugcagacauugugaacuugaagugccacagagaaacagaaaaggccccagccaaggggccuaaccuggugagguggcauccuccgauccccuuugcuagugacagucagaggccagguaccaguccuggaaagagugugcagcagacaaggaaaggcagcguggggcaaggcgugaugaucuaccaggcagcuggaccucgcccacugguuacaugaacggccuucuggccugagaagcacccucucagugaaaggcaauccagugcuucuuguugaggugacagguugcugaucuuaucaccuuugcuuucagaaaucucauaaaagcaaaaauuaauuuauguucgccaaacaagagggaguaggucaaauaucaagauggaaacagaaucucucagcagauggaugggagguaagaaaaguggucaguauuugaggacugagaucuuuuuuauucccugucagguaacucucucuccacuccccauaaacccucagggggcuuaugaauuuggauacaugaaucacacuguacuauuuggcagcagagcugaccauucauuuuaaugcacuucucuuuauuauguugaaaaauauagaaacuuugaggccuagggaaaacuuuuuucuuuucauauccuuggaagcuuauuugcuuaucacaaugauacugauaacaucaauaucuuuaguacuguuuuuugugucuggcuuagggcauuuauauacaguacuaaaaaaacauauccugguguauuucagauaauuaauuuuuaaaugcaucacugugaaggccugaucaucugcuugagaaaaaaaaaucacagaugaacucacugggucuugggaauccucuuaagagugagagagaagcuugucaaacuauggguaagaaguggaauuuacaaaccacaacucaguccugacagcucuuguccuuggggacccacgaaaggaaacgagaccuuuuucuucugccugcauaacaguaaacucuucccuuugacccagaggcaaggagaaagaggaaacaugcuaaccuaccucagggaacauggauuuuguugcuaauuucaguaauuaacacuuuuuucauacuccaucauaagcaaucaaaaacuuguaaaaugguuauggcaccacugacccuuuuauugaaacugagaucuuuugcuuuuaacuuugaggaugccugucagauuucuacaaaggcuucaaacaucccauuucuaagaauucaguucuccuuuuucauucuacuuuagcagcaagcuccaguaauugaaaaacccaguacucaacgacucuucagccaggacaguauggaagcaagcuucuucauucacuuacagguuacauuuauuccugcugcuaacacuccagaaggcagcaaaaaaagaaaaaaaguuagaucaggaaaaagagccaccuuccuagauaauaccauuagaugacagaguuuucucucaaagccuuuugaacugcaucaauuagugcuuauucuuacuaacaugaaauguuuuguuuuuuucuccaaagaggugguguuuucauugaguuggggguuaugaccugucaucuuuguauccccaagaucugaugaugaggaaacaacaugaacaaaaggaacagagccucuuccucgaaggugacaaacugaacuggggguggacagugccuuaaacaaauggguuugagaguguucucuggcgguuacuguagugauggaccacacauccucauccuggcaagugaggacauuagguggguaagggauggugagaaaggguaguuucaauggauuaccaguuccugggugguugaugaacugauuggguggaggaaggauuguuucuaaguacauguucaccaacaauuuugugccuagauuuuuuuccuggaauauaaaggccauggagguugaugagcagauuuugaaaccacaagacacccagggucaauuccagggauagcuggguuugcacacauccaugcuucuuccuuaaggguguugggccccaacagaucuuaugcaucggcugcauucuggggaagugcuguuuccccugcugugagcacugucacauacugcccaaaacacccuucagggcucagggacuucucccagcuccgagagugcuaauggugacagcccucagcugucuuggagaccaucucucugaagacaccugcuuugcccaaggucaugcccuccucccaggggcagccaauaccuaauaaguggccaacauguggaucuaaaggcccagcccccucaacacaacuccaggcaacuuggaagggccaucccagcuccagaggucuuacugggucaaugauagccuucauugagacugggcuacaacccaauuucuccuucagcccaauucuuccuucccuuccauucaacacguguggaccccaagagcaugcucuaacuuauuagaacccacacacuagucucccgcuaucucagauucugcuucccagggaccugcccaaguccccacagucuuaggagcggggccaccuuuugggcacucaccggacuugggguugcagagcacaggggggcugcugcugaggguggggcugcugcugaaguagccgcugcugccacagcugcucaugcugcuucuccucacugcagacacgaucuugaucuccuugcuggggcucacuguguaggccagagaacacacacagucaccaaggggguggucucggcucacuagagcacauaggcuuucaacugcaagguccagaggggccaggagaaagcacacuggucuuaguggcagaaaaacaagaacuugaguugcagcucugccacuuacuuuauauuauauauauauauauauauauuuuuuuuuuuuuuuugagauggagucuugcccuguugcacaggcuggaguacgugacacaaccugggcucacugcaaccucugccuccuggguucaugcgauucucuugccucagccuccugaguagcugggaccauagguguccgccaccacgcccggcuaaauuuuguacuuuuaguagagauuuguucucugucaccccugauaacggguggauaaccagucacuuuuuugugguuacugguguaaaugcccacagaaauaaucuucuuauucaucuuugaaauggauagcuuugcaaaguugugauuuacaaaacugaauaauuaaaugauauauaaaaacuacuuguaaggccgggcgcagugguucacaccuguaaucccagcacuuugggaugccaaggcaggagaaucacgaggucaggaguuugagaccagccuggccaacauagugaaacccuaucucuacuaaaaauacaaaaaugagccaggcauggugacacgugccuguagucccagcuacuugggaggcugaggcaggagagucucuugaacccgggagacagaaguuguggugagccaagauugcaccacugcacucuagccugggcaacagagcgagacucugucuaaacaaauaaacaaacaaaaacuuguauuuauuuauuuauuuuuaaauuuuuuggacagaugaggucuugcuauauugcucagccuagucucaaacuccugaucucaagugauucucccaccucagccucccaaguagcugagauuacagaugugugccaccaugccaggcaagaauggcuuguaaaugaaaaguaaaugagguuugagugagagccuagaggacuucuauaauucaaauacauaauuuuauaaaacagaguccuggcaucuaaguuggcugugcaagaaaaacuuaggguuucagaauuuuuuucaugcuucuugguuaugaauaaguaaaaauucuacgcucugauagagaacagaauuucacaaaggugagucauggcuccacuauuucucaaaagacaaacacuugagcuccaauaaaugccgggauggcauaccugacauaaagcugguagauuuccgauugucauggcucugcuuccucaggcagaagggacugucaugaguuuccugggaggagggggacuuuucauugagcagcuccaucagucuucgccuccgccggaaguucauucugaacugguagagaagauugcuguccacaaaugggugcuuguuggacacuggggagaaaaaaaaaaacaaccaaugaggacuaucuggcauccuggccacugagcgcuacagccaaaggacugcaggcaacagcggcaaaagucucaagaaagacuucucuuccacagaugccacaugagcugccgcccauccgcccaugguuccaaguucuuuccacgugacaugcacuuuaaaaauuugcuaaccaauuccucuggggaacuuugccugaccuugcuuucaaucugaguucuauucuuccuaguguucuccuggcuccugugcugcuuccaccaaagcacugauaacacugcacccucacugucugccccuucucuuucccucuaaacucuaagcuuguuggggcagugaucauggcuucacuuacucauguguccccauugcccagcagagagcuugucucauagccacacucgauccuuuuucuuuuuuuuugagauggugucucgcucugucacccaggcuggagugcaauggcaugaucucggcucacugcaaccuccgccucccagguucaagcgauucuccugucucagccucccgaguagcugggauuacaggugcccaccaccacaccuggcuaauuuuuguauuuucguagagacgggguugcaccauguuggccaggcuggucucgaacuccugaccucaacugauccacucuccucagccucccaaagugcugggauuacaggugugagccaccacacccagccccucaauucauuuuuaaaaacuuuuuauuuugaggccaggugcgguggcucaagcuuguaaucccagcacuuugggaagccaggauggauggaucacuugaggucaggaguuugacaccagccuggccaacauggugaauccucgucucuacuaaaaauacaauaauucgccaggugugguggcauacaccuguaaucccagcuauuugggaggcugaggcauaagaaucacuugaacccgggaggcagacauugcaguuagcugagauugcaccacugcacuccagccugggcaacagggcaagacucugucucagaaaaaaccaaaauaacuucuuauuuugaaauaauuauagacuuacagagaguugcaaagaaaaugcagagaccacacacuguaugauuccauucauauggaauguccaaaacaaagacacuucuagagacagaaguauacuggugguugccaggggcuggaggggggccuugggguugguuugggagggguauuagcuacagcacacaauuucuuuuugaggugaugaaaauguucuaaaauugccuguugugaugauuacaaaacucuguaaauaugcuaagaaccacucaauuguacacuuuaaugaauugcuugguaugugaacuauaucuucauaaagcuguuaaaaaaaaucggcaaagaguacagagaguuccuggguacccuucacccagauuuucccaaugguaaccccuuacauaaauaacuauaguauaauaucaaaccagaauguugacaucgguacagucuacggcccuuauucagaugucaccagcuuuuacaugcacugauuugugugugugagugugcaugugugugcaggagcacauauaguucagugcgguuuuaucacacguagagauuucuguaaccaccacaacaaucauggcagaagaacucucucccuguguuuccccucuauggccuccuucacugaauuccugaugccuggcaaccaccuuugcucuccaucucuacaauguuaucacuuugagaacauuauguaaguggaaucauacuaucuguugccauuuauguuugcuguuuaauacauaaauaaaugguuacccaauaauaaagccugcuuagucccuaaggaaaucuauacuuuauuuauuuacuaauuuauuuagagauagagacucacucuguugcccaggcuggagugcaguggcacgaucauagcucacuguagccucgaacuccugggcucaagugauccuccugccucagccucccaaguagcuaggacugcaggcacacaccacugugcccagccaaaauccacacuuuagagugauauaaacaugccagugugucaacuugaagucaguaauaacaagagcuagcccucauacagcauguccuauaaacccagcaugaccuuaaguaagugucuuauauguucuaauuccuuuaauuaucacaacagcuugggauauagguaccauuauuuuauuuccuuuuuuuuucuuuuuuuuuugagacagaauuucacucuuguuuuccaggcuggagugcaauggcacaaucucggcucaccgcaaccuccaccgagucucggguucaagcgauucuccugccucaggcuccgaaguagcugggauuacaggcaugcgccaccacacccauaccuggcuaauuuuguauuuuuaguagagacgggguuucuccauguuggccaggcugguuucaaacucccaaccucaggugaucugcccaccucgaccucccaaagugcugggauuacagacacgagccuccgugcccggccuauuuuauuucuucuucuucuuuuuuuuuuuuuuuccuauuuuugaugagggaacugaaguccaaagguauuaggaagucacccaaagaagacauaguaaauggcagagguagaaauauaauacaguaucugauuccagaguccaaguuccaaaccacugcucuuacugcuucugugagaaacaauuccuucuccagaucaucauaaaaaucaaaaccaugucccauaaaacugcucauguaugacuauuagucuggacguacauccaauucuauaccauuuauaucuuagaaauccauugagauuuauuuauugccucaauuuuauacuuugaguucaugauucuuggagcuauagugcagguuguacaucaggccccaaaagccauguuccuggaucauuucugucuguagagucaucagggacucugcaaacuggucaccaucaugcggaagucucaugcaacuuucccccagaagcaaaaaacuugaauagaugacacaaaaacagaagacacacaaauaucuaauuagcacaugaaaagaggcucaaccucauuagucaauauggaaauacacauuaaaaccccacaaugaggccaggugcgguggcucaugccuguaauuccagcacuuugggaggccaaggcaggugaaucacuugaggucaggaguuggagaccagccuggccaagauguugaaacccagccucugcuaaaaauacaaaaauuagccaggcauggugcaugucuuuagucccaacuacucaggaggcugagcugggaggaucgcuugagccugggagguggagguugcagugagccaagaucacuccauugcacuccagccugggugacagagcaagacuccacuauuuuuuuguuguuugaucauccauccauuuauucaacuaccauguauugaguuagguugacuauauaccagguacuuuucuugcccaguguuuuaggaaaagaugguaaaaacagaaguuaaacaaaaaauucaauccuggcaacuuuuuuuggauuguaaaauucaaaauguuauaaaccacuaggaaaauaaucuagauaauaaaaacccauuaagaaucauauuaacgcauuuaucaaucaugcuaacugguucaacagucucuuuucuauuucacaaacagcaucacauccucucuaggucaacaucaacacaugcaaucuaggguuguaacuauauuuauuaucuacauauguuaauaaacaauuauucuggucacauaaauaucaagucucacaaccugggucccuacuaagagagcaccagugccagcauuuaaucuaauaauccauauggguauuccacaguuuuuaaauggugauauucacuuuggccaaaugaauaaaguuggccucaaagacaaguauaguuaauucagugguauuucuacauguucuuaauaaauaaucuggacaggugugguggcucacaccuguaaugccagcacauugggagaccaaggugggaggauagcaugaggccaggaguucaagacaagccugggcaacauauucugucuccaaaaauaaaaugaaauuaaaauauuagccaggcaugguggagcaugccuauagucccagcuacucaggagacugaggcaggaggaucgcuugaucccaggagguugaggcugcacugagccgugaucacaccauuacauuccagccugggcaacagagugagauccugucucaaucaaccagucaucagugaaugcucaugcauguaaucccugcacuuugggaggcugaaaugggaggaucgcuugaggccaggcauucaagaccagcuugggaaacauagugagacucugucucaaaaaauaaaauauaaaauauaauaaaaucauaaauaaaccaaccauucuuggauucaggagaggcucaccuaaugcaaccuggaccaaaaaauaagucaaucacacuuugauaugauagcuaccaauguggcucucuuguggauagucaaauuuuuacauaaauucacuacaucgcuauacucaguaaugcuauaauaaaauuuuguagguaaguuauuucuggcaaccuucugaguuuauugagauuuuuaaaaaauccucaaguuggcuuuggcaacaguaucuuaaaauuauaaccugcaaauauauagcccuguauacauuuauuaagaccuacuguuuucucuuugcacagugaauuacauaaaauauuggcucuguauaaauaaauccagaaaagcauucuaaauccaaaaaaaaucuauagcagacuucaaaguacuuugagauuauuuuuaaaugaaauagaaauuugacugcugaccuaauuauguaucuccuccagcuuuaauuacugacccaguguuuaguuuacauccagucuccagcuuauaccuccccaccucuauaccaccuauaaccaacagggcaaacauacuaucuaagaucaaauacaaaagucaacuuuauauaguccuucuucaucacauucucuccccaauagaacaggugaccucaaacaugaggaagucagguaacaugagggccagaugagauagucaacuauaaguguucagcauaaugccaaauacauuguaaguacucaauaaauuauacauuuauuauuuuacaaccacuguuguuuuuuacuguuaucaucaccuauugaugauaugcugacauuuggccuaggagaauucaauuuuaugggauauaauauuuaauuuucaaggauuuucaagaauuuucaauucauccucaauuuucaaggauggauuuggauccgagugucucaggagcagccacccucccugaaaugaagguugccacguguuuauucaccuagcuguguggcuggcacagauggaaucgaguucucucagcauacaaaagugacaauuguauguaucacuugcauuguugccaauaaguuauuaauauuuugccuuuuuucugucuuucauuaaaaguuuaaugauauaaacaguuuaaugacauaaacauugaguuucacacauuugcuuugugugugaguaaaguuuuagguuuaauauauauaaucacagcuucaaaagcugaaagagugcagguagacagccauauuauggcaccaauaaaucacacgugacauucauucauuugacaaacugagcaccuacuaaguaucauacuccaucccagcuacugaucuuaacauugugauugaaauaugacaccuucaucugcucaucucuuuaugcucaccaauaccaaagccugcuaaaagagacaucauuucacacaagaacauggcaauuaaguuggaacuuuauugacaauuuuuaugcugaguaacuuugagaaauuucuuuuucuuuucuuuucuuuuuuuuuuuuuugagacagaggagccuugcucugucacccaggcuggagugcaguggcgugaucuuggcccacugcaaccuccgccuccuggguucaagugacucuccugccuuagucccccaaguagcugggauuauaggcaccuaccaccaggccuggcuaauuuuuguauuuuuaguggagacaggguuucaccauguuggccaggcuggucucgaacuccugaccucaggugauccacucgccuugccucccaaagugcugggauuacaggcaugagccaccgugcccggccuacuuuuagaaaauuuaucauacaaugaaaaguacaaguuuuacagccagguaucuucaguuucaauccuagcucugccacauuuacuaucugaguauuugggcaacuuguucaauuuuuugaauauauuccaugcaaaggaaaaaugagauaauuuauguaagagauauggcauggcaucugacauagaguguuguaagccuucuucauuuuagacuucuaaagauugacuucacacuuugcucauuuaaguuccuaugcagaacucauuuccucuaucuuuucugccuuucuuuuuucuuuuuuuuaauuuacuacuuauucugaaauucuaauucuucuaauucuucuuuuuuuuuucuuuuucuuuuuuccuuuuuuuuuuuuugagacagagucucacuguguugcccaggcuggagugcauuggugcaagcucggcucacugcaaccuccacccgcugaguucaagcaauucuccugccucagccucucaaguagcugagacuacaggcgugcaccaccaugcccggcuaauuuuuuguauuuuuaguagacaugggguuucaccaugcuggccaggcuggucuuaaacuccugaccucgugaucugcccaccuuagccucccaaaguacuggcauuacaggugugagccacugcgccuggccuaacuuucuuuaaagaacacauugcccuucuccgagcaguuuguuauccuuuuaccuaugaaaaacguaugaaaucauaaccagauauacagcuaaaguuuagugagugcaccacuggaagauauucaaacuugagaaguugacagaaagcaaaaaauaaagcaguguauuaagacacaguaagguuugggaaguaacuagauuaugaaagucaaagaucguuuuuauagucauaaauuauauaaguagaggcucaagaauuaacaacagcuaaaugacauagaguuuguauuccagagggagaaaaguugauuuuuuuuguacaccuuuuugggacagucuugcucugucauccagaguggugcgauuuuggcucacugcaacuuacgccuccaggguucaagcgauugcccugccucugccucccaaguagcugggauuacaggcaugagccaacacgcucagccugauuuuuuuuuucuuuuucuuuuuuuuuucgagauggaguuuuugcuccguugcccaggcuggagugcaauggugcgaucucagauuacugcaaccuccaccuccugcgucagccucccgaguagcugggauuacaggcaccugccaccacaccccacuaauuuuguauuuuuaguagagauggguuuucaccguguuagccaggcugaucucaaacuccugaccucagguaaucuaccugccucagucucccaaagugcuaggauuacaggugugagccaccgcacccggccucagccugauuuuuuccuacacauuaacaugcaauacuccauacugaauauaaaaauccuugcuacauaaacaacuuacuuuuuguuaaacacagaaaaaaaaaaauccaugauauggaaaaaaaaguaaagagaaggaagaaaaaagcauggggaacaguuugugccuguaagucuuaaauuuguuccaauucuacauuucucagaucccagugauauacaggaccuucguauuauaguaaauauaauacauaccauuugauaaauuucauuuuuugcuccuuggaacuauuuaucuguaaacaggacaaagauucaaagaggcaguguucaacaucuacauucaauaucuaauguuccaguugugaucuuaccaguuguaauugaaaacugacaauuuguuacucauccaauugauaauuucugggacuuuccaagccuucccuuuugcuuugguagaauucucuagggccuugucuugacuucguauuaaaugggauuuaaacuaggaagaaaagcagauguagccagaaagcuagagccacauaaauacaacaggaucucuguuuaggaaaguuggaacuuuagaagcacucaauucacuauuuggucaaagaaaaacagaucccuauacaccguuagguuuaacugcagaaaucaugagggaaaugucauguaguuuaccaaaauaauaaagugacaugguacagauauauucuucuuucuggggauaacgugacuacauuuuccucccuuauauauuauuaggaugauuuuagcagacaaagaaauaauagaagcugauuacuuaaaaggggggaaauuggcucccauucaacucaugcauguaguccaaggaugaauauaaaaauguaucaucuugaauucuacagguucuccugaauauaaaacuauuuucguugggcgcaguggcucacaccuguaaucucagcacuuugggaggccgaggcaggugggucaccuggggucaggaguucgaaacuagccuggccaacauggugaaacccugucucagguaaaaacauaaaaauuagccaggcaugguggugcgcaccuguaauuccagcuacuugggagacugaggcacgagaaucacuugaacccaggaagcagagguuguagugagccaagaucaugccacugcacuccagccugggcauagaguaagacucugucucaaaaaaaaaaaaaaaaaaauuuacucuacuuaucuaguuggaaggaggaaggucacauacuuucauucauccuugaaaugcuugcucauaaaugauauaacacaacaggcaucaugaagcaugugaacugaauccagcacuacgauagcaccauauagggaaugcgcagacaucaacugugcccuggaugacacaucaucaaaaauuuuuaaaagguggucuuggacuuacggucacguaaacaacuuaguagacugaaaacagacuuaaacagagagggaauaaagaugaugauuauccuacugaggaagaagaaggucagcaagauggggcuaacugcaaaccagugucaaaguuacagaggucaucaagaucaccuuaaagacauaagacccucacuagcugccagcucacugcuucaccaagugcacaaggguggcuggggcuucugugaaggaucauuuuuuuggucaccaaggauggcacucuauccaaccauucacuccuuuuccucuuauuuucuuagcuacuacugaucucugauagacuagcccugauagacauugcucaaaucacagauaaacugcaaggauaaauggaugguagaccuauuccuuagacuugguguuucuagaaggugaguaaauucugcauacaaaaguacugugguuucccugccagcaagacuuaagcuuuaacuucuuucacacauccagggauagauuugcaguauuuugucuucuggguccugcuagaucacagucugacagaguccaagcaucugauaucauuuaguauauuucauaauuuaaaaauggucaagacugaagaaauauucauaacaugcuuuuuaaucaugcauuuguagaaaaaccuuauuuaagaauuaguuacaauagaaaaguugaagcuauuuuuuuuuaaagaaaaucugacuggaggcuauuaaccuuaguacacuuaugcaggaacagaaaaccaaauaccucguguucucacuuguaaaugggagcuaaauguuaggaacuuaugaaugcaaagaaggaaacaauagccaagccaagcguaguggcucaugccuguaaucucaccacuuugggaggcugaggcaggcagaccacuugaggccaggaguucgagaccagccuggccaacucagcaaaaccccgucuccauuaaaaaugaaaaaagauuagcccggugugguggcacacgccuguaaucccagcugcuugggaggcugaagcacaagaaucacuugaacccgggaggaggagguugcagugagccaagauugugccacugcacuccagccugggaaacagagcgagacacuguuucaaaaaacaacaaaaaaagaccaggcccuggggccuacaugagggguaagguggaggugggaggaggagaggagaagaaaagauaacuauugggcacugggcuuaauauccugggugaugaaauaauauguacaauaaccccccguaauacauguuuacuuacauaacaaaccuucgcauguacccccaaaccaagaauaaaagauuuaaaaaaaaaagaaagaaagaaagaaagaaagaaagaaaaagaaagaaagaaagaaagaaagaaagaaagaaagaaagaaagaaagaaagaaagaaaagaaaacccgagcuguacuuaaggccaucucaaccaucucaagccauccuaaauggaagcaauaguugaaggagcccuauuuccuaaagcagcaaaaguccuugaaucgacuuuucaaaacaguaagcaauuguuuuuaagugccuacuccauaaaaacggugcuagcugcuugggauacaaaacucuccaaaaggcaauaacaacagugagucagaggacuaaaauaauuacuuccuuagcacugacaacauuaacaagaggauaugaaagcaggaaauugauuguaggacauaaaguccuauuaacugauauuacugaaacaaaauacuucacauucacaaaguuauaacccacuuacacuuauuuaauugauugaagggaggcaagaggauggaaaagaaguaaaaggauucaaaguaacuuuaguaaagauagaaaaccaaacaugacacugugauugucugagugcugcagcuucugugucuuacugccagaaauguaaaggcaauaaacagauggaaagucaaacuauguuuuauucuucuguauguaucauuaaacgauagcugggguggccgggcaugguggcucacgccuguaaucccgcacuuugggaggcugaggcgggcggaucaccaggucaggagauugagaccaucccgacuaacacgaugaaaccccgucucuacuaaaaauacaaaaaguuagcugggcaugguggugggcgccuguagucccagcuacucgggaggcugaggcaggagaauggcgugaaccugggaggcggagcuugcagugagcagagaugcgccacugcacuccagccugggcgacagagugagacuccgucucaaaaaaaaacuaaauaaacaaauaaaaauaauagcuggguacauuccaaagacuagaaagaaccucuacuguuagugauaacaugcagaacaagggguaggauuuucaaagauaaucuuguuuaucagaaacuagauuguacuguaagugcagagaagccuaaaaacaaaauuauuucauccggcaaauggaauaucucagauacauaauucaacaaaagaaaucuguaacucuauucuagaucuuuugaaauuauuggcaaaauaauuaaacccaaaggcccgaucaaaguauuucaguguugauuuacuuaacaagcacguaauagcagagaguauguauaagauacuguucaagaccagcaauggaugaggucaucaaauacauuaagcuucacccacucaggcaucugauaaugagaauguagaugauaaaaauaaugauaauuaucauuuacugagugauagauagccugugcacggcccugugccaagcacauuacagguuuauaucauuuacuucucaaaacaguacuaugagagaguuauuauauucccauauauauuauauucccauauuaugauucccaguuuacagauaaggaaacuggggcuuagacaaggcaaacuugcccauguaucucagagucacuaacaagaagauccaagagagaagugcugacggacucacuccaggucucaccccugaaccuccacacuagacugccucccauuucaaggugugaucauggaaacgaggaggcagacaagcuugcaaaacaagagaguggagucugcuuugcccacauuuauuccuguuuccagguuacagacgguaauuuggcuggaaauguuuuccauaaaauucuuaaccaauggcccggcacgguggcuccugccuguaauccuaauauuuuaggaggccaaggcacaagggucacuugagcccaugaguuugacacuaaccugagcaacauaguaagaccuugucucuauuuauuuaaaauaauuuuuaaagaaauauucaccaccauaaaaugcuaauuacuuuggaauugcuuaccaaaagaauguggcagccaggcacgauggcucauauauguaauccuagcacuuugggaguccaagguaggcagauuacuugagcucaggaguuugagacuagccugggcaacaugguaaagccccaucucuauuaaaaaaaaaaaaaaaaaaaaaagaaaaaaaaaaggauauggcuauagcacagaaaacauugcucugaucucagauagcccaggguugaaugccaguuuaacgauuuacuuaauuacuuaacugcucugaauuuuaguuuucuucaucuauaaaaugaauuggaggaacaaugaaacaacauauguaaaaggccuaguaggccggacacggugguucacaccuguaaucccagcacuuuggggacccgaggcgggcaguucgcuugaggucaggaauucaagaucagccuguccaaaauggugaaaccccaucucuacuaaaaauacaaaaauuagccaggcauggugguacacaccuguaaucccagcuacucgggaggcugaggcaggagaaucacuugaaccuaggaggcagagguuacagugaaccaagaucacaccacugcacuccagccugggcaacagagcaagacuccaucucaaaaaaauauuuguaaaauaaaauuuagaccugggcaagauggccgaacaggaacagcucuggucugcaacucccagugagaucaacgcagaaggugggugauuucugcauuuccaacugagguacccgguucaucucauugggacugguuagauaguggguguagcccauggagggcgagcagaagcagagugggacauugccucacccaggaagcacaaggggucagggaacucccuuccuuagccaacggaagcccuaagggacucugccaugaggaacagugcauuccagcccagauacaaugcuuuucccacagucuucacaacccgcagaccaggagauucccucgggugccuacaccaccaggguuucaagcacaaaacugggcagccauuugggcaggcacugagcuagccgcaggagguuuuuuucauaccccaguggugccuggaacaccagcgagacagaacuguucacuccccuggaaagggggcugaagccagggagacaaguggucuagcucagcaguucccaacccaauggagcccagcaagcuaagaucuacuggcuuuaaauucucacugccagcacagcagucagaggucgaccugggacacucgagcuugguggggggaagggugucugccauuacugaggcuugaguaggugguuuuccccucacaguguaaacaaggccaccagcaaguuugaacugggcagagcccaccacagcuaugcaaacccauuguagccaggcugccucucuagaggcagggcaucucugaagaaaggcagcagccccagucagggacuuauagauaaaacuccccucucccugggacagagcaccugggggaaggggcagcuguuggcgccgcuucagcagaccuaaaccucccugucugccagcucuaaagagagcacuggaucucccagcacagcacucgagcucugcuaaggaauagacugccuccucaagugggucccugaaucccaugccuccugacugggagacauaugccagcaggggucgacagacaucucauaccggagagcucugguuggcaucuggcaggugccccucugggacaaagcuucuagcggaaagaacaggcagcaaucuuugcuguucuguagccuccacuggugauacccaggcaaagagggucuggaguagaccuccagcaaacuccagcagagcuacagcaaaggggucugacuuagaaggaaaacuagcaaacagagaggaauagcaucaacgucaacaaaaaggacauccacacaaaacucuauccgaaggucaccaacaucaaagaccaaagguagauauauccacaaagaugaggaaaaaccagcacaaaaagacugaaaauuccaaaaaccagaaugccccuucuccuccaaaggaucacaacuccucaccagcaagggaacaaaacuggauggagaaugaguuugacaaauugacagaaguaggcuucagaagauggauaauaauaaacuccucugagcuaacagagcauguucugacccagugaaagaagcuaagaaccuugaaaaaaauguuagaggaauugcuaacuagaauaaccaguuucgagaagaauauauauaaccugauaaagcugaaaaaucacagcaugagaacuuugugaagcauacacaaguaucaauagcugaaucgaucaagcagaagaaaggauaucagagauugaagaucaacuuaaugaaaugaagcaugaagacaagauuagagaaaaaagaaugaaaaggaacaaacauagccuccaagaaauauggggcuaugugaaaagaccaaaccuauguuugauugguguaccugaaagugacagggagaauggaaccauguuagaaaucacucuucaggauauuauccaggagaacuuccccaaccuaccaagacaggccaacauucaaauucaggaaacacagagaacacaacgaagauacuccucgagaagagcaaccccaagacacauaaucaucagauucaccaagguugaaaugaaggaaaaaauauuaagggcagccagagagaaaggucggguuacccacaaagggaagcccaucagacuaagagcagaucucucagaagaaacucuacaagacagaagagagugggggcaaaauucaacauucuuaaagaaaagaauuuucaauccagaauuucauaugcaggccaaacuacgcuuauaagugaaggagaaauaaaauccuuuacagacaagcaaauguugagagauuuugucaccaccaggccugccuuacaagagcuccugaaggaagcacuaaauauggaaaggaacaaccaguacgagccacugcaaacacauaccaaauuguaaagaccauugacacuaugaagaaacugcaucaacuaacaggcaaaauaaccagcuagcaucauaaugacaggaucaaauucacacauaacaauauuaaccuuaaauguuaacgggcuaaaugccccaauuaaaagauacagacuggcaaauuggauaaagagucaaaacccaucggugugcuguauucaggagacccaucucaugugcaaagacacacauaggcucaaaauaaagggauggaggaauauuuaccaagcaaauggaaagcaaaaaaaaaaaaaaaaaaaaaaaaaaaaaaaaaaaaagagcagggguugcaauccuagucucugauaaaacagacuuuaaaccaacaaagaucaaaaaagacaaagaagggcauuacauaaugguaaagggaucaaugcaacaagaagagcuaacuguccuaaauauauauacacacaauacaggagaacugagauucauaaagcaaguucuuagagaccauucaggauauaggcauggguaaagacuucgugacuaaaacaccaaaagcaauggcaacaaaagccaaaauugacaaaugggaucuaauuaaacuaaagagcuucugcacagcaaaauaaacuaucauaagagugaacaggcaaccuacagaaugggugaaaauuuuugcaaucuauccaucugacaaagggcuaauaucuagagucuacaaagaacuuaaacaaauuuacaagaaaaaacaaucccauugaaaaguaggugagggauaugaagagacacuucucaaaagaagacauuuaugcagccaacaaacaugaaaaaaaaagcucaucaucacuggucauuagagaaaugcaaaucaaaaccauaaugagauaccaucucaugccaguuagaauggcgaucauuaaaaaguugggaaacaauagaugcuggagaggauguggagaaauuggaauacuuuucuuuuugagacagagucucaugcuguugcccggguugaagugcaauggcgugaucuuggcucacugcaaccucugccuccuggguccaagugauucuccugccucagccucccaaguagcugggauuacaggcaccugccacuacacccagcuaauuuuuuguauuuuuagucacuauguaggccaggcuggucucaaacuccugaccucaugauccgccugccuuggccucccaaagugcuggaauuacaggcaugagccacugugcccagcccaggaaugcuucuauacuguuggugggaguguaaauuaguucaaucauugcggaagacaguguggcaauuccucaaggaucuagaaccagaaauaucauuugacccagcaaucccauuacuagguauauauccaaaggauuguaaaucuuucuauuauaaagacacaugcacacguauguuuauagcagcacuauucacaauagcaaagacuuguaaccaacccaaaugucccucaaugauagacugaauaaagaaaauguggcacauauacaccauggaauacuaugcagccauaaaaaaggaugaguucauguccuuugcagggacauggaugaagcuggaaaccaucauucucagcaaacuaacacaggaacagaaaaccaaacacugcauguucucacccauaagugggagcugaacaacgagaacacauggacacagggaggggaacaucacacacuggggccuguugguggguggggaguuaggggaggcacagcauuaggagaaauaccuaauguagaugacagguugaugggugcagcaaaccaccauggcagguauauacccauguaacaaaccugucccagaacuugaaguauaacaaaaauuaaaaauaaaauaaaauuuaaaaauaaaauaaaaggccuaguagcgucccugguccauagaaggauuccauaaauauuagccaugugugcuuccaugcaagggcccagggugucagggccaaaaggauaucuuuccaagguagaagccuuuucagaccuuauuuuuauagaagggucuagaaguaacucuagguggucucggggaacagacagugggguacugaaauaaaauccuucccaggaaccccaggaugugaaaguuucuucccaaaggcucacuccugcauggcauuuucuuaguauucccaggaagguuaccauauuaacuugcuggugcuuuacugcacaguaauuuaucaggugcugcuuuugagacugaagagauaaagucaguaugucaacagacccucaaaggaggaagaggcuaaaguucagaaaaggaagauagcaguggcaagacauagucuuuuuuuuaacugucuuuauauauuuucuauauuguucauagcuuuaaaaaagaagaugcaggaaaaaaaaacccaccuacuuuuuaaaaaauaaacuuuacauuuuagaauaacuuuagauuuauagaaaagcugcaaagaaggccaggcacgguggcucaugccuguaaucccagaacuuugggaggccaaggcaagcggauuacuugaggucaggaguucaagagcagccuggccaacauggugaaacccgucucugcuaaaaauacaaaaauuagcugagcgugguggcgggcaccuguaaucccagcuacuaaacaggcuaaggcaggagaaucgcuugaaccuggaaggcagagguugcagugagccgagauggcgccacuccacuccagccuggguaacagugugagacucugucucaaaaaaauaaguaaauaaauacaaaaauuagcugggcguggugcuacacaccuguaaucccagcuacucgguugcaguaagccaagauugcaccacugcacuccagccugggagacacagaaagacuccaucucaaaaaaaaaauaaaaagaaaaagaaagaaaaaaaagaaaagcugcaaagauaguacagauagcucccuuaugcccuucauccagcacccccaaauguuaacauaacuaugguacauuuguugaaacugagacauuaacaucgguauacccaucugcuuuuaaaucuagcuuagagcuauuuguguugacacaggaagaaagcuguuccuuaaaagcguauguuucauaaggaaguuugcuuaguuauuuaaugaaaaagacauuuguccuuguagcugacagugccagcugcuuauucaaacccaaucucucuuucuuccuccuuaagaauuuugcucagggcaguagugugcccagccaaaaccauaugagucaccgacugccuuccagcauggggugaccaugugacacaguucuggcccaugagauguaggaugaaaucccugggacagacugcccuucccagauaaaaagcaaagucuugcuaggugacaccucucugcucuuaacucuuugccauucccuguucuuccugcccagagugcagacaugaggccugguguacacuaagaacaggagagagagagauggacagcgccuuuguggggagucucagugucagccugggauucuagaccugggggcaucucacuucaggaggcagagaaaccucacugcuuaaacuaucuuuacugcacuuucuguuauguguugcuaaacacaacgcagauagcaucccaaauucaagucuagaggcuuaaacuaucuuuacugcacuuucuguuauuuguugcuaaacacaacccagcuagcaucccaaauucaagucuagagacauaagaucaaaagcuuaggaaacaaacacuuucuaucucuuugaagcccauaucguguaagaaacuaugcuugacucagaagccacgaagcugcuuagacaggaagucaagcugucagaagacauggcuucuagcaauguggcucagauuccccugcaacagaacaggggaauguucaguuauguuauguucaguccuuaggccucaauuuuuccaucuguggaagagaaauuacgauacuguauucuuuuauccaaagcaagugaaaguaauaaauauguagaaaccaaucucucccugaaagacauggucuccauaaugcuaauauagcauuaauaauauuguucugcugucaguaaaacuccaaaggacccccacaaugaaaacuagaauuuuuuuuuuuuuuuuuuuuuuuuuuagagauggaaucucacacugucgacugggcuagagugcaguggcaugaucuuggcucacugcaacaucugccucccaggucaagugauucuccugccucagccuccugaguagcugggauuacaggcgcccgccaccacucccagcuaauuuuuuguauuuuuaguagaacgagguuucaccauguuggccaggcuggucucaaacuccugaccuugugauucgccugccuuggcuucccaaagugcugggauuacaggcaugagccaucacgcccagccugaagacuaggaauuuaagagaauugccaaaaucaaguccagucuaaauaauaauagccaacuacauuuuuuuuuuuuuuuugagauagggucuugcucuguugcuuggagugcaguggcacaaucacugcucucugcagcuuugacuuuuccaggcucaagugauccucucaucucagcuuccuuaguaguuggaacuacaggugugcaccaccacaccuggcuaauuauuuugauauuuuguagagauggaguuucacuguguugcccaggcuugucuugaauuccuggccucaaacgauugccugccucggccucccaaagugcugggaauacaggcgugagccacugugcccauccuacauuuuugacuucuggaaauauuaaaaaaucaaagguaaaguaaaaacggaguggaaagaaaaaguagaaaauuuaagcugcaaauugaccugaauagacucccccuaaaauauaauugguaguguagaauuugguguuaauucaguuuggaagccauacauuaacaguuugauggacauuguuucgauucuuuaggagaaccuguuaaacaagcacaggaauuguuucucauggaggccauagaacaguuguuuggaacuuggauucuggagucagacacuauaguucuauuuuccucaugccauuuacuguguuuucuuugggugacuuccuaauaccuuugggcuuuagcuuccucaucaaaaacugagagagaaagaaaauaggauugugaaaucauggugcuggggaagggagaacauuuguuguuaccuauguggcugguacccacuuuauauggauguccaaacuggcacuguaaaaauacagauaucagaaaucucagacauagaggaacaaagaucacagagauaagggacugaaaaaugaaaugcggcugggcacaguggcucacaccuguaaucccagcacuuuggaaggccgaggcggguggaucaccugaggucaggaguucgagaccagccuggccaagauggugaaacccugucucuguuaaaaauacaaaaauuagcaggcugugguggcacaugccuguaaucccagcugcuugggaggcugaggcaggagaguugcuugaacacaggaggcggagguugcagugagccgagauuguaccauugcacuccagccugggcaacaagaacaaaacuccaucuccaaaaaaaaaacacaaagagagaaaagaaaagaaaagaaaagaaaagaaaagaaaagaaaagaaaagaaaagaaaagaaaaaagaaaaaugaaaugcacacaggucaggacaccaugcugcccucugcugguuucaaaacggccuagagcuguguucuccaagauggcagccacuagccacgugagccuugaaaugugagucugauuaaaaugaaaaaacacacuggauuuugaagacuuaguauaacaaaauguaaaguagcuaauuuguauuuuucauauagauugcauuuuuaaaugauaauauuuuggagauggcgaguuaaaguauauuaugaagauuaauuuaacccauuccuccuuuuuuuuuuuuugcuauuucuacuagaaaauuuaaaaucacauauguagauugucuugguggcuccuagcauauuuucauuggguagcccuggucugguggcugauuucccacaagaacagaacagccaaccaacaaacaaguucaccccuuucauuggguacaguacuuugaaagccauuugccauagaagaugauccuuguccugaacaagcaaaugaucaagaguuuuuccaguuuuucucacacuaucucccccaucccauuucccuuauuuugaugaggaagcacauuuuguucccacuuaagaggaaucccccauugagguuaugauuucagcaccaagaaggauuucagagucacaggagugagccaguggggcaaaaccaacacccaccccuuccccaguggccuggaggcuuugccaacugccaauaugaccaaaaccugggacagcuuggggaguggcuaaaauaaaauuuaaagaauaugaacccugauacgcaggccuuccuuggauggaagcggggguggggugagcucuuuguuggguuaagugucaucacucagaggagaaaaaaguaaagggaagcuuucuagaaaaaaagcugggccaggugcaguagcucacaccuguaauuccagcacuuuaggaggccaaggcgggugcaucacgugaggucaggaguuggaggccagccugggcaacauugcaaaacccugucucuaugaaaaauacaaaaauuagccacgcccauagucccagcuacuugggaggcugaggagggaaaauugcuugugcuugggagguggagguugcagugagccaagaucaugccacugcacuccagccugggcaacagagcaagacuccaccucaagaaaaagaaaaaaagcuggaugaaaaguucuagccuuuaaaauguugauuuuaaaauaacauacuaauuaauaauuuuuaaaaacauuacucucuaaaucaaaacugauuaugaauauuaaucaacacacauauuuuuccaaucauagucaggauagauguaugugaguguaagugagauuccuucuuaaauuucaucuucauaccguuccguggucacacugaugaguuugcuuaugcucaguuuuauuccugguaguuacucccuggcauuaacauacuuggacuuguuuauccauuccuggcuggagugggggugagcagggagcagggagcagggagcagggagagggaagauagaaagaaggaguuuuuccaaagaaucagagagccaaacagaaaagacgacccagauguacugagaugagaguuaucagcuaagagaaacugaauuauagugagcggcucagaaucaaaagccagaagcagcuaguggaaaaacuuuuagaggaagaaucaugagugacagcagugcagcaaggcugaaacagcugagaguaaucauuguuuauaccugcauaaggagagccugggucccagacaggaaucccagcccaaacccccuagccacccagcugggagggggcugauacuagaaacucacccaagguugacacaagggucagggcuagaaaaaaggucugugauggaaagagaauggaaacaauucacugcuuaaaggagagccucucaacuuuugguccccuugucuccucagcccccgccucccauugacgaguaugaucuagcucacguucaucaggaacuggaacuuaauaccacagcacucuuugaccaggagagagaugaagcauaucagaaucugaaguuugaacucucuguuccacccaggagacugagaaaccugauaugcucuucuagcgagccugagaccucauucuacaggccccacugaaaaugaccacuuaaacccugcugaggauuuaaaugaccagauaaggccaagcugagcacucaguaggagcacacuuucaauauaccucaacugcauagagauauugugcuggcguuuuaagacuucugugugcuguuguaaaagaucaugcuugggcaaagugaggaccucauacugcaggggacacugggugacgagcugucaggacugaggcagggguggguaggaacacaggcuucagaagcaagcauagguuguaccucgagaagcaguuuauauacaauggacaaagauucuacuaaugucaagaaggaaagaaauauucauagguaugacacuguuuacaaaagaaaaaccucaaaugggcauggugguucaugccuguaaucccagaacuuugggaggcugaggugggaggaucacuugaccccaggaguucaagaucagccugggcaauauagcaagaccccaucuuuaaauuaaaaaaaagagagagagaaagaaaccucucgucugugugcauaacacucuucuuucaaaauauuacauaagauaaggcauccuguauuccuuucauacuuucugaaaaguuaaggcuugaugccguuauagguacauuuuccuuuaacauaaaccaauacuuuauugugugccaaugucuuggcccucuaucaagcaaccuguuccuuucuauuuacauuacaacagcauucuggcugugucuauucuuccuccugcauuggauucagcuacaauagaaaguaacacagggccaaagcauaugagagagcacagugggaaaaugcccagaaagucuaaauucggaaaguaaaaaauuagauuagauuacagcugcugcuaagauuacacuugaaauguuaaauauugaaaguagauugagaaaauacucuacccagcuuuuuuuuuucuguucaaaguugaacauuuaggagcuaagaaugauuauaccaguugcaaaugccucaacgucuucaucuaaaaaaaacagagacauggucaugugcaguggcucaugccuguaauuccaauacuuugggaggcuagggcgggcggaucacuugaggucaggaguuugagaccagccuggccaacauggcgaaaccccgucucuaccaaaaguacaaaaaaauuagcugggugugguggcacgugccuguaauucuagcuacuugggaagcugaggcaggagaaucgcuacaacccgggaggcggagguugcagugagccaagauugcaccccugcacuccagccuggguaacagaguaagacuccaucuaauaaaaaauggcauaaaauuuaaaaagagagauaacaguaucaagugcauugauugcuugugaagauuaaaugaguuaauagcaguaaagaacagccugccaagcacucauuuuccuguggaaacagggcuugcuuuuucuuuuuucuuugcagggugugcggggggaggguggaacaacuacccccauucucccacuuggugaaucugucagucaaaggguccccacccagggucaagaggugagccugugacccgacccagccaauaaggguccucucuagaacauuagcaucuggagacggcaacugcauaugcagaaaacagagcugauucaccuggccauagguggcuggaagggauuaguuuuuagucacuaguuccugguuccuggauccccagaguugcuucaguuucucuucuucagguagccuuguuuucaacauuuccuuuaacuaucagcuggcucugccauauauuuaaaggaagugaugauuggagcugcuucuauucaaagaaagcuugcugguauaaacaccaguauugugcccagcaaaggccaaguccucaguaaguggucacuuuugucacuuguucauucaauacauuuuugcugauacgauauauauauaucguauuuuuugcugauacgacauauauaugcgccaaaccaauaggaauacagaaaugaacaaaacaacuucucuauccuuaaaacauuuacucucuaguuagggguaaagaaaggcuaagacacagggugccaucuguaaagaagucuccuccauuucuucuucuugacuugcaaguccucuuggcaagaaguuagcaaaugcaaaccagagagcaugaguagggggcugggagugguggcucaugccugcaaucccagcauuuugggagggccaggcagguggauugccugaggucaggaguucaagaccagccuggccaauauggugaaaccccgucucuauuaaaaauacaaaaauuagcccagugugguggcacacaccuguaaucccagcuacucaggaggcugaggcaggagaaucacuugaacccagcacaaucucgguucacugugcuccagccugggcaacaaagugagacuccaucucaaaaaaaaaaaaaaaaaaaaaaaaaaaaggagcaagcaugaguaggagagcaggagagccaugauagagaggaagggcgggugggcaagcaaggcuaggucggcacuguuagacgcuccccuggaccaagcuucagucaggcuccuuugagcccucuuuucuacugggccuccaccuugcugcucccuuccccuccacuccaccccucauccugcugucuuggcuuacccagcccaguuuuagcaaauaacccugauaagucaguauacugaaaaucccucacccuugauacccaaucaaguuuguuaucuccaccuuugauuucuaaguccuuggccugucuugagcaagaaucucucugcccuaagucuccuauuuaguaauuuuccauccacugaccgacuccgcacugugcuccuugacucuaaaucccuacuugucccuauauuuuaaguugagcccaaucugucuccccuauugcaauaccccuauuguaauuaucuuaaacaaaguuuuccuuacuuuucuaacaagugucaauaauuuuuuucuuaaugccauauagucuugagaaaguugcaauugauggggcucaggacaugccacccugaaauauggcuaccuggcauaaggauuguuugguacugguuauuuugagaagcugcagacacagcaguagcuccaaaaaguuguccuuucaaaaauguacaucuguaaaggaaauguccuuuuguccuuuuuaaaaaaauuuuuuuuuuuuuuuagagaugggauuuugcuauguugcccaagcuggucucaaacuccugggcuccagcaguccucccgccuuggccucuaaaaguguuaggauuacaagugugagccaccaugcagagcuaggaaaugccccucuguaaaggucucucccucucugcaccaggaacagaaagaaaauuaagucacuagagacucguaauaaauaaagaagguguugaccuaagucugcauaacaaaccauacauuuguauaaggucuuuuucugacccucugguuuuaacuggguuacaucuuuuuuucuuuguuucagggaauaaugguauuuaagccugaagucugaacuacccacccccccaccuuuuuuuuuugaggcagagucuugcucugucgcccaggcuggagugcaguggcacgaucucagcucacugcaaccucugccugcugagcucaagcaauucuugugccucaaccucccaaguaacugggauuacaggcacacaccaucaagccugccuaauuuuuguacuuuuaguagagacgggguuucaccaugucagccaggcuagucuagaacucuuggccucaagugauucucucgccucagccucccaaagugcugggauuacaggugugagccaccacgccuggccugaacuacucuuuugagaucuauccuagagauuuacucauuucucuggauuuucacccauauuuacagagggcauacauauuaaacuucuguucauuuuucucuuguuaguccguccuuuguuacagcaggucucaauuaagaacucaugaaaaguaaagaaaaaauuauuuuuccuccucgguguaaucuugccuuuagccucaaucaucaguaccuucuuucucuuuuuuuuuuuuuuuuuuuuuuuuuuuuaaagagacaagaucucacuauguuucccaggcuggucccgaacuccuguccucaagcaauccuccccacucagcuucccaaagugcugagauuacaggcaugagccaccacacccaguuaguaccuucuuuuccuuccuucccucuccucuuccccuuuuuccccuuuccuuuccagcugggcuauuccaggcuuaggcugaucucuaucaauuaucuuaauuauuggagagaugcaguuaauuucugucuggauguggccucuagcuuccuuugcugcagaucccaaauucucucuucauggccagcagagcaaaugucucugcuacugucuuccacugaaggaugagauaaucauagcuacucucaagcaacugggaggauuaaaaagauaauguauguaaaacugcuuuguauauggcacaguaugauauaaauauauguuuaaaacaaaagaaaaagaaagagggcuuaguguugaaauuguugaagugcucugacuaaaguucuaaaacaggaaauuauccacgcagacacagcagcgguagccugguaggccagggucagcugcugcagcugugagcaauuuacccacaugauuaucugguuuccaucucccuccauuuaaggcugcuaaaauagcuggauggcaacuaagggaguugggaaagauaacuuaugugaguaaagaaguguguucgggcccuuugcaguggcucacaccuguaauccuggcacuuugggaggccaaggcuggaggaucgcuugagcccagaaguucaagaccaaccugggcaacuuggcaacaacccccgucucuaugaaaaauuaaaaaauuagccgggugugguggugagcacuuguaguccuggcuacucaggagcugaggugggaggacugcuuuagccugggaggucaaggcugcagugagccaugaucaugucauugcacuccagccuggucaacagagcaaaaaccuguuucaaaaaaagaaaagaguccaggugcaguggcucaugccuguaaucucaacacuuugggaggcugaggugggcagaucaccugaggucgggaguucgagagcagccugaccaacauggagaaacacugucucuacuaaaaauacaaaauuagccgggugugguggcucaugccuguaaucccagcuacucaggaggcugaggcaggagaauugcuugaaccugggaggcgaagguugugguaagccaagaucacaccauugcacuccagccugggcaacaagagcgaaacuccgucucaaaaaaaaaaaagguauuuaucccauuucccauuugcaaauguuacccaaaaaucucaaggucccuggucauuguuuggaggaagagaauauuguagauuucagagguuaauaaucuuuauaguauaaauaucugccaggcuaugucggcugauucagcugaugcaauagaacuugagaauuuuuuucuaguggggccugcaguuagcaucucaucuucuuuagcgguuaagagugcaggcucugaagcuagacugucuugauuugaaucuugaaucuaccacucacuagcucucaucuucagcacauuacuuuuuuuuuuuuuuuuuuuuuuugagacagagucuuacucugucacaaaggcuggagugcaguggcaugaucucggcucacugcaaccucugccuccuugguuccagcaauuuuccugccucagccucccaaguagcugggacuaccggcacaugcuaccacaccuggcuaauuuuuguauuuuugguagagacagaguuucacuauguugcuuaagcaggucuugaacuccugaccucaagugauccgucugccucagccucccaaagugcugggauuacaggccugagccacaaugcccagccuucagcauguuacuuaaccucaucucaaaaaugagaaugauuaugauaccuaacugacagggaaauacauacgugaauagaguuguuagaacaguggcugggauauaguaagagcucuauacauuucaccuauuauuuagaguagaucagaucauguacaagagcuagcauuugagggccauaagagguagaugcuguguuaaaagcuuuugccaagugcaaucacuuaauucucccaacaauucugugcaggaaagaguuaccauagcagccccaauacggaagggccggcuuauggggcuggcccauggcuagcaccugggaacuuggcuuuuggaagguucccaagucacuaacugauaaggaccuugcccaccuggugcacugaauuguguuguaucggccugccuagacuguacaaacagugugauuuauggagaauacuugcuuuccuucugagagucugcaauguugcugguuguggcuggcugagcaagcagaguauaccuaugagaaaagcccccaguaagaaucuuuggcucugcaccucaacauggguauuaggacucagaaacagacaccccaaaauauagcacuuugauaugcugaacugaagaaaaaucuacgaugucuccgaccuucuccccgcuucugccccucaauccucugugucccccaaagcacuggauaaaggucucugaaguuccuuaccugccuaagucuggaccugccaaagaagaaaacaauuuaccucugguuccuucccugaguuuucauuaacugaacucauaugacaggaagaaagacugaagucuguggacaaaccuggucagacuuuugccaggucugcucugcugacccaauggacuuaguagcaggcccuuguauauucuucaagccuacugaagccuccuaaaaaucaaucacacuuccucaucucccguuccucuaagaaguaggauagguagccucuguaccccauuggaauauuagguaaucacucugguucuccugguguacacacuaauaaauugguuugcuuuuucuccaauuaaucugucuuuugugaguugauuuuucagccaaccuucuuuuuuuuuuuuuuuuuuugagacggagucucgcucuguugcccaggcuggagcgguggcgcaaucuucgcucacuacaagcuccgcuucccagguucacaccaucauccugccucagccucccgaguagcugggacugcaaagcgccugccaccaugcccggcuaaguuuuuuuguauuuuuagcagagacgggguuucaccguguuagccaggauggucucgaucucccgaccuugugauccgcccgccuuggccucccagaaugcugggauuacgggugugagccacugugcccggccgauuuuucagccaaccuucagauggcaaaggggauguuuucccuuggccccuccgagggcuccccgguggagauauugcacacguguuacugcauuucacggcuagagaagggagucccuucaagaaggaagaacauaggaaacugugccuggauuucuccacacuccacccgaugugcccuuuucucuugcugacccugcuguguauccuuucacuguaauaaaucuuagccacgaacacaacuacacguugaacccuucuaguacacacugaacuuguggauguucauaggucucugaaaaaacaaacucucaaaggucuauuauguaacucuaauuuuauaguuucaaaauccgaggaaugggaaaguuauaagaugcagacguggccacuuaguaggugaaaaagccgcaucuaaauccagucugucuccuuccgaagacugugcucauuccaucaugccaggcagccauacccagucacaucccagaccaaggcaagcuucuuucuaagacacaacaccuaguagcuacaggguagcucuggaacuugagaaaaaucuguuaaaggauuugaagaccagauuucuucacuguaaaucugcaauaauaauacuaaugccacaaaauugcugugaggauuuaauaaguacaacauacaaagcauaugugugaagcacacacauauuaaauauacaguauauuaagaucuauaaaguagccuaaugccuuuauagaugguacacaucuauaaauuaaaaagcuagacaaauauguauagauguggucaacauacagacauuuguauaaauauguacauauacaugcauauauauauauccacauaaauacacaugcauguuaauuauucaucuaacaauuucugccuugaguaaagcgcaccagucaccauucauagaugaagcuaguuaggauuucacagguaagccugauuuuuacacuuacugguuucaaaauagggaaccacuuuuauccagaaaccuucugcucaaagccuaaaggcugacuuuccuuaauguuuaaccuaugaaauuaauuauuagccagacaauuaaaagcuuugcucaagacacuaacugguacuuaccaugagcucuaacauacacagguaugguagccauauuuucauaacuccaaguuacaaccugugaccuaucaaugaauuacugugcugggaaacugaaacucccucagaaaccccaguugcuauguagaauauucaguacuccuacaaucacgggaagcauacuucggugguuaagauuuauuaucggccaggcacgauggcucacgccuguaaucccagcacuuugggaggccaagguggguggaucaccugaggucaggaguucgagaccugccugacugacauggugaaacccucugucuacuaaaaauacaaaaaauuagccaagcaugguggcacaugccuguaaucccagcuacucgggaggcugaggcaagagaauugcuugaaccugggagguggagguugcagugagccaagaucgcaccauugcacuccagccugggcaacaagagcaaaacuccaucucaaaaaaaaaaacaaaaaaaaacaaaacagauuuauuaucaaaaaugcauuuguuuuauccuuuacauuguaccuuuaugguguuucuguuuauagcauuacagaguuacacuguaauugaagcauaauuacuuaucccuuggaaaucauuuagaaaccauucacagcauccucuaucuucuuucuaaagccaaggauauacagugugggucaguacaucauaguauaagaggcugguuuucuccuagaaguugguaucaucugacuuuuuuuuuuuugagauggagucuugcugugucgcccaggcuggaguguaguggcgugaucuuggcuuacugcaaccuccaccuccaggguucaagcgauucuuacugccucagccucccaaguagcugggauuacaggcauccaccaugacucccggcuaauuuuuguuuuuauaguagagacgggguuucacaauguuggccagcucgcugagccaccaugcccagccucaucuuacuuuuucucuguagagcaaagauaugaaagaaccaacuguaacccaaaccuaccauuuuucacuggggaaaaccccagucaucccacccaacuccaaggucacacuuacuagcaguaauauccauuuggacauuacuaccugaguggccucagacaagugauuuauccuauuggugccuucaccuucugauuuguaaaauggagauaauaaaaauacuggcccuauaguauuguacaucuaaacauuuguuaagaagggagcucucaggccaggcaugguggcuuacgccuguaaucccaguacuuugggagaccggggcaggcgcaucacuugaggucagaaguucaagacccaccuggccaacauggugaaauccuguuucuacuaaaaauacaaaaaucagcugagugugguggugcacagcuacucgggaggcugaggcaggagaaucccuugaaccugggaaguggagguggcagugagccgagaucugccccugcaugaucagagcaguaacugucccaaaaaaaaaauaauaauaauaaaagaagguagcucucauauuaauguucuuaucacaauacauuuuuuaaaaaaagaauaucuaccucauagaguuuauuuauuaauaaguuaauaaggguaaaaggauuagcacagugccuggcauauaguauaaaauaaauaaauaaaugaaauagauagcacaucuucuacuguucucuaauugcuucuauaaccaucucauaguccugacaauacuaugaacugcuuaaggucagggaucacaccagcacugugcuucccuguccaucuuccuuuccucagugaacuuaaaccagagcuagacauguuaggccaccaacagacagcugugaguccaacuguggcagaacugcacaggagaaagcagccuggaauacagugucacucacuccaagcaaugccucuagauccauggcuuccaaaauauuugacuccaauacacaguaacaaauaauuuuuagguuguaacucaauauacaccugcauaugucccuauguuuuauaguguauaucuaaaugaaauaaaaguacuguaaaacaauacuuacucuuuuuuuuuuuuuuuuuugggacgaagucuugcucugccacccagguuggaaugcaguggcacaaucuuggcucacugcaaccuccaccuccaggguucaagcgauucucuugccucagccuccugaguagcugagacuacaggcacacaccaccacacccagcuaauguuuuguauuuuuaguagagaugggguuucaccauguuggccaggcugguuucgaacuccugaccucaggugauccaccagccucagccucccaaagugcugggauuacauaaaaucuuaaaauauuacucuaacuuucccucugccuuucuguguaaaaacaggccauaaagaaauuaucugaccuacguugguuaacuguaggucauaagacucccauuccaagccgggcaugguggcucacacuuguaaucccagcacuuuggaaggcugaggcagauggaucaccugaggugaagacuguaagaccagccuggccaacauggugaaaccccaucucuacuaaaaaauacaaaaauuaucuggguguuguggugcacgucuguaaucucagcaacucggaaggcuaagguagaagcaucaccugaaccugggaggcggaaguugcagugagccaagaucaugcuacugcacuccagccugggugacaaagagagacucaaucucaaaaaaacaaaacaaaacaaaacaaaacaaaaaagacucccauuccagaaaggguccugcccuacacccaggaggaaugaaugcugcagagaggccaaaaagaaucuauacagacaggccuuguugggcugcucuacucagucuauuaacuuuagaucauacccuuuuuguccaaucauauuucuacauaacuguccauacuuuguugaacauaagcauaacaauggaugauuuucccuguaucucuggcuuuucauucugaaggcugccauacauguuaauaaauuuguaugccuuuucuccuauuaaucugccucuugggcccggcaugguuguucacgccuguaaucccaguucuucgggaggccaagguggguggaucacuugaggccaguaguuagaggccagccuggccaacauggcaaaucccuccccuaaaaauacaaaaauuagugcaccuguaaucccacuguaauuccagcuacucaggaggcugaggcaugagaaucacuugaaccugggaggcggagguugcagugagcugagauggugccuuugcaguccagccugggugacggaaggagacucugccuuaaacaaaacaaaacaaaucugccucuugucagugauuuucagcaaaccuucagagggcaaaggggaaaguguucucuuggcccuuacauguauaaccuacgcacauccuuuuguauacuucaaaucaucucuagauuacuuccugaguagccgggauuacagacgugcaccacaacacccagcuaauuuuuguauuuuuuaguagagaugggguuucaccauguuggccaggcuggucuugaacuccucaccucaggugauccacccaccucagccucccaaagugcugggaugacaagugugagccaccgugccggacuuggaaugggagucucaugaccuacaguuaaccaacguaggucagauacaauguaaaauacccgauacaauguaaacacucuguaaguaguuguuacauuguacuguuuagggaauaaugaugaaaaaaugucuguguguguguaguucagacacgacuuuuuuccaaagauuuuaaauucaugguugguuaaauacacagaugcagaacccacagauacaaagggcugacuaaaacacuucuuaaccaguaacuuacauugcaucauuaugauuuggcccuaaacggaaagugauacuuuuaugaaggcucuuuggcuuaacucuucacuguggcagcuuacaucaugguucaggaaauguuuauucucuaacaaccaaccuucugggaggcauccacuucccaacuccauauuauacuugacuucaugacuugcuuuagccaguuagauacaaaguugugauguuacaucacauccaagcagcaacuuuuggaagcgcuauaagaaccugccugcccucuuuagcaucugcaauaauuuauuaaaaacaacacaucacagacaguggauauuccuuuagucugugucccagaauggaaaggcguggagcacagaccugaauuugacccccaacuuggagacaagcugaacauaagcagaggugcagcugacuuacagauucaugagugagaaauaaguacguguuguuguaagacacaagauuuggggcuggcuguuuguuccugcagcaaaagcugcccaauacgcucaccaugcuggaugaugccaugcuccauaagccgguggcaaagcugcucugccucuuuccucgugguggccucaccuuccugaaccagccaguccaggaauucagaugccaugaaggugcgcucauacuugaccccuuccuccucccugggcugcaggaguguguuuucagggcucaucagccugggaagaaaaaaagggaaaagaaaaguaaaccuauacgaaaggaaaacagcucauuugaaaucauagauuuccaugaaguacuacagcaaaguugucagacagacagaugcagcugucaggugccaccacacauguaauuucuuuuuucuuucuuugagacagauuuucgcucuuguugcccaggcuggagugcaauggcgugaucuuggcucacugcaaccuccgccuccuggguucaagcaauucuucuaccuugaucucccgaauagcugggauuacaggcaugugucaccacacccagcuaauuuuguauuuuuaguagcgacagguuuucuccauguuggucaggcuggucuugaacucccaaccucaggugauccacccgucucggccucccaaagugcugggauuacaagcccagccuaccacacauguaauuucuaauugcuucagaagcaaacaagaugcauuuucuccuaguaauuucaaaaaaaaaauuggaaaugcaauccaaaacucuacgauuagcagacuguauucaaguuagcaaucuugaaaagagguuacaauuucauguucuauucuaccauucugaaaaagcuaguauuucuuuccuaauugcauuauuucacuucugugcuaagaagacaagugcugugaacugaguguguccucacuaauuuuuuuuuuuuuuuuuuuuuuuuuuuuuuuuugagacgggcuuucacucuuguugcccaggcuggagugcaauggugcgaccuuggcucacugcaaccuccaccuccuggguucaagcgauucuccugccuuggccuccagaguagcugggauuacaggcacaugccacuacacccggcuaauuuuuguauuuuuaguagagacgggguuucaccauauuguccaggcuggucucgaacuccugaccucgugauccgcccaucuuggccucccaaagugccaagauuaccagcgugagccaccgugcccagcgguccgugcuaauuacauauggugaaucucuagucgcuaaugugaugacauuugcagguggcacauuugggagguaguuagguuacaaggcuggagccaucgugguggcauuagugcccuuaucaaaacagacaaaagggagcuugcucucuuucucucucucugcucuugccacgugagaacauagccagaagacagccaucugcaaaccaagaagcaggaucaaaccaagaagcagccaccugcaaaccaagaagcaggugucacuggaucugcuggcaccuugaucuuggaccucccaaacaaauguuuguuguuuaagcuacucagccuaugguauauuuuguuacaguagccugaacuaagacgacuacauaggugacucuuuugaaauccucccauacccacauagcuugcuucucacaccugucuucccaggcauuccucaacuccucuggauuccauuuucacaucuccaaaauagcuccaacugggccuauaaguguuccccuaugcauccauauaugaugcaauguaacacaaaugucaguccuuauucugguugacuuuaauaccaguauauggguccaggauugguagcucacaccuguagucccagcaccuugggaagcugaggcugguggaucacuugaggucagggguuugagauuagccugggcaacaugacaaaaccccaucucuauuaaaaauacaaaaaaauuagccagacacauuggcacaugccuguaguaccagcuacucaggaggcugaggcaggagaguugcuugacccagaggcagagguugcagugagccgaguucacaccacugcacuccagccugagugacagagggagacuccgucucaaaaaaaaaaacaaaacaaaacccaauaguagaagguacugaccacugcccuuggcuagggggacaucaaucacacucuauugguuuucgaccugcccucugcuccuaccucuuacucagccauccuuguguuggcuuaucugcaucucccuggacuuuaaaggcuggaauuccuugagauucagucccuacauaccucuuuucucauuccauagucucucuagugagcuccuccauuuccugucuucgauuacuauccacauuccagauucccaaauuuauauucccagaccaggccuauacucccaacccuacagcuuugcauccacauagauuucucaaagccaucucaaaaucaacaagcccaaaacugagcucacguucuuccuuccaaacccgguccugugccagucaaugcuuacauuguccagccagaaaaugaggcauuguccuuggccccucucucuuccucacccccugcccagucaucagcaugaacugugaacuugaacuccuaaaucucucucauguaugucuaagccuucccaucucaggcacugccacuaccuuagucuaaaacaccaauacuuuaaccuagacaacuacaguguuuucuuaauugacuauacuaugcauccacucuuauucucaacccaaccuuggaccccuaagucuacacauagcuauuaaauuaucuuuuaaaaauucaaaccugauaauguccuuccccuguugaaaauacacuucaauagcuucucauugcuuuuaggauaaagaccaaaauucuucacauagccuauaaaguaugcgugauccugcccucuuucaguuccucaaacauaccaugccccaucuaccacaggccuuugaauuugccauccccauggcuagaaugcucucccucucuucuccccaccacacccucccaugccuacuugacuucuuguuuugcaucucgguuauggucaggucucaauuagaccaucucauugcucccuguacaguuucugugauuaucagauuaaagacaggucaauuauaggcuccaagaagguugaguccauguuuguccauaaaacuuugggguuuuuuguuuuuguuuuguuuuguuugagacagagucuugcucugucacccaggcuggagugcaguggugcaaucucagcucacugcaaccuccaccucccaaguucaggugauucuccugccucagccucccaaguagcuggaacuacaggcaugcaccaccauguccagcuacuuuuuuuuuuuuuuuuuuuuuguauuuuuaguagagauggguuuucaccauguuggccaugcuggucucaaacuccugaccucaagugaucugcuggccuuggccucucaaagugcugggauuacaggggugagcuaccacaccuggcccauaaaacuuuguuaaauuaaaaauugaaccauauaaaaugucacggucauugugucaucuuccucuguaaaauuauuccugaugaguuccugucuuccauaugaaagucuggcugucucuuuuaaaaacuuucauuuccuuugaaacuaauaauaauauacaauacaaauugaacuauuucauucuagaguaggaagaaaccuuggagaucauuguaguccaaacccucuuuauucacaugagaaaaauguaguucccauucaaaugagaaaaauggaacugcagcuuucaguguggugggaaggaaacuugcucaaggucaugcaaacacucacucuauaccuaucaaucauugcauuuggagguaauuaagcccuguaccugaaugccauaugauguuuauuuucaaugcuuuuagacucagagcccaaccaugcuguagaaagaacacuggacaaggaauucaaagauuuaaguuuaucccagugagucacuuaguagcuuugagauguaaggcaagccacuuuuuuuuuuuuuuuuugauacggaguuucacucuuguugcccaggcuggagugcaaugaugcaaucucagcucaccgcaaccucuaccucccagguucaagcgauucuccugccucagccucccaaguagcugggauaacaggcaugcaccaccacaccuggcuaauuuuguguuuuucauagagacgggguuucuccaugcucaucaggcuggucucgaacucccaaccucaggugauccacccgccucagccucccaaagggcggggauuacagacgugauccacugugcccagccacuuuucuuuuauucagccuuguuuuucucaagaauauaaugguagaaagaacauuugacuaugcauucaaagauuuaaguuuaucccagugagucacuuaauaacuuugagauguaaggcaagccacuuuucuuucuuucuuucuuucuuuuuugagauggaguuucacucuugucacccaggcuggagugcaauggugcaaucucagugcaaccuccgccucccggauucaggcaauuauccugccuuagccucccaaguagcugggauuacaggcacgugccaccaagcccagcuaauuuuuguauuuuuaguagagacgggguuucaucauguuggccaggcuggucuuaaacuccugaccucaggugauccgccagccucagccuuccaacgugcugggagccacuuuucuuuuauucgaccuuguuuuucucaagacuauaaugguauccuuacccagcucuugugaaaaucaugagugugaaugaaacaacuuuguaauaagaaauaauguacaguguacauaaaguguuaugcuauguaaguaaucauuguaccuacauuggggcaagaugaauuucugccuucauagcuaugaacugaugaaaauggagauuccuuuaaggucccuucucucuuccuagaagaaugauuagaguucuauuugaaauccauggaagggacucaggauuagaaauuaggugccugggacccaaacacagcucugcuacaaacuagucauguaccuucucacugucucccaaacucauauuaaaugaggaagauaauaccuguuccacuuccuucacuaaauuguuguuaucaucaaaaaucuugggggcaagugaaguucuaaguauaugaauguauacuguuuuuuuguuuuuuguuuuuuguuuuuuuuuuugagagggagucuugcccuguuacccaggcuggagugcaguggcaugaucuuggcucucugcaaccucugccuugcagcuucaagcaauucuccugccucagccuccugaguugcugggauuacaggcgugugccaccaugucuaauuuuuguaucuuuaguagaaaugagguuucaccauguuggcuaggcuggucucgaacuucugaccucgugaucugcccaccucagccucccaaagugcugggauuacgggugugagccacugcgccuggcccaugaauguacacccuuauuaagaguauaagaguauacaagguauaagcaucuaauagaacucauuaaagaccuucucauucagcauguaacagaagucauuuaaaaaucuuauuuagaggccaagcacagaggcucacaccuguaaucccagcauuuugaggccaaggaggguggauuacuugaggucaugaguuuaagaccagccuggccaacacagugaaaccccaucucuacuaaaaauacaaaaauugguugggugugguggugcaugccuguaaucccagcuacuguggugggaggcugaggcaggagaaucacuugaaccuggcaggcagagguugcagugaaccgagaucgcaccacuguacuccagccugggugacagagcaagacuccguuucaaaaaaaaaaaaagauuauuuagauauuuucccaaaucaaaccucuucugcacuuuaauccaugcuuagaaauagccaacagguggccgggcgcaguggcucaugccuguaaucccagcacuuugggaggccgaggcagguggaucacaaggucaggaaaucgagaccauccuggcuaacacggugaaacccugucucuacuaaauuuacaaaaauuagcugggcgugguggugggcgccuguagucccaucugcugaggaggcugaggcaggagaauggcgugagcccgggaggcggagcuugcagugagccgagauggcgccacuucccuccagccugggugacagagcgagauucugucucaaaaaaaaaaaaaaaaaaaaaagaaagaaagaaagaaaaagaaauagccaacaggcaacaggcuucuuucccaaaguuaguaacagcagaguugguauaagcgauaugaauuuuauuuaauauaauaauggacaaccccuucuuagaaggugguaaggacaacugucacacguaugucaacacaagugacagaaacauaaaaacacucucuaggaaacuguaugcaaagauggacacaguaguuccucaugugucuuccagugugacuucauugcuucucccauccagaugcugaguccauuucuauuucccuugaacuugggcuagcuuugugacuugcucugaccaacgggaugcagugaaagugagguuauucuucuucuuuuucuuuuuuucuuugagauagagucucgaucugucacccaggcuggaguacggugacgugaucucggcucacugcaaccucugccucccggguucaugcuauuccccugccucagccuccugagcagcugggauuacaggugcaugccaccacaccuggcuaauuuuuguauuuuuaguagagaugggauuuuaccguguuguucaggcuggucucaaacuccugaccucaagugauucacccucggccucccaaagugcugggauuacaggugugagccaccaugcccggccacguuaugcaacuucuaaggugauaaacuuggccuagcuuugugacuggcuuugaccaacaggaugcaaugaaagugacauuaugcaacuucuaaggugaggcuuuaagaggccuuacaacuuccaccuuugccccuuggaaugcccuccugaaaucaccaugaaagggggcaggucuagcuuauuagaggggaagaggccacaggaggaggaccagguuguccaagcaacagcaagcaccagcucucagacaugugaaugagggcauccuggaccuuccagcccagcugacccuucagcaagcagaugaaugugcccacaugaaaccaauagaguaaccaccacgcaaaccauguaaucagaagaaauaacacaucauuguuguuuuagacugcuaaaucuuaguaugacuuguuuuguaggaauagauagcuggaacacauuuguaugaauaagcaguggcaaagauacaugaaaccacacacacugaggcauguuacauagcucggaaagucacaacagaaugauggaugaacacugaaguuccagggaauaaacugaauagaauaaagccacauggaaugaugacaagaaucuagaaaagaaaauagaggccgggagcaggggcucacgccuguaaaaucccagcacuuugggaggccaaggugggcgaaucacuugaggucaggaguucaagaccauccuggccaacauggugaaacccugucuuuacuaaaaauacaaaaauuagccgggcaugguggcgcgugccuauaauuccagcuacaugggaggcugaggcaggagcaucgcuugaacccaggaggcggagguugcagugagccaagauugcaccauugcacuccagccugggcgacagagcaagacucugucugaaaaaaaaaaaagaaagaaagaaagaaaaaaaaaauagaaggacccaugugcaugcccaggcaagaaauaccaccauuccuucauuucuuuugacccucaaauaagcugucuuggaggacaaaauggaagaaaaacuagcguccucaguuuucugguuuuagauaucacuuucucuaagaaaucugcaauuccuacaaaucuggaccauguaccauuucuaaggucccucucgaagccuaggggaauuacuugcucacuugauuagaagcuuuuugagaccagagucccugucuaugugguucacaguuuuuuccuagcacaguagguuuucaaaaagcuaagugaauaaauuaaauuuaauuauaugcauucuccugcuauacaucauuauccaaguauauacuaaaaacaaccccaagcugggugcaguugcucacucccaccugcaaucccagcacuuugggaggcuaaggcaggaagaucccuugagcccaggaguucaaaguugcagugagcuaugauugugccacugcacuccagccuggaugacacagcaagacccugucucuggccagggacagugaaucaugccuguaaucccagcacuuugggaggccaaggcagguagaucaccugagaucaggaguucaagaucagccugaccaacagggugaaaccccgucucuacuaaaaacacaaaaaaauuagcugggugugguggugggugccuauaaucccagcugcuugggaggcugaggcaggagaaucacuugaacccaggaggcagacguuacagugagcugagauugugacauugcacuucagccugggugacagaaugagacuucaucuaaaaaaaaaaaaacaaaaaaaaaaaacaaaaaacccugucucuuaaaaaaaaaaaaaaaaaaggagaccuguguggagauaaucaagagacuuuggcacuauugauagucuccauuuaagacacagacacagacuccuggccuuuaucccugguucugaccacucugucccuuccaguucagugaauuuccuuucagggaauggggagggccaguggaugggguuaacuugugucauuucuuguaacuagaaacaugaccugccagcccucuagagcuccuacuaaguaucugguggccucuggacaagugacugguuagcugcuucugccagugugagcuuuaggacugaggccagcuggcaugccugccuggauuggaucaacuugccauuuacaacaugcuccaccagccuuagcgcuuccuuauuucacuuccccuuauaaucaacuaauguccccauccagguucuuauuuugaagaccacgccuuucgugggauuuuauuuuaggauuaauauguagucgcaauguuaaagcaagaguuugacuuacuacuuguugcaauuauuuuugccauaugacaagcuacucccaaacuugguggcuuaaaauaaccaucauuuaauuauauguuaguauuguaugcauugucugggguucaccugggcagcuccucuaugacucuagcuugggaucacucacaauuacaugcagaugauggccagaaguggaucguuggcucugcgguaccccucaaaauagccucucuccaguaaggaagucuggaccuggugaugcggggcucaagaaagaggaagcagaugcugccaagaugaguucuucuccuucucuucucccgcacccuccccuuccuucuucuuccagcuuuacucagagauaauucacauaccauacaauuaaccuauuuaacacguacaauucagugguuuuuaauauauaccucaugccuuauauaaaaauuaugucagcagggugcaguggcucacaccuguaaucccagcacuuugggaggccaagguggguggaucaccugaggucaagaguucgagaccaaccugaccaacauggagaaaccccgucucuacccaaaauacaaaauuagcugggcgugguggcacaugccuguaaucccagcuacuugggaggcugaggcaggagaaucgcuugaacucaggagggagagguugcggugagccaagaucacaccauugcacuccagccugggcaauaacagcgaaacuuugacucaaaaaaaaaaagaaaggaaaaaaauuaugucaaaauggauuauggaacuaaacauuaagagcuaaaauuauaaaacuccuauguuugaaagaaaacguaaguagcaaguuuccauaggcuuggauuaggcauguuuucuuagauaggaggccaaaagcacaagcaacauaacagagaaauagacaaauuggacuauuucaaaauuaaaaacuuuugugcuacaaacaauaccaucaagaacagaaugggagaaaauauuugcaaagacuaugucuaauaacagauuugcauccagaacauaauaacucuuaaaauucaaucauagaggccgggugcaguggcucaugccuguaaucccagcacuuugggaggccgaggugguuagaucaccucagguuggaaguucaagaccauccuggccaacauggcaaaucccugucucuacuaaaaauacaaaauuagccaagugugguggcgggcaccuguaaucccagcuacucaagaggcugaggcaggagaaucgcuugaacccaggagacggagguuccagugagccaagauugugccacugcacuccagucugggcaacagagcaagacugucucaaaacacacacacacacacacacacacacacaccaauauuugccugcugcaagcacucaccagguuuugcuugugcaugugagcugauuuccaccuuuccuggaucuauaucugacucagauuucccagacccguauuaaccuagagggaaggcagcacuacaauagaaggaacuacuacauuuaggggccaguacaagaauagaaauaagcugauagcgaucuccuuguacacugggaaaaaaaauucaaaagagcugaggaggcccuguguaaccugggaauagaugugaaugauguacaggagcaaaagccagggagggagacaaaauggccuguggggcuuaggucaaaaagaugcuucagaauuuagaaagagagcuuuaaaaaacaagucauguguuaauaugaucaauuauuuuuaaaagcaaaacagacugggcaugcuggcucacaccuuaaucccagcaguuugggaggccaaggugggaggauuacuugagcccaggaauucaagaccaaccugggcaauauggcaaaaccccaucucaacaaaaaauaccaaaagauuaguuggguguaguggcacaugccuguagucuuagcugcucaggaggcugaggugggaggaucacuugagcccaggaguuugaggcugcagugagcugugauugcaccacugugcuccagucuggaugacagagugagacccugucuccaaaaaaaaaaaaaaaguuaauuauucauucacccaaauauuaaaaccauuaccuuggccaggcaugguggcucacgccuguaaucacagcacuuugggaggccaaggcggguggaucaccugaggucaggaucuugagaccagccuggccaacauguugaaaccccaucucuacuaaaaauacaaaaaauuagccgggcgugguggugggcaccuguaaucucagauacucgggagguugaggcaggagaauugcuugaacuggggagguggagguugcagugagccaagaucgugccacugaacuccagccugggugacagagugagaaucugucuuaagaaaaaaaaaaaaaaaaaagaagcuaucugaccuaucuuguuugacuguaggucauaagacccccauuccagagagggucuuaccccacacucagaaggaaugcaugcucagaaaggccaagaagaaucuagauagacgggcuuuacuggguuuccccacugagucuauuaaccguagaucauacccuuuuuguccaaucauauuucuuucuuucuuuuuuuuuuuuuuugagacagagucuugcucugucacccaggcuggagugcaguggcacaaucuuggcuuacugcaaccuccaccuccuggauucaagugauuaagugauucucaugccucagccucccaaguagcuaggauuauaggcgugugccaccaugcccagcuaauuuuuguauuuucaguagagacgggguuucaccauguuggccaggcuguucucaaacuccugaccucaagugaucugccugccuuggccucccaaaguacugggauuacaggcgugagccaccacgcccagccuccagucauauuucuacacaacuguucauaauuucuugaacccuagcauaaaaauggacaauuuccccuguaucuuugggucuucauuuuaaagguuccuaugucacauaaaacuauccauaaauauauaugccuuuucucccuuggccccaacagcaagaaagggaaaguuuucccuuggccuugacagcaagaaaguauuaauuagggagaaaugcucacaugagcauugauauuuuuaaguacuaugcuauugucuauagagcacauguuacauagcuaaauugauauaauuuucauaauaauuugguuuggaacuaauaaacagcugcucaguuaauauuuaugaguaaaacuacugcauacuggaaaaggugaggaacaagggaagaaacaguacuuuauagucugacaacgaggaucuucuacccuccuucaccagccugcauaucagacacugaauagaacauacucaaucucaccuugguuccuuacucaugguguucccucacuucuucccauuuucacuucccugaagaaauugaaacuacacguccuuugcagggacauggaugaagcuggaagccaucauccccagcaaacuaacacaggaacagaaaaccaaacccacauguucucacucaucagugggaacugaacaaugagaacacauggacacggcccggggggaacaacacauacuggggccaguagcagugggagggcacggugcaugcagggcuuaauaccuaggugccagcaaaccaccauggcacacuauuaccuauguaacaaaccugcacguucugcacauguaucuuggaacuuuaggggcuccuuguacaguaauacagguuguucacuguacaagggaaccuagguucaggggcugaaauccaacuccaggccuucaugaccaguccuguguccuguguggaggugaggggcugcaccagcaugacggaaagagcagaaggugccuggcugucauucauauaaagugucaauggagauagugggacuauuuuaaauggacagauuaagcccuaaggucucugugaacauaucccaacuaaggagcaauccauacaggucuugcccucucuuugaauuuccucucuuuuuuuuucuuuuaaagaaauucuuugacuuccucuuuuuuuuugagacagaguuucacucugucgcccagguuggagggcaguguuguggaucucagcucacugcaaccucuaccuccuggguucaagcaauucucuugccucggucuccccaguagcugggauuacaggcgugugccuccaugcccagcuaauuuuuguauuuuuaguagacaggguuuugccauguugcccaggcuugucuugaacuccugacucagguaauccacccaucucauccucucaaagugcuggaauuacagcgugagccaccacacucagcuugaauuuccucucaauuuuuacguacuauuuuuaucccuccagugaaacuagaacuuucugaagaacaggcaccaugucuuaaauguuuuuauuucuuagaaaacugagcccagggaggagguauacauuaggugcucaacaaauaucuucuaaucaacugacuaaaaacuaagugaauaccauaagcaacaguaauggaggguguuauuuguuuuuggaaauaaaaucccuuccucuuugcuugcuauuucaaauuagcugaaagaaagaugagaacuuuuuaguguugguuuuacacucugaagagacugauauucuggaaaguuguaauuuucacauuccccauggguuuuaguguugccuucaacagccauuuucagaaucugaaucagcuuuagauagaagccaaguguggauucucaggccauggccauccuaaaaggccacauucaacuaugguuucaucaccacaaaauuauauaagaaggagagaaaccaagugcuuguacccucaauucaaaacaauucaaaccucggugagccuuuucaaacaaaugucaagggaagcuggguucuaaaaccuauuauaaaggcucauuugacaggaaugguuauuauuuauucugaaugcuuucauaauuauuagaaaauagaagaaauugauaccaaaacagagaaagaaaggaggaguaaauaaagauacuuaggagagguaagaugaagugaugaaggaaaacugaugacaaucugggaaaauugauguguguguguguguguguguguuuguguguguguauauuagauagugucuaaccccgucaguggugugaccacaccucacugcagccuugacuuuccaggcucaagcaauccuaccaccuuggccucccaaagugcuggaguuauaggugugagccacuucaccaugccaaauauauuuaaaagauauaagaaacauggcagggugcugucgcucaugccuguaaucccagcacuuugggaggccgaggugggcagaucucuugaggccaggaguuggagaccagccuggcaaacaugguaaaaccccaucucuacuaaaaauacaaaaauaauuagcugggcauaguggugcacgccuguaaucccagcuacucgggagguugaggcaggagaauugcuugaacgggaggcggagauugcaaugagccgagauugcaccacugcacuccagccugggugacagagagagauuccaucucaaaaaagaaaagaaaaagaagaaaagaaaagauuagcaagguguggugaugcacaccuguaaucucagcuacucaggaggcugaggcaagagaauugcuugaaccugggaggugaaggcugcagugagcugagaucgcaccacugcaguccagccugggcaacagagcaagacuucgucucaaaaaaaauuaaauuaaauuaaauuuaaauuuaaaaaaagaaacaaugauaaaauauugaacacaaugaucaguaggaacugccuuucuacauaauaacagguuaggugauagcagggcuucucugucccucauauuuguggaagcaguauaaaaagacaagagaagcagucuccgcuuucauuauucaaccaagguguuuuauauuauuaucuaaacacaaauuuuaaaucacuacuuugguauaucuauggucaacugauuucaacaagggugccaaggccauauaacgaggaaagggucguccuuucgacagauggugcagggacaguuagauagucacaugcaaaauacagaaguuggauccuuaaccucauacuacacagaaaaaauaagccuaaauagauuuaaaagcuaaauguaaaagcuaaaacuacccuucuucugggauuacagucuggucgcagugauucgcaucuguaaucccagcacuuuaggaggcugagguggguggaucaccugaggucaggaguucaagaccagccgggccaacauagugaaacccugucucuacuaaaaauacaaaaauuagcugggcaugguggcgugcaccuguaaucccagcuacucaggaggcugaggcaggagaauugcuugaacccgggagguggagguugcagucagccaagaucacgccacugcacuccagccagggugacaaaguaagacucugucucaaaauaaaaacaaaaauaaaaacgggcaaaugaucugaauaaacuaaaggaaauauaaaaauuagccaauaauuacauagaaagauuugcaucagggaacugcaaauaaaaacuauaaugacauaacauuucauauccgcuaguuggauagaaacaagacagagaacaaguuuugacagugauauaaacuagaagccucauacacuguuggugggaauuugaaauggugcaggcacuucagaaaauagucucacaguucuucaaaucguugaacacagaguuacuguaugaucccgccauucuacuucuagguaugugcccaagagaaaugaaaacauauauccacagaaaaccuugcauaugaauguucauaacgauauuauuuauaaaggccaaagaguaaauacaauccacauguccaucaacugaugaaacugaaaaugugguguaugcauacaaggaauuaguuggcuauaaacagaagugaaguacugaaacaagcuacaacauggagaaaucuugaaaauauuauaccaagugaaagaagacagucacaaaaggccauacauuguauuauuccauugauauaaaauuaucaaaauacagaaauguggucgggcaugguggcucaugccuguaaucccagcacuuugggaggccaaggcggguggaucaccugaggucaggaguuugagacugccugggcaacauggugaaacccugucucuacuaaaguuacaaaauuagcugugugugguggcgcaugucuguaaucccagcuauuugggaggcuggggcaggagaauugcuugaaccugggagguggagguugcagugaacugagaucacgccauugcacuccagccugggcaacaagagugaaacuccgucucaaaaaaaaauaaauaaaaauuaaaauuaaaaaaauagagaaauguauagagacagaaaguagauuaauguuugcuuagggaugaggggguagaugaaggcauaggggagugauagcuaugggguaagggguuucuuuuugaagugaugaaaaugcucugaaauugacugucguaaugguugcauacaucugugauuauacuauaaacaaaguuuuuaaaaaguauaaaauuaacuuauaugcuuuaaauaggcgaauuguaugguaugugaauuaugucuucauaaagcuguuaaaaaucaguauuuaguacuuucauuuguucauucauuuaauaaauauauuuuuuaauucuuauuuuuauuuuaguuuuuauuuauuuauuuuauuuuuugagacagagucucacucugccacccagacuggagugcaguggcacgaucuuggcucacugcagccuccaucuccuggguucaagagauuuuccugccucagccucccaaggagcgggauuacaggcaccugccaugaugccuagaccauuuaaauaucuauugagcaucaucugucucccaggauaugcauaaaugaaaagacguggcccuuacucuuaaguugccuacuaucagauggggaagcaaauguuaaaaaaccuaugugcaagacagauaaaugcuguaacagagguacagguacauacaagaugaaggggaagcaagagaaugaaauacuuaagugucagagggcacuuucaaguuccaaguuaagaagaaauggaaguugguccuucgagauggugagaggacacaggaucaaggagcaaguacaaaugcauggugcaaaugagaggucaggacaaaucaugugguacugggcagggagaggaugggggagggcaggagagcaaagcacagggagcuaagcaugggcagcagguaaagauuaggucagaaaugcuucauugccuauaggugauagccauggaaaaauucugagcucaagagugucaaucaggauaaagaugacagcauaaugauccuuuuguacugugauuauccaucaccuuuucacuuucauuauggcaacagugcuuucaguucagcaagugucucaggcacauacuggauacgccgcccugugcuagucacugggaauauaaagauaaggcaaaauuuccacuuuggaagaucaggaggaagcaaaguaaacaaaccucuugaaagcugggaacugcucuuauauauaaugauuucacccacuggcuagaaaccagaagggguucaucagagccaaagcaucagugacuaacuucagucuagggucgaugggaaaaagaaacagcaagcaggagccacuggugugcaggcagaugcuuggugacucucaaccaucucagcauggacuaggagaaaggaauggcuugcaaaagcagaauaugauugaaagggaaaacuucacaguucuuucugaauacaucuguccuagcacaggaaggaaauauaaugaguacaaaacaguacuccagagccacacaaaagguguugggaugaucuggucaauuaccuugucccccuuucuugccuaugaacauccauggcuccggagagguagcggcaggagggaagccauccuaggacuucuaaacugcaguugggugcuaugauccugagcugcuucuuguacauaaugaggacaauaauacuuaccuuaacagaaucauugugaaaauuagagcuaaucuguuuaaagcaucuagcauauugccuagcauaaaguagcaugaacaagugauauacaagguucauacacacacgccccucagagcugacccuugcagaggcuggaugacagucugaacuggccagaauaacaaauuccaggcaucuggagagggugagggaagaagggcagcaucagguggcaggugaaacagagaaaagccaagaaguuaaguuacuuaaaagaauguuuuauauucuagaagaaacuaacaccaaugcaaaaguuaauuuuguuuagcauauuaaaccuugguagaacacagagaacuuuuuuuuuuauuuuauuuuuugagacaaaguuucgcucuuguugcccaggcuggagugcaaugguacaaucucggcucaccgcaaccuccaccucccagguucaagugauccuccugccucaaccucccgaguagcugggauuacaggcaugugccaccacacccggcuaacuuuguauuuuuaguagacaugggguuucagcauguuggucagguugaacuccugaucuccagugaucuaccaccuuggccucccaaaguacugggauuacaggcaugagccacugcacccggccucagagaacauuaaaaaaaaaaaaaaaccaaacacuauuuggguggugguuccacagguauguucaguuugugaaaaugaauugagcugcacacuuaugauauguucaguuuauggagauuacauuucaauaaauuuaacuuuaucauuaaaauuuaauuacaaauuuaacuuuaauaaaguuaaaaauguuauucagauuuucuuucuuucuggacugaaacacucuuuuguuagggggucugaaauuauuaaauguuuuuugucaauuuggugccuuuuuccauuugguggaacaaugccuuuguuuucccuccgaagcucugugugaagggacugcaauuaagcggggauguuuucauuuagcaaacaaagcaagaaaaacaauacagcaacuacaccccuuggaaucaucucugcgcuuaacaacaaagcgcccgaccaaccgagggagccuugguuugcguggacaaagccuuucaucauggaagaauauccuccuccuuuaaaaccucccagccaugccuuccacugguaucacucuucaaauauccacuuuuacuucaauacgugccucuucucucagaaggccccaaccccguugcugcucugucugugucuuagaacguuuagcacagccuaacgcugacccgugugccuucauccauuggcucuagaaucuccacacuuaaaaauaaacaagagggauuuccucuaggaagggcucugaguuuuagucucucuuccagauggaaucaacugacccucuguggcagcuaggguucuuggauucaaaacaugcugaacauggcauucaauuucuauagguucacugcaaggaauuuaacuuuuuuauuuuuaaugcagaauugugggaaagugaagagccuaugccaugagcaacuguuggccagaaucacucuuuagcaaauggaguauugaaagcaucuacuuagcccaucucaaauuaaccuuccuuauuuguaaauuggugaugaaaauauuuucuucuuagagguguaggaaggauuaaaugaacuaauauguaaaaaauacuuaggaaggugccuagaacauagaaauccucaguaaaugauggcuaagauuauuauucuuaucuucugaauuuuuaugaucagaacccacaaccaauaaacacaaauagagugaccuagaauaaucaauaucuucuacuaguuuuacugaaauuucaacauucuucagguuaggaaaaggaggaagggacugccuauugauuucuuuccuaauuaagaauuaccaugcauucaucuaucuauucaucucuucaacaaacauuuauggggcauaugcuauguauguauaccaaaguugugugaggccucaaggugcaugaccucagagagcuuauaguucagcuggagagacugacacaucaagacucaaucacccuguugagauggcugcugugcugggacccaaggugauacagaagcagagaggaagggugucaaaauaauucauuauaggcugggcgcaguggcucacgccuguaaucccagcacuuugggaggcugaggugggcagaucaugaggucaagagauugagaccauccuggccaacaugguuaaacccugucucuacuaaaaauacaaaaaauuagcugggcuugguggugcgcaccuguagucccagcuacucaggaggcugaggcaggagaauugcuuaaacccaggaggcggagguugcaguaagccaagauugugccauugcacuccagccuggugaaacagcaagacucugucucaaaaaaaaaaaaaaaagaaaagaaagaauuaccaugcaaucauuuauccauucaugucuucaacgaacauuuauggggcauaugcuauguacguauaccaaaguugugugaggccucaagguacaugaccucagagagcuuauagucaagcuggacagacugaaauaucaagacucaaucacccuguugagauggcugcugugcuggaacccaaggugauacagaagcaaagaggaaggaugucaaaauaauucauuauaauccagccauauuccaugcucuuacaacaguggccacuaaguguaucacgugccaacuucaaccaucacaucaugcauaguacacaaucagaagaaaacaaaacaaaacaaaaagagcaaguggcuuuuccauuuauagaguguggauaauucugccugccuguccacucaaggagaugggagaugaacucgucucacuuuccaaguggauuucacaggcucccagccagaaauaacaaggcuaugcaaauggguuaauaaaaaagacaauuuaggcccagagcgguggcuaacgccuguaaucccagcacuuugggaggccgaggugggcagaucacgaggucaggagaccgagaccauccuggcuaacacggugaaacccugucucuccuaaaaaaaauacaaaaaauuauccgggcaugguggcgggcgccuguagucccagcuacucgggaggcugaggcaggagaauggcgugaacccgggaggcggagcuugcagugagccaagauugagccacugcacuccagccugggcaacaaaacgagacuccgucucaaaaaauaauaauaauaauaaaauaaaaauuaaaaagacaguuuauaauaaaggaacuaccaaagcuauggguaggguuaagggaaauuauaaaggacggugaagcuccuggucugacagaacggggugggguggucauuaacaacuuuaggccucaggauuguagagagagaccaguuuccagagcccaaaggggacagauguuaacgggagggcugcaugacaguaaccgugacugaugugguuuggcucugcguccccacccaaacucaccucgaauuguaauccucauaauccccacaugucgagggagggaccugggugggaggugacuggaucaugggggcaguuucccccaugcuguucucgugauagugagugaguucucacgagaucugaugguuauauaaguguuugagaguuccuccuacuaucucucucacccucaccugcugucauguaagaugugccugcuuccccuucugccaugauuguguuuccugagaccuccccagucaugcagaacugugagucaauuaaaccucuuuucuuuauaaauuacccaaucucuggcaguucguuacagcggugugagaauggacuaauacaguggccuucaauggcagggaggaagcaggggaauaaauacgcucaccccaaucuccuuccuuccaccuacuuccuacuagugccucccacugacugagcugaaccagaagccaaagggcaauggacuccggugaaaccguccauguaagucagccucuuggggacacagcagguuggaaaaggauagagaauggaucuggaaggacaaacagaaaugucccacauacaagcugaauaucucaccaugcugaauacaauucuaguauaggaaggcauguguuuuuuaugcagcuuggguagcacaaggauacuuuagacuacaugcauugcauuuuuccuuguuuauuagaaaccuagcauauccugcauuagaugaaacuccacuggauuuuaucauguccucacaauaugccugugaaguaugcauuuucuucccauuuucccaugaaaaaacagagacucagaaaagcugaaugucuugcuaauaaggggcaggauaagaacucugacauguccuucuucaacuccagaaaacuuaaaugauuucugcauucuaucaaguugaaaaauuacuacagagauggauuagcaaaaucaguguuacagaaacuugguucauagcccugacauuacauaggauuaggaaaacuuggcggaaguagccagcacagucaaucuccaccaucaaugaguccagucuaccauucaaauagcaauauauuuaccuuuaaaucaagucacggccggacgcgguggcucacgccuguaaucccagcacuuugggaagccagggugggcagaucgccugaggucaggagaucgugaccagccuggacaacacugcgaaaccccgucucuacuaaaaauacaaaaauuagccaggcgugguggcacacaccuguagucccaacuacucacaagguugagacaggagaauugcucgaacucaccaggagguggagauugcagugagccaagaucaugccaccauacuucagccuggguggcagaaugagacuccgucucaaaaaaucaaucaauaaaucaauaaaaaauaaaucaagucacuucuacauacuaagccagagcuagaaaucugcagaugacaaucuagggcugauggcuucuggcaagcacagcuggccggcugccuguuuugcauguuaacaaauugccauauauguuacagcagggggaggggggcauuacaaagaaacgguaagaaggaugugauuuccaaaacuagacccaaaaaguuggcaugagccaagugacagacacuuuuucccccacucauuuaaaaauugauuaagcugcauaccguuuaucuuuauuuaguggguucauuacuguugcugccugggacugaaggaaaaaguuaagaucauggguccuagagcuggaaaccaggguuugaagaugcucucccacacuuuccagcugugugaauuuaggcaaguuagcuaaacucucuagacucaauuucccuauuuuccaaagggagaauaaccauauuuaucuucuugguuuagaacgaagcuuuuagaagauacuuguaaaguucuugguauacaauaagcaucaguaagggcuacucgcccuggguuugcugccuucaucauuaucaacaucuccaggcuuacucugcuaucucuucaacuccucugaucaaaaacaucuggccccaacuguuuagauaucauuuuggcuuucucuugcuugccaguacacugauaagauaagccuguauguuccccacucccugccuuuuuguguguuuuaaaauauugauuuacuuuauuuuuuauugugguaaaauauacacaacauaaaauuuaccauucuaaccuuuuuuuuuuuuuuuuuuuuuuuugagauggagauuugcucuuguugcccaggcuggagugcaauggugcgaucucugcucacugcaaucucugccucccagguucaagugauucucucgccucagccucccaagaaacugggauuacaagcauaugccaccaugccuggcuaauuuuuuguauuuaguagagaugggguuucaccauguuggucaggcuggucuugaauuccugaccucaggugauccacccaccucagccucccaaagugcugggauuacaggcaucugccaccacgcccagccccauuuuaaccauuuuuaaguucaguagcacgaaguacacucauagcaguguacaaccaucagcaccaucccucuccacaacuuuuucaucuuccuaaacuguaccuuuaaacccauuaaacaaugacucccuauuccccccuuuccccugcuccuagcaaccaccauucuacuuuccaucucuaugaauuaacuguucuaggugccucacacaaguaagaucauauaauauuuaucccuuuugugaugagcucauuccaccuagcauaaugucuucaagguccaucucuguugugaagcaugugucagaauaauuuuucuuuuuuuuaaaauuauuauucuuuuuuuaauuugagacggaguuucacucgucacccacgcuggagugcaauggcgcgauuucggcucacugcaaccucccggguucaagugauuguccugccucagccuccugaguagcugagauuacaggcacccaccaccacgcucgacuaauuuuuguauuuucaguagagacgagguuuugccaaguuggccaggcuggucucaaacuccugaccucagguuauccacccaccuuggccucccaaagugcugggaugacaggcgugagccacugugcccggccauauuuuuccuuuuuaaggcugaauaauauuccauuauauguggcuaucacauuuuguuuauucauucaucagugaacacuuggguuacuuccacuuuuuggcuauucuguauaaugcuguuuagaaauaugggugugccaauaucucuucaagauccugcuuuucuacuuuuggguacauacccaaaaguaggauugcuggaucaugguaauuacauguuuuuuuugcuugguuuuguuuuguuugagauggaguuucacucuuguugcccaggcuggaguguaauggugccaucuuggcucacugcaaccuccaccuccugcguucaagcgauucuccugccucagccucccaaguagcugggauuacaggcaugcaccaccaagcuuggauaauuuugaauuuuuaguagggacagaguuucuccauguuggucaggcuggucucgaacucccaaccucaggugaucugccugccucggccucccaaagugcugggauuacaggugugagccacugcgccuggccugguaauuacauguuuacuuuuuuaagacacuucuauaccauuugucauaacugcugcaccaucuuacauucccaccagcaaugcacaaggguucuaauuuccccacuuacucaccaacacaaauuuuguuuguuuguuuguuuaaaauaauagccacacuggccgggugugguggcucacaccuguaguuccagcacuuugggaggcugagucaggcggaucacuugaggucaggauuucaagaucaaccuggccaacauggcaaaaccccaccucuacuaaaaccgggcaugauggcacaugcuuauacucccagcuauucgggaggcugaggcaagagaaucacuugaacccgggagguggaguuugcagugagccgagaucgcaccaaugcacuccagccugggugacagaauaagacucuggcucaaaaacgaaaaaagccauacuaauagaugugaagagguugccucccaccacuuguuuuccaauagcucuguguucacacaugcauuuuaccaccagucccuugguauaaccaaauauguagacacugacuaguuguucuacucugaggaaagaggacugagcucagcuaccuggaugaaacuagacaugaggcugccuccugagacggcccuuccccggcagaccaagcuugccgcuacagaagaugagcgagccaacaaaguuaggugaccuagggcugguuauuugcaacaugcaagcacacucuuugacauacuuuaaaugacacuuauaauuuaugagacauuguuuacauagagaaauuauacaguauaaacuuuuuguugaaauuuagaguuauaaaacacugaguuugcuuuauguagucucuucaguccccaagaccccugaugggcaaauuacaaagcaucugaauaaccugucaggcuagacaacuuugcauggcuuccuauaaagaaauuagagaaacacagagagagagagagagagagagagagagagcaagaaggaacacaaugaaaagaaagaaagagaaagaaagagagaaagagaaagagagagagaggggaaggcagagagggagaaacggggagggagggagggaggaaggaaggaaagaaggaaggcaggcaggcaggcugggugugguggcucacaccuguaaucccaacaauuugggaggccgaggcaggcagaucacuugaggccagaacucugagaccaaccuggccaaccuggcaaaacgcucucuacugaaaauaaaccauuagccaggugugguaaugcacaccuguaaucccagcuucugggguggcugaggcaagacaaucacuugaacccaggaggcagagauugcaaccagccaagauugugccacuguacuccagcccgggcaacagagcaagauucugucucaauuaaaaaaaaauugaaaaaagaaagauacagauuucaggagcaucuaacaaacauguauuucuaggugaaaaauuucccauggcucuaagcugcacaugaacaauaaaaccacuuaaauuuuguucuaaaguuauuaaauacccugugggaagagaugauggcccuuuaaaauuagcauaggcuuaaaacuuuuaaaacuaacuucuuuucugaaaucuuucauauaauccauuuucaaauuucauguuuaugacauuuacuuauaaaaguuaaacagagaaaccuauaagguagucuugauuacacaaaaaauaaagaaauaagaggauuggugaggauaauuacaguuacuccaaugaucagcuacggaauccaauuuacuuguacauuuugcgguaguuguuagaagauaacucuuuaugggucucucagauuucuuuaugucuuauaagcagaagcacugacagcuuuuguuccagacuagcuuuucaagaauuuuuguaaagugaacagaccuaagagauaaagguaguauuucuuucuggagcaacagggcagauuuguuuucugccagcauaaugaagauaacaucuuccuuaucucagacagagggcaaguuuucuugaagaccauuauaaaauauucagguuccugaagcuuaggguuccucugcugucacacagcccacugcaugugcagguaucacuugccccucacugugcuguucugugagaacuauggcuugggaauugauucauuaaaauugaugauacucuggcuguugcucuuccugagaguaaugagcugucuuuguccagaggucuucuguuuucugccaguauccacaaaaugguggcagcaaacuugugagcuugcaaguaggguaaaaaucucagacuccuaacaguucuugacauuaguuacauaguguaaacaucucuggucacacaaacagaaaguuacaaaagguaacaacuuuaacccacucacauugcaaucuuaggacauuguucaaauaaaccaagaaggccgggaacauucauucuaaaauuauauguaaccacuagggcagcacaaguaaacugugaaagugcauaucuaugcauauauuagaaaauauguauauguuuugagacagucuugcucugucacccaggcuggagugcaguggugcaaucaugggucacugcaacucugccucccggguucaagcgauucuccugccucagccucccaaguagcugggacuacaggcacccaucaccacgccuggcuaauuuugguauuuuuaguagagacuggguuucaccauauuggucaggcuagucuugaauuccugaccucgugauccgccugccucggccucccaaagugcugggauuauaggcgugagcccggccagaaaauauuuuuauuacaguuugcaauuuguaaaacucaggaucucaguuuaagaaacauuucuuuuuaaaaaauuacuuuauuuauuuauauuauuauuuuuuagacagagucucacucugucacccaggcuggagugcaguggugugaucucagcucacugcaaccuccgccucccagguucaagcaauucucccaccccagccucccaaguagcugggacuacaggugcccaccaccaugcccagcuaauuuuuguaguuuuaguagagaugggguuucaccagguuggccaggcuggucucaaacuccugauguaaagugaucuacccaccuuggccucccaaagugcugggauaacaggugugggccacuacgcuuggccuuauuguaaaauuaauagaaacagucucacuaugcugcccaggcuggucaccugaaaaacaccucuauacuggaaauagaacaagauggagacaaaagcuugaagacuuuuuuuguuuguuuuucacuccaguuccuuaccuagggucuaucucagucauuaaaccucucuccacagcucaugucccccauuuuuauaaugggaauaauuaugccugcuggauauaacucacagaguuguacagaggaucaaacaaauuaauguauaugaugguuugugggcucuaaagaggccagacaaggugaauucuggcuauuguugcuuguuauuaaaagcaagcucuguguagcucaugguacaggcucagcagcuuauagcgaucacaacauguagagcccuuuguucauucaacaaauauuuauugucccaggcacugggagagaacaggagaaagauccuaacacacaggguagagaaacuucugauaagauaaaacacgcagaagggcuuugccucuuuggauguacucucucccuuuuauuucucuuugguccuguggaaaagaaauugaaggaagcaguaggaauucaauagacaucuaauggcauacgggcuuguuaagccaauucuucaucaggucuaaacuccuaagcaggauaaagagacuaauaguagcuggagauagaaacuccugcugcugagaaaaucaaggcccuuuggauaaaaaaaaaaaaaaaaaaaacaacuagacuaaugugucuaugaaccagauuaagaggggauuuaguuccauaucaaaacugagguugaauuaaaauuaagaagucucuucuaaguuugaagauaaaaucgaaguuaguuuaaaauauacauuucaacuacuggguuuagugaggaaaaaccaaauuguaccucaaacacacacucacuuuuauagcugauuuuauuuguuacuauacagaggacuugauaauccugaauucaacuuuuuucuuuucuuuucuuuucuuuuuuuuuuuuugagauggagucuugcucugcugcccaggcuagagugcaguggugcgaucuuggcucacugcaaccuccgccuccuggguucaagcaauuuuucugucucagccuccugaguagcugggauuacaggugcaugccaccacgccuggcuaauuuuuguauuuuuaguagagacaggguuucacccuguuggccaggcuggucuugaacuccugaccugaagggaucugcccgccucggccucccaaagugcuggguuuacaggugugagccaccgugucuggccagcuuuuuucuuaaauaaaucuauuuugccaaucaaguuuugcaguggggaacaugcacucaaaacccuuucuaccaucuuaaggccgcggauagagauucaacauuguucuuuuaaguuaugaguacuauccugcuuauaaagguuuccuuugagaaguaaaaauuguacuguuugggaaaaugugacuuauguucauguguugagugucuuggguacuugugcccaugcaaaauuaaguggagagcuguaagccccucccgaagagacaaaaugcuaugccuuauucuuugcacccucaguccauuugcuggccauaaugaagacucagcagagcuuagagcuuguugaugaaaguguauugugcccugaauguacuuagaugaauuccucaaaaugacaacaucagggcaucaauccauaagcacacacucuuucucauacucccccacagcuggcagcaggaggugagcaauagcauacacucauaucugaugcgggcccuguccugugugcauacucauuaguccauuuuacucccacaacaagucuaugaggucaggauggucaguaucuccauuuacuagauaggcaaauggagacagagagagagaaagccacaugccccaaggcauggagccaagauucacacccagguagcugggcuccugggcuguuaucugcuaugcaaagcugcaucuuaaaauaauuugagaaaacaagaauaggugucacguauuuauauuauuauuuacuacucuaauaacaacagcuaacauuuccuaggcucucaguccaugucaagcagugugcucagcacuguacagauggaucucggucaguccucccaacagccuuuuccagcagugggucccagccuuaucuccacgguagacugcagaucacagagauuuagucagccugcugaagggcacaaagcaagcaaguugugaagcugggauggaagacccaggcugugugacuccagagccuacagccauugccacucacugugcaggacgauccaugccuccaguuccucuaaagcuuuccucacucacacuggggcaacuugaaagggccagcuucuugcuucuucauuaguguuuguuccagcaugucucaaguaagguaacuagagugacauacauacuaagagccagcagaguuacugaaauuguaguuuugagaccuggguuuauccuaccaacgagcagacugagaaacaccacuauggguuagaaagccaggguacccaggccgggcgcaguggcucacgccuauaaucccaacacuuugggaguccgaggcggacagaucacuugaggccaggaguuugagaucagccuggccaacaaguuaaaaccccaucucuauuaaaaauacaaaaaauuagccagguaugguggcacacgccuguagucccagcuacuugggaggcggaggcaugagaaucgcuugaaccuaggaggugaagguuguagugagccgagaucaugccacugcacuucagccugggugauagagugagacucuuauaaauaaaaauaaaaauaaaaaagaaagccaggguucccaaaaaucaacaugguucagcaaaaccucagucagaaaccacaaaguuucacaaaguccuauuuauaacacagaacaaacaagcaagaaaagagccaaaaagaaauacugacaauacgcccacccccucagagcugcugagacagcagcagccccaacaccugccaccccagguucaugucucacccugucccucgcaaacugugucaacaucacauauaaauuacuuaaaugcauuggaucccagaugcucccucugaaaaugggccaguaaaguaaugcuccaucuauuuuaaaaagaagcuuagguaaaauaaucuaaaggaagugcauuaagaagcuuaacuuacaaauaauaaacauugugugugugugugugugugugugugugugugugugugugugugugucuugcucugucucaaagaaagggggcuugaacuucccagguucaagcgauucuccugccucucagccucccaaguagcugggauuacaggugccagccaccacgcccagcuaauuuuuauauuuuuaguagagauaggguuucgccauguuggccagacuggucucgaacuccugcccucuggugaucugcccaccucagccucccaaggugcugggauuacaggcaugagccaccacauauuacuugagccaccuucacaauuaacuggaagccacaggagucagugauuuagggaaaggggugagagcggcaugaguccucuaggcagagggaacagcacaugcagaaguauaucagauugccacuuccccacucccuccucuccaacggccucccauuacauuuaaaaucaccaguucuuacugugguuuuaagggccuuauuaugaacuggcccugucucaucuccugcuacucuccucuuuacuucugcccucuggacacucuggucucauuacugcccuuaaauauguccagcacauucccaucucaaagccuuuauccuuaccguucccuuugccugggauguucuuccaccagauaucugcaaggcuuccuuuauucaaauguugucucuucaaaaacgucuuccccgaugccccuauuuaaaguaccccaccacccucaguaagucuauuuuucuuucuugcaccgacgacaccuguauuauacucugucacaucuucaugugucugugccuuuaaugucugccucuucaacugaagugcaagcucaugaaggcaggggcuuugcuacaggcauuucuggugucuuuagcugugccuagcauguggaaagggcucaaucuauauuuguugaauaauuaaugcauuaaugcaucuccugaagggaaagaagaugcucagagauacacagugcugugugacuggcccauaggauggaagggagauccaacagaacaugaggcuggaguaagucugcuuucuagaagaugugagcaacuuuaacucuucuuacugucuugccaucauaacuaucccauuaagcaauaacaguucucugccagacauuuucaauuauagcugaucccugccccacagugugguuaugcagaucccaagagauaagcuguagcuagagaagaguguuauaggugcaguagcucauggcuguagucccagugcuuugagaggccaaggcaagaggaucacuugaggaccagaguuugauaucagccugaacaacauaaugagauccugucucuacaaaaaguuaaaaaaaaaauagcuggacaugguagcauaagucuguacucccagcuacuugggaggcugaggcaggaggaucacuugagcccagaaauugaagguuacagugagcuaugauaaugccacugcacuccagccugggagacagagcaagcuccugucuuuauaaaauaauaauaauaauaauaauaauaauaauaauaaucuuuuuuaauuaaaaaaaaaggaaaagcguuuacagaauccacuggccuucauccuuggagaugacaugcauguuuuggccaacauagaaucauuguuugaaaggaacaucauuguaauugaaauaccuaacaccugcuagaauuuuacaaaaggaacuaagaaauuaaaagaaaguagcaacaaaacaaaugcacauguucaaguaaacaaauggagguucugauggaucccuuccauucaaauucaugugagucagaaagaugagagaguuucuccauuucaguauagaaagcaagugauaguagacugaguacaaauuaggacaucaaauggugaucauuccaccucaagaaacggagacaagaacugggacagagcgcauaacacaggaaggacacagucgaggguggccgucaguacugugcucguauuuggaauggcuaucaucugugaggucuuacuacacaccagagacccugagcuaaauacuuaagcacuugacacagcuaucguuuaacucccacaacagcacuaggagguagguucuauugcugcugucaugucacuaaugaggacacugagcuuuacaaagguaaggugacagggcuacacuucaaacucugucuggcuuuuaaccaucaugccaauuaaucugaccacucagacacccacccagacccuuacccccaaccacuguacaacaggcucuuuuaugugacaaauauguuuuguuuuuuuuuaguuuugagaugaugucucacucugucacccagguuggagugcaguaacgugaucccggcucacugcagccucugccuccugguuucaagcgauucucguacccagccuaccaaguagcugggaugacaggcacucaccaccauggugggcuaauuuuuguauuuuuaguggagacgggcuuucaccauguuggccaggcugguuuccaaccccugaccucaagugauccacccaccucggccucccaaagugcuaggauuacaggcauaagccaccgugccuggccgauaaauacguauuuuucaauucccucaagucuuguaaggcagccaggguuacaaagcacgugccauugcuucugcaccccuuuuucuaaugguugcccuggaaaacuaaaugaggaaggcagaaugguaaagaggccacagaaguagcagaucaacccagagauggccacucagaagauucgagacccaccaaccaaaaacuccugugcuacacuauacuuaucucuugaaagggcugaaacuuguuccucauagacauccagcuaucugaaguucucucacuacucaucuccuggccugaccaauuccccugcucucgaugcugcuucuccagucacuuacaagccugaaacuccaauuuacaaaacaacaguauuuaaaagaaaaaagggggccaagcacgguggcucacaccugcaaugacagcacuuugggaggccgaaguugguagaucaccugaggucaggaguuugagaaaagccuggccaacauggugaaacccugucucuacuacaaauacauaaauuagccaggugugguggcucaugccuguagucccagcuacucaggaggcugaggcacgagaaucacuugaacccagaagacggagguugcagugagccgagaucaugccacugcacuccagccugggcaagagugagacucagugccaaaaaauaaaaaauaaaaauaagagaggaaaggggcauccacaucauuugaugguaaacaaaaauucuggagcuuuguagaaucaacuuaaauacagaaaauaagauuuaaguaaauucuuuauuaagaaccuuaugaaauugacuuauuuucuggcaaagagacagcaaaugcuugauaguuuucucauauggaaaagaacaguuauguaaccagcccacauagaaaagccacgcugaaaucaacauaaugagacuggcacaguucugcuucuuucuauaagucaagauuacaggggggauuucaugcggaacauacuuuucauauagccucuguccucucauaaaggccuucacuucauuauccaaugggaaggugccgucauccuuucuaaagcgguagaagaguuugacauccuugaauuccuuaugcucaucacacacugaaacacaauaugcacagagaagcaaaugagaaaaaaaaucgcucuuauuuaauuacucaagcgaaguaugaugcuaauuaagaauuauuucacuaucacauucuucaugcaugcaaauauguaccauaugagcuaauacuuguaaaauaguuacauaguacuugguacagaguaaguccucaguauuuuuagcuauuauuaucaccaucaccaucaccauagucaucaucaucaucaucaucaucaucauauuuaggaaguucacacaauucaauucaucaugcaauccacaaauucuucuaaagcauauuggggcaugcaucagccucaaagaaugugaaaucuagugagguaaggagaaaugucaacuguaauugaaauauggugugauaaggcuacagagguaaggagagagugcaaugggagcccaaaggaagaguacccagugccccaggaacacagugacacagcuuuugaaaaagaaagcuucccugaagaguuuucauguaaguggagaccugaagaaugaaucgaaauugggcaaaaaaugaggcgaaaggguauuccaagagaacgauggcaugugcaaaggucgaggccaggaugagagauuucaagaagacauguuggugaaucuucauugaacccacugagaguaacagcaaaaacuuggaaaccauguaaaugcccacugaaaaauguauaguggcauaauuauacauauguauuauacaacagcaaaaauaacaaauaagacauauacuaucaauguggaugaagcucacaguguguugaucaaguugcaaaagcauaaauaugcacuucuauaaugauagaaaacuuuuaaaacaauaugaugcauuccuuaaagauguauauacagacagguauaaagcaguacauagaaauaacccaaaugccagcuggacacaguggcucacgccuguaaucccagcacuuuggggggcugaggcgggcagaucacccaaagucaggaguucgagaccagccugaccaacagggugaaacccggucucuacuaaaaauacaaaaaaaaaaaaaaaaaaagaaagaacccaaaugccucuuagaggcaggaagaaaaugcaaucagggagagguacacuggagauaaaauaaagcaaaauguuuucuuucuuaaguggguauguucaugaaaagaucuaguccuuccauuucucucaagucaccuugacucgccaccgcacucaccauggugaauaaugccccggucugcuaauuucugcaugaguuuaauugccgucucucugucagaagccucuuuguguucaaucagccagucaaucaguucuuuugcgacaaaacaguuuggguaggucuugagaugaugacgucuaucuuuaauaaccuuuucuucgugcagccugagccugaaagaaaaauuagcaauuacuuuggaaauucugaugacagcacaaauuauuaaaccaaucccagacaguaauaacauaacagaaguucuaaaggcaugaaggugucauugaauaucuuuagcucgcuuggugauuuccauacugucagaguucaaaggcuccagaaagugacuccagccucugaucuagaugacagagguaaauaugagggugaaacaaucacagccaacccagaacccuccugccacuccugagagugagaaaagcucuccauccccuacucugccucacucccugcuuuuucucucuccagugggguuauuguuucaaccagcaaacaaaaacccuagaaaugcacugaaacaaagugcacccucuuuaucacaaauuguucagggcccacccuacuuguagucauucauucauauaaaaaauauuaaugaaugucuacuaccugccuguuagguacuucuaggcacuacagacauacaucagggugugguggcucauaucuguaaucccagcacuuugggaugcugaggcaggaggaucacuugaggucaggaguuugagaccacacuggccaacagugaaaacccaucucuacuaaaaauacaaaaauuagccaggugugguagcaggugccuguaaucccagcuacucaagaggcugaggcaggagaaucgcuugaaccugggagguggagguugcagugagcugagaucgugccauugcacuccagccuaggcaacgagagugaaacuccgucuuaaaauauauauaauauauauauuuauauauauauaauauauauguauauauauauguauauaugugucuugagcuacuacuagccaaucuugccaucauaaaggaagaaucugccuagaaagaaauacaacacagagcaaaguggaccagauagauagagauaaagggauagagacaaaagagagagacagagagauuacaaacaacucuauuugagcaccugaauucaacaguucaugaagccaccuaaccuggguuuaaauuacaugaaucgauacauucccugugcuuuagugaguuuauucagguaucuguuacuaauaccaauauugucccaauacacccucgagcugaaugcuagcuuguggcuccauggcacggaauguugccacaguggugccuucagagaccacguaaacggccagagcucuguacucugcacccagugguuccagaacuucauagggucuguuucucauucuccuaucuccuuucccuguccugcugugauaugcauauguuguccuuguuccuaaacucaagcaguuccccuaaucugcuguuucucuucugccauggucugcuaaguagucaguauuuaggauuuaaaauauuuugagcaaaagccugauaugaacaucuacgaagaaagaaaaugagcauuuugggcauggaauuuaugacaucuauuuuggucacucaaaggcuaucuuaugugcuuuauuacugcucuuuggcugagugcuaaauaauugggaaugaauguuaaugaugcuuauuuacuguacaauguucuaccaucugcaaauauuuauuaucuaaaacuuaagagucaagucauacuauaggauuggcuaaggaaaggacauagcaaugaauccacuaguaacagagaugaggauaucagugauaucaggaaaauacuaaaggagagguauccaguagacccagaaaacauucucauaagaugguggugauagaguagggcugccagguuuaguaaggaaaaaccagacaggaaacccaguuaaauuugaauuucagauaaacagcaaaccauuguguaguaaaagcuugacccaaauauugcaugggaccuacuuauacuuuaaaaaaacaauuuauuauacuguaucuauaauucaaauuuuagagggcacucugcauuuucugacaaccuuaugggggauauauuuuauuaaccuugaagguuaguacauuaggauuaauguuuuaugcuaaaaaagaaaggaaacuacacugaugccagaagacacuuugaguccuuagggcuuccucuucuagggaaagcuaguugugugauuuuuuuagagcaccugaaucaucauguuuaucugaguauuccagaagauacuucaacccaugugcuuggagccagacuaggcuucauuugccagggaccagguaggaaaugggaacuguaaagauuauaaauugguaaagcugguggagugaaaucggagcacagaaucucccuuucuucuauuaaggaaaauaauuuuuuaaaaaaacagcaaacagaaguagccagacaaagaaaaagaaacccuaacuacauaaauguuuuuaauuggcauccuaaucaaauuaaugcuggaacagaaaaccaauaccacauguucucucuucuaaaagggagcuaaacauugugaacacauagacaucaagaaggaaacaacaggccgggcaugguggcucacgccuguaaucccagcacuuugggaggccaaggcagguggaucacuugaggucgggagcucgagaccagccuggccaacauggugaaaccccgucucuacugcaaauacaaaaauuagccaggcacgguggugcaugccuguaaucccagcuacuaaggaggcugaggcaggagaauugcuugaaccugggaggcagagguugcagugagcugagauugcacaacugcacuccagccugggcaacagagcaaaacucugugucaaaaaaacaaaaaguaaacaggcaacaauagacacuggggcugauaugguuugacuguguccccacccaaauuucaccuugaauuguaauaauccccaugugucaagggcagggccagguggagauaauugaaucauggggcaguuuuccccauacuguucgcgugguaaugaauaaaucucaagaucugauggguuuuuuuuguuguuguucucguuguuguuguuuuuauuauuuucguuuguuuguuuuugaggcagagucucacucuguugcccaggcuggagugcaguggugcaaucucggcucacugcagucuccaccucccauguucaaguaauucuccugccucagucucccaagucguggggauuacagguguguaccaccacucccagcuauuuuuuguauuuuuaguagagacgggguuucaccauguuggccaggcuggucugaaacucuugaccuccagugauccacccaccucggccucccaaagugcugugauuacaggcgugagccaccacacucagccuugaugguuuuauaaaugggaguuucgcugcacaaguuuucuugcccacggccauguaucuuccuuugccuucugccaugauuaugaggcuuccccagccauguggaacugacaguccauuaaaccucucucuuuuauaaauuaccuagccucagguaugccuuuauuagcagcaugagaauggacuaauacaggggccuacuugaguguggagggugggaggagggugaggacccaaaaaccaccuauugccuacuaugcucauuaccuggguggcgaaauaaucuguacgccaaaccccugcaauaugcaguuuauucauguaacaaaccugcacaugaauucccugaaacgaaaauaaaaguuggaaagaaaaaaauaauaaaauaaaaauaaaugaauaaacaaacaaacaaaaggaaucaugauauaauaaagugauuuaggccuguuuuaccgauaggguagauuagccuuaaaauacucuccacccauugaaaugaccaaaaaaagucuuuguaauuuuugaauaaagggaaaagaugaaaacauaaauaaaguagcagccaaaaaaauaagcaggagauuuuagaguggcaagguaaggcaaguagacucucaccacccagaagccuuguugcuaagucaaugaaauccucagaauuuucauuaagaaccccaaaguuugaaggaaaaaaaaccauaaauaacugaguuuucugucuucugauuagggacaguugaaauggcuguuggggaaagauaggugcaaugaaggagaugaagaacuagaccuuuucucuaacagugaagccucccaaacucaauaauaaauuuggggaccauugcagcagcaaaaauaucccuccauagcagugggauccaucucugacuaugugaaaugaacccuaggacaggaaguugaacaacaccucagaagcaagacucucuccuuccaucaccaggagcccuuaagcuguaaaacaauggaacaaauaauuagcuaucaaauuuagcucagaggggaaaaugacauucugagaugacuuaggaaggugcuaaggagaugucaccugccuuuauuuccaagcacagauagaguauggacagauugaaagcauggacaaaacugucugcauuaagcauaaacaucauggggaaaagcaaacagcuaugugauacugugaagcaaaaauaauaccaaaaaaaaaaaagaaagaaaaaagaaaagaaaggaaaaacagagggaagggaaaaagagagcauucaguagauaagaagaacccugucugaaagaaaacacaauucaagaaacaauuuccuuaaaguggucugaacuauaaaaaauuuuaaaacaauuuaaaaagaacauaaagucaagaaaauaaggauucaaagauaaaauaauuaugaagagggagauauagaucuuggaaaauaaauggaugucagacaguuuaucaagcaaauuauaaacugucaggacaaauaaaucacauagcugaaaaaugaaauucuuauugaaaaaauacuucaauaaagaagaaaaagcaauuaaagcagauaggcugggcaugguggcucacacguauaaucucaggacuuugggaagccaaggugggaggauaacuugaccucaggaguucaaaucagccugggcaacauggcaaaaccccaucucuacaaaaauacaaaaauuagcuggguguuguggcacacagcuguaaucccagcuacuugggaggcugaagugggagcaucacuugagccugggagguggaaguugccgugagccaagaucaugccacugcauuccagcccgggcaccacagagagaccucaucucaaaaauaaauaaauaaauaauaaacaaauaaauaaauacagcagauagagguuaauagauguggagauuuuuuaagccacuaaauuaauuuauaauauuaccucaauauacauaauaagucuaaacaaaaccaacuaaaauagucuccagcacacagcuccagggaagaccuaggugaucuucagaacaaaagagguggcaggaguauuucccagcaagccaaugagguucaguucuuccuuuugacaaccagcccauguucggggaugguguuucaagaagugcagacccaccaacucuuccugggucugaaguacuuccuggagagaagcacuacacacuaucccuacugucccaccagggccugcuacauuuccacuccacacagauuuguucauuucugacuaucacagauuucaccccaaaaugucaguucugaggauaaugagaaaaacgggauuaggaauacaaagacuugguucucacccuggugcugccaguaacucuacaaccucugagcaucagaguuuuuacugguaaaaugaagauaaucuuaugcaucuaugugcuagggacaguuugaacugcuuuaugggcauuaauccucauaacaacucccugaggcagucaauucuaaaaccacaaaugauaccuauguagaguuguaauuauuaauaauaaaaacuaagcaccagcuuaaaaaaacaaguuuacauacggugugcuaaagucaucccaugaauccuucuaauuaauucagugacaacgacacugaguaauuuguuuaacaugcucagaguggcagaaugcaaaauauuaauucuuagaugugaugucugucaggaauccaagaauaaugaagaccaauuuacuuagaaauuaaaauguggaacaagcuacuauguaauuuguuauauauaguaggagaaggacuauauuaugagccaagagaagaguuuuagcuccuguaaacuuuccaaccuaagagaauuauuagauaguauuuaucuuuuuuuuuuuuuuugagacaguuucacucuuguugcccaggcuggagugcaauggcgccaucuuggcucacugcaaccuccaccuccuggauucaagcaauucuccugcuucagccucccgaguagugggaauuacaggugcccgccaccaugcccagcuaauuuuuuguauuuuuaggagagacgggguuucaucauguuggcuaggcuggucucaaacgccugaccucaggugauccacccaccucggccucccaaagugcugggaauuacaggccugagcuacugcgcccagccuauuuauguuuaaauacuacaaaauaauuagccgggugugguggugugugccuguagucccagcuacuugggaggcugaaacaggagaauugcuugaacccagaaggcagagguuacagugagucgauaucaugccacugcauuccagccugggugacagagcaagacccuguuucaaaaaacaaacaaacaaacaaaaaaaaaaacuacagaauagaaccuuucaguuaccauccuucuaugacccuggagcuuagggcuaauucuugaacauuccugauuuccaccaauucccugcaaggguagaaggggagaagcacuacacacuauuccuacugucccacuggguccugguacauuuccauguuuaagaaaacugaguaugaugggggggaaauaauuuuggauccaggauauagccuagaacucaauauuuuuagacaugucaccgggguuaaaaucuauaagaacugugcuauuaucuuuuuucuuuuguagucagaaacacagacuucuaaaaaugagcuuugaaaauuguauauuccagaaaaacuaucccaauaaagagauaaaaauuuucacacugcacacguauguguuuugccuggcacagcaaauacuuaauauuuggugaacaaaugaauguauaaggacacuaauagaaaugauguuauuuucagcugggcaugguggcucacaccuguaaucccagcacuuugggaggccgaggcugguggauugcccgaggucaggaguucgagaccaaccuggccaauauggugaaaccccaucucuacuaaaaauacaaaaauuagcugggugugguggcacaugccuuuagucccagcuacuaugccggcugaggcgggaggaucccuugagccugggagauggagguugcagugagcugagauuguaccacugcacuccagccuaggugacagagcaagacccugucucaaaaaaaaaaaaaaccucagugcuaaaagucaucgaggaaacuggaccauuaggaaggagaggggagugggggcagcacagagaagccaagaaagcaacaggaagccccugaagcagcaaaugagggaugcaagaggaacaaguugcaggaguuccucagauccuuagaguuuuccaguuucucuuccaagccaugugcacucguauaauaaccaagacacuaccaauccccucagggggcugagugggacucgacucccuggauccaaaagaaccucaccuacccaggagcuaaggaggccuuccacccugacccuagaucgccucuugagcuuccuugucucucucaccucccaaucacaugcauuccugcuuuguacucugaauauucugaacucuucuucagccucugaacaugcuaaucacccuccaugccucugcuuagaaugcuccuucuuccugccuucaauaauucauaaccauuugacuuaucuucaagggucagcuuuucaagggcaccuccucugugaacguuuucccagccuuccaaagccagaaaacagccuucucucuccucuauugucccacaauauuuuagcgccaacaguaaagcauucaucgcacuguauuacaacuagaugacauuagggauacuaaaggggagcugcuuauuuauuguugcaauucuagugcauagcaaauaguaggagauagaaaucucauugaugugaaaguuaauucgugcauauuauguauucagcauggugggaagcauagauagaauaguuuucugagcaacagagucccaaucacauuaaaccauugggaagagugaccaucuguauuuuagcugcauuuucaaucccacuggcuaugaaauauaaauuaagaaaaaaaaaaccuuccuauuauucaucucagacagcugguucacaggcuuuagauucaaggugauucuguaauguucuauuccuguccagcuaaccagcugcugaaauugcaucagaccauuuccucuuccagcccuaagagaacaaacauuacugggugcaggguguuaacaauaccugcaaaaucacuguccaucugauaagaaauguagaaauuguuuuucaaaaauagcuugcagagaacuguggcagauugugggacucagggaacaaaggggagauugaaaccacauauucucauuuuaaaacagcgucauaaaucucagccaaaguaaacaguuuaacaaacacagcaagccaaauaguggggcugacagugugagccugugauuugggcaacaguacugacauagauaugcuuuaaacuacagcucuccuccuuuccagauguucugcaacagccaauaucuguccuuggggaucugagaacccagggaaagucacucuuuaucacacaccguugaaagacucugagucuaaaagaaaaaaacaaaauggaaauauaauacacugcauuuccuuuuaauaucugaacuuauuuucuaauucagauuuuaaauuaucaaaauaauauauccucacaguagaaaauaauucaaauauauauaaaaaugaaauuaaaagucucuuuucucgguucagaugaagagacaauuauuaaagcuggguuaacuggcaaugaacugaucauugcugaagcuaggagauggggacauaggaggucacuauauguuucuaccuacugugcaaaaaauauguuucaggcuuuccuccaccuccacuuuccaaaggaaccuaauauaauagcugccuauguauucuuacagaaaucuucuagguauguguacacauauggcuauauuuguauauuuuuuacaugaaauaggaucauaauacacauuucauguaguuuugcuucaagaaaaugcuugaauucucccaaccugaucagaacaaaacaacaaauacagauagaaauaagaaggaaagagaauagaacugguuuauauaaacagagcacaggugauucuguagggccagaagcaauuggucuuggacaacacacacacauacacauacacacacacacacacacacacacacacucacuaugcaaauagcugcaguaaccacuucauaagguauuccauggccaggcgcgguggcucaggccuguagucccagcauuuugggggucugaggcaagcagaucaccugagguugggaguucgagaccagccugaccaacauggagaaaccuugucacuacuaaaaauacaaaauuaggcugggcgcgguggcacacgccuauaaucccagcacuuugggaggccaaggagggccgaucacaaggucaagagaucaagaccauccuggccaacauggugaaaccccgucucuaccaaaaauacaaaaauuagcugggcaugguggcacgugccuguagucccagcuacucgggaggcugaggcaggagaaucacuugaacccaggaggcggagguugcagugagccgagauugugccauugcacuccagccugggcaacaagagugaaaucugucucuaaauaaauaaauaaauaaauaaauaaauaaauaaauaaaggugguccaugccaaauguuucacuagcaauggcucugugaauaaaaaacaagucagaguccuaacuccuauacagagcccuuccaggacucacgucaaguuaauacaaagcaaaguucuaugcaaccucugugucuugucacugcaauggauugagaggauaaacacacccaggaaguaaagagguggguugccccuccacaccuguggguuuuucucguuagguggaacgagagacuuggaaaagaaagagacacagagacaaaguauagagaaagaaaaaagggcccaggagaccggcguucagcacacagaggauccacgccagccucugaguucccuuaguauuuauugaucauuauuggguguuccucggagagggggauguggcaggaucauaggauaauaguggagagagggucagcagauaaacacaugaacaaaguucucugcaucauaaacaagguaaagaauuaagugcugugcuuuagauauguauacacauaaacaucucaaugccuuaaagagcaguauugcugcccgcauguuccaccuccgcccuaaggcgguuuuccccuaucucaguagguggaauauacaaucggguuuuauaucgagacauuccauugcccagggacgggcaggagacagauaccuuccuccugucucaacugcaaagaggcguuccuuccucuuuuacuaauccuccucagcacagacccuuuacggguguugggcuggggaaaggucaggucuuucccuucccacgaggccauauuucagacuaucacauggggagaaaccuuggacaauaccuggcuuuccuaggcagaggucccugcagccuucugcagugcuuucuuucccuggguacuugagauuagggaguggugaugacucuuaacgagcuugcugccuucaagcauuuguuuaacaaagcacaucuugcacagcccuuaauccauuuaauccugaguugacacaccacauguuucagggagcacaggguuggggguaagguuauagauuacagaacaaaauggaguccccuaugucuacuucuuucuacacagacacaguaacaaucugaucuuucuuuuccccacaaggaaggaagcauguuucauucugaaucucauauaucauguacugucuuugaaaucaacauggaguauuagcagagugagacaauguaacacauauaagagggcauguuugcucauuucuguuugccaacauaauuucacaaagcccuugacucuaauaauguguagcucucuagaaagauacuuugaagacgaaacaggauagagcacacagccccguagaucucuugccggagucacuguacacuuuaaaagauaaaugaggccccacaccauggcucacgucuauaaucccagcacuuuggaggccaaggcugucagauugcuuaagcccaagaguacgagaccagccuuggcaacauggugaaaccccaucucuagcaacaaaaauuuaaaaauuagcuacguguggcggcacacgccucagccugggugacaaauccagacccugucuuaaacaaacaaccgaccaaauaaauaaacaaaugauaaaggacucuaguccuugccuuuuccuacccauaagauaacaucugaagggguuaguaauuaugccucuguaaucuacaaccagaugcacucuuacauccaaaccuugcugugauucagcuuaauguaauuucugaacaagucugaugugauuuugcauguacugaaccuccaccaccuguauauaagcaaugggcugaaauacugugcaggggcaguuggauagaaccuuucuaaagggcugcuccugagcugcugaccccugucuauaguccucaguaagccuuccaaauaaaacuaacuuuaauucuuuaaaagcuuaacuuuuucuuugguggacagcagacauaguaacaguaauaaccuuacaucugaauggcaccauaauacacuaucagagcugagccuuauaauaucccuguuggcugggcaccguggcucgugccuguaaucccagcauuuugggaggcccagguggguggaucacuugaggucugggguuucagaccacccuggccaauauggugaaacccccauuucuaaaaaaaaaaaaaaaaaaaaaaaaaaaaaaaaaaaauuagccuagccugguggcaugugccuguaaucccagcuacucgggagacuaaggcaggagaaucacuugaacccagaagguggagguugcagugagcugagaucgcgccacugcacuccagcguccacccguuauucacuguguaacuuuggacaaagcauucaacuucucagugccuuuacuuucuuaucuguaaaaugggaaugauagagaaugucucauaggguuauugagaggauuaaaugagagucagauuuugccagaagugccaucaagaggccacuaaguagcauuucagcuuuuuuuuuuuuuuuuuuuuuuaacaaaugaaguccugaaucaaggaaaaauugauuggcaauuacuggagagacuuggcuguucucuuuuguuaaaggauuagaaagagagcccuucugguggagugguaagucaaagcagagaaaaguccaggugagagaguacuuggccacucccuacugcgagguuugcuggaaucaaccucaucucuucuaugguaucaaccuaacugauaaccaaaaucacugaauugucuuaacuggaaagaaaugucaggcaaucuaguucaaguccuugccaauaucacuguuuuacagcuggaaaaacggagacuuacagaaguuagguaacuugccucuuuucccagauaagaguuaaaccuugaccuccugacugcuaccagaauauugguugagcgccacuguggaaacagaaguugcuaaucuagugcuuuaaccaagaguggacugcugaugagagagcuagccuagaaucuguuugugacagcccugcaagucauuucuggaaacacccagauuauacucacucuugagaaagacacugcauugccaugaaauguuuaguccuggaaacugaaaacuucuucccugagaagaaacagucucagggacaauuuuagacaaagacaaaauauauagaaagaucaaauauaaaaacauuauuuaaauaauaacuaaaauaggcugggcgugguggcucaugccuguaagcccagugcuuugggaggcugaggcaggcauaucacgaggucaagagaucaagaccauccuggccaacauggugaaacccaccucuacuaaaaaauuaaaaaauuagcugggcgugguggcacauggcuguagucccaggcauucaggaggcugaggcaggaaaauugcuuaaacccaggaggcagaggcugcagugagcugagauugugccacugcccuccagccuggugacagggcgagacuccaucucaaaaaaaauaauaauauugcccaauauaccacccccucauggaauauaaaaaauacacaccaaguaaucugcagacugcugcaacuauuauagucagagaaggugagagcaguaauucucacaaauagacuguguuagaaucaccugaagggcuuguaaaacacagaaggcugagccccaccuccuacgguuuguaauucaauagauuuggggugggcccaaggauuugcauuuuucaaaagugcuugggggauuggcaagcucacgccugucaucccagcacuuugggaagcccaggcaggcggaucaccugaggucaggauuuccagaccagccuggccaacauggugaaaccccgucucuacuaaaaguacaaaaauuagccuggcgugguggcaagcaccuguaaucccagcuacuagggaggcugaggcaggagaaucacuugaaccugggaggcggagguugccgugagccaagaucgugccacugcacuccagccugggcaacagagugaaacuucaucucaaaaaagaaaaaaaaaggcuugggugaugcugaugauacugauuagggaccacacuuugcaaacgcaggggguuggaaugaaacagagccaacauugcauuaugaaauaaauaagagggugggcacgguggcucaugucuguaauuccagcacuuugggaggccgaggcagacagaucaccugaggucaggaguuugagaccagccugggcaacauggcaaaaccccgucucuacuaaaaauacaaaaauuaggcaugguggcacucgccugucgucccagcuacuugggaggcugaggaaggagaaucgcuugaacccaggagguggagguuguagugagccaagaucaugccacugcacuccagccugggugacagagcaagacuucucaaaaaaaagaacaaaaaaggaaaaaaaaaaaaagaaaagaaagacuggguagguauuaaagccauucccauuuugauggggaaggaauuuaaacuaggaagccucaugauuuagaaggaaaagcaggagggcuugucccgcugaugggacaaggaugggaaaggaugcacagaggugacgcuagggcaugguaagccaacuugacaauuguccaagccucgauggaacaacagaagccagggccuguguugucucuaggaggagucaggacaccuaacugaagagugugcauugcugguuuagguaacauggccuggggagaccucucacccaacuaagaccucagcuuccugaggaaacugacuggcuuuaucucuaaaaucucucaacucaaacuucucagguuuuuauggacacccugaugaaccacgagaaauaaaaaccuuuuaucugaggaauaugagccccuuuaaauuaucaggcuuagaaagacauuuaaaagguaacagcagucacaucccacucucacuugagcuaaauaauuaccucuugaagccacuuacuuugugggcuauagacugacacuaaguagccauaaaaugccauacacccuguaguucaacaauguacagccaaucaccaaucaauguuauuucuguaaaccagugaaaaugccugaugaacaacuuuugucauugcccccucucuuuguucguccucuuuuuuccuuaaaaaugugaaccucucuuuuguuuuccagaccacuccccagugcaacuuggaagugccuggugcugcaguccucaaacuuugagcuugaauaaacacucuuuaaacuagauucuggcugggugcaguggcucaugccuauaauccccagcacuuugggaggccgaggcaggcggaucacuugaggucaggaguacaagaccagccuggccaacugggugaaaccccaucucuacuaaaaauacaaaaauuaacuggguguggugguaggugccuguaaucccagcuacucgggaagcugaggagggaaaaucucuugaacccaggagguggagguugcagugagccaauaucgggccacugcacuccagcaggggcaacagagcaagacuccaucucaaaaacaaacaaacaaaaaacaaaaacaaaaaaacaaagcuagauucugauccuuuuuauuauuuuagguugacagccucuaggauacauccucacacacaagaucaaaauagaaccaacuguguugggcacauuuuguacugaaaagaucuaccguaagccacaaggccagggagcacaaaacagcaaaucucauuuccuuugggcuuccaaacaaggaugaacacauuaaagugaaucuugugcuaagcaugcuguacaaacacuguguaggguuaugaucaucuauuuucaguucacaggacagacgcugaggcugccaaagugccacaggcuuugaguguugcacgucuauaacuugagaauagacaagguuucucuggauuuaaaaauauuucaaaucuucagaaguguucucaggaacauccgcagcuaucgcggaggcagcuugcaguuaaggggcuugcaaaaauuucucaaccgaaacacauuuauugauucccaacugcauaccuggcauagcuuaaacaacuguucaugcuggcccaguuucuggaguucaaggauuauguaacugaaacagguguuguuucuuccaaauggaaauguuguauucuauauguuagggaauuguguguguguaugccagucaaaguuuccuuaauauguuaaaacucaaucuauccaacauuauuuuccucuuccaauuuuagcccaauccuuccuuucugccucuucccuauauuuaggcuacucccuuuucagaauaugcucucccucuuuuccuauuuauccaccaaauucaaaugccucagccuucuuccaugauguguucuuucauccaacagauaugaucuacuuucuaaaaugcucauguuuaccuauauaauauuuuguauuacuuuaaucuuauuugcauuaauucucuucaauuauacuacaaauuugaugaguaaaaaacuaucucauucuucuuucauauuucccaaaaugugugggacagggcuuaggguaaaugacacuucgugaguauaaagguuuggauuuucaucuuuguuucagucuggacagaaggaaaccauaguguaguacagaaugcaaaccuugagccucuagugugggguccuuugauagcuguguucauagcugucauguccauggaagagaaggacuucagaauguuucugccaucaccuuucuauuaauaugaagaaguauuuggacuacccguguguguuuaguuccacuggauaagaaauguuacauaacccuuccuucagaaaggaacauguuauucuucacagaauguguacacagcaggggccaggcacgguggcucaggccuguaauccuagcacuuugggaggcugagguggguggaucaccugaggucgggaauucaagaccagugugaccaacauggugaagcucugucucuacuaaaaauacaaaauuagccaggccugguggugcaugccuguaaucccagcugcuugggaggcugaggcaggagaaucgcuugaacccgggagacggagguuguggugagccaagaucacgccauugcacuccagccagggugacaagagugaaacuccgucucaaaaaaaaaaaaaaaaaaaaaaaagaauguguguacauagcaugguccuggcuguggcugaagcucugucugcugucaggauccaggcaggucuggauagguguagcucaggcugguucacagggcacuccaggagacaauggauagcugagcaaagaagucagagcauuagcuagcagggaaauugauagaaggccacgguaucuggucagucccaaagauaaacagccaacacugaaggugcuccuguucacuaaaguccugugaggcaauggguggaggcagcucugcuguguugaaaagauaaaacagcacccaccaaaaaugcugaauacugaaaaucucagacgcagugauggaaacauacauacacaaacauacacacacacacaccccucuaggaaacaaaaaagucacaaaugaucccaaaccacuccacauuaagcauuuuggggguuaacuaucccuuacucaucauuaacucacguagucaaauguuuaggccaucuuugguacucaaugcagacaucaaauacacuugguacugugauuuauuuuuaugucuaacagaaugugaguuaaaaugaagccugggggcugggcgcaguggcugacaccuguaaucccagcacuuugugagguugaggcggguggauuacuugaagucaggaguucgagaccagccuggccaacauggugaaacccugucucuauugaaaauacaaaacuuagcugggcaccuauaaucucagcuacuagggaggcugaggcaggagaauuguuugaaaccgggaggcggagguuguagugagccgagaucgugccauugcacuccagccugggggacagagcgggacucugucucaaaaaaauaaaaaauaaaaaauaaggccugaaaaaaaauucaaaaacccuaaaaauuuauauuucacuacugacaauguagaaaacaaaaauguuucccagggcugcguaauaaaaugcuauuucacauaucugaccacccucaggaaaaucuuuucuaugucuguuagacacagccagugaaaagcaccuucugguaaucuguauauuggcuuaugccagguuugcauuuucccuuucuuaacauaggugcucugacuuuugcagguguucuauauacuuagagucaaauuuucagacuaccuguuucccaauguagccccugaauacucuugguauaugccuguauaugaugaggcuuugguagauaaaauuucauauaucuacauacaccucuaucuggaucuccaggucacuuaaacaguuugaggaucagaaaaaaauacaagaggcgccaaagccauuaucaacagccaaguggaaauuuaugucaggugugagugagacuuuaggugguagcuccagauuauccaguguucuauguaucugauaccuaaugagguucuacauaauaauaaauccaaauuucaugugcucagcacauuauggcuuauuaauuaccucuacauacugcaucucauuugcgaaaacuugauuuggcaaacaagcauguaaccuaguuaagagaugauuaacccuugucuguagaugagaagaagguucacuucuggugauuggaauugguuaugaauaguuuguaaguggcaaggccacacacagaaucuagaacuuaagauuuuucacucaucaaaacucauauuugaaagagcauauuuagucuuauuaauauuucugcaugguuugcaauuguuuacauuaaugguuuuaucuguagaguuaauuugcauauuuacaccuuucaugccacccuaaaggcucuguuuucucucuguaacuuucuacuuugcuaugguagauaggcagguguucaaacccugcugaugccuauauaaagacagaaaauuuaacucuauuuagagucccaagaaugcugacagggugccaaacaccuguggcuacuuauaaaauacagcacucauuaagccaaagacagugucuucuaaagauagcuagguaacuaaagauuucaucaguuaucugucgcauucuccugacagcugucauuugaacugggguggcacuuggcaagaacuaaaaagucacacucuauuaauuaggcuaccagaggcaagguagggaagcugaaagaggacccuuuggaaaucauuaagauucuagagagccuuugaaagucuuuucucaauuuaauauaaucacacuacugcaccugucuccaauaucuuuccauccuagcauuuguuauugugugagaugcuaggaagcaaagccaauacgacaaacucucacuccaggcaccaagaaguaaaugauacuuguguucugagaauuagugggcuggcugucaugguuuuuaaaugaggcccuggcaucuauuuuagccuaaggcucuguuccuuggugacucugauuuacaucacaguuacauuugcccuggaggaaucugauaacucucugauuuauuuuuccaaugauguaaaauguccagaaaaucaguccgcauuuaucagacuuguaauuuucccacugauuacacaagggaagcucagggacaaacagcuugauucaauagcaacucaaguccucaauuucuuuguuuuaagaaaagagcugcaagcagccuggccaacauggugaaaccccaucucuacuaaaaauacaaaaauuagccaggcgggaugacgcaugccuguagucccagcuacacuugucccacaagacugcccccacuccagauaccaauugcaaguaguaggcagucaccuguacuuuuaacugacuggcuuuaaaucaagauucccaucaucuccuccacaaguucaaauaauuuguuaggaaggcucacagaagucauggaaacacuuacuuacauuuauugguuaaaaaaaauuuuuuuuuucauuuuuuguacuaccagggucucacuauguugcccaaacuggccuggaacuccuggccucaagccaugcuucugccugggccucccaaagcacugggguuacaagugagccacugcaccucacccauuuacugguuuuuuauccaguauauuagaggggauacugaugaaugccagauggagauggauagggcaagguauagaaagggggacacagagcuuccaugcccucucuuggccagccacccucccagcaccuacacaugucagcaacucagaagcucaucaaaucucauuguucaagagucuuacaguuugaucuccggacuccuucggccuccacuuuuccuagugguuggugggugggguugaaaguuccaacccucucauccucuaaucacuuggucuuucugauggccagccucaucaugaggcuagcuaggugucccacccugagucacuuuauuaacauaaauucaguugugcuaauaagggcuuauuauaacaauagacacucuuaucacuugggaaauucugagaguuuaagcucugugaggaaccagggacuaaauauauuucauauuauaucacaguaacucaauugcccuccauugauucauggauucuuauuuucuucccuuuuuuuuuguuuuuugagacagagucucucucuguugccaggccagagugcaguggcaugaucucaguucacugcaaccuucaagggauucuccugucucaacuuccuaaauaacugggauuacaggcaugcgccaccacgccccgcuaauuuuuauauuuuuaguagagaugggguuucaccauguuggccaguguggucucaaacuugauccaccugccucggucucccaaaguccaccacacuggcccuuauuuucuuucucuaccuaaaaagucaucucccuaagggcaggaaucauggugucuauuucuuucuauuucuugauuuuaguacaagcaaaagcuguucccacaggcccucaauaaauauuuauaggcugauuaacuaaacauaaaauauuauccguaggcauauguauuuuaaaaaucauucugggaagaaaauauuuuuuaaaaaaauaucuagguuucuuugaaauuuugugaagaaaucugugccccauauauuucuuaaaaaccucaaauuaaucuguaauacaauguuaauugcacuucacacaaaacacuaccccucaaccuuguuccaauccauccauuaguaggaagguagugucaugggccagaucuuacguuuuguugccaugugaaaaaaacaguuuuguugcuacaacaucauagaccccuggauucaaaagucaaacagaaaaauaugcuuuugguguuguaaucaucaccaguaagagccacggugggaggaagaauagccucauucucuucgccugcuuauacaagggcuauuuaccauguugacaguccuuucaucccugccaagagagucacaauaucccuuuuauuaaucacucaccacaggcaccauguaaugcacaggaauacuauuggcccugaugaacaacgcgaaugcucucagaagacacagagaaauuaugugagggucuugacuacccuaagauaaacagugagggcuagagcucaaaaucaaagcucugguguccugcauagagcucugggaaauccuaugaaggccuuccuucaguaaagucuauaaacauuugucaccagccaucacuuuaggcuuaugguccagcaauagggaaaaucaaacucacuccaacaauccauauuuauugggugccuaguaaugcuagacaagggguauacagcagugaaucugacaggccuggccucucucacagggcuuagagucuuaagaguggucuauaaaggaggggccuaagaccaaccauuggugcacagcuagaaaauaucagcauaucuauacuuuuucuuaaaaggauuuuaauuuuuuuuuucuuuugagucagggucucauucugucacucaggcuggagugcaguggcauaaucuuggcucacugcaaccuccaccaguugggcucaagugaucuucccgccucagccuccugaguagcugggaccacagacaugcaccaccauacccggcuuuuuuuuuuuuguauuuuuaguagagaugggguuucauuauguugcucagguuggucuugaacuccugagcucaagcaaucugccugccuuggcuucccaaagugcugggauuauaggugugagccauugcacccggcaaaauuuguguguguguguauauuuaugauauacagagugcauuaguauaguaguacauguguguaacuguuacauuaggccaggcacaguggcucaugccuauaaucccagcauuuugggaggcugaggcaggaggccugcuugagcccgaguucgagaccagcuuaggcaacauagcgagaugcugucucuguaaaaauaaauaaauaaauaacauuuuaaaaauuggccaagugcaguggcuugcgccuuuaaucccagcacuuugggagacccaggcagguggaucauuugaggugaggaguucgagaccacccuggccaacauggugaaaccccaucuccauuaaaaauacaaaaauuagcugggcauagugacauguuccuguaguccaagcuacucaggagguugagaggcaggagaaucgcuugaaccugagaggcggaggcuguaguaagccgagaucauaccacugcacuucacuguacuucauccugggcaacaaagcaagacucugucucaaaaaaaaaaaaaaaagcccauauaaagcccauauuggggaaaaaucuaugccuaaaauauuuuuacagauaagagaugggcaagcagaaacaucagaaacaucaaaaaccacuagacgacaggacuauuucaacuuuccuaaacaugucauguuauuucaaaccuuucuuuccaccugcucuugucucuguauggugcuucucccuuccugcacugcacuccuaguaaaaacaccuucaaacuucaaaccucacucagcugucaccugcugcaggaagucuuggcuaucucacucucccagguagucugucacuuccauccggagcucccauugcaccuugcacauccuucuauugcagaaauucucaugcuggguuguaauugucuguccacauuucuaucucuggcuguagcugucuggaaucucaugcugugagcuucuugcggacaagauuccaaugguuuucauauugccaucaagggcuagcacagggccuggcacauagaagacucacaguuuagguaaaaggugcauucacuggcugggcaugguagcucacaccuguaaccucagcacuuugggaggccaaggcaggaggacugcuugaggacaaaaguuaaaaaccagccuaggcaacauagugagacucugucucuacaaaaaaaaaaaaaaaaaaaaaaagcaaaaauuagccaggcaugguagcgugugccuguaguccuagcuacuuggguggcugaggugagaggaucacuugagccuagaaguuugaggcuguagugagcuaugaucacaccacugcacuccagccugggcaacagaggaagacucuggucucuuaaaaauaaaggcggggugcaaaauggcucaugccuguaaucccagcacuuugggaggccgagguagguggaucaccugaggucaggaguucgagaccaggcuggcuaacauggugaaaccccgucucuacugaaaauacaaaaauuagcugggcaugguggcacacuccuguaaucccagcuacuugggaggcugaggcagggagaauugcuugaacccaggagguggagguugcagugagucaagaucacaccacugcucugcagccugcgugacagagugagacucugccucaaaaaaauaaauaaauauaaaaauaaaguuaauuuuuuaaaaaauguauccaguuuuuucuaccugcaauugacuuaaagguaacugagguuuacgccgggcgcaguggcucaugccuguaaucccagcacuuugggaggcugaggaggguggaucaucuuaggucaggaguuggaggccagccugacccacaaggugaaacccugucucuacuaaaaauagaaaaaucagcugggcgugguggcaggcaccuguaguuccaacuacucggggcggcugagacaugagaacugcuugaaccugggagguggagguugcagugagcugagaucgugccacuguacuccaaccugggagacggaguuagacuccaucucaaaaaaaaaacaaaaaaaagagagagagaacugagguuucacacagccaauuaaaucgagugccuuuuacuuccuccuccucuuguggagggauagaggcacuuugggguggggaagaguguucaggcucaagaugucagaauagcaacuccuggcccccagagucaggaauaacauuuacagaagggaggugggaaugcuacacauuuuaaauuuaccagugagggcugcccaguuucaaucuugaauuaaagauugagacuaagcacugguaaagcugggaagaccaaauucgaaaugcagaaaaaugcuguguuuggguggcacaguccugugaagaugccugcaggacugagcagaaaggagcccaggacggagcuguaagccucauguccugcucagucucuguagguuaccucagaggccacucggucuccagaggagucagucuggauuccccauaaguacucucauaguugacaugacgaaauaggagaccaagacugucaguucucaucccugaucuaauaccaaaucagauggccaagcaagaguccuuuaaaggagcuggauuagaucauugcuguuuccuccagccuaaguuucaacaacuucacuauguugaugacauaaagaugguauguuaaucaaccaugcaagguuugaguaaccuuuaggaagacccucauuaaggagugacuuauggcaacaaacuuagggcaaaaaaauaguauuuuuggcugggugcaguggcucacgccuguaaucccagcacuuugggagaccaagguggguggaucaccugaggucaggaguuugagaccagccuggcuaacauggcgaaaccccaucccuacuaaaaauacaaaauuagcugggcaugguggcagggaccuauaaucccagcuacuugggaggcugaggcaggagaauugcuugaacccaggaggccgagguugcagugagcugagaucgcaccauugcacuccagccugggcaacagagcaagacuaucucaaaaaaacaggaccucacccagccaacgaauauuacuugaacuccuacuucacugcuguccauugggcacugugccaggcacugggcauagaguaguaaacagacacacauagacccugcccucacggagcacacaauuuuaguacauuucacuugucuugucuccaaauguacagguucuuucgugucuaaaaacccugaaauuugaugauucacucuaaauuccaaaguggcacgacccucaagauguucucuccaauuuugcauauuuuuaaaaaauuccccuugaacacauaagaacuauacaacuuaauuuuagcugaaaauaauuccucauccaacuuaagaaaucugcaucuuaagauuucaaauguauuucuuuacuuuagcucuuagcaucacuauaaacuacuucaguuguccucuuucgagcauaagcauuaggaaacuaugaaacuuggagucaaaaaauccuaaaucugccagacaugguggcucacaccuguaaucccagcacuuugggaggccgaggcagguggaucaccugaggucaggaguuugagaccagccuggccaacauaguaaaacgccaucucuacuaaaaauacaaaauuagccaggugugguggcacaugccuguagucccagcuacucaggaggcugagacaggagaaucgcuugaaccagggaggcagaggcugcagugagcugagaucgugccacugcacuccagcuugggugagacagaguaagacucugucucaaaaaaaaaauccuaaauccuaaaucugagcagucuccaucacuuagucaugugugcccauggccaagucacuuaguuucucucugagcuccauuuauuuugccacuuagcauauuuuuuauuccuugucuauuguauacccaucuuuguaccaaauccuggggacacaacauugagcaaggaaguauuacaagacuucacguaaagcuuuucaucucuaaauugggaaucaacauaaucacucagguuccucucugcucauaggauuaagggucaguaggauguuggggaucagcagaaugguguauauaaaaucucuuuccaaaauauaagaugcuguguaaauguuagcggauguucauaauauguaucacagacacuuagcacaaaaauaaaaucaagaaaaggaaaauugaaaaaaaaaguuuaaaaaggauaaaaaagaaauaaauaaaauaaaauaaggaaaggaaaacuguuacagaaauacagaaauaguggaauuuccuuacauuuucaucucacccagcaaguguuccuugugauucuacagaccaaaggcuaacaguaugaccuguguccauugcuucagaaagcauuggagccaucaacaaauagcugcugugaaucaaugagagugaaauuaucacaucuuucguucuuuuuuuuuuuuuuuuuuugagacagagucuugcucuguugcccaggcuggagugcaguggcacaaucucggcugacugcaaccuccaccuccuggguucaagcgauucuccugccucagcuucccaaguaguugggacuauaggcacaugccaccacacacagcuaauuuuuuguauuuuuaguagagauggggcuucacuguguuagccaggauggucucgaucuccugaucucgugauccgcccaccucagccucccaaagugcagggauuacaggugugagccaccacgccuggcugaaauuaucauaucuuucuaacagcaucagggagagcuaaaaauauuaauauguuugugcaucuucucaccugcaauuauauaaucagcugauucugaaaugggaguuuguguuuguaccuaaauauuuagcaguuucaauagcacacugaagugacagacugaaacauaaaaagaccaauagaaaguuaauggcucaugagagaauugcauaaauauccucguccaugcauagaucugaaacugcaaacaaccaaaugaaaucaauuaaguacaaacacucugcuucuuacucccaauguagauuccaaagcacagagagauucaauucuuaaaaucucugagucuuccuacuuuugaaaaaggaaagaggagaaugaaauuucaaugcuuugaaacuaaaagcaauuuuacuuuccacuagggaucaaucaacaugcauuucacauuuauuuauauucuacucuaugccuagaagagugaagaugcugugggaguugcaaaaauagaauaacauucagccauuuauauaacaaauguaguuagaagucaaacauuuuuggguauuagagcucauacaaaugugagggauaagaugguuauucuauaucaagcagaauuagccuuugcuuauaccuuguagcaggcaauacuuuaauauaaauagcucugucuuugugcuuuuagaaaagaaaaaaaaguguaagguccaggugcacugauucacaucuguaauccuaggacuuugagaggcugagccaggaggaucacuugagcccaggaguuccagaucaaccugggcaacauagugagaccuugucauuccaaaaaaaaauuaaaaaugagccaggugugguggcacaugccuguaguccuagcuacucaggagccuuagaugguaggaucacuugagcucagggggucaagguugcagugagcuaugaucaugccacugcacuccagccuaggcaagugugagacccugucucccaaaaaaaaaaaaaaaaaaaaaaaaggugagggguguguaauagacauuuaguuuuuuuuuuuuuuucuuuuuuuuuuuuuugagauggagccucgcucuguugcccaggcuggauggagugcaauggcacaaucuuggcucacugcaaccuccaccucccagguucaagcuauucuccugucucagccucccggguagcugggauugcaggugugcgccaccacgccuggcuaauauuuuguaucuuuaguaaagacgggguuuuaccauguuggccaggcuggucuugaacuucugaccuuaugaucugccugccucagucucccaaagugcugggauuacaagcgugagccacugcgcccagccgacaucuauaauuuuugucacauagaauuuauauuuacccauuccugguacuaaucucuguguuaauuaugguucuuugauuacaagaaacaagaacaaauucuggcuaauuuaagcaaagaggaacuuuacugaaaggaaauagaggcucuuauaaauucaagggaaagcuaaaaaaccaagcucagaaaaacauaacuguauaacugugacuaugcucaggagucucauuagggaagcauaggaacugcuagaagcauuuaaaauuagauagguaagauauuuccagagacauuuaagaacuucuacaugaugaagacugcacgaucuugaaauagguuugcgaguuucucugagcuauguagugauucacggagcacaaauuaugguugucucauaacagauugugauuuuuaaaaaaauguuuuacaaaacaaaaaccauuccaauugccaaugccagaaaacucaucucagaaagcagauacuuuauuuaacugaaauuuuugacuaccauuguaaauacacauagauucuugcacagauuuaaggcauuaaccuucuauaagucuauguuuagcaucugaaugaauguaugcaugccuuuuggguccaauugacaaacaacuuuucccgcuuaaagaagauaugaaaaugaaugaagagcagguaauuccuucuucagccuucauucagcuccuagauaaaauccugagacaaagaacaagaauuaaaagauaucgaaagagacuccuguguuaguaaagugcaauccagcuaaauaacagguuucuaaaguaauuucuugucucauaacaugaggaagucugauaacauuaacaaaaacaagcagcugauaaauauaugacaaaaugaauaaaucacucuauuacaggauagggaaaagcugaagaacaguaugacuuucuaucuacaauacuacuuuuaaauuuauaguggcugauagaggguucaccaaaagcgaugggagaaaauuaagucaguauuccacauuuggcuaaaacaacaauacauguggucucauaugaauuucaccaaaaggaauaugggguuuuggcacaggcugcacagagagaacccauuaguccuuaguggcacauauauuuuuaaugucaucuucuguaucaaugaaauaagugguaggcaucuaugcugaggggaaaauaacuagaaaacaaaugauuuaggguucuauguggcuaacuauuuaagugaaguauuuacccuugaucaaaacuaucacaaugucccuaagcuugcuuuccuaaaauauaaggcuuuuuuuuuuuuuaguuuuuauuuuuuuugagacagggacccaggcuggaaugcagugguacaaucucagcucacugcaaccucugccuccugggcuccagcgauccucccaccucagccuccugagcagcugggaccacaggcacaugccaccaugccaagcuauuuuuuguacuuuugggagaagcggggucucaucacauugcccaggcuggucuugaacuccugagcucaagcaaucugcccuucuuggccucccaacguucuugggauuacacacguaagccaccacacccagcccaauacaaggcuuuuaaaauuaaaauuaucauaaucaacaccaaaccuuucaaaaucaauuuauaaauuuauaaucucuuguuugggagaaugccaacaauuucuaguaaauguuccuuaguuuaaccguauagaaaccgcagaaacacauucacacacguacacaacacacaucuuuucuuucuuagauauacaccaaggguuggcaaagguuuucuaugaagggccagauagcaaauauuuuuggcuuaggagaccacacaauuucuguugcaacuacuuaacucuguuguugaagcaugaaaguaguuguagacaauacguaaaucagugggcaugacuguguuucaguaaaacuuuauuauacagguagccauaguuguugccuaucccucacauuggcaucuauaauuuaaacaucucuacauuuaaaaugauguaugaauauuuguacaucuucauuucauaauugaaaaaaaguuacuuccugaauguuaacugagucauguugaccuauuuacuacuauuaauagcaggagcaacuaacaaugaguguuuccuacaugcuaggucucauucuaagaacuucaaaugcauguaccucaaauaccccuuuuauucuucuuauuuuauagaacaguaaaagggccaggcgugguggcucacgccuguaaucccagcacuuugggaggccgaggcaagcagaucaaacagauccuauuuucuaccaaaucucaaggucuugugugaaaaaauucaguuauagucauaaaauuauugccucaucuauuccuacaaagaaagugggagggucuugaauuaauuauccagugcuuacagaaaucgagaaauaucuugaaaagcucuuauacuacaauauaccaaauaauuuuuugaauuauuuuuuugagacagagucucacccugucaaccaggcuggagugcaauggugcaaucucagcucacugcaaccucugccucccagguucaaaugauucgccugccucagccucccgaguagcugggauuacaggcgccugcuaccauguccagcuaauuuuuguauuuuuaguagagacaggguuucaccauguuggccaggcuggucucgaacuccugacuucgugaucugcccaccucggccucccaaagugcugggauuacaggugugggccaccgcucccgaccuggaauauguuuuaaugauccuuacaugaaauucuguuggauaaucuaucccuuauguguaaaacacauccagucuggggauaugcauuuuucuagaguuucaugucauagaaacucuucgagaaccuaaaauauaaccaacuacacucauauucuagaacuucuaauauuuuuaguuaauuauaauccauagugauaucuucuuauauguguacauauacacauacacugaucacuauguugucugguaauuaggcguacauaauaguauaaguaaauaauuauucaugcaaccaacccaaguuuuuguagcuuuuauuaauaaauauuucuucauuugugauguauuaauguuguuauuaaucauuuccauauauguaguugacacaauuauuaucaucuauguaaguuuaauuuuugcccaacacagacacaaauauucaaagauuagucaaggcugggcacggugguucacgccuguaauccuagcacuuugcggggccgaggcaggaggauugcaugaggucaggaguuugagaccagccuggccaacaugaugaaaccucgucucuacuaaaaauacaaaaauuagccagacaguggcaccugccuguaaucccagcuacucgugaggccaaggcgggagaaucacuugaacccaggagguagagguugcagugagcugagaugaugccacugcacuccagcuugggcaacagagcgagacucaggcucaaaacaaaacaaaacaaaaacacaaagaaacaaagaaaagucaaaguucaaagguccaggcuccauguccacaauagcuggggcaucuccgccucugaccgccacacuccaacagcuuagggcugagcccagcuguguccucaaccaucaaagagcauggccuuuggagggaaacuggagcugcaaucccagcucccaccugcucaccuuguaacccugggcaaguuucuuaaucuuucuaagccuuugcuuucucauuucuaaaaugggacuaaugauacuuacuccaggauuaaaugauacuguucaaauaaacugcaugccacuacuggucacauaguaugguucaauaaauacugguuuuuauuuuuauuauuguuguuacuauuuauugagaagguugaaagaaaaucuacauaacacaaaauccauaaauacugcaaaaaaaauagcauaauaacaaaauuuacaaccuacucccaaggaauaaauuagccauguaucuuggcggacauaaaauagaguguuaaaaaguguuaaacaauuaaaaagaguaagagguuaaaaaaauaaccuaguuuaaccuuugaucuaaacauccuuaucuaauaagauaagguaaaguuuaaaguccucauuucaaagcaucgguguaagucaaaaugcauuuguaccauggaaauaaugguaugccucuuccuggauuuuaagcaggaaccccuggauauaugaaugaauaggacaccauaccucaccuuggaaagugugcagacaugccagcugaggagggacccaaggaauugguggaugugaccucagaggcucagcuugaucugcuaggcugugggugggcugggacuaguagccuggccuuuccacagcagaaacugcagcuucaaucaagcccccaaggcucuucugugccugaguucaaaauacuuguccuccagaaauaaagccauucagccauucucaugcuuauacuacagcagagggauaggguacccccugaggaacagaaacaugcagcuuggccagacagguugauguaccugcccaacucauuguaggauaguaagaggacagaggacugcacgucccuucuugcugauccuuuggauuuaugcgugcccaguuaagcuguuccuuaaucuggaccauaaaauguugugguauucaccuuuaucuacuucaccacacaaacaggacagaaaugugcaaggcuguagacccucugauggaagucuauacaagguacuaaaaggcucaaugcaggaagggcacccauacuuuuaagucacuagaauaaugaguccagcaauuacaguuguacuucucuuucagguuucaacuauugcuuacacuuuccauuccugaaagucugaaggagagggggagacaggccugcaaucaccuugaccuuuauccaggaagauuaucaaaugggacauaggggcucuucaaguagaaaacaucugcccugugagaaaaauauaccucacuuugacaacguucuaccauggaaugcauuucaugucacacagauucgauucccaaagccacauggccucgugugguacaaaugucuaccuucuaauguaugcaaauuuuaagugacaaacugcauuuuucagauguaaccuuugagaaagauucugaauagaccccaggguaguuauaaauaaguauugucuuuguuacauacuauaccgaacuuucuaugaaaguccaauucccaggauucuccaggcauauuaacuaacuguggcuauguucuauuaauaauaguaaauucaauuacuaacuuuuaagaacuauuagaggccaggcgcguuggcucacgccuguaaucuuagcacuuugggaggcagaggugggcagaucaugaggucaggagaucgagaccauccuggcuaacacagugaaacccugccucuacuaaaaauacaaaaaauuagccgggcauaguggcgggugccuguagucccagcuacuugggaggcugaggcaggagaaugccgugaacccaggaggcggagcuugcagugagccaagauugcgccacugcacuccaggcugggcaacagagcgagacucugucucaaaaaauaaauaaauaaauaaauaaauaaaaaagaacuauuagaggccaggugcagugguucacaccaaagacauaaucccagcaccuugggaggccgacgugggaggcucgcuugagcccaggaguuugagaccagccuggacaacauagugagacccugucucaagaacaacaacaacaaauuuuuaauuagcuggguguggugucccagcuacucaaggguaagcuaagguggaaggaucgcuugagcccaggaagucaaugcugcagugagccaucaucacaccacagcauuucagccugggcaacaaaggaagaccuuguaucaaaaaacaaaacaacugugaggauaaauaucauaauaaaauuuccuuucacacaagcuguuaauaaagauugcaaugauuuccccaaaaguauauagaucccguuaguaugacuaccauagugaugguggccuuucccucaacaccugucuauuuagaaguucacgaagaugagauagaguucuggccacuagaaguuuucucuggcagaggcuggagaaucaauggaggaacacugguaggguagcagaguuacaggugacagaguaguguucugaaucucaagaaccuauggagagauuuuuuuuuuuugagacggagucuucucugucacuggguucaagcaauucuccugccucagccucccgaguaguugggguuacaggcgcaugccaccacacccacuaauuuuuguauuuuuaguaaagacaggguuucaccauguuggucaagcuggucucaaacuccugacgucaagugauccaccuacugcggucucccaaagagcugggauuacaggcacgagccaccaggccuggccuaggagagaagaucuuuaugagauucauccaccaacuucaugcacucucaguaagucuggcuucauccaggaaaucauagacuacagauagacaggaacaacaugaaggaaccaaaaauguccagauaaugcccaaauucucacagauuucaaacuccucccugaauaaacguucuuccagaacugcugacaaguagccaaaccaacuuccucuccuucucuguguuccccuuuagggaaagaaauuaucuagcagcugaauaaccacccaaagcagaggaagacaauugaagagauuuccccugguuaauuaagcauauaaauaaucaaauaacuuuuugucccaugauaaaugaaauggcuuaauaaauccuggugcauugggauagugguuucuaaagaauuccugccccuaaccacuauaccuucacuugaaagauguaauuguaaauuauaauaaagucugccaggcgcgguggcucaugccuguaaucccaggacuuugggaggccgaggcagguggauaaccugagaacaggaguucgagaccagccuggccaacauggugaaaccccgucucuacuaaaaauacaaaauuuagccgggcaugguggcgugugucuguaaucccagcuacuaaggggacugaggcaggaggaucgcuugaaccugggaaacagagguugcagugagccaagaucgugccacugcacuccagccugggcaacagggcgagacuccgucucaaaaaaaaaaaaaauuauaauaaaguccuuaguaaucagacucugcucuucuuggcuuaaagcucucauuagcgcagacucagcaaauagugaacauguagacaaauguguuggcuccaagcccagcuucuuguauuucauagaugcuucucaauggguuuaacuggagcuucucucuuuuguagucaacacaggcauaagaaaaaucaugcuuuucauaucacaguuccuugucaguacaugaguacaaaagguuugcugcauguggacacgugcuacccauuucauagaauaaaaggcuaaacucauacaguauuaucugagcauaaaaccacuuuuauuuggauucauuacuauuacuuauauuuaugguaagaugcaguacaaaaucaaugccaaaguuacuguuguaaugucaaugcaaugauauacugagguauaagcuuaaucuuauuaauaguggagaaaaauauugacaccuugauaaucaaagguagcuccaggccagguauaguagcucaugccuguaaucccagcacuuugggagaccaaggcgggcagaucaccugaugucaggaauuugagaccagccuggccaacauggcaaaaccccgucucuacugaaaauacaaaaauuagcugggcgugguggcacgugccuguagucccagcuacucgggaggcugaagugggagaacugcuuccacccgggagguggagguugcagugagccaagauugcaccacugcacuccagccugggugacacagccagacucugucucaaaaaacaaaacaaaacaaaacaaaaaacaaaaaaacaaagguagcuccaacagaggcugaggggaugacaaauauauugaaacacaugaccugaaagaccuuuacucaguugaguuaugcaaguaaagaacauuuugcaguuuucccagaagucugcaucuuaauuauuccucaaguagcuuugcuuauacaaagagaugacuuuuauacagcuuuggcugggacucucucugaguggagguguuucuuggaaagacaucaaaacucaaguaauacaaaaaucauuccaugaaauuugaauguaagccaauugccacuucagucauauguugagagcucuauuuuacuuuauuacugagcaaaucuuugcugggggggacaggcauaucuuccaaguaagggaaugguuuggggugaaggagugagcaugaugaacaggccguccucacggugaggagguuuacaccaggacaauuacauuguaaguaguaaagaacaaaauguacacuaacaucuccuaaguuuucucagccuguaucuuuuucuauggaauauuuucuucaaccaaugaaggacauugcugugccuuaauaucuagugggucugugaguuaagaugauucaaaaagaucagagcucacaacuuuuguggauggugaauggcagacagccccgucuucagucuugauugcugcggguggccauuguaagacuauaaaagaagucuucaugaagacaucgugaaagcucagaguagaaucaaggaaauuuaagagaaauagaccgagucuacagccauaccacccugaacgugccagaucccaucugaucucggaagcuaagcagggacaggccuguaauccugugauuacaggccuguccacaggauguuccagugagccaagauugcaccacugcccuccagccuggguacuuggaugggaggaauagaccugaaauucugaucaaacccucuccugaaauuuaauguuacauaagcuuaagaaauccccauuauuguuuaaaccauucuauauauugcccuuuugaauuaguaccuaaaugcauaugucuuuuccuccuucccauccugcuuagacugugacccgaaggcaaacagaauaagccuuacuucuugauauuuuacagggcuacuuccacagcuguauguauguauucugagaggccuggauucaaaaccaauaaaccaagcucccauacuuaccacaugugugaccauggcaaguugcucaugccuugguuucuuccauuuuaaaauggagauaauaaaauuauuguaagaauucaaggaaauaauguacauauaaaagcauaaaauaggacaugacaacauugcuaucacuauuauuuaacaaaugacugaauugucgcauuucuucaaaacucacauauaggccaggcacgguggcucaugccuguaauccuaacaauuugggaggccgagguggguggaucaccugaagucaggagaucaagaccagccuggccaacauggugaaaccccaucucuacuaaaaauacaaaaauuagcugggcaugguggcgggcgcauguaaucccagcuacuugggaggcugagucaggagaaucacuugaaccugggagagggagguugcagugagccaagauugugccacugcacuccagccugggugacagagugagacccugucucaaacaacaacaacaacaacaacaaacaaacaaacaaacaaaaaaacucauauaacaauggacaccuugccaggcgugauggcucacaccuguaaucccagcacuuugggaggucaaggugaguggaucacuucaggucaggaguucaagaucagccugggaaaccuugucuugacccgaaauacaaaaauuagcuggguguagcggcccaugcccguaaucccagcuucucaggaggcugaggcacgagaaucacuugaacccaggaggcagauguuccagugagccaagauugcaccacugcccuccagccugggcaacagagugagacuccgucuaaaaacacaaaacaaaacaaaacaaaacaacaacaaaaaagacaccuugaucacuucucuacaaugauuaucaucaccucuaacuuuuugucccaaauucaucuaaaagucaugagaagacuucauacuguacugagcuacugccacaagcuuguuaggucagaagggcaacccagaagcuaaagggucaauucuggccugguuucccacaacauaggcucuuuaucacuuauucuagguuuauggucuuaagcccccuugcccugcacugcuuucccuucuccacuccucuccccuguccuccccuccucuccccuccccuccccuccccauccuccccuccccuccccuucccuucccuccccucccguccccuccccaccuccccaccccuucucuccccucccgucuccucuccucuccucuuuuuccuuucugagacaagcucucgcucugucacccaggcuggagugcaguagcccgaacauggcucacugcagucucgaccuccugggcuuaagugauccucccaccuuagccucccaaguagcucagaucacagguaugcacuaacacaccuggcuaauuuuuaaaauuucuguagagauggggucucccaguguugcccaggcuggucugaaacucauaggcucaagccaucuuccgaccucagccucccaaagugcugggaucacagacgugagccacugcacccagcuucuguggaaguuucuaagacaguuaucuucccuuguguuagaagcaugacuuacuuuuuuaaguguccuucuuugccaaggaugccugauaacaucuucaauacucccuaacuccuccacccuuagauuuugaauaacuucauuuuaauguuucccaguuuuuauaucuauugaauuaucaguauauuuauuaaaguuauuguguacaaauuuuuaaauaaauucauuauaugaauaauguaugagacaugagauuuccauaauaugugcuuuugcccuuuuccgcccaggcauucucccaacucccacuccuauaugauauacaccccuucauaaaauugauuuuaccucaggacaaauacaaaugaacagacaaagaagucuuuuuuuuuuuuuuuuuuuuuuugcugagacagagucuugcucugucacccaggcuggagugcaauggcauaaucucugcucacugcaaccucuaccucccagguucaagcaauucuucugccucagccuccugaguagcugggacuacaggugugcaccaccacaccuggcuaauuuuuauauuuuuaguagagacgggguuucaccauauuggccaggcuggucucaaacuccuggccucaagccaucugccugccucggccucccaaagugcugggauuacaggcgugagccaccgugccagccuuggauaaagaauucuuguuuauccaucaagauuguugauuguugacuguuuaucaaacuagugaugaggcacugagaaaaauccugcccagaauucaacaggaagacagagcccuuuaugccacuguugagucaacuuuuggcuucaaaauguauaauccaaucuuuucuauagcuuuucgacacuucugccaagucgagagcuaaaggcaggggaggagagggcuugauauaugacaauucuaauaguauaguaucauaauucuaaggaagcaguauaauuucagaagaaacauaguuaccuacgaguguggcaucacuugguuauucuauuuggaggaguuguuucuccuagaaggagaaaaauaugauguuguguucucuuuguucucuuucuaauaaaacaaauaacauuuuaaauuaauuguuguaguaaaaaaaaauaaauaacugaggcccaguacagugguucaccucuguaaucccaacauuuugggaagccaaggugggaagauuacuugagcccaggaguuugagaacagcuugagcaauacagugagaugucgacucuacuaaaaauuaaaaaaauuagccagguguguuggcacacaccuguagucccagcuacucagaggcugaggcagggggcucacuugagcggguaggguuaagggugcagugugcugugaucaugccccugcacuccagcccgggugacagagcaagaccauguguccaaaaaacaaaacaaagaaagaaagagaaaacaaaaacagcugcaguggcucacaccuguaauccuagcacuuggggaggcugaggugggcggaucacuugaggucaggucagggguuagagaccagccuggccaacauggugaaaccccaucucuacuaaaaaugaaaaaauuagcugggcgugguguugcaugccuguaaucccagcuacuugguaggcugaagcaggagaaucacuugaacccuggaggcagagguugcagcgagcugagauuacaccacugaacuccagccugggugacagagugaguacaacuccagaaagaagagaagggaaggggaagggaaggggaagggaggggaggggaggggaggggagggggaacgggaggggaggggggagggggaggggggagggggggaggggauggggauagggggaggggaaaggagugcaggguaagggggcuuaagaccauaaaccuaggauaagugauaaagagccuaugguguugcaugccuguaauccccagcuacuuaguaggcugaagcaggagaaucacuugaacccuggaggcagagguugcagggagcugagauuaugccacugaaccccagcccaggcgacagagugaguaaaacuccagaaagaagggaagggaagggaagggaggggaggggaggggaggggaggaggggaggggggggggaggggagggggaggggaggggaaggggaagggacugguaaaaacacauaaccauuucuccauagucuuuaauauaaugugguuuuaggucaugaauuccacuuaguacacacacuugguaaaacugggcaggauacauuuugagcugcucaagaauaaaagccuucucuuauuucacuugguaucucucacagcuaguacugagaugcccgacaaauagcaggcacugaguaaauaugagcugagcaagugaagaaaugguaucauuugccaaaaauaggguuuguuuaaaagaaauucucauaaaauuagcugaaauauaguugucuauuauaaauuuaaggauuacuaucacaguguugaccucccgcaucguaguuuuacauuugcaaagaaauaagauugucuuuucacuggaguauuuucuaauuuguuacacuauuuuucuuuuucucaaaacaacauguacuaguggguuuuucccuuucucaaaauagcagaaaauuauauuaaccagcgcaguuuuucuggaagugguagaauaggguugugcgugaaucguggagugacuccuguaugugucuauguguguauguauguaucuguguguguguaucuguguguauaugugugugucuguguguguauguguauguguaugugugugugugucuguguguguguacugggggagaugcccccuuggcuugugucauuccccuccccuggcuacaaucccaccgacucaggaauaggcaugugaccuaaccaacgaagucagggugaaccucaggacuugugauuggaguccugaauggaaauacuucccuuucucccagauguuauuacaagccauaugaggccugacauuccuguucuaccacuggcuggaagaugaagccaaccaauaaaagagcuggcacaugaaggagcuacaagagagaaccaaaagaauugcagagaaugaauuaaauuuuaaggcauuguaucuccugaacuuccacuuauaggaggcaacaguuuaagcugauuguuucuugcagucaaaagcauuaaaaaauaucuggauagggauuugcguuguauagaugugcaauugcuuuagucaauauucaucaaauggcauauuuuauuguauauaaauuuuaucucugaaaaaaagaaccaaaagcaaagagugaauacuaguuaguacaccgagagcugaagguuuuaggaaaaguguauuauugucuacaacguacucugaaauacuuuccaaaaaaagaugaauuaauugacagauggauagagggagagcuagauggauagucaugugauaaagcaauacagugaaauguuaauuguggaaucuuaagugguggacaugaguauucacuguaaaauuauuuaaacuuuucuguacauuugaaauuuuucauaauacaauguuagaggaaaaagcucuaacuuacuccuauugcuuauacuuggauguccuuaaauauuaugugauggcuucuggcucuucaaguauaacaagagaaaaaaauguuccuuaucauggcgucaaggccugcuaauccucucucaugacgaccuaggcuaugcucacuguauaacaguagaauuuguuucuaccguuagaauuuauuuuauugaugacugguuuguagaauguaauuggcaaugugagggaaaaugaaucagagucauacauuagguaauucccucaaaaccacaucccuaaacaguuuuauuauugucaguuccucagaacaaaauaggaagagauuugguaaagucuuauuuuaucaaccacaauauaacuuaagaugauuaaggggcauuucacacuucaauguaaaacacagucauauaccacuacagggaauaaaccccacuuuuugcagugaauauauucuguguacaucacuuucauauauagaaaaguuaaagagaaaaaauaaguagcgcuuuaaaaaaaauucagugaaaagaggguccaagguuaccccauucuccuuuccucuugggaaaggagaaagaaacuaagaagcaaaacaauaguuauucaaaucaagaaauucaggccaggcaagguagcucacgccuauaauccaaaacgggccgauugccugagcucaaaaguuugagaccagccuggacaacaugguaaaaccucaucucuacuaaaauacaaacaauuagcugggcauggugguucaugccuguagucccagcuacucaggaagcugaggcacaagaauugcuugaaccuuagaagcggagguugcagugagcuugaacccuggaagcggagguugcagugagcuugaacccugggagcagagguugcaaucaugccaccacacuccagccugagcaacagagagagacucuaucuccaaaaaagaaaaacaaaaaaagaaauucccucuuuacuacacucauuauauguguuuggaaauaggacacaaaccuuaucuguauaaggaacuugcauuuuaaguagcaaacuaacucaagauccucaauagaaauaugugcucaauccuucaacaugaaaaaaaaaaaaagccaauccuuuaaaaguauuuuuuuucuuugcaaauugccuuuucucauauugguuguccuuaaaucagcaaauaauucuuuauuucuacacuguccccccacuacacugucuucuuugcuuucggacaccacucacgacucgcauaguauuccuccagaauuucaauguuuguuagauguuagccaaacuucauacauaauaaaaugcaaccggccaggugcaguggcucaugccuguaaucccagcacuuugggaggccgaggugggcagaucacuugaggucaggaguuugagaccagccuggccaauauggugaaaccccaucuuuacugaaaauacagaaauuagugaggugugguggugccugccuguagucccagcuacuggggaggcugaggcaggagaaucgcuugaaccugggaaccggagguugcggugagccaagaucaugccacugcacuccaggcugggcgacagagaaacuucaucucacucuaacucuaaccuaacucuaaugaaacgaggguggcaugcaaugagagaauggcuaugagaauguucauuuguuucuuauaccuuaagucaaggucagaguagcuacugagcguacugugcuaggacuaguccuucugaauccugccugcucugcacacaaaggacaagguucuguucucuauagcuguaauaguuucaucacucaaaggagugccucauggagcuggaugcucuaaacaaggccaagacauagauaccuacuggcccaaggcuuacucaaugaagagagcuuccggguaaauaucagaacccaaaaucuguagguaaaaguauugcagggagauaggaggacacaaggaucaaagcaaacaaacacagucaaacagaucuauaaguagcagccugagaguuauagguggaaagacuugagccuugagccucccucagcugcuaccuaccuccuccucugcagcugccacgggcuuccccaagcuagaggccaugacauuuguucccuuuugcuacacccuagcaacagcuguuaucugaaaagugggaauacuaaagcauauccuucuuuuuuuuuuuuuuuuuuuuuuuaagacgagucucgcucugucgcccaggcuggagugcaguggcgcgaucucggcuaacugcaaccuccaccucccggguucacgccauucuccugccucagucuccugaguagcugggacuacaggcgucugccaccacacccggcuaauguuuuuguauuuuuaguagagacgggguuucaccguguuagccaggauggucuugaucuccugaccucgugauccgcccgccucggccucccaaagugcugggauuacaggggugagccaccgcgcccggcccuaaagcauaucuugucucacacugcaggguguguuuucucuccucaucuccccacccaaccucacaaauauuuguaaagcuaccaaaaagugauucucugcagccagcccugaugaaaauagcucaaguugauccugaagguaccaccuugcaagcauccuaucugucccacuaaauccucuccccaacuccaucuucacgaugucccccguguaucuaaugauacauagaaacaaucacugccauaaacuucuaaguuuaguuaaggcugauaauacuagaacaaggaucucagauuugguacccaccucuccuugguagauaauggaacacggaaaaguauaauuaccguguagaaaguaggaccgauuguucuuuccuuugucauuuccuaaucacuaaacucauggaaaccaaccauuuaagagccaccaaugaaggggaaaugaacuccugacucaaaugaaagcuagaaagaacaggacaagaagcuggugcugauggccucuaauaucagcacuuugggaggcugaggugggaggauugcuggaguccaggaguuugagaucagccugcgcaacauggcaagaccccaucucuacaaaaaauacaaaaauuagccagguguggugguacaugccugagucucagauacuugagucucagauacuugggagguugagguggaaggaucacaagagcccaggacccagagguugaagugagccaggaucaugccacugcaccugggcaacaagagugagacacugucuaaaaaaauaaaaauaaaaauaaauaauaaaaaaagauauaaaacaauguauuuuuuucuaaaauuuaaaaaauuaaaaaagaaauaacacaacaggacagaagaaugaccuuccuucaccuugcauucucuucucuugagguuuaacuuauuuucaguuuuauugauuccaaagcugauggaagccauaacuuauaucagcaauggccuuuuagaaaaguaauuacaaggccgagcgcaguggcucaucccuguaaucccagcauuuugggaggccaaggcggguagaaaaccugaggucaggaguucgagacaagccuggccaacguggagaaaccucaucucuacuaaaaauuaaaaaauuagccgggcgugguggcgcuugccuguaaucccagcuacucaggacgcugaggcgggacaaucacucgaaccugggaggcagagguugcagugagccgcgauugcaccacugcacaccaccugggugacagagugagacccuaucucaaaaauaaauaaauaaauaaauaaauaaaaauagaauaaacauucuacaugaauuaggcucuugaccauugacuccaaauacagggacucuucauuuccuaaagcccuucuuuuucaaaaaucuguauaggcaguaauuuacugacuccaggauaucucucugcuguuuaggagaagaaaauuucaauccuagcuucuaagggacacccccuaagauauucuuauaccaaccguaaaguuccuuaggugccuacuugaauaaaaugaauuauuucuccuuguccuguuguguaugcucuaaauuccuuaucucauauucgauuuauuagagcuugaucuuugguucaaaggcccauuuuaccuuuuuuuuuuuuauuauuuuuuuugagacagagucucacugugucucccaggcuggaguucaguggugccaucucagcucacugcaaccucugccuuccugguucaagcgauucuccugccucagccuccagaguagcugggacugcaagcacgcaccaccacccccagcuaauuuuuuuguaauuuuagcagagacgggauuucacuauguuggccaggcuggucuggaacuucugaccucaagugaucugcccaccucggccucccagagugccaggauuacaggccugacccaccacaccuggccuguuuuuaccuuuuuucugaaaacugcauuaacauuugcaaagcaaauuuaggaaagcaauucaauauuuauuaaagacguuuuuauuaaaaagacaauaguaagccuguaagagccugaaaggcagccuguuauagaaaaaaggcaaaggugacaaacaauuugaaagaacugcauuuccuccaacuuagcuaacuaaauucauagccuaguaaguugcuuuugggaagucagccuuagugauuggauaagauuguuguaaucagcacacuucaucuugguagaggagcaaaagugaaauuaauuaugaauuaaugaaauuaaaugaauuaaagugaaauuaaugauugaugcauuuucucucuauuuaagcauucccuuuauuauacauucugaauucucuuccuuacccuacucccauucucacagauggcaaaauagaacugcaauuuaucuucccauuaaaaugguuacaaauucugaaucaguggaguccaaauucacuuuuuaaaaccacaugucagaaagauugaguuuaauauuuaguagagaaagugacaauccuaccuugucaaaauauaaauacucacaggaauaaaucagauuuuccccaacagaauggaaaagcuacuugucuacuuuuuuauuuaccaaaguugucacacugcaaugugauauucucauauacaugauucuguuuuaaaguuguuuuaguguuucauuuuuuuuaacccucuaagucacuaguugggaacaguauuguagcuuaucauagugcuuaagagcagaaacacucaacucuaccguaacuuucuggcugaauaaucuauggccuguugguuuaaaugaucuuuuccucaauuuuuuaaucuacaaaauaaaaguaauaaagguaucugcuacauagaguugcuauaaagauuaaaggcauuaccauacauaaagugcuuagaagaguccuuaccagguaauaggugccauguaaguguuauuguuauuauuauaauugcuaccauugcuagaaagagaauagugauauuguugggcuucuuuauuuuauuuuauuuuauuuuauuuuauuuuauuuuauuuuauuuugagacggagucccgcucugucacccaggcuggagugcaguggcgcaaucucggcucacugcaaccucugccaucuggguucaagcaauuuuucugccucagccucccaaguagcugggacuauaggugccugccaccgugcccagcuaauuuuuguauuuuuaguagagacgagguuucaccaucuuggccaggcuggucuugaaugccugaccucgugauccacucgccucagccuaccaaaguccugggauuacaggcaugagccaccaugcccggcuaauuuuguauuuuuaguagagacaggguuucuccauguuggucaggcuggucuugaacucccaaccucaggugauccacccaccucggccucccaaagugcugguuacaggcaugaguccccgugcccggcccuugauuauuuauuuauuuaagacagaaucuugcucugucacccaggcuggagugucauggugcaaucucagcucacugcaaccucugccuccuggguucaagcuauucuugugccucgccuccugaguagaugggacuauaggcauguaccaccacgcacagauaauuuuuguauuuuuauuagagacaggguuucuccauguuguacaggcuggucuggaacuccugaucucaggugauccacccaccuuagccucccaaagugcugggauuaauaggcgugagccacugcacucagcccuguuuuugauuauuaugaauaguacugcuaugaacaucuguguacaaguuuuuauguagacauguuuucucauuucuccuggguauauaccuaaaagcagaauuucuaggucauaugauaacucuauguuuaauauuugaggagcugccaaauauuuuuccaaaggggcuguaccauuuuacauucccaccaaguaguguguagggguucuaauuucuccacaauuucuccacauccucacaaacacuugugacugucuuuuuuguuauacccauccuggaggcugugaaguaguauccaaaugcauuuuuuuuuuugagaccgaguuuugcucuuguugcccaggcuggagugcauuggcgcgaucucggcucacuacaaccucugccucccagguucaagcaauucuccugccuuagacucucgaguagcugacauuacaggcaugugccaccacgccuggcuaauuuuguauuuuuaguagagaugggguuucuccauguugguaaggcuggucuugaacucccgaucucaggugauccgcccgccucagccucccaaagugcugggauuacagguguuaagccaccgcgccuggccccaaaugcaucuuuaagaugcaaaaauugaaauacauugggagaaggaaguaaaaucuuuuaugacaagggaaaaacaugaagaaaauuaaacaaaggguccugcaguuaagcugaaaaaggaagcaagagauauuuuuaggucuguuaguuaauuucuuguccuuauacaaccaaccgcccuuuaaaaagugugaggauuggccgggcaugguggcucacgccuauaaucacagcacuuugggaggccgaggcgggcggaucacgaggucaagagaucgagaccauucuggccaacauggugaaacgcugucucuacuaaaagcacacacacaaaaaaaauuaacugggugugguggcacgcaccuguaaucccaccuacucgggaggcugaggcaggagaaucgcuugaaccugggaggcgaagguugcaguaagccgagauagugccaccgcacuccagccugaugacaaagugaagaugcugucuuaaaaaaaaaaaaaaagugucaggauuggccaggugcagcucaugccuguaaucucagcacuuugggaggcugaggugagcggaucaccugaggucgggaguuggagaccagccugaccaacauggagaaaccucgucucuucuaaaaauaaauaacuaaaugaauaaauaaaauacaaaauuagccacaaucuccgccuccuggguugaagugauucuugugcuucaagaaaaauaaauuuaaaaaauagaaaauagggcgugccuguaaucccagcuacuugggacguugaggcaggagaaucucuugaacccggaggcagagguugcggugagccgagaucgcgccauugcacuccagccugggcaacaagagugaaacuccaucucaaaaaacaaaacacaaacaaaaaaagaagcgucaggauuguggagccagcccccaauuucacaucuggagguuacaauagucauaacaacacucuucuugcuuuaucgauuuauuuuacaaaguuucuucccaugcuguacccuauuugauccacuaccacaaaucuuaugugggaagauauuauucccauucuguagggaaggaugcuuaggacuagagagguuaagugacuugcucaagagggcauagcuacaauuaaagaaagaaaaagaaauugauagaacugggccuagaggcuaaauuuuuuauuucaaaucccaguccuugguuuccucuuaucaccucuaccucaucucugaugacccagaaaguaaugcaaagugagagaaagcagaggggaacugagagugugugaagcacuuagaggcaggaggccuggacauugcaaagcacuuacaauccugcagugagaggggagcuacagacagaagaacucuuugugaaagugacaagaaugacugaacuuccaacccuccaauaacuaggaaaccaggcauacgaccgcuuuaauuccuaaauucugacuauuauacugcucuguacuaacagaaguauauugaauacuuacgauauucauuuaacuacuuacugaguaguuacuaugugcuaguuacagugccaaaacaguugagauaaaaaacagcaaugauuaaaauuuuccaaaguagaauuaaguggcuaacauuuccuaagccuuuuacauguagcaucucauuuaauccucacagagcuccugaagaagugucaucagaauaacauuucguagaagaggaaacugagacacagagaggcuaaacauauuguccuaaaguuacagaauaaaugguggaggcagaauaagaacccaggcagccuaguucuauauccugcgcucuucaccaccacccaauccuuccugcccaaucuugcuuggcuggaagucacaugcagugaugcagagagaccaauaauacuaauuaauuccaggaacuauuuguugaaugcucauuaauacaugaagcccaggggcaaauucucgcaacuccaugaaauacauucaucuucauugucuuuuucaaauguggaaacagagacucagagaagugaauuuacuuguccaaggucacagaacucuaccuuagcuaauguugaccuggugcuuacuacauaucuaucagaaacuacccuaagcgcaacucaucuaauccucauaguaacacuaugagguaaauuccauuauuacccauccuucuucuucuuuuuuuuuuuuugagauggaggcucacucuguugcccaggcuggagugcaguggcacugucuuggcucacugcaaccucugccucccagguucaagcaauccucucaccucagccucccaaguagcuaggauuacaagcaugcaccaccacacccggcuaauucuuguauuuuuaguagagaugagguuucaccauguuggucaggcuggucuugaacuccagaccucaagggauccgccugccuuggucucccaaagggccaggauuacgggcauaaucacuuguccaaggucccacacuaguaaguagcaaagccaagauucagucuagcuuaaagucuuccuugaaacaacuuaaugcugacacuugccuacauaaugguggagcagucauucaaacccaggucuaauuccugcaugacaaggauggcucucaaaacugcugcagugcagagaggcgcuagaaaaguggggaauaacaagugcucuggggacugcaaggaagaggcauuuaaacugcaucuugaaggaaaaaguacuugcuggacaaaaagagccaucaugcaauuuaauauuuguaaaauaaaugaaaaauaaguaacccuauccaacagaagacuuuuaaaaagauggcccaguaaugaagagcagagaaauuaaacuuucuuucccacaguaggcuuuaaagggacugaagccuguuaucacucgccugcuacagcuugggcuucuaaagccuacaaacucuccuuacaauucccccauuuuaccugucccaaaacuggacaagucuuacagguuaguucagguucugcaccuuaucaaccaaauuguuuugccuauccacccuguggugccaaaccuguacacucuuuuguccucaauaccuuccuccacaacucacuauuccauucuugaucuuaaagaugccuuuuucacuauuccccugcaccccucgucccagccucucuuugcuuuuaccuggacugacccugacacccaucagucccagcagcuuaccugggcuguacugccgcaagucuucaggaacagcccucauuacuucagccaagcccuuucucaugauuuacuuucuuucuaccccucugcuucucaccuuauucaauauauugaugaccuucuacuuuguagccucuccuuugaaucuucucagcaagacacccuccugcuccuucaacauuuauucuccaagggauaucaggucucuucuuccuuacucuacucuuuacaacagggcuuuaugaagucacccccgccuucuuggacugcaccucacaaacuuacaccacuauccaucaucuacccaacuccuauaaaacaaccccuuccccaucucccuuugcugacuccguuuuuagacucaguccaccugcacccaggugauuaaaaagcuuuauugcucacacaaaacuuguucgguggucucuucacacgggcaccgcgugacagguuucauuagaaaguacuuuugaugaaggaaaaaaaguuuuuauucccuuuaauucugaccacguauuuuuaaaaaucaacaaagaaucgauaggugcaauuugccuuuuguaacauuaaaaaucaguuaauucugacuuccaauauuggucuccuucagagaccuuugcaagacacucuuucagguccugaaacacagacauuuagaaaccaaaacaagcuggggaauucaggcuaagaacuagaaguaacaggggcccgcguacaaguuguggcucaaacgcugcagagcuggguuuucuuuuuccuggcaaacugauuuauaaccacacgaagggcagcugcagaaccaguuagaccauaaguacuauucccaaacagcccuagaggaaggaccauacagggaugggaauggcaagggggauucugggggucguccuuguucccaaguuccgugagacgccgcaagucuuaauucuugcaggagccaggguccccauggauccugcugcccaaaacgugcgagcccggggaguuggcacagccucaaggcagcccgacaaggugccuccacgcccccuugcggacccaaaugauugaggacgaugugccaauuaacugauaggugcaggguuucagaaaugcucucucaguuuaaccucacaaaaagcccuugaaucagcccuguuuuacagauguaaaacaccgaggcucaggggagugaaggaagacuugucagcaaaaaggaaaaccuagugaagacuaucguuggucuugcuccuuuuaucaaggaguagaggggcuggggucgccucgggaccccacagcgaccccucuugcucucuucgcggaugaggcgcaggcugucagccgggaggccuggcggcguccagguacacgggaagacggacagcgcgguggguggcagggacuuugcccggcacaggacugcagcagccaggcuagggcgcagcgcgcaccacccgcucgucggcuucugccaggcagccccgcuuggcgagcgaguccucagggaccgaggcugcagcagcuaagcgcgggcgcaccgaggaccauccacgcgcccgcagccguuccggcgccccacgcgagucgcaagccacgagccagggagcgcgugcgcgcaggacugcagcgggcacgcguuggcagugccaucgugagcucacccgcugugucucuugccuuaccguagcuguuccccggugaccaagaccucagccaugcgcuccagcucccuuugcugcgccccgccacucccgcuggugcugcugucacugccagcacugccagugcugccgcccuccuccaugguuuuagggccgugcggcuaccacuggcuccgcuguccgccgaggguuugggugcucggaucagucugcccucacagacgcuucccgcgccaucuuuguucggggcagcuccgcugcucugacuggauuggcuggagagggaaucccuauggguaggcagacgcgcugggcuaguccggccccaga

SEQ ID NO: 192547 - RNA, 76615 nt, Homo sapiens
cgcggagcuuguggcgccagaauucggagcgcggaagagccagagcugcgagcgccuggagcuggaucucucuccggucgcgcacgccgaggccaguagggagagaagauggugguucuccgcagcagcuuggagcugcacaaccacuccgcggccucggccacgggcuccuuggaccuguccagugacuuccucagucuggagcacaucggccggaggcggcuccgcucggccggcgcggcgcagaagaaacccgcggcgaccacagccaaagcgggcgugaguacgggccugaggcgggcucccagggcgguucccggggggacugccggcagcccggcgcucggaggggccugggggugggcggcgccggucagggugacaguugucgggggagaaguguggucgaggacgaguaaaauggaagcucucgggaucggaggugcgggucggaucgcugagcugaggcuggccgggagaggacuaagcauuuggucaccaccuacuuuuacgcaagaggaaaucgaagcccgccacagcggagugcggucuggggccaagccgcggcuguucggccgcccgcacgaccccccacucccuggccgaucgaucgcccaggcuccugcccuagguucgcaucaaccuggaggcaacacgcauccccugacugcuuucugucugcgccauaaacguugggggggagggggcacagggacagacagguuguaauucagguucucugaccuccauuaacgauccagaggaguuccguaauaacagcgcagugaauaauaccagguugcauaauguggagggaugaagaccaacauuucauguacgccccccgcuuccaagccucgucauaacccuuugagaaugcguaguugugcuaucucuuugacagaugaagaaacggauucaaaaagguaaacaguaagggguagaucuaaaauuggaacucagauugccugccuccuaaaucguucccuuucuaugccgucaugcugcaguuacaagcagugucuauaggggaaguuuggaaggaaggaggguccucuugaaagaagugcugcuucuaggucugaagugcagugacgguuuuugcagggcagaguuaaagcugagcaguuacuccccucccauccaccuccccaccccagcugcugaaagaggccuagguggagggguuucagcauucacagaagguugaagaagucggggaagcucgcuaguaaauuuaguuaaggcagcaaguaauauauagcuggacugaagguguuggagugagugaggguaggcauggaguaggaaaaauaggaccugagagaagguugggaacuugggaaugagaaugagaggcucaggggaaaugugugguggaagugacaauguaauccucuucaguucagcagacgauuucagggucuuguauuaagucuucuauuaagaucuuguauuuagauaacuauauaaaauuaguugccaguaucuuuugugggcaucccauucugguugcuacucuacugaggggaauggguuaaaaacuacacucccuucagucucugaaauugugauucugaauugaaaagacaaguaauuuccugacuuuaaagauuuguuucucagucaucugccaggaauuggcagagaccuggagaggccaaacacuucugcacuggaauugguuacuugacuuaaccuguguucagaaaauguguuucaauacugauugauuauuuauguccaggguaacacuagauccugugaacauaaugauacguacugauauauugaauacugguuaaauacauaggcucuuuuuuuuuucuucgagacagagucucacucucucauccaggcuggagugcacuggugugaucucggcucaccgcaaccucaaccuccaccucccggguucaagcaguucuccugccucagccucccaaguagcugggauuacagacauacaccaccacgcugggcuaauuuuuguauuuuuaguagagacaggguuucuguauguuggccaggcuggucucgaacuccgaccucaggugauccacuugccucagccucccaaaaugcugggauuacagaauugagccacccugcuuggccaaauacauagacucuuaagaaaacuguuaauuaugaauuucaguuucagcuucucagguuuaccaauaaucaucagguuucuacacuuguuaaaugggaugauacccaccacauugguagugaggauuaaaugugaucauguauguaaggagauuaauugaacaguuagcauaugguuaggauucagucauugucagcuauuaagaccaucgucaguuuuaguuaauggccacuccguuuuuuuuuuucaguuccucaggaaaaaaaaccuuagguuguuguugacuccucacauccagugcauuagcaaauucuguuggcuccacuuucaaaauauauuccaagucugaccacuuuauauguccuccaguguugccaugcugguucaagccauaaucucuuuccuggauuauuuauuuauuuauuauuuugagacagaaucuugcucugucacccaggcuggagugcagugacgugaucucggcuugcugcaguuuccgccucccggguucaagugacucuccugccucagccuuccaaguagcugggauuacaggcaugcgccaccacgccuaccuaauuuuuguguuuuugguggagacgguguuucacuguuuuggccagucugaucucaaacucccggucucaggugaucggcccaccucagccucccgaagugcugggauuacaggcaugaaccaccgcgccugaccaucuuuccuggauuauaauagauucuugauuggccuccuucccguuuuccacuguuugauauauauauuaugccccaccuucccucaacagucaguucucuuuauuuaugcauuuauuuauuuuugagacagagucuugcucugucacccagguuagagugcaguggcaccaacguggcucacugcagccucaaccucccaggaucaagugauucuccaccucagccuucuaaguagcuggaacuacaggggcucgccaccacacccagcucauuuuuaaguuuuuuguagcaauggagucucacuauguugcucaggcuggucucgaacuccuggacucaagcaauccuucaguuucagcuucccaaauugcugggauuaaaggugugaaccaccacgccccaccaauagucaguucuuaaugcagugaaucuuuuuuuuuuuuuuuuugagauggaguuucgcucugucacccaggcuggagugcaguggcccaaucucggcucacugcaagcuccaccucccggguucacgccauucuccugcuucagccucccggaguagcugggacuacaggcacccgccaacacgccuggcuaauuuuuuguauuuucaguagagacaagguuucaccguguuggccaggguggucucgaucuccugacuucaugauccgcccuccucggccucccaaagugcugggauuagaggcgugagccaccgcgcccagcaaaugcagugaaucuuuuaaaaagucaaaacaguugaucacuuaaaacccucuugagacucccuaucuaaguaaaagucuguaaguuuggaagcagcccuaagcaucccugcauccuuuauaaugacaucuuuuucuaccccuuuacaaaacgcacucuauuccagccacacuggcauagcugcuucuuuaauaccagggccuuuccauuugguauaccucugcuggaaauacucuuccccuugauaucugcaugacccauucuuuuaacuuuuuuuuuuuuuuacauuauuuuaaacuaaaaaacaaaaccucaggaauuauaguacuuuagugugguccagaaauuguacaaauaaauaacucaguccuuacaaccuuaugagguagguaagauuuuuuuuuuaugagaaaacugaugcacagagacuuaaauaaauugcccaaauucaccuuauaguaagcugugugacuaugauucaaauuuaggagucugucuaccucaagucuuugcuaaaauuucaccuuugcaaugauguuuaccauaagcaccauauuuaaaauuacaaaccacucuccugacaugccucuccuagcacuugucaccuuccaacauuuucuguacuuuucuauuuuuaaguauuuuucucucuuccccaaucagaauguaacugcacggggacuuggauuuugacuuuuuuuuuggcaauguuaucccagcacuuagaacagaaccuagcaggaaguaaguguauauuaaauauuuguuguugauuguucuuacucuaaagagauacaagucuagcagaggagaccuaacagcaauauacagagacuauuugccauaaaucccguauuugugguauauggugguugagcaauuagaaugcacucugcuggauguuguaggguagaaaggaucccccucaacccccaccacaguucccagcaggcauuauaccuuuuugagacaaaguucuccucccuuuuauacaucaaggugucuguguagaccaaauuauaaucacaguguuacauaaugagcaugggauuggauuaaaauaaaucgguggucuuuagggguaauguauucauacugacaagcccaucaguaccaaaaaugaaacaugccucuguaauuggaauauuuucugauuugggggcuuuacauucaauacauuugguuggauuacaccuugcuguuuuacaucaaucaugcauuucagagacuucacucccugaucacccugauuauauuuggauauuucuuaguuuccucagccacauauuuauugacagagcauuucuuaggcuaggcugcuuuuaugggugguuacauuuauucauuuaauucauuaacuugaauuuuuccuagucuaaucucaggcugaccuuuuuuuuuuuuuuuuuuuuuuuuuucaaaacuucucauuaccucugaucaggcugaucuuaucuucaaguucugaaguuacuuuuagucaccuauuuauuaacuacauuguauuuuuauauuuugaauauguucucauucagcugggcuuauagauuuguguuuuuguuuuuuccugacuuguauggguucccugaauauugugguggugguggucuaaguuuguuuuuuguuguuuuuuuaaaacuucuauuuucauccuaccaacuuuaugacuauggauaucuuuucuguaguuucuuuuucuuccagaaucagaguagccauugucuauuucuguacuuucuuuguuuucuaaggucugagguucuuugguuucuguaaauuuaggguuguuucucauguugaagagucacuuaaggauggauaguaggguguuuuuuuuaaauugaugaugaucguacauuacuuuuggguuuuuuuuuucuuuugagacuguguuuugcuuuugucgcccaggcuagaaugcaguggcgcaaucucugcucacugcaaccucugccucguggauucaagcaauucuccugccucagccuccggaguagcuguaagcgccuuccaauuacaggcgccugccaccaugcccagcuaauuuuuguauuuuuaguagagacgggguaucaaacuccugaccucaggugauccaccugccuuggccucccaaagucugggauuacaggcgugagccacugcgccuggccuacuuuuggguuguuuaccuacauuuuuacuuuucuguguguuagguaaaauagaacauucugcaguauguagaagguacuauuuuaaaaauuguauguuuauuugaaagucuggaaagauacucaaaacucaacaccaauauguguaacauacaggagauuuuaaaaacuuaaagcauaacacaguacagaaacaugaaaaguauauagcuuaaugaaguaucacaaagcauagauagggagcuucuggguguggcagugaaugguguucccuggaauugggugacauggcaguucuguauucagucauaagcaagaaagggcccuugauuuuagguuuagagguuacagcuuuaugugggagacagugaagagcuagaacagggaucugaugagacaguguuucggauggauuauaguuaacaaaaaccuagagcuaagaagaccaguuaaaagauuauaaugguagucugggugcaguggcucaugccuguaauccuagcacuuuguuugggaggccgaggcaggcauaucaccggagaucagaaguucaagaccagccuagccaacauggugaaaucccgucucuacuaaaaauacaaaaauuagccggauguggcagugugcaccuguaauccaaggugccggggaggcugaggcaggagaauugcuugaacccuggaggcagagguugcagugagccgagauugcgccauugcacuccagccugggcaagagagcaagacucugucuaaaaaaaaaaaaauauauauauauauauauauauauaaaauaauaguaauagcuaccacuuauauagcaguugcuguguaccaggcauaguacuugauaagacacauauauuucuccuguuuauaaacuauuauuauccucauuacuagauucuuaguaucuaguauccauauacuaaguauucuagauuccuagauccuuagaguuuaaguuaaggugguauuaguaggaauggagaaaaauguccaauaauacagcacaggaucugagaguuguuugaacacagggagggaagacguuguuuccagcuaaagaagugagcaguagaccauugggaguuuuguuuuguuuuguuuuugagacggagccuugcucugucgcccaggcugaagugcaguggcgcgaucugggcucacugcaagcuccuccuucuggguucacgccauucuccugccucagccuccugaguagcugggacuacaggcgcccgccaccacgcccggcuaaguuuuuguauuuuuaguagagacuggguuuucaccgugauagccaggauggucucaaucucccgacuucgugauccgcccgccuuggccucccaaagugcugggauuacagaugugagccaccacgcccggccgaccauugggaguuuuaugccagaauugcuaagagguugggacugcuuguccuugaggaugaauagaaaacagcaaagcacaggccgggcacgguggcucacaccuguaaucccagcacuuugggaggccaaggcgggcggaucaggaggucaggagaucgagaccauccuggcuaacacggugaaaccacauuucuacuaaaaauacaaaaaaaaaaaaaaaauuagccgggcgugguagcaggcuccuguaaucccagcuacuuuagaggccguggcaggagaauggcgugaacccaggaggcggagcuugcagugagccaagaucgcgccacugcacuucagcgugggcgacagggcgagacucugugucaaaaaaaaaaaagagagagaagaaaacagcaaagcacaaaaagaauuaaggaggucugaagcaaugccuguauuuuaaaggugagaaguugaaucauggaacuaagaguauuaaguaaaccaagggaccgaagcauuuuaagaaaguacuggccaggcacaguggcucacacuucuaaucccagcacuuugggaggccaaggugagaggaucaccugaaaccagaaguucgagaccagccugagcaacauagugagaccacccccccgcccccaccaucucuaaaauaaaaaauaaaaauuggcugggcaugguggcucacaccuguaaucccagcaguuuaggaggccgaggcagguggauaacuugagccgaggaguucaagaccagccugggcaauguggugaaacccugucucuacaaaaaccagcuaggugugguggugccugccucuagucccagcuacucaggaggcugagagagagaaucgcuugaacccaggaggcagagguugcagugagcugagaucgugcugcuacacucacugcaccccagccugggcgacagagcaagacuccgucucaaaauaauaaaauaaaauaagauaaaauacauaaucaguagccaggcgugguggcacaugccuguagccccagcuacuaccggggaggcugaggcaggaggaucucuugagcucaggaaguugaggcugcagugagccaugauugugccacuguacuccagccugggugaaggagcaagauccuaucucuaaaaauaaauaaagaagguagugaucaguucuguagaauucagugagguagagaaaaggcuauuggauguagcuauugggagacaguugugaauguacugaaagagcuguggagguagaaacuaaguuggaguuuaccgaguagauggugaagugguuuaaacucauguuuaaagacaaaacuaaggaaggauaucacaacuauagugauauaacauguauaucauguauuagaauauacuguuguuuaaguuuucagggagcccuaaauuuguguugaguacauccuauuucaaccucauuuguugauauuugaauugacucaaacaacugaccucccccccaaacaugcuuuuuaaaaaaugaauuuaaagcuugaauaagcuuggucuucugugaaaaauaacauagaauauuuuuauuaugcaacuguguauacuuuaggaaaacuuuuuuguuauuuuauugcugcuuuuucucuauguuaacuuacugauucugcaagguugugagaaacuuaaaauuuaacaaaauacuaacauuuccucucuuaaaacuucacuuuuaaagaacuauaagugcucucaauauuuaaguagauuuuagccaaagaauaaaugagaauauuacaucucuagguuaaaauuucagacuaaguuuguuuucucuuuguuuuuuaguuuuuaggaauuuuuuucugguaauacaugugaaaaugugaaaaauagaaagugaaaguccccaucucugucauccaauguuaauuacuguuaacaguguugaacuuaccucuugggaauuagaugacuucgguuuaauaccugugcuagucuuccuuaggaaagaagauauacacaagauaauucaucuagagauauuuauaacaucagaaaaaauugcaggcaaccuaaauauaauacauucagcaauuuguuaaauagauucauguaauggcugaaauacuauucauucauuaaauuuuuagaguaauauuuaaugacaugaaaaaauauugauauuacuagaaaaaacuuauaaaacauauaguauuaucucaguuuuaaaaucauguaaauauguuugcauaggaaaaaaaugguuuuugcaccaagagauuaaaagagguugucugugaguggcugaaauuaagggugacauuuucauuuuuccaguaauaaugggcauguauugccuuuauuuuuauauugcuuuuguuagaacuguuuuugaaagaugcauuuaaaaauuuuuuaguguauacucuauauagaggacucccacauaauuuuuuuuuuuuuuugcccacauuguugagucuuucuugcugccuaguacuuauuuggagagaaugacaagccguucacuaugcacaucaaagauucucuuauaccacuuauaagauugucuuccaaguuucuuaggaaauguuuuuuccuaguauuguccccauccaccccuuuucuuguuuuguaaggaaacaaaaucuuuuuuuauccucaggaauaugguagcauuuauuuucuuuuuuaauguaccaaaauauacauaacauaaaauugaccguuuuaaccguuuuuaagcuuacaguucauuaaguacauucacauuguucugcaaccaucaucaccauucaucuccagaacuuuuucaucuuccagaauugaaacucuguacccauuaaacacuuacucccaguuccucucuccuccuagucccuggcaaccacuguucuacuuucugucucugaaugugacuguucucugaaucucauauuccuagacuaaucauauuugucuuuuaugacuugcuuauuucacuuagcauaucuucagaguucauccauauuguagcauguguuaaaauuuccuuuuuuaaacaagaaggaauaauauuccauuguauguaccauguuuuguuuguccguucaucugucaguggacacuuggguugcuuccccuuuugggaauugaauaaugcugcugugaacaugaguacaaauauuugugcaagucccugcauucgcuucuuugaguguauacccaaaaguggaauugcuggaucauauagaaauuuuguguuuaacuuuuugaggaauugccuuacuauuuuauguuaccaccagcaacacacaaggauuccaguuucucuacauccucaccaacaauugcuauuuucuccuuuuuuuuuuuuuuugugaguagccauccuaaugugugugaaguguuaucucugugguuuugauuugcguuucucuaaugacuagugauguugagcaucuuuucauguguuuauuggcuauuugucuaucuuuggagaaaucucuauucacaucuuuugcuuauuuuuuaauugguuugcuuguuuugcaaaggaguucuuuaaauauucuggagauauauauauguaugcguguauauauguguguguguguauguauauauaaaaccuuauauaccuuaucaguauaugauuugcagauuuuuuucguauucuguagguugccuuuucacucuguugauaguguucuuuaugcauaaaagguacucauuuugaugaggucuaacuuacauauuuuuauuuuguugucugugcuuuuggugucauccaagaaaucauugccaaauccaaugcuguuuucuccuaagaguuccuaaauuguuuuuuaguucuuuauucucucauacaguuuuaaguuaucaucucaacuucccccucauuuauuucuuucaaaggauguaauuucugucaucuuuugauguugacauuaaaaagaauaaaacuauuaugucagacuuuaccuguauccacugcagucuaaaaaccaguugauauguuuugaaacauuuaaaaauaauaacaugagcaaacucuuagcaaaguuuaccuugauucuuuuuuuucucucuuuuaauuugcauuuucaguccacuuaacccacugcauuuuauggugaugugaaauuuuuuucuauacaagccauuuauuugaaaugucuacuauauguaagacagucaguguuagcaugcucaucaauaacaguagaaaaauagaaccaguggaaaccuguauagcuguaaugguacucaaaagagaauuguauccuuuuaaaauguuuuacacaggugaauucaaguuuggagguaccuaaauaaaaauauuacauauuucuuuaaaaacguuuauauacaauuaaaauauaaacaaguuguacaaaguacugguuaugcagguuguagacaacacuugaaugggacaugaaaucaguuuaagaaaaaugucugagccuuagugggcuucugagcgccaagaaauaaaauguuuguggguagaguuguuagaauuaaugcucugucaaucaaaacaagaacauauuaucuacuuggauuugaaaugauaaaacuuagaaaguaagauuuuaaaaaauuguuucgcuaaucuuuguaucguuccaauuuugugagcaagaaaaguaagauuuuaggagaucucacaugguugaaguucccuuacccacccaauuaguucaugugucuguggauguaucauaguuauugcuaaagacaguguucucuugaaaaugccuugcaugggccuggcacaugggugcuuauuacauacucuugcuuucuugccucuggguuggggaggcacugcacugcaaagggagccccuccauucugaagacauugcuaggggagagucuggacuucuaccugugaccagagugaagggaaaauucuugccuugucagagauggaucaaugaccaugaaaaaucuacccugugaucuuuuucagucuaagcauuaaaagcuccuaaagcaaaacaaacaaacaaaaaaucaagacuguguuuuuguguaucgguugcauuguuuuuauaaauguaaguauuguucauauaaauaaguagacaguaauaaaaggaguuaugcuuagcagugccacccaguuuuuuuuuguuauacaucaaaagucacuugccaaaaaugauuuuuaauguucuuuuagcuuuauuaggucuccuuucaauuuuauugaaagcagagaauugaaaaccaccuaauaagggaaaguauuuguugccuuucuuuagucauucaguuuuuuucuuucuuucuuuuuuuuuuuuuuugagacggagucucgcucugucaccaggcugcagugcaguggcaugaucucagcucacugcaaccucugccucccagguucgagcaauucuccugccucagccucccaaguagcugggauuacaggcacgugcuaccacacccagcuaauuuuguauuuuuaguaaagacgugauuucaccauguuagccacaauggucucuaucucuugaccucaugagccccucgccucagccucccaaaguguugggauuacaggcgugagcuaccacgccuggccuagucauucaguuucuuuuuuuuuuuuugagacugaauuuugcucuuauugcccaggcuggagugcaauggcacgaucccggcucaccgcaaccuccgccuccuggguucuagugauucuccugccucagccucccaaguugcugggauuacaggcaugcgccaccucgcccggcugauuuuuuguauuuuuaguagagacaggguuucuccauguuggucaggcuggucucgaacucccaaucucaggugauccgccagccucggccucccaaaguccugggauuacaggcaugagccaccaugcccggcugucauucaauuucuuaacaccuacaccaguguuuuucuuuggcuuuaugaaaguuuuuaauaccuugaagugucugcaauagugaaauucagaaugggugagagauagaacuuuuuuuuuuuauuuaauuuuguuuacuuuuaaaauuauauuuuaaguucugggauacaugugcagaaugugcagguuuguuacauagguauauaugugccauggugguuugcugcacccaucaaccugucaucuacguuagguauuucuccuaaugcuaucccuccucaugccccccacuccccgaaaggcccugguguaugguguuccccucucuguguccauguguucucauuguucaacucccacuuaugagugagaacaugcaguguuugguuuucuguuccuguguuaguuugcugagaaugauggcuuccagcuucauccaugucccugcaaaugacaugaacucauccuuuuuauggcugcauaguauuucuaugguauauaugugccacauuuucuuuauccagucuaucauugaugggcauuuggguugguuccaagucuuuguuauugcaaauagugcugcagugaacaugugugugcauguguuuuuauaguagaaugauuuauaaucccuuggguauauacacaauaaugggauugcugggucaaaugguauuucugguucuagauccuugaggaaucgccacacugucuuccacaaugguugaacuaauuuacacuccuaacuguguaaaauugugccuauuucuccaccuccucuccagcaucuguuguuucuugacuuuuuaaugaucaccauucuaacuggugugagcugguaucucauugugguuuuagaacuuucuuuuuuaaaauggagaagggcaaaugaaugggauggcuugugccuuuucaggcugaucaguuuuaagaaaaaguacauaugaaaguugauaauuuggaaacagauuccauuuaaauauuccuuggaaaaugaaagucuuauacacuacacugaucuaagauguaaauauuugucuuaaaaauaauacaccacccaagguguaaguauucuuuuuucaaacauccucaaauauagguacauugauaaagauggugacaaaucuuacacaucauuuaauauuuuugaaguaccugucuaauuuuuacacaaauuauugugguauaaauauccuuuuuauugugaaccaaccaaauauuuugcucaaaucaaaaauaaaugcccugauaaaacaacauucgacaauagaguaaagccagccugggaugugauccaaggacucaaauguuugguguuuuuuuccuaaaucacugcccguuuuucuaaacugaucaguuuucagaguaguagggcauagaauuauagaguuguuaggaaccuuugacuuugauuucuaucuuugguuuguuuguuuguuuguuugugauggagucuugcugugucgcccaggcuggagugcaguggcacgaucucugcucacugcaaccuccaccuccuagguucaagcgauucucuugccucagccucccaaguagcugggauuacaugcacgcaccaccaggcccagcucauuuuuguauuuuaguagagacgggguuucacaauguuggccauggccaggcuggucucaagcuccugaccucaagugauccgcccaccucaaccucccaaagugcugggauuacaggcaugagcaacagugccuggcccuaucuuuuuuuguuuguuuuguuuuguuuguauuuuagauaccuuugacuucuaaugugaaaauacucuauaugaucucagagcgguguaugaacuuuggaauacuuuaugacagaaccucuagcucauaaagcagcccauuaacuuagccucuagucuauuuauuguacuaaaaugaaguuacauaaagcuguaugguuuuuacaacagauuaacauacuuaaacaguuuuguuuuguuuuguuuuguuuuguuuuguggcagggucucacucuguugcccaggcuggagugcaguggcgcgaucacgggucacugcaaccuccaccucccaggcucaaaucauccucccauuucagccuaccaaguaacugggaccacaggugugcuccaccaugccuggcuaauuuuuuugcaauuuuaguagagaugggguuuugccacguugcccauguuguucuggaacuugugagcucaaagcaauccaccugccuaggucucccaaaaugcuaggauugcaggcauaagccaccaugcccgggcccuaaacaguuuuuuaauucagcuguugcauuagcuggguuaaaacugggcaaaauauacaguaauaacucuuuuucauuguuuaagccaaaauuauaauucugauggaccaguuauuuugagguugcugcuggugguuaggugacaguauuuuggugagucuguaucuuucuuaggucuuucuaacuucuauagccuuaaaauaaaugaguaccuacuauaauaaacuauugcaacuuuucgucagugguggaaaacuucacucucuagacuacuuuuuauaaagugguuaugaacuacuuguuaugaacuauaaaccaguaaaucuuauauuagcugcuucauagacauugcugauauuuguuuaucaugaaaugguuuuucuagauacuaacuuguaguuucuuggggagauacaaaaugauucugcacaaaaagcaguuuuuacuaacuuguaaucagagaauacucuuuggaggaauuuaaauuggaguuuuguaaagaaaaacuuagauggcuuucuuaauuuuucuuaaaggaugggucaucaguuaaggaaguugaaaccuaccaccggacacgugcuuuaagaucuuugagaaaagaugcacagaauucuucagauucuaguuuugagaagaauguggaaauaacggagcaacuugcuaauggcaggcauuuuacaagguaauacaaggugguugaacacuaauucaaaauaguuuuaaagcaguaauuuaggauuugcuuuaauuuuugaaguguauuuuugacuggucaucaagguucuagggcuauaaaauguaguuuauuugaaaauaaaugaucacaagugaguaugacuaaauuaaaaauuaauacguggccaggcacgguggcucacaccuguaaucccagcacuuugggaggccgaggcagacagaucaccugaggucaggaguucaagaccagccugaccaacauggagaaaccccgucucuacuaaaaauacaaauaauuagccggguguaguggcgggcgccuguaaucccagcuacucgggaggcugaggcaggagaauggcgugaacccaggaggcggagcuugcagugagcugagaucgcgccacugcacuucagccugggcgacagagcgagacugucucaaaaaaauauauacaaaauuagcugggcaugguggcgcaugccuguaaucccagcuacucaggaggcugaggcaggauaaucacuugaacccaggagguggagguugcagugagcggagaucaugccauugcauuccagccuggacaacaagagcgaaacucagucucaaaaaaaaaaaaauaauaauaauaauaauaauacguggccgggcgcaauggcucacaccuguaaucccagcacuuugggagaccgaggcaggcagaucacgaggucaggaguuugagaccagccgggccaauauggugaaaccccaucucuacuaaaaauaaaauuuaaaaaauauagcugggcauaguggcaugcaccugaggucccagcuacucgggaggcugaggcagaagaaucacuugaaccugggaggcagagauugcagugaggcaagaucgugccacuguacucuagccugggcaacaaagcaagacuccaucuccaaaaaaaaaaaaaaaaauuaguauguacacauucaugcuuuuauuauucaaagaugauaccugugauacauaugaguacagcuaacaagguuagcugacguaggaucaguucucagguauuugaguaucuaaagagaccuuuugugacuauaacuuagcuugugguuuauggcuccacuucauagucuauacaaagccuucauucauaaucguaguucuguuucugauugcuugcuauaaaguuuuuuaucaauucugagucauuuaugaauuucuauguguugguguugguguauuucuaaagcagucuguacauacgguuuuuugguuuuuagaagaggaggcaugaaacccauuuuaaacucaagaaaucaauuuuaauggauuagguaguuuggcuaaauucauggaacuggaauaucuuugguucagggcgaaaaaccccaauuaggguaaaauuuguuugaugaaauaauuguuuuggcugggcacuguggcucacaccuguaauccuaccacuuugggaggccaaggcagaaggaucacuucggucggggaguuugauaccagccugggcaacauaacgagacccucucucuacaaaaaauaaaaauaaaaaaauuaucugggcauggugucgcacaccuguagucccagcuacuguggaggcugaggcaggaggaucacuugagcuggggaggucaaggcugcagugagcuauaaucaugccacugagagugagacccuguuucaaaaaaaaaaaagaaucguuuuuacauuacuucuucucauaaauaaacaauuuguaaugacuuagaagacugaaauccuccugcucuuaaauggaauuuugauuuuuuuuuuuuuuuuuuuuuuuugagacacagucuugcucuguugcccaugcuggaaugcaguggcaugaucucagcuuacugcaaccuccgccucccagguucaagcgauccuccugccucagcucaccuaguaacugggauuacaggcacgcaccaccaugcccagcuaauuuuuguauuuuuaguagagaugggguuucgccauguuggccaggcuggucucgaacuccugacuucaggugauccacccaccucagccucccacagugcugggauuacaggugugagcuacugcgcuggccuggaauuuugauucucuuauuuuguauaccauauuuucuagauaagcaagguuaugcccuuuugaguuuuuaauuuuuuucucagcuauuucaucauucuuuuaauacauauuuuuuaauuugcgucuuauccauuauuuauggaguguuuuauacuguauuuuaugaaauccauaguaucagcaauuacaugacaauguuuaugggacacuaaaaaagaaaaucacugacaguaaacugugaggugccaucaguaagacacauuccaauuucagagauguuaaaauggggagaaacguacaacuuuuagaauugaugaaguacaauauaaaccagccugauauuucugaaauuugaagucuuaagguuuauucuucugagguaagguagugguccauuaacugucucugagaacuuaaaauuguuuuugacgaucugaagaaaaaaauaagcauuuuaggaccccuaaauuguuaccuuauagagaauugccauaaaauuugaggccauacauuuguguuuacaguugaauuggcaucaaguaguacuacuuuaguuaucuuagauuaaugagauaagaacagaaucagaccugaauacauaaaugaugcaucugcuucuguaugaaaggcaauaugaugugguagcaugacauacuauuuaaaugaauguuuggcacauuuccaauaaagagaaguggaugaguugccccaucgugguacacagcaguauauauagcaauuaugguacacaacaugccaaacucgagagaaacugauagcagucaauaccacauucauacaccaaaugguuauuucauuuuagcaaaaccccuuauuacauuaauauuuauugaugguuuuauaguuuuauuuguauaaaacuuauagaugaacuucuauuuaguuugguuuacauagucauacaaaaaaauuaauguuggaaguccuguuuuuaccuuuaaaaggaucuguacauuauucaaguuuauaaaacauuguuuggcuuuauguuagaaaggucuuaagggaguauaauaaaauaaaugcuuucgaucuggauuuaaagaggaaugacuugguauuuuuaauuagauuauuucuaaaauauauugaauuucuauccuuuuuauuaauucuuuuuuucuuuuugagaauauugccuugcucugucacccaggcuggaguguaguggcaugaucauggcucacaguagccucaaccccccaggcucaagugauccagugguccucccaccucagccucccaaguagcugggacugcaaguuugcaccaccacaccuggcucuuuuuuuuuuuuuuuuuuuuugagacggagucucacucuuuuugcccaggcuggagugcaguggcgcaaucguggcucacugcaaccuccgcccccuggcuucaagugauucuccugccucagccucugaguagcugggauuacaggcaugcccuaccacacccagcuaauuuuuguauuuuuaggaggauaggauuucaccauguuggccagacugguguagaacuccugaccucaagugaucugccugccuuggccucccaaagugcugggauuacaggcgugagccaccacacccugccucauuguuaaauuuuuuguagagauggagucucaccauguuacccaggcuugucuugaacuuuuuuggacucuagcaaucccccugccucagccucccaaagugcugggauuacaggugcuagccacagugccuggccauauuaauuauuucuuaauaacaguuuauugagauauaauuuauacaccauacaauucacaauucuaaaguguacaauuccaugguuuuaguguguguguguguguguguauuuuuuuugagauggagucuugcucuguugaccagacuggaguucagucuuggcucacugcaaccucugccucccagguucaagcaauucuccuaacucagccuccugaguagcugggauuacagucaugugccaccaugcccagcuuuuuuuuuuagacagaguuuugcucuugucgcccaggcuggagugcaauggcacaaucucggcucacugcaaccucugccucccagguccaagagauucuccucccccagccucccaaguagcugggauuacaggcaaccgccaccacauccagcuaauuuuucuauuuuuaguagagacaggaugagaccauguuggucaggcuggucucgaacuccugaccucaggcaaucugcccgucuaggccucccaaaguguugggauuacaggcaugagcuacugcacccagccuaauuuuuuuuuuuauuuugagacggagucuugcucugucgcccaggcuggaaugcaguggcucaaucuuggcucacugccaccuucgccucccagguucaagcaguucucugccucagccucccgaguagcugggauuacaggugcccgccaccacgcccagccaauuuuuguacuuuuaguagagacggggucucaccaucuuggccaggcuggucuugaacucuugaccuugugauccaccugucugagcccccaaagugcugggauuacaggcauaagccacugcacccagccacuaauuuuuguauuuuuaguagauauggaguuucaccauguuggccaggcuggucuugaacuccugaucucaggugauucacccgucuugaccucccaaaaugcuggaauuacagcgugagccacugcggcuggcucaguacuucuuauuguugaauaagagucaauuguauugauauaccauguuuuguuuauucauucauugguuggugagcauuuggauugucuacuuuuuggccauuaugaauaaugauaugaauguagguauacacauuuuuauguggagguagguguuaguucuuuuggguauacaccuggcaguggaauugcugagucaaauacuaacacuaacauuuugaggaaguagcauacuuuuccaaaacauuuacagcauuuuacauuccuaccaccaauguaugagggucucuacauccucaccaacacuugucauagucugccuuuuugguguucgccauuuuaacaggugugaaguaucucacugugguucugauuuaccuuucccugauggcuaauaauguugagcaucauuuuaugugcuuauuggccauuuguaugucuucugucaagaagauuuccuguacaaaaauccucucccuacauucaggucauuauuacaaauagugaugauuauuuuacguaaugguaacaucagugucuguuugcauaaggcuuauauaaaagagccuacaguauuucugaguccuuuuucauauacuuuuccuguuucuuuuucacuguugucagcaugccugacuauagaaaucucuuuauuuccuuccuuuccauucuuuuuuuuacucuuuguuuucaaucuacuugaggcucaaagaccagaggaucaagauuguuagaaaaagacagaaagauaugaguaacugugucaugaggguacgaucuacauacuuacuuacuugauccugggguucuuaacuaggguccagugauuagguauagucuucgcagaguguacacaaaaccucugaaguaauguuuaaacuugcguauaccguagcuuucaucagauuugcagcgguugacaaacuccagcugcauauuuuuguaaauaguuuccuuggaacacugccaugcccauucauuuuguauguggcuccuuucacccuauaauguuagguagcugugacagaggagacuguauggcuuccaagcuuaaaauauuuagugcauagcaauugaaggaaaaguuuaccaacccuuggaagguugcuuuccuccugcaggcaaaaagaagacaguaggggugggugguucagaaaaauagugcuuuagucauucuguuccuagcaucugaaaggggccugguuuauaaaauguauagaccuacaugguaugaagggaggagcuccuuuaugagaaaagucugugagccuuugaagaaacuaagccuuuaccuguagaugaacuacucaaaaguuuguuuguuuguuuguuuuugagauggacccugugcucugucacccgggcuggaauguaguggugcaaucuuggcucagugcagccacugccucccagguucaagugauucuccugccucaggcucuugaguaggugggacuacaggcaccugacugguuuugguuuuguuugcuuguuuguuuguuuguuuuuaacuagagauggaguuucaccauguuggccaggcuggucuugaacucuuggccucccaaagugcugggauuacaggcaugagccacugugcccagccaaaaguuuuuauuuucuucuuaauucuuaccugucuuccaagagagaugaggaauuaaugaagacuuacuuuguuaaugagaauauauaaguuaacucaucagggaaagaugguuuuauuuuacuuuaaguuguaauauuugaaauuccacauauaaaccagcccacuugcaaauagcuugauacauagguugauuaacagaugcagccuaaggauggaaaauugagucacuaaaaacaaauuaauggcacauacuguuuugcuuaguagauuuuuuuuuuuuuuuuuuuuuuugaggcgaggugucacucuguugcccaggcuggagugcaguggcgggaucucggcucacugcaagcuccgccuccuggguucacgccauucuccugccucagccuucugaguaucugggacuacaggcgccugccaccaugccuggcuaauuuuuuuguauuuguaguagagacgggguuucacccuguuagccaggauggucucgauuuccugaccucaugauccacccgucucaaccucccaaagugcugagauuacaggugugaacuacugugccuggccuauuuuuuucaguauauuuuaaguuuuuagguaucuuaguauuuguucuccaggcugauuuaacuuuuugucuuguuuguaguauuauagaauauaagaaauacaguuaugucuuguuuguaguaucauggaauauaagaaauaguuaugucaguuauagccagguaugguggcucauaccuauaauccuagcacuuugggaggcuaaggugggagaacuggagaacugcuugaggccaggaguucaagaccaaccuggacaaaaaagcgagaccccccccgccccaucucuacaaaaaaauguuaaaaguuagcggccaggcguggugccucaagccuguaaucccagcacuuugggaggcugaggugggcagaucaugaggucaggagaucgagaccauccuggcuaacauggugaaaccucgucucuacuaaaaauccaaaaaauuagccgggcgagaugacaggagccuauagucccaacuauucgggaagcugaggcaggagaauggcgugaacccaggagggggagcuugcagugagccgagaucgcgccacugcacuccagccugggcgacagagcaagacuccgucucaaaaaaaaaaaaaaaaaaguuagcuggauguagugagguguguaguucuaccuacuggggaggcugaggugggagguauugcuugagcccagcaguuugaggcuguagugagucaugauugugccacugcacuccuguuggacgauggagugcaaucccaucuaaauaaauaaaaauaaaguuaugucaauuauuuugaauuaaucuaauuuuuuaaaauauaggcaguuggccagacagcaggcugauaaaaaaaaagaagagcacagagaagguaaguacuguuaaagucauuucagaucuuaaaauguguaauuaauauucuguuuacagguuuuuugagguaccuacaauaaauuuuacauguuuaaaguguauaauuuguuagguuuuaacguaaguauaugccaugaagccaucaccacaauaagauagugaagguaauuauuacccccaaaaacuuccccgggccguuuuauaauuccuccuggcucuucuagcuucucuccucacucuuugacacuacuccccaccaguuuccugagcaaauaauuucauuggaacauagccgugaccauucauuuuagaaucuguucucuguuauuauagcuuaguguguauuaucuacaguuuuauauaaauggaaucauacaguauuuauucuuuguuuggcuucuugcaacucaucauaauugcuuugagaauccauguggucacuuuuuuguugaugaguaguauuccauuauauggauauaccacaauuuaucucuucaccuuuugauggacuuggguuguuucugguuuggggcuaucacaaagcugcuuugaacauucauguacaagucuuuguauuacauaucuuuccucuucuccugggaguaggugggcucaaucuuaugguagguguauguuuuaacuuuauuuuuguuuucugauguuuuuaagaaagcuaaguuuaagauacuguaauuuuguuacaugaaaguauagcuuuucaauuguucauuuuagaauuguuuuauaaauacuauuauuucaaauguuucuauuuauuuuuauguaugcauuugugaagacaaagugauuccaguuacucggucauugagggcuagaaacaucguucaaaguacagaacacuuacaugaagauaauggugauguugaagugcgucgaaguuguaggauuagaagucguuauagugguguaaaccaguccaugcuguuugacaaacuuauaacuaaguaaguaaaaauuccuuagaucaagaugauuuaucugucagagacuuuuuguuggggaggaaucauggauuucaaccagcccaaacauuuaaugcauucuacuacguaaagcguacaggagaaugauuaucagaggucuuugugacaauucuguauaugucucuauucuuggaaagaaauuuuaaaauauuuuuauacaaguaaaucaaugcuucuuauaaaaauauuuaaaaccuuagugccaaaaguuugcaauggaagaaaaauaaaguuuuuaaaauucugcuacucuuuuacaauuuucacuuacauuuauaucuuuuuuuuaaagcacugcugaagcuguacuucaaaaaauggaugacaugaagaagaugcguagacagcgaaugagagaacuugaagacuugggaguguuuaaugaaacagaagaaguaaauauauucuuccauuaagggaaugauuuaauauccaguuuaauuuuuuuauaguaccuaauccauuuuucauuaaauaucuacuuuuuccagcauuuauuugaucagucauuaguuacugcuggaaauguaagaguuuauggcuguaaauaucuuaauuuuaaacaagauuggaggauccaacuuaauuuuuuuaauaaauagauuccaaauguuaauggcuuuuauuuaaacauuuuuagagcaaucuuaauauguacacaagaggaaaacagaaagauauucaaagaacugaugaagaaacaacugauaaucaagaaggcaguguggguuagucucuucucuuguucugucuucugggauugaauuuaagaacuuuuuauuuaguagaaaauagccuuuuuagcuagaaggugugacauuuaugguaguuugugagagaucagaggauugguaacuuaaaaguggggaaaggggagagcuuaagaggauaguauguuuuguuugggaaaguaacugaaaucaacaaucuaaagccaauaauauuggucugcuuauguaauacauccacuauggacaacacacuguauaucucuuuuuuaguuuaaaggugauuaaaguuauguuuugcuauuccauuuaggacuuaauuaccauaaucuauuagaacuuaucuuaagugaaaaucaguuuucugaaaugcauuuuaaauguuuggugagcauguuuuaccauaaucauaaguagauugaguuaugcagcguguaacuccaugacagccagaugggcugggugaaaugucaaacuuaaguuuagaaagcaaaagcuuaaugaggaaauuugaaaacuugucaaaaaguuauguuaacuuggaagcuuaaguuuagucaccuacauuaaugaaauucauggaaagacuauaaauuuuaguuuggugcuugcuuaacaguagccuucaaacuucuuucucuacuuccuuuuuuccuuccuuguguuuuucugcaguuuuuuaauguuggaaaagaauuacaaauacuucccaugaacaaucuaggaguagauaaguuugguuuuuuuuuguuguuuuuuuuuuuuuaggaguagauaaguuuuaaaaggguggaucuuucucucccaacucaccuauguuaaaaauuguuaacauuuugcugaguaucuuucuggaaguaaggaucucuuaauuguagagucaucugaagagggugaagaccaagaacaugaagaugauggugaagaugaagaugaugaagaugaugaugaugaugacgaugaugaugaugaugaugaugaugaagaugaugaagaugaagaagauggagaagaagagaaucagaagcgauauuaucuuagacagagaaaagcuacuguuuacuaucaggcuccauuggaaaguaagugcuauacauacucuuuccaggagauguaauuauauuagcuuuauauuuccuguuucuucucuguuauucuugucuuuuugguauuuuucauauuuucauuuuguugaauacucauuacuguugucuuuaccuauccuaaguuuguaacaaauaauuucucugaagaaaguuaaauguuugccuugaccaaagcaaauaacugggcuauuuuugaauuuuauaucugucuuuacuuuagacugcacagcuuucuacuuaauuuauuuugucaguuuguauagagauaggacuucuuuugauuuauguuaauauuauaccacaguacuugugagcauuaauauacaaggcugauaaucaaccuguuacacaucucuacagucacaaugguuguuuauggccuguguguguuuugguugguugguaucugugcuauacauguuaucagcugcaacccucuggacauaaaugacuuaaaauaugaacagcaaaauauuccauaguagauauuuacuaguacuucauggaaggcgauaagcaccuuuguaaguauuuagaugaagagcaaaauuaucuucauacauauuuguaugccauauauauauauauauacaaauauauauauauauuucuuuuuuuuagaaccucgucaccagagaaagcccaacauauuuuauaguggcccagcuucuccugcaagaccaagauaccgauuaucuuccgcaggaccaagaaguccuuacuguaaacgaaugaacagguuugguucugauauagugauugauuuaugacaacauaauuguuuuuauguuagggcuggacucuagacuuucaggauuggguguauuaggauaaaauucuagaauuguguauuugggagagcuuaguuucuauaccuuuaguagucuaauccccaguaccacugacuaguuuuugcuuuugcuuccacuaauaggagguguuaguaacuaccguaguaagguaguuuauuccauuuuuccacacuuuaauaauagagcaaccuuagacucaggguuuacuguaguccuggcucuguguuaagcauuuuacguagauuguuucauuuaaucuucacauuaaguuagaauauagguuuagucuuuucuuugcauacuaucacagaugcauuuuccuaccaugucagauguucuaagcuacauggccucuagaccuuucaugacucugguuaucuuuuucuggaucuauuuuauaauuuauuccucuucuguuguaggaaacauuuauuuucuuugacuauucaauauuuguggauuucuuuuccuucuacaucccaacaguuguucauuggucaaauuuaaguccaaagagauaauucuucuauuuuuauuuuauuuauuuauuuuggggagggugggggcggagcagagucuugcuguguuccccaggccggagugcaguggcacgaucuuggcuuacugcaaccucugccuccuggguucaagcgauucuccugcuucagccucccaaguagcugggacuacagguaccugccacuacacccagcugauuuuuguauuuuuaguagagacggguuuucaccauguuggccaggcuggucucaaacucuugaccucaagugauccacucgccucagcuucccaaagugcugggauuacaggugugugccaccacacccggucaaagagauaauucuugauacuuccucaucaaugcauuggaauaaucauuuugguaguucaugaaugagagagaagacuaagaaaccaggaaaaaaauuuuauuuguauggggaaugguaauuuuuuucccuuaauauuagaauuuucucagaaguaagaccgaagccuuaggauauuucaguuauuugaacaguucuuggaaguuuucuccuagagacagaccaucugaucauguuuuggucauggaagcagcaccuuuguaagugcugaagguuaauuucuuucaggaaaaauaaaaaauacuauuugugucccuaggucuuuucauuucauuguaggaaucacaaguguacaucuagauuucuuauuucaucauccuauuucacaugaccaggguccagaaggauggaggaucgggaagacaaacucagucucucagggcuuuucaagauuaauugcacuugaaaggaggcugcacaucaguauucucacaggccccuuagaauguaaagaccucuauuuugguggugaaauguaaugaucuucagaaaaggagaggaagguauaguguucccuagaauccccaccaccaccaggcacaggaccaaggcacuguuaugguuaccuaacucaagggguggaucucuguuugauccagcaguacuaagaggguggcagcuacuuugggaucuuauuucuucucccguuuuguuuuguuuaagaggaaaucucacucucucgcccaggcuggagugcaguggcgcgaucucggcucacugcaaccuccgcuuccuggguucaagcgauucuucugccucagccccccgaguagcugggaucacaggcgucugccaccaugccccgcuaauuuuuuuguauuuuuaguagagacgggguuuucaccauauaggccaggcuggucucaaauuccugaccucaggugauccacccaccuuggccucccaaguggugggauugcaggcaugagccacugcacccggccgaguuauugguuagauucaaagugcugguccaguguuugugggugucagauuuuuaauuggcuuucaguaaaauggagauugggggaugagcacauguagacagauauguguguuuaaauguuuuuuauuuauuuuauuuuauuuuugguuuuuguuuuucaaauuuaggaaacauuuuccuaugaaaauggauuauacugacuugccucagccccucuuuuccucuuuuuuuuuuaaauuuuuuauuuccguagguuuuuggggagcaggugguauuugguuacaugaguaaguucuucaguagugauuugugagauuuuggugaacccaucacccaagcaguauacauugaacacaacuuguugucuuuuaucccucacucccuucccacucuuucccccugaguucccacaguucauugugucauucuuaugccuuugcaucuucauagcuuagcucccacuuauuagugagaacacauggaacauacgauguuugguuuuucauuccugaguuacuucacuuagaguaagucuccaaucucauccaaguaguugcaaaugccauuaauucauuccuuuugauggcugaguaguaguccacucaauugauggacauuuggguugguuccacauuuuugcaauugcgaauugugcugcuauaaacauacguguggaaguaucuguuucauauaauaaguuauuuuccucuggguagauacccaguagugggauugcuggaucaaaugguaguucuacuuuuaacucuuuagggaaucuccacacuguuuuguauagugguuguacuaguuuacuuuuccaccagcaguguagaaguggucacuauauacacaccaacaucuauuauuuuuugauuuuuugauuauagccauuuuugcggggguaaggugguaucacauugugguuuugauuugcauuucccugaucauuagugauguugagcauuuuuucauauguuuguuggcuauuuguauaucuucuuuuaagaauugucuguucauguccauagcccacuuuuugaugggauuguuuuuuucuugcuaauuuguuugaguucguuguagaugcuagauauuagucuuuugccagauguauagauugugaagauuuucucccauacuguggguugccuuuuuacucugcugauucuuccuuuugcuguucaaaagcucuuugguuuaauuaagucccaccuguuuaucuuugcuuuuauuguuuuugcuuuuggguucuuggucaugaaacccuugccuaagccaaugucuagaaggguuuuccugauguuaucuucuagaauuuuuauauaguuucaggucuuagauuuaaguccucgauccaucuugaguugauuuuuguaucaggugagagaugaggaaccaguuucauucuccuacauguggcuacccaauuaucccagcaccaucugaugaauaggguguccuuuccccacuuuauguuucuguuugcuuuguugaagaucaguuauuugauuuuauuucugaguucucuauucuguuccauuugucugugugccuguuuuuauacuaguacugugcuguuuuggugacuauggccuuauagcguaguuugaaaucagguaacguaaugcuuccagauuuguucuuuuugcuuagacuugcuuuggcuaugcaggcuuuuuugguuccauaugaauuuuaggauuguuuuuucuaguucugugaagaaugauagcugguauuuugaugggaauuauguugaauuuguagauugcuuuuggcaauauggucguuuccacaauuuucauucuacccauccaugagcaugggaugugcuuccauuuauuugugucaucuguuauuucuuucagcaguguuuuguaguuuuccuuguagaggucuuuugccucuuugguuagguauauuccuaaguauuuuauuuuauuuugcagcuauuguaaaagggguugaguucuugauuucauucuuagcuuggccacuguugguauauaguagaccuacugcugauuuguguacauugauuuuguauccugaaacuuugcuggauuuuuuugucaguucuaggaguuuuuugcaguagucuuugggguuuucuaggugcacaaucauauaaucagcagacagacaguuugacuuccuuuuuacugauuuggauacccuuuuauuuuuuucucuugucugauugcuguggcuaggacuuccaguacuauguugaauagaaguggugagagugggcauccuugucuaguuccaguucucagagggaaugcuuuuaaccuuuccccauucaguauuacguuggcuguggauuugucauagauggcuuuuauuacauugaaguguguucuuuguaugcugacuuugcugagagcuuuaaucauaaagggaugcuggauuuuguugaaugccuuuucugcaucuguugagaugaucaugugauuuuuguuuuuaauucuguuuaugugguguaucacauuuauugacuugaguauguuaaaccaucccugcaucccugguaugaaaccuccuugaucauaguagauuaucuuuuuugauacguuguuggauucgauuagcuaguauuuuguuaaggauuuuagcaucuauguucgcagggauguuggucuauaguuuucuuuuuugguuauguccuuuccuaguuuugguauuagggugauacugacuucauagaaugauuuggggaggauucccucuuucucuaccuuguggaauaguguuuacaauguuuuuaaacugaaguaaugaccuuucuacaguauagaguaauugcuaagaaccugggcccaugacuaggacugucuaggcuuggagcucagcucuacuaguuauuagcggccuuuggcaaguuacuuaacucuguuucaguuuuuuuuuuaucuguaaagugaggauaguaggaccuaucucauaguauugugagaauuagaugaguuaauacauguaaagcauuuaaaauagugucugccauacauuaagugcgguauguauuugcuauuauaacuguacuucgauguuuaaaaauaaucuccauuuugcaaaucaaaugucagaaauuucauguugguccacagguuguguuauuguuugcuuuuaacuuuauugguuuaugaaauuaaaaaacuggaaaucaucaguauaguaauguauagaaugcagauuuuuugaauaaacauauagguuugaauucugacacuaucaaugacagauucugauauuuugaguaaauuauuuaaccuggaagccacacuggcccuaacuguaaauugagccuacuaauaauccacuuuuccaaaauuuuaauuaagauuaaauacuauaucaaguacaugguacagaaagcagucaguuaauguuagucuuuuuuauuaauugggagguuagucugaauucugugacuacauagugaguucacauaaaauuaugugaauacauuaaagucuaauauucaugguaauaaugaauaaguuaguuuuucauauaaaguugcagacuuguacuggauauaauaauuuuaguuucaggcugaucacaaagauggucuugguguauuuggguagguggaugggugaaagauuauuuucucauuuauuucuguguuuccacaaccccuuauccaaaacccuuggaaaaccauuuguguuucagaauucagacuuuuuggcuggauuuacagauaacacacaacauauguaguguggcaacauuaacaucucuagggucuccaagccagcacuguguggucaaauacauuaauuaauaauucuguaguaaaacauaugaauaaucauaguaagugggacaaaauagaaacuaaaaauugccuuguacuaugucagguuaugauuugcugcaagugaauaauggaauaacuuccgaguuuuuuugauacacguuucuggaacuacauuaugcagauaauagauugugaaccuuuuguauuuuuggaaauacuuacuuaccaucauugcacucugacucagaaaaguucuagacccugagcaaguagaauaauuaaaguucuucccaaccagacucuuuguuuuuucugugagucuuuugcaaccauucaaagguagaagugauuaaaaauuuucuuguauauuuguaauaucuggcaucuuauuuaauaguaccaaccagccuaaguauuugauaguauuuuuuucuuuuuugugagcaagaaaacuuauggguugaguaacucauccacauuuacacagcuguuaagugacaguugugaauuuacaguggaugguauacuguugauaaaaggccaucuuauucaucacuguuucccagcauuuaaaaagucuuucuugaugcccuuuuguuuacauaaaaucucauguccuucuuuuaaaauuguuugauauuuuuggccgggcgugaugacucacaccuuaaucccagcacuuugggaggcugaggcgggcggaucacaaggucaggaguucaagaccagccuggccaacauggugaaaccccaucucuaucgaaaaaaaaaaaaaguuaacugggcacaauggcucauaccuguaaucccagcugcucgggaggcugaggcaggagaauugcucaacuggaacccaggaggcagagguugcagugagcugagaucaucccacugcacuccaaccugggcuauagagcgagacgaagucucaaaaaaaaaaaaaaguuauuugauuuuuuaaaguaggugauuuccucccaaaugugaauauuauguauaguguaauauugaaaauaguuucaaauuacagucccaaauacuuuuuuuuuuuuuuuuuuagauagaggcaggggcuuacuuugucacccagcaggcugcagugcaguggugcaaucauggcucacuacagccucguccucccaggcucaagcaaaucucucaccucagccuccugaguaucugggacaacagaugugcuacaaccauaccugucuaagcuuuuugauuuuuaguagagaccaaaucuugccaaguugcucgaaugauuuuuaguggagacaaugucccgcuacguugugcuugaacaccugucaagugauccuucccccucggucuccuaaaguguugggauuacaggugugagccaccacacccagccccaaauauucuaauacccucuuaaucccaccuuucucuuugagaauaacugauuuauaucaagacuaagaagucacccugccuucuccugucuccaugaacauuugauauucagcucugccacagucuuuagucuuuuuuccuuuccucucaguuguuuaagucuuuuauuccauuugaaagauucagcgaacaaaguuuaugucagugggucagcagauguauuaauuuuaugauaaacuuuuuggagcauuagguauuucugaugcuuuucuuaugccuuuucuuuuuccugcccuuccuuaucaugauuucaauuuuguuuuuuacuuuaggcgaaggcaugcaauccacaguagugacucgacuucaucuuccuccucugaagaugaacagcacuuugagaggcggaggaaaaggagucguaauagggcuaucaauagguaagugccauauugaugccuuuuuaaacuagcagacacauuuuguaaaaauugcuaagaaaacagaauaauuuggguauaaguauaggcuggcugauuaaaaaguugcacaacagguuaauguauaaacuagaaugcugucuuguuagaauuaucuacaguugaaucagaauaacagguuagaacauaugacugauuucuugacuuuuuuuuuuuuuuuuugagacagggccugguucuguugcccaggcuggaguacaguggcgugaucuuggcucacugcaaccaccaccucccggguucacacgacucuccugccucagccuccugaguagcugggguuacaggugugcaucaccacaccuggcucauuuuuguaguuuuaauagagaugagguuucgccauguuggccaggcuggucuugaacuacuggccucaaguuauccacccgccucagccucccaaagcuauggaauuacagcugugagccaccaugccuggcccgcuugccaaaucauuauauauggcccacagugguucuggucaaacagugacuuaaggaaauaaccuuuucuuuucauguauuuuuuuuuuuuuuuugcuuauaauaaugauaaguucugaggaacucuuaaggaaaacggaaggcuuuacucauuuuauaacuccuuguaguguaaguccauguauacuaaccagcuuauuugauuuucccaauaaauauuuaagggagauagagcaaggauuauuuacauuuuacagaucugguugaguaagugaaaaugcagugcuuaggugcuuggauucuuuuuuuuuucuuuuaauagagacagguucucacuaugucacugagacuagaguagaagcuaggcuggucucgaacuccugaccucaagugacucagcugggauuaccggcaugagccaccacaccuggccauaacuauuucugaauauuuuugaaaguaguuagggaacuuccagccuguccagcauggugaaaccccgucucgacuaaaaguacaaaaauuagccagauguugguggugcacaccaguaaucccagcuacucaggaggcugaggcaggagaauagcuugaacccaggaggcgaagauugcagcgagccgagaucacaccacugcacuccagccugggcgacagggugagacucagaaaaaacccaaaagacaaaacaaaacaacaaaaaaggaaguaguuagggaacuugcuugagaggauugaucuuggauccaaaugcugguagacugcgaauauuuuuucugggagauaucauagcagaauuguuauagcucuggagacagaccacuuguguuugauuccuggcccugccauuuacuaguugggugaucuuggacaaaucaguuaaucuuucuaugucuugguuuuguuuuaaaauggggaaaauaauaauaccuuccucauaagacuguugugaggauuuaucaacuuaauccacguaaagcaccuaaaacuaaaacagugucuggcaaaugguaaauacccugucuguguuagacaccuccauuaaaauguagguuaguacugucugauuucaccaccgugaaucacuuuauggugccuguggcaucuugguauuuuuauuugauuauaugucuuuaauuucauaauaaagcuucagauauaaauauuucuaacacuuaaguucuggaccuauuacagaaaaugaggaaauuaaaauacauaucuuaagauugcuccgguugaaauuuagauuuuuuuuuuaacuuaaauguuuauauucaaacauggaauuugggaaggagggugaguugauggguuugugugguuuuaaaaaaucuuuuuaaauaggugccucccacuaaauuuucggaaagaugaauuaaaaggcauuuauaaagaucgaaugaaaauuggagcaagccuugccgauguugauccaaugcaacuagauucuucagugaguacucuguuuugaaacauaugcuugaacuauaaugugcuuuguuuuaguuuuaaaguuaaaaaaaggaaccaaugauuuuucuuuuuagucaaaacucuaaccuuuacagacguuuucuguuaaucuucaggucacaauuaagauauuauuacuucauugacuguguaugguguggggugacauuuuaaucuggacuccaaaucuaaaaauguacauguucgcuuccauuaccagguacgauuugauaguguugguggccugucuaaucauauagcagcucuaaaagagauggugguguuuccauuacuuuauccagaagucuuugaaaaauuuaaaauucaacccccaagguaauuuaauuauauuuuuaauuuuagcugaaaaucuuugcuauucuugcuucuuguaguucuuauaccuugcuuauuaacccauuuuuaagugauaguucccuuuucccuuuucauuauacaacuuuucucucugaaucaccuuuauagaagcaguaauuuaaauaaacuuuuaaaaauuaguaagcuuuccccccaucauaaaaguaauauacugggccaggcacaguggcucaugccuguaaucccagcacuuuggggggccaaggcggguggauuaccugagcucaggaguuugagaccagccugggcaacguggugaaaccccgucucuacuaaaauacaaaaaauuagccaggccuggcggcgugcgcugaggcacaauugcuugaacccaggaggcggaaguugcagugagcugagauugggccaccgcauuccagccugggcgacagagcaagacaccaucuccaaaaaaaaaaaaaaaaaaaaaaaaaguaauguaccauauaucaaucacagguaaacacugguggguuuuaaauuaaauuuuguaauuuaaaaaauuagaaaguggccaggcacgauggcuuaugccuguaaucccagcacuuugagaggucaagguagguggaucacaagguccggaguucaagacuagccuggccaacauagugaaacccugucuuuacuaaaaauacccaaaaaauuagccaggcaugguggcgggcaccuguugucccagcuacucgggaggcugaggcaggagaauugcuugaaccugggaugcggagguugcagugagccgagaucgcaccacugcaguccagccugggcgacacagcaagacucugucucaaaaaaaaaauagaaagugccaggcaugguggcucacaccugugauuccagugacuugggagacuaagacaggaagauugcuuuagcucaggaauuugagguuguagugagcuaugaucaugccacugcgcuccagccuagcugacagugagaccccaucuuuaaaaauaagucagaaaguuauuaauauuaaauaacauuuacuucuuacaggaaauguuggaagugccuaguuaaaguaauuuaguaaauuaaaaacaaauuucuugaauuuucuuucacauuucuucuuccuuacaauauacguuuucccccauacaaauugaauuauaugauugugauaugugauuacauaugcaagguaagauaauaugaugaacaugaugaaugaauuguuaaaauguuucaaauagaguuuuauuuacaguuucaauauuaauuuuacaguaucaguauuaacucccagguuuuaaguugugcuuuguggugcgaaacuguaccauaauucaguugucuuacacauuuuaauuuucuaauuaaaugaaucaugaaauugguuucuaauuuuuguuuuaaaagucugcuuuuuaaauguaauacuaaaauguuaauguauuguuuuacagagguuguuuguuuuaugggccaccuggaacuggaaagacucugguugccagagcacuugccaaugagugcagucaaggggauaaaagaguagcauuuuucaugaggaaaggugcugauugucuaaguaaauggguaggagaaucugaaagacagcuacgauugcuguuugaucagguaugauauuaacauuuuauauaucuggauaguucuguaaucuaggcagaugugugugaggauuagauaaaucuuacauuuaaucaguguucuaaauaaacccagaagaauuagacuauuucuuucuagauuauuuucuuuuauaugucgagaugacacugaccuacagugaacaguuuuauaguaagaagggaaagaaauaauuggaucuuaguuguuuggagucuuaggucucaugcauauaggaagagagugguaaucucauauuuagagagauaguaguagugaauuauggcucaguaugggaguuaaagacuauuucugcccuggagcggcuuucauuuucauaucccagauuguauugacagcacauuguaagauaauacuuucugaucuacugaggcauauugcugcaaaugcuuuuaaaucucuuuuuggaacucucccgagguucuuuuuuacuuuuauguuuauggaaauggauaaaaacuguggcaucuugcuaaauaauguuuucccauccugacuuggaggaagacuaugucacugucuucuauucuuugucuuguuuccauaguucaauaaauauuuuugcguguccaggaacgauagcuaugugaaaucuaagguauauaaccaguggaguauaucuuuugaauacuucugguugaaaaugcaauugaaaauuaaaccauauaucauuauaauuuaguuugaauucuuaaaaccccguuacuagaacuuauguuuaaauuuauaaauuauaaauaguuauaaauuauaaauaaauugagacugaggcaggaaaaucacuugaacccaggaggcagagguugcacugagccaagaucacgccacugcacuccagccugggugacagugagacuccaucucaaaaaaaaaaaaaaauuauauauaaauucugguaaguaaguuugaagaaaaaccgauucaaauaguauauauucagcuuuauaaauucuguuaagcauauuugaaugagaauuuauuaaaaugguuuauauuaagucuacguguuugaggcuguuuaugcuaacaaaugaccacuccaccuacuuucuaggccuaucagaugcgcccaucaauuauuuuuuuugacgaaauugauggucuggcuccaguacggucaagcaggcaagaucagauucacagguaaaacuugcuugauggcacuucaacguuucuuccuauuuccugagugguauugaugugugagagauagaauguuaaauggugaaagaaacuuuauaagcuaguaguuccuuuuuuugguaguagaaccccaguauauaguacaaaaauaaaaaauguggaugguugcaguggcucauaccuguauuccuggcacuuugggaggccaaggcaggcagaucacuugaggucaagaguuugagaccagccuggccaacauggugaaauccugucucuacuaaaaaaaaaaaaaaauuagccgggugugguggugcaaaccuaauaaucccagcuccguggaaggcugaggcaggagaaucaggagaaucacuugaacccgggaggcggagguugcagugagcugagauuaugccacugcacuccagccugggugacagagcgaaacucccucucaaaaaaaaaguaaaccugcuccgagugucaguguguuguaaagcaugguuuaaaaaucuugguuacagaagauuuaacucaugauagaaacaaaugucugcgggucagugauguuaagccacuaguaagaggagggcuaugguggggaauguggcugaauguccuaucacaagagcauauucaguugcuuuuaucucugaccuguuacugaugugcagaagcuuacccagacuugaaaaaucgauuuuuucccucagauuuuauguucaaauugucaaguaucuuaaauuuuaccagcuaauuuggaugcuuuuaagacauugccugcgcuaaacaaaaucuaacuuagggcauuacuacuaguuuaggauucuaauacuagaccaaucuccccauuuuaaagauggguaaauugaacccucaacccccaugauuaguugcuuauccaagggagcacuuuuacaagugcuauugucccaaccugaaucuaaauugcuuuuagucccaauucauuucaguuuuuuagaacuucuuuuuaaaugguuucaugaaugauguguaauugauugauuaauuuggaauauccuaaaggaaauauuugcauacuuucauauaugcuaguaguauuguuuuauauuguagauaauguagaugaauaagauauagugugugauugauagguggguuuuggcuuuucuaacaucuaacaagauuugcuauauucuaauggccuuuuaaacuugaugauaaacaauuuugcuuauugcugugaguaaauuaaaauauauguuaaguaccaugguaaaaguaguuuugucucugcauguccuauuaguaaucagauaaacuuuuuauaugugacgcauuucauuaucagucacacuauauucauugugcuaacaggaaggaacauauuuaacaauacuuccaucacuucauaaucaaguaaguugaguacuuacuguguuuugggauacuucuaaagguauuggaggaauuuuggcaaaaaaauuacagaguaauuguagcaaaacugugccaucucaaauauauauauauauauauauauauuuuuuuuuuuuuuuuuuuuuuuuuuuugagacagagucuugcucuguugcccaggcuggaaugcaauagcgugaucuuggcucacugcaacccccaucucccagguuccagcgauucuucugccucagccucccaaguaguuggggcuacaggugugccccaccaugcccagcuaaauuuuuguauuuuaguagagaugggguuucaccauguuggccaggucuugaacuccugaccucaggugaucagcccgccucagccucccagagugcugggauuacagaugugagccaccgcacccagccuguucuuuguauuuuuagcagacacuggguuucgccauguuggccaagcugguccugaacuccugacuuuaggugauccacccgucucugccucccaaagugcugggauuacaggcaugagccaccgcgccuggccaaauauagcuacauuuuuaaaagaaauuuaguauucaaguuauuuuaaccaaaaacuuaaaaauucugacagaguaaaaauguauguuaaauuaagcuuuuuuagaauuuagcacauugcauguugaagaugauuaaacuguauucugcacuuaauuuuaguaauaauacuguagaauaaugcaaauaaguaauuaugugaaugucauuagguaauaauauuuucaaccuaagagaaagaagauacaagugugaaauaaagaagucaaauuacccuaaauuguuuuuuuugagacaaagucuugcucugucgcccaggcuggagugcaguagcacagucuuggcucacugcaaccucugccucccgaguucaagcaauucuccugccucagccucccgaguagcugggauuacaggcauguaccagcacacuuagcuaauuuuuuguauuuuuaguagagacaggguuucaccauguuggccaggcuggucucgaacuccugaucucaggugauccaccugccucagccuuccaaaguacugggauuacaggcgugagccacccacuugaccugaaacccugauagucuuuacuuugaauugcaaauaucaauagaaacuugggacagaguuuuuuguuuuguuuuguuuuguuuaaagaaaaaaaaaauccuaacucuggacacuuuaaacaggccuagaagcaaucacaauccaguagcaauuaauguccaucccugaguguggucucuaaauauuaggacucaggagagauggcggauuguaacacugaagcagaaacgaucaagacaagccuggaauacuuuguaaugccugaaagcaauaaaaaaaaaaaauuacuggaaucguaccagaaugacauaggagccaauuuugagggaucucucacuggcugaagaugaaacaauuugagcaucaaaaauagugacuacaguagauagaaauauaucaaauaccuaaaaaaaaucacuuuuuuauguuguuaguuuuuuguuguuguugguuuugguuugguuuguuguuguuguuguuguuguuuugugacagagucucacucugucacccaggcuggagugcagugguaugaucuuggcucacugcaaccuccaccucccagguucaagcuauucucgugccucagccuccccaguagcugggauuacaggcaugugccaccacuccuggcuaauuuuugaacuuuuaguagagacgggguuuugccauuuuggccaagcuggucuugaacuccuggccucaagagaucuaccugccucagccucccaaagugcugggauuacaggcgugacccaccacacaaggccuuguuuuuguuuuuugagacagaaucuuacucuguuacccaggcuggagugcaguagcaugaucacaacucacugcagccuugaucuccugggcucaagcaaucuucccaccucaacuucucagaacuacaggcacacacuaccacacucagcuggguuuugguuguuuguuuguuuguuuuuuaguaaagaugaagucucuguugcccagguuggucuugaacuccugagcucaagugauccucccaccucaggcucccaaagugcugggauuacaggcaugagccaccaugcccagccaccaucaguuuuuuguuguuguuguuguuguuguuuuugauuuuguuuuuguuguuuuuuuuuuuaaaagaaaacaucuuauuuguaaaaaaaaaaaagguaugauuucuuaauuucuauucuuggcauaaauuuucuuuccagugcaaccaaaacuuacggaacccucuucagcacuguuauucagaacuuggaguucuauugcuggauaaaaaauucauucacaaauaagcugugcaauucgaucaccuugaaguuuugacuucaaacuuuucuuugacaaaacaccaauguuucuccuauaaccuucaucuaagauacccagcuccuaaguguugcagccaagccaaaauguagagcuacucuuccauaauacccagaaggagcagcuaucugaaugucugauagcuucuuccauaggugguacuguauaaucauaugcacuguauaggucauagcccucggccuguguggacucccagcucccagguugaguccagaaccaggcaagguggagcuacaugccccaccccacccuccugugcaagccagacccacuugccgggggaaaugacaggugucucuuuggagcagggcauggcagagcaaggaggugaggggaggagauagccacgagaaccagaaagugcagaaugagccuccuccccaucaccaccacccccgccacugcuggcagggaacacaccaagaucuuaaaaaucaucaguuuuuagggccgggcacgguggcucacaccuguaaucccagcacuuugggaggccaaggcggguggaucacgaggucaggagaucgagaccauccuggcuaacacggugaaaccccaucucuacuaaaaauacaaaaauauuagccaggcaugguggcaggugccuguagucccagcuacucgggagguggaggcaguagaauggcacgaacccgggaggcggagcuugcagucagcugagaucgugccacugcacuccagccugggcgacacagccagacuccgucucaaaaaaaaaaaaaaaaacaucaguuuuuaauaauguuuuuaauucaacuggucaccuaagguugcugaguuauuauuuauuacucugaaaauugauaagagggaaagaaucaaacauuucuucuuccuguccuauacaggccaugauugaggguaauucagcaguugaugaaguaguguaguucuuuguauaggaaaaucacagcuaauaaaugcaaaagaaaugauugaaucagaaagucaccauuuugcagccucuuaugaaauaguggaucuagaccugucguuuuuuaaccagggaugaugccaucccccuccccgaagggacagauaucuagagacaguuaugguugucacaacuggugggggcagcuacuuagcauuugguagaugaaggcuguuaaacaucuuacacguacaggacagcucuccacaacaaauaauuaucuggcccaaaaugucaguagugcuaauuugggaaaccuuuaucuaaacaauaauuaucaauggccacucaagcaguaagauaaaaaagaaguuugauggggauauuuaugauggguggaacaagcuguuaacaccugaccgaaacucaacccacugauugaccuuaaaugggaaacugauauuaggugccuccuguggggauauaauaggaauuacgugguaucuuccugugaaauaugccaucccaaaugguuuagccagcauccaugaagcuucuagaucuaggccgggugcaguggcucacgucuguaaucccagcacuuugggaguccuaggcaggcagggcagaucacaaggucagaagauggagaccauccuggcuaacacggugaaaucucgucucuacuaaaaaaaaaaauacaaaaaaauuagccaggcaugguagcgggcgccuguagucccagcuacucaggaggcugaggcaggagaauggcguaaacccaggagguggagcuugcagugagcugagaccacgccacugcacuccagccugggagacagagcgagacucugucucaaaaaaaaagaaaaaaaaagcuucuagaucuagcuaccaguuuccaggaaaugugaaagauagagggggacaacuuaaaugacccuaucaggaagcagucagcccaguccagaacgugggaaggaaauucuacaagccaaacgacccaguuucuucaacaaauaaaugucauggagggaaaaaaaauguaagaggcacagugggaacugucaaggaauucagugacaaauaaucaaguguaguguguggguccuggauuaacuaaaucaaauguaaacagguauuuugagacaaucaggaaaaauuggguauuagauauuauuaaagaauuagucauuuacuuaggaugaugauauuguuggguuuguuguaaguccuugucucuuagaaauccauacaugaaguacuuacaugaaauauuuaugaauugaacuguguguccgagguuuuauuuuucuuuuuaaaagugaucaggugaagacauuaaaaaagucauacugauaauuguugaagcugagugauggaaauuuggagaucauuuuacuauucugucuuuauaauaaaaaguuuaaaauguaaugaaaauucuguuaugcuuuauguauauucuauuuugguguccuuugauaauguauauacaguggaaauuuuauuauuuuuagauacuguguguccuaccuggugcuaccagcacuuuuuuucuuuuucuuuucuuuuuuauuuuuuugagacaaggucuugcucugucacccaggcuggaaugcaguggugcaaucuuggcucacuacguacaaccucagcuucccaaguaguaggacuacaggcacaggucaugucaccaugcuggcuaauuuuuuuuuuuuuuuuuaauagagaugggguuucccuauguugcccaggcuggucucaaacuccuggccucgaguacucuucccaccucagcccccaaguucugggguuacaggcgugagccaccaugccuugccuuuuuuuucuuuuugauguuauauauuguuugagaacucuuaaguuccuuugugaaauuaugcuuuauaaaaugucuucuaggauucauuuguggggggucuaacaaccgucuguuuuccauugauuucaauuucugugggccauuugggauguuauuuuauagauuuuuuuaauccauuggaaauagugaggugcccugagaaaauuuauucacauguaaugcguuaaaucuuacaaaagaagaaauauuacugaaugauauagacuguguucauaguauuaaucucuucucucuuauuuuuaaaauuuaguucuauuguuuccacccugcuagcucuuauggauggauuggacagcagaggggaaauuguggucauuggugcuacgaacaggcuagauucuauagauccugcuuuacgaaggccuggucgcuuugauagagaauuccucuuuagccugccugauaaagagguaagaauuuaaugucacucaaauuuugacaaaauauauugcuguuuauuaauaauaagucuugguauaguaaaaauuuggagauucuugaguuuuguaucauggucuugucaaaugauaguaaacaacucaaauggggacaaauuuuuauucuuuucuuuaaauauaauaaugccuucccaaaauuacucuuaaaauuauuucaauuugaguguagccuuuggauguucuaaguguugcuucagaacauauggcuuaaugaguaaucaauccuuagccaguuuguuagccuugucuuuuucaugaauaucaucauauaauccuaccgaguuuuuuuaagucuacuuaaucuucugggaaccaaagaggaaaauaugucaagagcugucuguacucuuaaaaacagcucuuaauaugcaccagaaugaauagcuacuuuaguaguuacuuuucucuuauuuguguuuaugacgaauauaacuuuagugcuauaaaugcaaauauguuuaauaaugagacuuaaguucauuaaacucuuaaaaguacauccuuuuucuuauuuucacuuucauauuuugcuuauauugaguuuuuuugguugguuguuuaugauaaagucuugcucugucacccaggcuggggugcaguggcacaaucucagcucacugcaacuuccguccccgggauucaagcaauucucgugccucagacucccaaguagcugggauuacaggcacaugcuaccacgcccagcuaaucuuuguauuuuuaguagagagugguuuucaccauguuggccaggcuggucuugaacuuccaaccucaagugauccaccugccucggccucccaaagugcugggauuacaggugugagccaccgcacccggccaguauuaaguacugaucacuuuaaaauuuuagauaaucaaaaguauuuuaaucaaaauuaauguaaucugaauagcauuuauuauuauaguuguaaaaaauuaaauuguuuuuauucauaggcucgaaaagagauucuaaagauucacaccagggauuggaaucccaaaccacuggacacauuuuuagaagagcuagcagaaaacuguguugguaaacauuguuuuaagcaguuaaaauaaauacuacauuuauuucaaauaugaaacaaguuauauuagguuggugcaaaaguaauugugguuuuugccuguaaaaguaauggcaaaaaccacaguuucuuuugcaccagacuaauaaagaaauacaagguuauauuuguuucuuaucucuuauuuguggcauuuucuucucaugaagucuugguauuaaauagagauauuugacaaauuggccaucaggggcagaguagauaauaauauaauuguacaaaauacaauauauuauuauaucauaauaagauaauagcuauucuuuacugaccauuuuguagucauccuuuuaagcauuuuacauauauuauuucauguaauuuucacaucauuccugugauguagguagcaguaucucuacagaugaagaaauggcuggagagcauuaugugaaucuucuaaggucauacagcuaguaaauuacaaacuggaaugugaaucuagucugugugauuuuaaaacucuugcuuuugaccucugugcuauacuuagugcuuguguauugcacucuuaaaaguugauugauuguugauggccauuacuacccuauaaguuuacuggguaaaagagauuuuggucuuauuacucuuaaauauuugcuaacuauauuccgaggcugauuuuuaauuuuuuuuuuaaccauggucaugcuaauagaguuuuguguuucuuuguuuggucggcugguucuuuucuuccccugguugcuuuggauaggauacuguggagcagauauuaaaucaauaugugcugaagcugcuuuaugugcuuuacgacgacgcuacccacagaucuauaccacuagugagaaacugcaguuggaucucucuucaauuaauaucucagcuaaggauuucgagguagcuaugcaaaagaugauaccagccucccaaagagcugugacaucaccugggcaggcacuguccaccguugugaaaccacuccugcaaaacacuguugacaagauuuuagaagcccugcagagaguauuuccacaugcagaauucagaacaaauaaaacauuagacucagguauaaaacuugauugaccauuuaaaguuaguuuuuauaaucaguaaagugaaauguuucauacauaccagaaauauuuauuuguaaaagaaucucuugaaaagaauuugguaaugcuuuaccugggauauuugaaggaaauuuacuccauggauugcccuuaauuuaacuuauuguaaguuuggggugcauuuuuacauuuacuuauuaauucauaucuacacaaauauuuuugauucuuugaaaaaauuuaauugaaguaugcugacuugguaacugaagcaauaaagauuugcuuugcaauccaaaaguuacuaauguacaauuuuuugguuuuauagauauuucuuguccucugcuagaaagugacuuggcuuacagugaugaugauguuccaucaguuuaugaaaauggacuuucucagaaaucuucucauaaggcaaaagacaauuuuaauuuucuucauuugaauagguauauuuuucuugcaaaucaauguuuuuugcauguguaaauuuucuaaaaauaaaugagaugugguugaaaaaauaaaaagugcuaaccaaucugcuuuuuauuuaaauuaaacuaccagaaauuuuuuguuguuacaguugucacaacaguagaaauuacagucuauaaaaauauuccuaaaaaccuuugggggucaguuuccagaaacuaugugaaccauguuaugauugguuggccuuauuggcaagacuuuuuacuuaugaaaguuuauaguugacaauuuagggggaaaauuuaaacuguuuuuucuaaaacauagcuuauuaaucauuucucuuucagaaaugcuuguuaccaaccuaugucuuuucgaccaagaauauugauaguaggagaaccaggauuugggcaagguucucacuuggcaccagcugucauucaugcuuuggaaaaguuuacuguauauacauuagacauuccuguucuuuuuggaguuaguacuacauccccugaagaaacaugugcccagguaauuuguuggugcccaaguauaagacaaaacaggcuuucagaggcaaaagcuaaaauugccccauuuuuuuguauuguguuuuuuugucuuucugauuuguaacuuuagguuuacaaaacagaguuaugcaugauugcuuagucauuaaagagaaugacuuuaaaucccacauucacccuuaauaucuuugugaccuuaguaaaguuguuagaucucucuaauuuuccccuuuuggaaaauggagauaauacuacuuaccucacauggcuguugugagaauuaaaugaguaaaguacuuaaaauggugacugcuccuuaguaaguacucagauauucugcaguuucuguuuuugguauuuguauauuaacuuuuuuuuguuuguuuuugguuuugguuuuuuugagacggagucuuacugugucaccaggcuggagugcaguggcacgauccuggcucccugcaaccuccgccuuccggguucaagcaauucuccugccuuagccucccgaguagcugggacuacaggugcaaugcaugccgccacacccagcuaauuuuuuuuuuuuuuuuuuuuuguauuuuaauagagacgggguuucaccauguugcccaggauggucucaaacuccugggcucaggcaguccacccgccuuggccucccaaagugcguggauuauaggcaugagccaccgcgccuggcuauauuaacauuuuuaaaacauaaaaauauuuuauauuuguaguuuuguuuacuuuugauuaccacaauagaaaaaucuucuagauuucuccagcuguuuucuaguugcuugaagaaauuaucuuuuuccaaaaaaaugaaacuuuuaauccacauuuaaaaauaagguugugggauuuuggagaagcauuuuaaaaacuugaggacuuuauauguuacuccugggagguuaaacauuguuucagacuaauagaacuagcauuauuaacgugcugacucuaacugaauuuguuuuguucucucucuacuaggugauucgugaagcuaagagaacagcaccaaguauaguguauguuccucauauccacguguggugggaaauaguuggaccgacacuuaaagccacauuuaccacauuauuacagaauauuccuucauuugcuccaguuuuacuacuugcaacuucugacaaaccccauuccgcuuugccagaagagguaauuuauguggggcgguaucauuauacuuucaaaaagaguuguuucuaccacaauaaucauaacuuauugaaaaaauucaaaugcuguagaagugaauaaaaggauaaguuuucuuaucaaauauaccauugguaacuauuugguauaugugcucauugggcaagaugguauauguauauguguauguauauauuaaggauacauaaauuuuuucucuugaaaaaugguauuauaugccgggugcaguggcucacgccuguaaucccagcacuuugggaggccgagguggguggaucaugaggucaggagauugagaccauccuggcuaacagggugaaacccugucccuacuaaaaauacaaaaaaaauuagcuggacgugguggcuggcgccugcagucccagcuacucgggagacugaagcaggagaauggcaugaacccuggaggcagagcuugcagugagccgagugagccacugcacuccagccugggcgacagagcgagacucugucucaaaaaaaaaaaaaaaaaaaaaguauuuaaaaaaugggaguauaugauacauacuauucugcaauuugcuuuauucauuuaucaauaaauguauucauguauuuguuagugcuaaagucucuuuaagagcugcaugguuuuuccacuguugauguacuauaauuuauuuauccaaagcccuauugauagguuuuuugguuguuuuccagauuuuuuucuacuggacucuuacagugagcauccuuguauuuuaguuaguaugagcacugguauguggauuuuucuaguuuugauuccuagaaguggaauagcuguagcugaaucaaagaguauuuuacauuuacaaguuuuaacaauauuaaauuacucauucaaguuugugccaauuuagacaacugccaauagugaacaaaaggccauacugcuucugccuggaauacucuucucuuacauacuugccugucaucauuuuuuauuuuucucaaaucucugcucagauaucaccucagggaggccuucuuugaucagaguuucucaauaauagcaauagcucuuucacccaucacacucuuuucccuuuuccugcuuuauuuguauugccuccugccauuaaauauuaauuugcuugacucuguuuccccaucagaauguaaaguacaugaaauuagggacuauuuuuugucaccuuuguguccauagagcacauaacaagcauauuguaggcuucuguguauuuuaaugaaugaguuuaaugguuuuuuuucacacuuuugacaauugguuuacacuuuuuagaacacuaguaggaagauaagcucaaauacuuacuaaagaaauauuuauugagugcuuauuuucucccaggugugguucuaggcacuggagauauaacagugaauaagauacacaaaaacguguauccuuacacauguagggcuaacauuuuaguugagugggggagagaaguuuuaaaaauuuuguaauacuaacuauuauuguggagaaagauuuagcuaagggguaccaaaagaguauggguagguuacaguguuaaauaggcuagguaaggccucaguaagaagaugauauuuggccggaugcggugguucacgccuguaauucuagcacuuugggaggccggggugggcgaaucaccugagaucaggaguucaagaccagccuggccaacauggugaaaccuugucucuacaaaaauuagccggacauggugaugugugcccguaaucccaguuacucgggaggcugaggugggagaaucgcuugaacccggaaggugggguuuguagugagccaagaucccaccauugcacuccagcuggggcgacaaagcaaaacuccaucucaaaaaaaaaaaaaaugaugaugaugaugauauuugaggaaagacguggaaaacguaagguagugaaccauuggaauagcugagggacaaaagguccuagcagaggaagaagcaaaugcagaggcucugaggcagaucugugucuggcagguuggaaaaauagcaagaaggccaggaugauagagcagaguaagugagggauaauggaggaaaggaggccaagguuaucaagggaccagauuauguccccagugacucuguauaauaauugauuacagaaccuccaaguuaaauaagcuaggaaaugaauauuaaguauauauuagaaacucuuugagugggggagguccuuaaagguuuccaguuuaguuaauuaucuaguuucauacccuacacugucgccuuuauguggauaucucauauguugaaacaguuucuacacaguucuuuuuguuaccuuugacuccuaaaaauccaacuuauugaaggaggcuuucauuucucuuucuuuuuuuuuuuaacuuacaaaggggucaugcuaaucuucuguauuguuccaauuuuaguauaugugcugcugaagugagcacaaaucuuccacuucuuaaucuccauucauuucccagauugcauauagaacuugacuaauacaucuucaucaugacaagucuuuguauauuugaauacucuuuuaugucuugcugauccaggccuuuucacauuaaacaggauaugguauauucauuagggcuauuaauaaaguagaaguuuauuucuuacucacuuuaacaauacuaggcagguugauuacauuggcaaguuugucuucugcuaugcagucauucaaacacucaggcugaaagauacuuuauuuuacuuuauuuuauuuuauuuacuuguuuauuuauuuauuuuuggagacggagucgcacuguguugccuaggcuagcagcguaggggugcgaucuuggcucacugcagccucagccuccuggguuuaagcaauuauccugccucagccucccgaguagcugggauuacaggcauccgccaccaugcccagcuaauuuuguauuuguaguagagaugggguuucaccauguuggccaggcuggucuugaacuccugaccucaggugagccacugugcucggccuguuuucuuauuuucaucauguagccuuccaggucgcuuucaguacagucaacugaaaggacaggcucuugcuugugccugacuuggaagugguguaaaucauuuccucucaaauuccacuggcuaaagcucagucacauagccuacuucauugcaagaaaggcuaggaaaucugaccuagcugugugcccaaagaacaagaauacagauugugguaauaguagacuuuguuacacagcacaccagguuguaguuucuucaaaauucuugucacucuccugaaugucuuucuuuuuucuaguucuuuuggaaggccagagccagaaugaaugaaguacucuagcaguguucugauuaacacaguggaaaaaaaagauuguuagccauaguauuacuggcuucuuauucuaucaacugaaacuguuaaucauuuugagauuugaaauaaagauaauggcuuuaugcuccggguaacaaguaagacaaacuaggugaacuuuguauggauguggagaggucgaaaaaauguaaucgguuuaaucuggggaaacuuuuucgagaauguggaaauucuauaccaaaagaucuuuucuuaaagcauagcuucucuuacuuuuuuucuuaggauaauauuuucuaagcauauaauugcaaacuggguaaaauauuuuaauaccacauucuauaaguaggggagaaugggccagggacuaggaauuacccauuuuuauaaaaugaauaaaaugagcaugguggugugcaccuauagucccagcuacucgggaggcugaagugggagaaccgcuugaaucugggaggugggggcugcagugagucgagauugcaccacugcacuccagccuaggugacagagugagacccugucucaaaaaaaaaaaaagacaaaacuuaccauuucauccauuuuuuuaagcauauaguauagucgcauuaagugcauuuacaauguugggcaaccaucaccacuauccagaucuuucuuguuaucccaagcagaaacucuguaccuauuaacgguaauuccccauuucuaucuucccacagcccucgguaacuucuguuauaauuuggcucugaauuauuuauucuagguaccucauauaauuugaauauguauuugucuuuugugucuuauuuaguguaauguuuucaaguucauccauguuguaucuuguguccaaauuuuauuccuuuuuagggugaauacuuuuccauuguauguauauaccgcauuuuguauccauucaucuggugacagacguuugggucaucuucaccuccugacguuugugaauaaagcugcuaugauuacuggaguacaaauacucauuugaguuuuuguuuucaguucuuugggaucuauaccuagaaguggaauugccacaucauauacuaauucuguguuuaaacuuugagaaaccaccaaauuguuuuccaccgcagcuacacuauuuuacauucuuaccagcaguccacugaguuuccaauaucuuguagcccacacuuaccuucuggccuuuauauuuugguuuuuguuuguuuguuugcuuuuuauuuuugaacaguugcucuuucuuauaucucauuugggguugggaaaaugaauuaauugaucucaacaaaccuuuuaaguaucaggaccaggcacgguggcauaugcguguaauuguagcacuuugggaggccagggcaggaggaucacuuaagcccaggaauuugagaucagccugggcaacacaaggagacccuaucucuacaaaaaguuuaaaaauuagcugagugugguggugcgugccuguagucccagcuacucaggaggcugagauaagaggauugcuugagcccagucugagguugcagugagcuaugauugugccacugcaauccagccugagugacagagcgagaccuugucucuuaaaaaaaaaaagaaaacaaaaaaaguaaaauaucaucaagucaguuccuuuauuaauuguaguuuggguucuugaguucucaugauuuuuaguuccuuaaucucuuguaaacaugguuuauacauaaaucuaacauucuuuaaagacuuguuuaaaaaauauacaauuuagcuugucauuaaaaauauguguauaauaaccugcuauugucuugaaugacugacacaugcauuucauaugcauguguguauauauacugcauacauauguuuauauacuguauagaugcuccuugacauaugauggguuuauuuggacauaacccgauuguuaaguggagggacauacugaauacaugucacuuucaugcugcuguaaagucuaaaaauuguaaauugaaccauuguaaguuggggaucaucuguauauaugauauauauugcauuuauuuucuuuuuuaaggugcaagaauuguuuauccgugauuauggagagauuuuuaauguccaguuaccggauaaagaagaacggacaaaauuuuuugaagauuuaauucuaaaacaagcugcuaagccuccuauaucaaaaaagaaagcagguuaguuucuauaucaaaguuaauauuuaauaauuuugagaaaguaggaaugaaauaguuaauggcauugacauguaucugauaacacaagcucaaaaccuaagucaugagguugaugcaucugcugcuuaaaaaucucuaugcuucccauuaaaacagacuaaaguucuuaagguacacaaagucuuucauaguauagccccaaucuaucuuucuaagcucauuuugggcacuuguguucugccucagcccuccacccccacauuuuuuuucucauaaaacacuaucuuuaaaccauauguaacauaauuuuaccuuuucacuauuuuaguaaugcuugcucucucaucaguaaagcuucuaucucuaucccccaucucugucuaaagaacuacuuauucuuuuauuuuuauuuuuugagacagggucugugucauccacuggagugaaguggcaugaucgaggcucaacugcagccucaaccuccugggcucaagcauccucccaccucagccuccgaaguagcuaggacaagaggcucaugccaaaaugcccggcuaaauacuuguccuuuuaguauaccucauuuauucuuuauuaugaagccuuuccuaacuuauaugggcaaaaugaauugcuucugccuuuaugacccaucauacuuuuaaaauacuacuaauauggcaucacaaugauauaauuaugccucuuacucccuuaguaguuugucagcucauuguggcaggacucuaauaauccuuuuuuucauccugaguacucauuggauaucuauuuaaacaaaauaaccuguugguauauuugaaacauauuacacauuuucauuaguucaaaacuaguaaagaaggcuuuuuuauaguuagaauauuuuuguccuggaaauaaugcaauuucaaaguuuaauagccucuuaaauugucuuuuuuuuuuuuuuccuugagacggagucucucucugucacccaggcuggagugcaguggcacgaucuuggcucacugcaagcucugccucccagauucacgccauucuccugccucagccuccugaguagguaggacuacaggcgcacgccaccacgccagcuaauuuuuuguauuuuuaguagagaccggguuucacuguauuagccaggguggucucgaucuccugaccuggugauccacccaccucggccucccaaagugcugggauuacaggugugagccaccacacccggcugccucuuaaauuaucuuaaaggaacagagguaaugacuuguaggaauuagcauuccaaauuacaaguuacuaaugauuucuggaggggacguaggguuagagauuaugguaauacuuuuguauuucaaaucuuuggauuccuugcauauaugaggaagauaaucccucaaauccugacucuguuuucauuaaaucauuugucaaccucaauguuauggaggagcaguaacuaaauucuuccauucaugugaaguuuugcaggcuuuggagguacucccaguagcaccaccaccugagccaagaucacugacagcagaagaagugaaacgacuagaagaacaagaagaagauacauuuagagaacugaggauuuucuuaagaaauguuacacauaggcuugcuauugacaagcgauuccgaguguuuacuaagccuguugacccugaugagguauuaguuuaaucuuuggaucaaguguauucuaggccauaaugcuucacaaucaaaggauauuugaagaguuuaugugguucugccuacacucuuaacuaguuuuaucuauuuggaaacauguaccggguuaguguccuaagcacauguagacuuuaagagcaggguaacgcauuuuccuuuccugcagacaauuaacuuugucuccccaaccuaaacauuccagaaguaauugagaaugucuuauuauuuuuuuuuuuugaaacggaguuuugcuccuguugcccgggcuggaaugcaauggcgcgaucucggcucauugcaaccuccaccucccagguucaagugauucuccugccucagccucccaaguagcugggacuacaggcgugugccaccacguccagcuaauuuuuguauuuuuaguagagacaggguuucuccauguuggccaggcuggucucaaacuccugaccucagguaauccacccaccucagccucccaaagugcugggauuacaggcaugagccaccaugcucggcccccccuuuuuuuuuuuuuuuuuuuuuuguaguaaggguugaggccucacucuguugcccaggcuggagugcagugacacaaauuaucuuucacugcaaccuuguggagauagggucuugcuguguugcccagccuagucucaaacucuuggccucaagcaaucuuccugucucagccucccaaagugcuggggauuacaggcaugauauuauuaugaccuacacaauuggaagagaccuggagagccacgucuuaaguugcucugaaggauggguggcaauuggaugaggaaagaauauaggcuguuacuggagaauacagcugcccaagaauaagaaacaauuacuggaggauacagcugcccaaggaauagaaacaaauacaaaacaaaaacagccuuaaaucaagugaaagguuuuauguuaaauauauuaucauaaucucuuacguauuuauucucuaucuccuauauugccuggcaucgaaacuugacucacauguuauguuuagaguuaauuuugugauuugaucauuugcuugaauuuuagguuccugauuaugucacuguaauaaagcaaccaauggaccuuucaucuguaaucaguaaaauugaucuacacaaguaucugacugugaaagacuauuugagagauauugaucuaaucuguaguaaugccuuagaauacaauccagauagagauccuggaggugagcauuagugaauuuuuuuucaggggguugaguuggggggcagcuaacacuuaggguugauuuuugugucaggugcuauauuauaaacauaaucaaaauacuauuuaauccucacaacaaccauuuuacaaaugguaaaaaugaaguuuagaaagguuaaaaacauugcugaaggucacacuuccaggaagggacagagugagaauuugaaugcagguuucuuucauucccaaaucccuguuuauuaacaauuacaugauagauccucuaaugagacacaaaauggcuuguauacuuuguauaucagugcucuuccucaaaguggaaaaguaggcacucuguaaugaaauaguuuuuaaaauauucuauuaguuaagaccauuauaauuuuuauuacaaaagcaauauaauauagggcuuacuaguaguaauauuuuuaaaaaucuagucccccauuuccuuucuccaaaggcagacacuguuaaguuugaggauaucuuuucagaccuuuuucugugcauauaccccuucugcuuucaccuaucgcaucuauuaauauaaaauuuaguggguacaauguauguuauuugggugguggauacccccaaagcccugacuucaugugcagucugugccuguaacaaaaauuacacuugcaccccauacauuuuuacaaauuuuuaaaaauaaaauguauaaaggauuuuuaaugauauguuuguucugcagcuuguccauuuccaagaaauguucuuucuugggugcuuauuuaauuuuuugauggcuuccuguuauuacagaugcagaguucuuuaacucuuaccaguggauaaaaagauacauuuuaaaaauaguuguuuucuguauucauuucuccuccaguacauuggcuuucuguuuuuaaauugguggugcuuguuaguuagauugauuaguauaggaaacuacuaaaauuuuuuucaacaauugaaaagcuuacuauucuuucccucccaguccucuagcucaccuucccuaggcauuucccuguaguucagaguucuggagucaagcaguaggaaacagacuaacaagaugagaacaguccauuguacauaggaagaagaaacgagguacccuggaggcagagggcuuucucuguugcauugcaaucaugcuguugcugcugcucccuuucugucuauuguggcaaucuaaaauuacuucaggcuaguggugucaaauguuaguggacaucagaaucuccuaaaggacuucauaaaauauggaucacuggaccccaucucuaggguuucugauucuguagguguggccccugagaauuugcauuucuaaugaguuucccggugacacaggcugcugaguucuggaaccacuacuucgaccuugcccugacuuucuucaggcccaaaugccauguuagaaagcccacuucagcauucugcguguaauguacuguauaaccugggagugaauuuugcaaucucuuguccuuugaggaguauugauguggcucaagcaauccugcauucacuuauuccgucuucugccucaaaucauauuccaguuuguaguauucauacucugagcuuaggauuuucccaguguuuccuguggaggguugcuuuuucauugucuuugucuauuuucuuugucaaugcaauaacaaccucuauaaaucucuugcaaaauucuuucacauucuuuguucacuaaugacacugauagccuucucuuuuauuuuucguuaucauguuuaaucucuugcuauugauugauuccuuuuuuuuuucugauauuucaaagggaucugaacaggacagagcaguaaaauuguuuggguuuaguuugccauauugaaucagauguccagaacauuagauuagcuccagaaacagaauaggacaauuccaguaacuuugacuauucuugguaaaagucaaaaggaauuguaagagcuacuaucuuagccuaauaugcugaguuuauuuuugguauauuauuaaaagggggaaauuaaaaauuacauuuuuuacucacuucauagaucgucuuauuaggcauagagccugugcuuuaagagauacugccuaugccauaauuaaagaagaacuugaugaagacuuugagcagcucugugaagaaauucaggaaucuagaaagaaaagagguaggaaagugauuugguugauuuguaccaaccuaauauuaucaaugaauuucagaauauaugaauuucagaagcaucugaaaaggaugcuucagauguauuuuguacuuuuaguuaauccuucauguaauuuugaaaucuggaaauccuuuugacaucccacauaucuauuuauaagguuguagcuccuccaaauaugccccgucuuacuaccaugugaugccaaagcaaaauuccacucuuguuggugauaaaagaucagacccagagcagaaugaaaagcuaaagacaccgaguacuccuguggcuugcagcacuccugguaaguacucaaguaguuuucauuuaugaaauuauaacuuuauucuuuucuaaugccauuaacuuucucccuuauuuuccuuuauuuguguuaaugcagugaauuacauugauuuuguuacuauuaagacaacuuugcauucuugaaauaaauccaaguuuauaauguaccacuugcaacccagaagucaccaucuaauuguggacugucuugauuugaaacugaugucuguaaauucuggucuauuucuuacucccccuuauucuuagaagguaacuccacguuaccuauucaaagccuguaggguuuucuaaggccugccuuccuuggcagacuucuaauuccaauuuuuguucuuuaagccccuuugucagacugcuuagcuucucagccucuguuauucacuuguuuucccagauuuuagcacuguaauuccucacuacccuuuuuuuuuuuuuuuuuuuuuuugagacggagucucgcucugucacccaggcuggagugcaguggugcgaucucggcucacugcaaccgcugcgucccggguucaugccauucuccugccucagccucccaaguagcugggacuauaggcacccgccacuaugccuggcuaauuuuuuuuuuuuuuuuuuuuuuuuuuuuuguauuuuuagagagacgggguuucaccguguuagccaggauggucucgaucuccugaccucaugauccacccaccucggccucccaaaguguugggauuacaggcgugagccacugcgccuggccauuccucacuaccuuuuuagaucucuguguguguguuaagguuaggguuagcgguguuugcugggguugaaccuucuauuguauugcaaguuuguccauccucggguaauugauuugagauagauaaagaauaagcccuucuuuugaaaaaaugggaggaggcagcugggaaaggaaagauaagagaagaaaauuagcaagaggccuucacuaccagaaugcugacagucaaaucagcuuuaagcaagaauauauauauauggaaauuggcucccuuaaaacaaucguuugauagauacccaacaggauuacauauuuuguguccaccaaaagacauguacaagaauauucaaagaagcaauauucauaauauuagguugguacaaaagugguugugguuuugccauuaaaagucaugguucaacacuggggguaacucaaaugcccauuaccaguagaauggaaagauaugaauuauuauacagugagaauccuuaaacgucaacuacauacagcagcacagaugaaccucccaaacaauguugagugaauccuagauacauuuacaugugaaauaaauuuuaaaauauguauuuaaaauuuuuauauauguaugaagucaaaaaugggcaaaacuaauccauggugucauaaaucaggauauuauuuacuuuuuaggauauuaugacuagaauuagaauaagggugauuuggaauguuaguauauauucuguuucucaaucugggugcugauuaugugaguuucuucuguugguggauauucauuucauuuuuauguucugaguacaauugacccuugaauaauacgaguuugagguacacagguccacauauguguggauuuuuuucaauaaauaucuuggaaauuuuuuuggagcuuugcaacaguuugaaaaaacuugcagauugaaucacguagccuagaaauagugaaaaaguuagguaugucacagaugcauacaauauguauagacaguagucuauuuuaucaccaccauaaaauauacacaagucuauuuuaaaaaguuaagauuuaucaaaacuuaccacacaaacacagaucguacauagcaccauuugcagucaagagaaauuuaaacaaauguaaagacucaguauuaaaucacaacugcauaaaauuuacuauaguacauaacuuuacuaccguaauuuuggagccaccuccuguggcuguuguggugagcucaaguuucaugaguaucugcuuaaaacgaugugugaugcggugagcaguuggccuguccaguaaauugcuuauugcaguaaaaagugauuugcgguucucaaguauuuuuuguguguguuuaguauaguacaaaaaaucuugaguaacaccauaggacacauaggaggugccacuaguaaugcuggaagugcucccaagaagcagagaaagucauaaccuucuaagauaaaguugaauuguuuguuauguaacauagauugaggucugcagcuguaguacccugcccuuucaagacaaaugaauccaguauaaggaccauuguaaacaauaauaauaaagagccaggcaugguggcucacgccuguaaacccagcacuuugggaggcugaggcggguggaucacuugagaucaagaguuugagacaagccuggucaacacagugaaaccccgucucuacuaaaaauaaaaaaaauuagccaggcaugguagacagugccuguaaucccagccacuggggaggcugaggcaugagaaucacuugaacccaggaggugggguuugcagugagccagauugcaucacugcacuccagccuggccaacaaagugagacccuugucucaaaagagagaaaagaauaccaggcgcaguggcucacgccuguaaucccaacacuuugggaggucaagguggguggauugccugaggucaggagcucaagaccagcguggccaacauggugaaaccccgucucuacuaaaaauacaacaacuagcugggcaugguggugcacgccuguaaucccagcuccuccuguaaucccagcccucaagggacugaggcaagagaauugcuugaacccaguggggcagagguugcagugagccaagaucgugccacugccuuccagccugggcaguagagugagacugucucaaaaaauaaagaaagaaaagaaggaaauuuugaagcuguuguugcagcugcacuagcaaaugcaaaaacuuuguacuuuuugugaaauaccuuuugucugauauugaaaaugcagcuuuuauccggaugcaagauugcuauaagaaaggcauaccuguagacucuaauacaauucaagaaaaaaugaagucauuauaugacaaagcagaaggaauuuaaugccagcaaaagaugguuugauaauuuuagaaagagguuuggcuuaaaaaauaugaagauagggccaggcgcgguggcucacgccuguaaucccagcauuuugggaggccagggugggcggaucacgaggucaugugaucgagaccauccuggcuaacacggugaaaccccaucacuacuaaaaauacaaaaaauuagccgggcacgguggcggcaccuguaguccagcuacucgggaggcugaggcaggagaauggcgugagaccaggaggcggagcuugcagugagccgagccugggugacagcacuccagccugggugacagagcaagacuccaucucaaaaaaaaaucaagauaacaagagaagcagcuucugacaaccaagaggcagcagacaaguucccaaacaccauuaagaaaaucacuggacagaggccaggcacuauggcucaugucuguaaucccagcacuuugggaggcuaaggugguaggauugcuugaggccaggaguuuaagaccagccugggcagcagagcaagaccccaucucuaaaaaacaaacaaaacacuggccaggcaugguggcacacauuuguagcccuaccuucuugggagacugagguaggaggauugcuugagcccaggaguucaaggcugcagugagcuauugauuaugccacagcacuccagccugggugacagagcaagacccugucucaaaaaaaaaaaaaaaaaaaaaaaagaagccacuggggagaaagguaaucuuucauucuccuuugucauuucuauuaccuaaaaguuuuaccacuucuuuccaggacuacugcugugugguuauacugcaucuagucuagacagaauauuuaaccucucuguaccuuaguuucuucaucuguaaaaugaugaugauaaugguagcaaacuucauuggguuaaagugaaaaauuuuuuuuuuuuuuuuuuuuuuuuuuuuugagacggaguugcgucacgcaagcuagagugcaguggcaugaucucgauucacugcaagcuccgccucccagguucacaccauucuccugcgaguagcugggacugcaggcaccggccaccaugcccggcaaauuuuuuuguauuuuuuguagcgaugggguuucaccguguuagccaggauggucucgaucaccugaccucgugauccgcccgccucagccucccaaagugcugggacuacaggcgugagccaccgcgcccagccagguuaaauuaaauuuuaaugaguaagcauacauaaggggcuuagaagaauuccuaguauaugcuugaugcaguggcauacaccuauaguuguagccacucaggaggcugaguuaggaggaucgcuugagcccaggaguuugggguuguagugcgccaagauugugcuuguguauagccauugcacuccagucuaggcaauguaguaagauaguuucuaguacaugauaaaugcucaauaaguguagccuauuucaagucuugcccuucuuccaguccauuucucauacugcugccaaagugaucuuugcaaaauaugcauuagacagaucaugucaguacccuccuuaaaaguauucaagauuaaaaguauucaagauaggccgggugcgguggcucacgcuuguaaucccagcacuuugggaggccgaggcgggcggaucacgaggucaggagaucgagaccauccuggcuaacagguugaaaccccgucucuacuaaaaaugcaaaaaauuagcugggcgugguggcgggugccuguagucccagcugcucggagaggcugaggcaagagaauggcaugaacccgggaggcagagcuugcagugagccgagaucgcaccacugcacuccagccugggcaacagagugagacuccgucucaaaaaaaaaaaaaaaaaaaauuucaagauaaaaucaaaauuuuuuaccauuuuauggucugggccuuacccacuucuccaccuucucacaguaugcucuauucuuguuucuguauuuuaaucauacaaaauacugugguuucucacuauuuauccuuucauauaucaggguuuuucacucuuugaauuucagaaaaugguugaauguucuuucaucauuuuucuuuaaauuucuugaagcucaguugaagaggaaaauucgcaaaaagucaaacugguacuuaggcaccauaaaaaagcgaaggaagauuucacaggcaaaggaugauagccagaaugccauagaucacaaaauugagagugauacagaggaaacucaagacacaaguguagaucauaaugagaccggaaacacaggagagucuucgguggaagaaaaugaaaaacagcaaaaugccucugaaagcaaacuggaauugagaaauaauucaaauacuuguaauauagagaaugagcuugaagacucuaggaagacuacagcauguacagaauugagagacaagauugcuuguaauggagaugcuucuagcucucagauaauacauauuucugaugaaaaugaaggaaaagguacgucuuuuucaauuaaaauaauuuacugauuuuaaaagauauuucaaaguuucuaaacaccuaauugcaucuuaguuuauugcuuuuugcuugccuuucagagagcagauguuaguuaauuagaaaacaauagcauuaucuuuacuauugagcuaguaaggauaguuacaagcuguggcaucaaacagaccuagauuugagccuccaguucacuacuuaguagcuugugaccuuuggcaagauacuuaacuugucagccuguuugcuuaucugcaaaauugggguagauaagauaguugcuugguaaugaggcauuuuuaagauuaaauguaacaaacuaaaguauaugauacccuuucauuuuuaagcaagauaagagucugcuaugauucuugcugagugguaugaacaacucuuaccccgaucauuuuucuaucccuuauuguagguuaaguccaagauuauuuauauuuauucuacugaucugcuccccaaauuuucuauuuagaauuguugucauuuggaucuucuggagcccuugacaguagauuuguuuggauuuuagaaaagccaaacauuauuuaaucauacaaagcaaaauaguggauaauggggccaaaaauuuauuuuggucaaaaauaagcauugacuaaguuaauggacuuuuuuuuuuuuaguggcugauacacugaaugcaagccuuuugcaagggcuucuuugacaugagcucuaaguguauuugaguaauuagcaauaauagacuaggauauacuuucuagugugaauauuuuaaauguuaaucuucuggcuguauaauauguuuugguuugaaucagauuuguuuuauuuuucuuuuaucauuuucuuuuuaaaaagaauacuauuuagcaguacagguacuugcuucgauaucaggaagucugaguucuuauccuggcucucacaacaauuagauguauauccuuagaaaagucucucuucacggucaggcgugguggcucacacuuguaauccuaacacuuugggaggcuguggguggaucacgaggucaggaguucgagaccagccuggccuauauggugaaacccugucucuacuaaaaauacaaaaauuagcugggcgugguggcuaacgccuguagucccaacugcucuggaggcugaggcaggagaaucaccugaacccgggagguggaggcagagguugcagugagcugagaucaugccacugcacuccagccugggugacagaaagacuccaucucaaaaaaaaagaaagaaaagucucuucaccucuccuggccuuauuuuucucauuuaucauugaauguauuguucuaaaucauggaucagcagacuucuuuaaagaaccaaauaccagauaguuaaauacuuuagccuacacaggggcccauacaaucuuggucucugugacaacuacucaacccugcugggaaaacuacauugacaguagauaaaauggauauggcuggguugguuuguuuguuuugagacagagucuugcucugucauccaggcuggauuucaguggcaugaucucugcucacugcaacuucugccuccucggcucaaacgauccucaaaccucagccucccaagcagcugggacuauaggcauguaccaccaugcgcagcuaauuuuuuuuucuuuuuuuuuuuuaaagagaugggguuuucccauguugcccaggcuggucuugaacuccuggacucaagggauucaccugccuuggccucccaaagugcugggauuacaggcaggcuguguucuaauaaaacauaauuuacaguggugggccagauuuugaccaugggugguauuuuacaaccccuguucuagauuauugaggucccuucuagcuuuucaguucugugugucuugugcucaaguagaagacauucuaaccuguugagaauccccuugaaauacucaauaugaaacauacuucucaaacuguccuuaauuuuugaguguaugaguggcaguaucuuaaucuuauaacagaaugaguuaauaagccagaauugcuguuuauguccuuaguaaacaugcccuguuuaaucugccuaauauuauuauuuauuuuagacaucauaauaucuauggaccaaauaauaaucauuugauuuuucauucuagaaauguguguucugcgaaugacucgagcuagacguucccagguagaacagcagcagcucaucacuguugaaaaggcuuuggcaauucuuucucagccuacacccucacuuguuguggaucaugagcgauuaaaaguauguaaauugaaaucauaaugcuuuuacucugcagauuacuaauccccaaacacuggcuugugacuaguagcauucuggcuacaugggauuuacaugaaaaaguaaaacuuuuuuuccuccaagcuucccuuuacuguucuucuccuuccccuguuccaaauuaagacuaggucaggcacaguggcucacgccuguaaucccagcacuuugggaggcugaggugggcggaucaccugaggucaggaguucgagaccagccuggccaacagugugaaacccugucuuuacuaaaaauaaaaaauuaggcugggcgcagugacucaugccuguaauccuagcacuuugggaggcugaggugggcggaucacgaggucaggagauugagaccauccuggcuaacacggugaaaccccaucucuacuaaaaauacaaaaacaaaauuagcugggcgugguggcuggugccuguagucccagcuacucgggaggcugagacaggagaauggcgugaacccaggagguggagcuugcagugagccgagguugugccacugcacuccagccugggcgauagagacucugucucaaaaaaaaaauaaauaaauaaauaauagauaaaacaaaaaauuaguuaggugugguggugggcaccuguauucccagccuacuggggaggcugagacaggagaaucacuugaacccagagguggagguugcaguaagccgagaucgugccuuccagccuggaugacaagagcaaaacucugucuccaaaaaaaaaaaaaaaaaaagaauuauuacuauuauuuuuuaauauaaaauagauuuuuaauucuuaaaaaaaaaauagacaaagucucacuguguugcccagucuggucucgaacuccugagcucaaguaauccucccaccucagccucccaaaaugcuaggauuauaggcaugagccaccaugccuggcccaaaauuaagaauuauauccaaggaucugugguaggaaucagagagaaaauagcuaagugauucugacagcugucagguuaucuguugcucauucuguuccccugccuguuccccuaaauucaauuuucauccuaaccacuguaauaaaaugacauccuaauagcuaauaauacuugccuuuguuaaauugaauucuucuugccauaucuguaacacuugacacuauagauaacucuucuuccuugacuguuguguccuuaaaucauccuugccuucaauuacuuuuguaagcuccucaggguuuuucugaucauuugcucuauuauucuguacuuuuggaauagccaucaccucuguaacggugaaccuacaucuggaaccccacacccugacacaccuaaacaacggucuuaucuccucaaccaacaacuuggauguguuacaguugccuuaacauauuugaaauaagauugauuucuugcccuuuuccuucaaaaauaaaaacauuuugcaucccaauuccaauuuaccuguuuuauuuuggccacauuucaagucugaaaacauuauauguuuaucagagauacauuauuuguaauacagauaagaguuuuggcauuuuagagggaaaucugcccuguuuaaguacaaagugaaccuguuaguacuaaugaacuuaggaaagccuuucucuugaauguagcagagcuaauaagaacuugaugucuacacuucuuagagaaggaagcagcaauauuccuggaguaguuucucucaaaaaacuguagucuuucugaaaaacucuauuaaaaaauauauguggaacugaaaacccauguaaaucucaugacagugaaauguauuccuagugcugaaacaggaacuuguguguaaguucaccguguuauguuguuugggguuaagaguagcaauuauuauuuuacuuaauuuuuauaaauuuuacagcuuuguucugcucaguauacauguaugucauucagagucaauuaaauucauuacugagacuauuucaauuuacuuuuucugaucauauaacccaucaaaauagacuauguaauaguaccauauauccauuaggcaugcaauaaauaauggccuuuuaugagaggauauacuugcuauagaauaauuuguauaaaggauguaguuggaggugacuauuuaauguauuaaauugcaguuuuuaacuugcugaucuaaauuauuggucccauacauuguuuuuaugaccauuaccuauggccauuuuaguugguuuuuacuuaacuauaaugguguguuuuuguuaauuaugagguaauggcagcauauucugguagggccagacuugaagaauuacagaaauccaguaaguccaccauuuuagucaugagaaaaaaaacacuuagcagauggaaaauccuuuuuauauaagaacccugaaguggugagguaguucaccauuuauguaguaucuuuuuuaguuucacauaauaaaauuaguuaaaauguacuuauacuaucauaaaauccccugcaaaaaaacuuugcuuuucuccuguuaaucuaaauugagguuaguuuuuaauuuguuuguagaugcuuauggcuagacuuagaauuggcaauccccucagcucuaguuuuuagaauaugaguuacucaaggucaaggccaggauuauagcuagacuuaaguacauuuaaaugucagagccacugccagaggcugcccugugucaucagauggcuuggucuacccucugucaggcuuguaauaauugcccaaaccuucuaaauuaaguaucuugucugaggaaguuucucucucacacauauugacacucauauuuucuuuuagaaucuuuugaagacuguuguuaaaaaaagucaaaacuacaacauauuucaguuggaaaauuuguaugcaguaaucagccaauguauuuaucggcaucgcaaggaccaugauaaaacaucacuuauucagguaaacucuugaguggaaacuuuuuacaaaugcucuuguggucacauuaauauaucacuuauguaggauuguugaggcuuuauuuaaucuguguaagaaacugauuguaggaacuuaaagaccaucuuucuauuuccaaaguugaugucccauuccauaaagaucauuuuuaauauguggauuaugaauuauuucuaaaugcaagugaguuuaguauuuuuccaaucuauaacuuaauuaguuuguuuguuuauuuauuuauuuauuuagagacagggucucugucgcccaggcuggagugcaguggugcgaucucaacucacucacugcagccuccaccuccaagguucaagcgauccuccugccucagccucccaaguagcugggaccacaggcaccugccaucaugcccagcuaauuuuuguguuuuuuguagagaugagguuucacuauguugcccacgccgaucuugagcuccugagcucaagccauccagccacuucagccucccaaaguacuggaauuacaaacgugagccacugcacccagccaauaguuugugucuuuaauaaauaguggaacauaaacuaugaauaccccuuuuguguguauguauuaaugaagaauaauagcuucuuuuaagacuugucagccaggcacaguggcucaugccuguaaucccagcacuuggggaagccaaggcggguggauugcuugagcccaggaguucaagacuagccuggccaacauggugaaaccccaugucuacuaaaacaacaaaaacuagccagaugugguggugugcacccauaguccuagcuacucggguggcugaggcaugagaaucacuugaaccugggaggcagagguugcagugagccaagaucaagcuacugcacuccagccuggcugacagaguaagacucuguaugacaaaaaaaaaaaaaaaagacuuauguacuuaaucuuccuuuauaguagguauuauaguguuaauuagagcauuaauacuuauuuuugagacaggaucuuucucugugugcaguggcaagaacauagcucacuauaaccuggaacuccugagcucaggcaauccugccucagcuucucaaguaacugagauuauaggcaagcaccaccacacugggcuaauuuuuaaauuuuuuguagagauggagguuuugcuauguugccuaggauggucccaaauucguagcuucaagcgguccucccgccucagccucccaaagugcuggcauuaacaggcaggagccaccaugccuggccuuauuauuauuuuuaauaacagaucauuucacuagagagugcuaaauuuuaaaaaaagauauuacuuacauaugcauauuauugguaacuacaaaauauaaaaaugauaaccauuaguauauauauaguauuuaguauaccuacuaaaguauacuauguaguauauauauaauauugauaccuacaaaguguaaaauacuaaacucuaacuacaucaguaccuugauuaauacuauuugaauuuaacauaagaugaaugcaccccagacucauuucaaaguuauuuaaauaaugaaguccuacagguaaaaucuauguggcagucuuaaauacugaacugaauguuuauuuucacuaucaaauauauaccugaauauuaauauucuuaagguuguuuacugaaaaaguaaugaaauguuucuuuagcuuauuccauauugaaacuuacuauuugcucuuccuccccuuuaucuagaaaauggagcaagagguagaaaacuucaguuguuccagaugaugaugucaugguaucgaguauucuuuauauucaguuccuauuuaagucauuuuugucauguccgccuaauugauguaguaugaaacccugcaucuuuaaggaaaagauuaaaauaguaaaauaaaaguauuuaaacuuuccugauauuuauguacauauuaagauaaaugucauguguaagauaacugauaaauauuggaacuuugcuagaacaagacccuguaguaauaguaauaauaguugaaguuuggccaacucuuaauaaaguuauuuugguaacuaauguuuuauggcacuuaagaauaauuagcagcguuaaauuuuguuuguauuaagcacuuuuaauuuuauccuuccuaaaaauaguuuauuguaucugacaagaaacuuacuuaaccauuguguccuucccaucuuuuuugucaucuuuguuuucuucaaaugcccuccucccaucugccuugagauucccucgucuucacuuaaaagccagagugcaagucaugauuugcgggagggcucuugaaccacuucuggcugcaccacaauucuguacuugaguaucacagucauuguuuuugagacaaacauuuuuauaauucuaauuuggguuaauaaagauuuuaaauauuucuugguuuacuuuuguaauuauauacacaacaaauguauuaauaacuaccuuguuaaacaccuuuuaauagcacaagguuuuuauauuugcaagcuguugauaucuuucuaaaacuguuuagguuauagucuauugauacuuuuuauauacaauuuuauaaauauaaauauuauaauuuuauauuaaugguaccaaaaauacauuucuuaagguuaaaagcaugcacuuccaugcauacuugcuuuuggggagaguggggagaagacauucuaauaaucaguuugugaaauagcuucuguuggaaaccuuuugaggggaauaaggaauggucaucuaaaaugagagauucuggauuuuaaugcaguucaaaguugagcuguauuuuuguuguugauuuaucuggauuuuuuuuaaagccuucuaaaacccagugaauucaauaccuuaauuaguacauacuaucuuauguaaugcauaaagcaaugccagucacugagaacauuuaaauauauuuauauuccuggagauacacauucucauuuuuguugguuuauuauaaauuauucuucuagaugcaucuuuuauaacuaggauuucauuuuguguguauagcuuauguaauaaauuuuaaaggugaaaacucucuuaa

SEQ ID NO: 192548 - RNA, 25296 nt, Homo sapiens
ccucuccccccgggcuccgcccaccccacgccgggaacccacgcgggccacuacaagcccgcccuuuccuacgucugguccagucggucuuccuccggcccgggcccuggcccagcuagccggccauggaagguaauggccccgcugcuguccacuaccagccggccagccccccgcgggacgccugcgucuacagcagcugcuacuggugagggggcgcgggcgcagccucugggucucccaggcucccgggcggcgagucgcaaccgggccccgccucuucccggccccuccucgggggcgcucccggccucuaccggcggguucuacaguuuugcgggaggagggagcgggaauggcagcucucgucucuugaguagagcgugggcuauuggaugggguugggaauucguccggaaucauagggucgauagugcauuaccugugccuggcgcuugucgguuggauuugcucagcagaucucugcuucggggccaggaaggguggagcucugaaaaucuuuggggguuacucugcugaagccugugggguuucagacugaggugaaggucauuuuaauuuuguaagagaaugaaggcacggagaguuuuucauacagcacuugcuauaugccacgcguuguucugggugguuuagguaaacuaaaucacugagcaucacaauaaccguaagagguagguauuguuauccccaguugaaagaugagagcacugaagcacagagggcugcaaguaauuugcgcagggccacguagcuugugaaugaaggaguggggauuuacagucagggucuggccccggaauccacgcagugcaccccuguccuaggccaccucugcagcugaaguaccgcccuugccuuaguccucauaccuacucuuuccugaguaauggcuucuuccccagcuucuaguccuuguacaggaaaccucagugcuaucuaaaccuacuccucccccuucugcuggucacuaaaccaaugccaccaagagcuuaacauuuguucggcccugauugcaugucaggcucaguggcaggugcuuccaucgauguccaggagguaccuucuuuuauuaucguuauccucauuuuacuaauaaaaagacugagccacagagaggcuguucugugcccccaaaucacacaucuagcaagugguggugcugaaacuggaaccucuucgugauucugaaguucaugcaucuuaacuacugcacuauuuuucuguccugccucucuucuaaaucccguuaguucuccucccuaauguccagucauuguuuuauucauucauucaauaaauguuuauuaggcacuuggaguauguggcauacuucugggcacuggggauauagcagugaacaaaaucgacaaauucccucauggaucccuugguucuuucauuuugagagaaaagcagauaaggcccggugcgauggcucacgccuguaauuccagcacuuugggaggccgaggugggcggaucucuugaggccaggagucugagaccagccuggccgacaugcagaaacccugccucuacuaaaaauacaaaaauuagccaggugugguggcgugcaccuguaaucccagcuacucgggaagcugaggcaggaaaaucgcuugaaccugggagguggagguuccagugagcugaugccacugccccuuccugccugggcaacagagcaagacuccaucucaaaaaaaaaaaaaaaauaaaaagccaaaaaaacaaguaaaccauguuugggugauguuaaauacuaugagaaaaauaagauaaaggauggugacuuaucuucuauuaggauauuuugagaagacauuguugauaaggugauauuugaaaagagaucugaaaaaagagggugggagcuuugcaacuauuggaggaugguuguuuaagcagggagaacagcagguacaaaggcucugagaaggaauggugcugugagugugauaggaacagugaggaggcugguacaacuggaguauuggaguuagagcagucuuguagaagaaugguaagagaugaccacucuaccacagaguuucuccaucuuggcuugagugacauuuugagcaugauaauuccuugcuauggaggcuguccuguguauugcaggacguguagcagcaucccuggcuucuacccacuagauacuguuagcacccuagcccuaguuaugacaaccaaaaaugucuccagacauugcuaaguguccuguagggguuggggggcaaaaucgccucuugcugagaaccagugcucuacccugucugaacacaucagguggggacaccacacuacuuuggcuccugcagcuuuggggguuuuuuuuuuuuuuuuuuuuuuuuuuuuuuuuuuugagacagagucucagucuguugcccaggcuggagugcaaugaugccaucuuggcucacugcagccuccaccucccaggcucaagccauucuucugccucagccuccugaguagcugggacuacaggcacccaccaccaugcccagcuaauuuucguauuuuuaguagagacgggguuucaccacauuggcugggcuggucuugaacuccugaccucaggugauccaccugccucagccucccaaaauucugggauuacaggugugagucaccgugcccggccauccugcagguuuuuuaaguugaaaugaaugccuccugucuacuucuguuagcuuccgucauguuagcuuccagauguuacuuacgcuucaagacccugcuuaaugauaauaguggcagccaguauuuguuugggacugugucgucagcagagcauuucugauucugacuuaauuguuuuguguuuuucaaacaauuguggagugccugcuuugugccagggguccuccccaucugcaugcaucucugaccucagcucaucacugggaaccccuggagugucccaaccuuucugcugccaagaugaucagcugacagcuuggggcaaauccacagcccucccucccucccucccucccuuccuuccuuccuuucuucccucccucccucccuccuuccuucauuccuuucuucccucccucccucucucccuuuuuugagucccuuaugcuuuuguuuagaguuuaaagaacauuucauauauuauccaaucacauauuuuguuugaguuuuuuucccuuccaacuuuuauuuuagauuugggguuacaugugcagguuuguuacauggguaaaguguauguguuggggguuugguguacaaauuauuuugucacccagauagugagcauacuaccagauagauaguuuugauccucacccuccugucacccucuacccucaaguaggccccaugucuacuguuuccuuuuuuguguccauguguacucaagguuuagcucccacuuauacgcaagaauauucaguguuugcuuuucugucccuguguuaauucacuugggauauuggccuccagcuccauccauguugcugcaaaugacaugauuuuuguucuuugucauugcuguguaguauuccaugguggaugauauauaccacauuuucuugauccaguucaccauugauaggugccuagguugauucuacaucuuugcuaucaugaauagugcugugaugaacauauaugugcaugugucuuaauaguaggauuuauauuccuuuggguauauacacaguaaugggauugcuaggucgcaucauaguucuguuucaaguucuuugaaaaaucuccaaacugcuuuccacaguggcuuaacuaauuuacauucccaccaggaguguauaagcauccccuuuucuccaccaacuugccagcgucuguuauuuuuugccuuuuuuuuuuuuuuuuuuugagacagggucucacucugucaccuaggcuuacagugcaguggcaugaucaugacucacugcaaccucaacuuccugggcuuaagugauccucucaccucagcuuccuaaguagcugggaguacaggugggcaucaccacuuuuuugacuucuuaaauuauuuuuauuuguuuauuuuuauuuauuuauuuauuuauuuaagacggauucuuacucugucaccaggcuggagugcaguggugcaaucuaggcucgcugcaaccuccgccuccuggguucaagcgguucugcuucagccuccuaaguagcugggacuacaggcaugcaccaccaugcccagcuaauuuguguauuuuuaguagagacgggguuucaccauguuggccaagauuaucuugaucucuugaccucuuggucugccugccucggccucccaaagugcugggauuauaggcaugagcugccguacccggccuauuuauucauuuuuuugagacagaaucucacucugucacccaggcuggagugcaguggugcaaucauggcucacugcagccucgaccuggugucaaucaauucucccacuucagucucccgaguaacuggggcuacaggugugcaccaccaugcccagcuaauuuuuauauuuuuuguagugugggguugugccauguugcccaggcuggucuugaacuuuugggcucaagcagucuuccugccuuggccucccgaacuguugggauuacagaugugagcuacugcaccuggccugacuuuaagaauagucauucugacuggagugagaugguaucucauugugguuuugauuugcguuucucuaaugauuaguguuguugagcauuucuucauaugcuuauuggccaugugcaugucucuuuuuccuuuuuuuuuuuuuugagauggagucuuacucuguugcccaggguggagugcaguggcucgaucucggcucacugcaaccucugccucccagguucaagugaugcucccagcugagccuccagaguagcugggauuacaggugugcaccaccaugcccagcuaaguuuuguauuuuucuuuucuuuuuuuuuuuugagacggagucuugcucuguugcucaggcuggagugcaguggcgugaucuuggcucacugcaagcuccgucuccuggguucacaccauucuccugccucagccucccgaguagcuggggcugcagguguccaccaccacacccggcuaauuuuuuguauuuuuuuuuaguagagacaggguuucaccguggucuggaucuccugaccucgugauccgccugccucggccucccaaagugcugggauuacaggcgugagccaccgcgcccagccuaaguuuuguauuuuuaauagagacaauguuucaccauguuggccaggcuggucuugaacuccugaccucaagugauccacgcgccuuggccucccaaagugcugagauuauagaugugagccacugugccuaucugcuuuugagaagaaguaucuguucauguccuuggccuauuuuuuaaugggguuguuuuuugcuuguuuauuuaaguuccuuauagauucuggauauuagacuuuaucagaugcauaguuugcaaauauuuucuugcauucuguagguagucuguuuuuuguuuuggguuuuuuuuuuugagacagggucucacucugucacccaggcuggagugcaguggcacaauuauagcucauugcagacuugaccucccaggcucaaguaauccucucacgucagccucccaagcaacugaaauuagagaugugugccagcaugccugguuaauuuuuuuuacuuuuuguggagacagggucucucuauguugcccaggcucaucuugaacucuugggcucaagugaucuuccugccuggguuucccaaagugcugggauuacaagcacgagccucaccaugccuggcuguagguugucuauuuacuccauugauaguuuuuuuuuuuuuuuuugcugugcagagcucuuuaguuuaauuaggucucacuugucaauuuuuguuuuuguugccguugcuuuuggagucuucaucaugaaaucuuugccagggccuaugucuggagugguauuuccuagguuuucuucuaggguuuuauaguuuuagguauuacauuuaagucuuuaauccaucuugaguugauuuuuguauauggugaaagggaggggucaaguuucaaucuucugcauaugguuagccagcuaucccagcaucauuuauuaaauagggaauccuuuccccauugcuuguuauuggacuuuguugaagaucagaugguuguaaauguaaauaugcggcuuuauuucuggguucucuaaccuguuccauugguccgugugucuguuuuuguaccaguaccaugcuguuuugguuacuauagccuucuaguauaauuugaaguuggguagugugacgccuacagcuuuguucuuuuugcuuaggauuguuuuggcuguuugggcucuuuuuuggugcauaugaguuuuagaauaguuucuucuaauucuuccacaacucgcuugcucuuccuuccuuucccucccucccuuccuuccuucccucucucccuccuucccucccuccuucccuccuuucuuucugucucucucuuuccuuccuucucuucuuuuguuuucucuucucuucuuuuuucuuucuuugucuuucuuuuccuuccuuucccuccuuuccuuccuuucccuccuuuuccucccuuucccuccuuuuccuuccuuucccuccuuuuccuucucuucuguuucucuuuuucuuucuuucuuucuuuuucuuuccggagggucuugcuacauugccuaggcugguuucaaacuccugagcucaaguuauccucccaccucagccgaggcauugggauuacaguugugagcuacugcaccccaccuacagguauuuuuguuucagcugugacuccuuguauuuccgaguauaagaucaucucccccuuuuuuuuaacauugaaacuuucaugggauucuccuacaugauauucguuaugcucuugaaaaacaauugcugacuaaaagggacuaaaaagucagugacuuuuacgaaguuuacauuuuuuucuguguaacauuuacauauauuucaaaaauaacaguguauguucaagccacauuauguauucagcuuaccaguggugcuugugguaucuguggauucaugaacucuuuguaguuuuuauuauuauuauuauuauuuuuaauuuuuagauggagucuugcucugucacccaggcuggaggagcagucgugcaaucuuggcuuauuacaaccucugccucucggguucaagugagucuugugccucagccuccugaguaacugggauuauaggugcaugcuccuacgcccggcugauuuuguguuuuuauuuuuaugcguuuuuuuuuuuuuuuuuugagaugaagucucacucugucacccaggcuggagugcaguggugcgaucuuggcucacugcaaccugugccucccgggcucaagugauucucaugccucagccucccaaguagcugggauuacagguuugugccaccacgccuagcuaauuuuuguauuuuuuuuuuuuuaagacgaagucuugcacuguugccugggcuggagugcaguagcacgaucucagcuugcugcaaccgccgccucccagguucaagcaauucuccugccucagccuccugaguagcugggauuacaggugccugccaccacacccaucuaauuuuuuguauuuuuaguagagacgggguuucacuauguuggccaggcuggucuugaacgccugaccucaugauccacccgcuucggccucccagagugcugggauuacaggcgugagcugcugcgccuggccauuaauuuuuguauuuuuaauaggguuucgucauguuggccaggcuggucuugaacucccaaccucaggugauccaaggucuuaaacuucugaccucaggugauccgccugccuuggccucccaaagugccuggauuacaggcaugaaccaccucgccuggccccuuuguauuaacucuaagcccacccuuagaggggaaugaacaaagagaaacuacaaccuauaccucuucccauaucccuccgaauuaaugacacccucuuccuuucugcaugcaucuuuuauggccuucuaugaugcuugccaguuauggauuuguaugucucugcucauggucuguaagcucuaauuuaucaucauauccuccaagcacuuagcacaguauuuuguacauuauaagcucuugaagguauuugcgguaaacucccgaaaaacuuguauaagccagagagauaauugucuucuucaaaccuggccuuagaacauuuagauuaaggaaauuuuauugugacguaauaugacauauaccauaugucauguugaaacagucaauaaaauuuuuuuuuuuagagguugucucucucugucgcccaggcuggagugcagugacacaaucuuggcucacugcaaccuccgccuccugguuucaagcgauucuccugccucagccucccgaguagcugggauuacaggcaucagccaccacgcccagcuaauuuuuguauuuuuaguagagacagaguuucaccauauuggccagacuggucucaaacuccugaccucaggugauccacgugccucagccucccaaagugcugggauuacagacguaagccaccaugcccggcccagucaguaaauuuuuauuacucuauaguacauaucauaugaaguagucaguagcaguagcaaucuucccacccccccacuuuuuuuuuuuuuuaaccacaaccaucacuuuucccuuguaguuuccuaguuauuuuagagaaaaggaaaaccaugggagaaaaacauguccaacuuccguauuuuaagccuaguuuuauagagcauuugagacaggcaaggcaaagauugaugaacugaaagagugucuacuucuguaagauggugaccauccucagggcuguucaugccuugcuucauuuuuagguagcauggcguggaugaaauuaggcuuugggccgggcgugguggcucacaccuguaaucccaguauuuugggaggccgaggcagguggaucaccugaggucaggaguucaagaccagccauggccaacaugugauggccaacaugugaaaccccaucucuacuacaaauacaaaaauuagccagaagugguggcaugcaucuguagucccagcuacuugggaggcugaggcaggagaaucgcuugaauccaggagguggagguuguagugagcugagauugugucacugcacuccagccugggugacagagcgagacuccguccccgcuccccccugcaaaaaagaaacuaggcuuugacagacugagccacauucugugaacagaguguuaguguaccucauuuugagcaaaggugcguguaucuuacuagaaaaagauaggaacccaacagcugagcugugaguacugcccgaagugacugguuuccugugcauggaggugcagcucaguuacugcucuguuugauguacuacugggcaucacuuuacuuagguggguucugacuacugcuucagauagccaaagaccugucacguagaagagagauucaucuggggcaaagguaugggaagauugauuucaguucaguaugagaaagaacuuucuaaaaaucaggccucuugagaaggccaggcacaguggcucauaccuguaaucccaguacuuaggaagauugaggugggaagauugcuugagcucagcaguucaagaccagccugagcaacauggcaagaccuugucuccacacacacaaaaauaauuuuuaaaauuaguuggguguggugaugugcaucuguggucccagcuacucaggaggcugaggcugggaguuugaggcugcagugagcugugguugagccacugcacuucauucagccugggcuauggagugagacccugucucuaaaaauaagcauaggcugggcacgguggcucacucuguaaucccagcacuuugggaggcugagguagguggaucacuugagaucaagaguuugagaccagccuggccaacauggugaaacaccaucucuacuaaaaauacaaaaguuagcuggguguggugcugcacgccuguaaucccagcuacucaggaggcugaggcaugacaaucacuugaaccugagaaguggagguugcagugagccgagaucacaccacugcacuccauccugggcagugaaguaagacucugucuccaaaaauaaauaaauaaaaaaaauaaaauuaugucccuuucuuacuagaggggcauggggaaucccacucacagggauucccccaaaugaguucccggacauaucacauaauugcuccugauucuuuccagccaggaggcuuucaacccaaaacacccauccugccccauuucuaaagagagcagggaaccaguguuaacuaagauuuuuguguguuuacaguauaugauuaugcccauuuuacacaugagaaaagcagauucuuggagaagucaagauggucaaagcuuuuuuuuuuuuuuuuuuuuuugaguuggagucuugcucuguuguccaggcuagagugcaguggugugaucuuuggcucacugcaacuucugucucucagguucgagcaauucuccugccucagccucccaaguagccgggauuacaggcacccgccaccaugccuggcuaauuuuaguauuuuuaguagagacgggguuucaccauauuggucaggcuggucucucugccaggcuggucucgaacuccugaccucgugauccgcccgccucggccucccaaagugcugggauuacuggccugagccaccacgccuggccuuugucaaagguucuuaccuuguaaguggcugaguuagaauuucagcuguauuacaaguugcugggcccaaaacucauagaauauugacauauuuuaucaguuauaaaaugccuccauguacaagcacugcuaggggagguaauuagcucuguguggagagggguuuacacacaguauagguugaauaccagcuuguugggauguuuuagaggagauucagacauuagccaguuguuggaugacaugggguuuaaggucuuuuccaacuuuuugaugucaucaucaguauuuuguucaaauuuaaaagacacauagaauguucucuaaucuugauuaaacaauuauuuuauuucagugaagaaaauauuuggaagcucugugaauacaucaaaaaccaugaccaguauccuuuagaagaauguuaugcugucuucauaucuaaugagaggaagaugguaaguuggugagugauugcagaaagaaaacaagagauuuaggaugacauuagaagcuaaauuaaaaaaaaaaaagcuaaauauagcauggguguaguacucuucugaagugugcuuuauuaaauacagcaacauuuaaaagcuugcuuuugaaugagauuuuuuuccuuacaaggcacgauugaguuagaagaguugagucccuucugucgcccaggcuggagugcaguggcgugauucuuggcucacugcaaccuccaccucccggguucaagcgauucuccugccucagccucccaaguagcugagacuacaggcaugugccaccacgcccagcuaauuuuuguauuuuuuaguagagaugggguuuugcuauguuggccaggcuggucucgaacuccuggccucaagugauccucccaccucagccccccaaagugcugggaguacaggugugagccaccaugcccagcuuagucccuuacuuuagguaaggaaauaugugauggucuacgcagauaaagucccuuuucuuuagguaucaauguagaccuguuuuuuuuuguuuguuuguuuguuuuuucuuuuauuuuuugguacggagucucacucuguugcccaggcuauagcacaauggugugaucucggcucacugcaaccucugccucccagguucaagugauuuuugugucucaggcucccaaguagcugggacuacaggugucccaccacgauggccggcuaauuuuuguauuuucaguagagacaggcuuucuccauguuggccagucuggucucgaacuccuaaccucaggugaccugucugccuuggccucccaauguggugggauuaccagcaugagccacugugccuggccauuuuuuuuucuuuuuuuaaauucaagauggaagauguagacuuuuuaaaaauugcuuagagacgcauacucucaguuuuaaaguaaggauuugucucuggaguuuaaauagaacuacagucaacuuacaugaagaauuagaaaaaguaagcccuucauauuuuguaaaacacauuugcaggcaucaucucauuugaucccaauggaagcccugugaagcaggcaauauuuggacaaguuucuucauuuuauagaugaagagauuaagacuuaggguggcccuaugaauaauuaaaugggagagcaagauuugauaccugccaggacuucugauuccuaguucagaucccuuuucacucuccaaagaccaucauacaauaacuagugcucuugagagcuuucauuguuggggauacuuagaaggauuucgauuucuuccucuucauucauuccuucaccuugauuuuugcaugcuuaaaaauauuuuauuucucauguauguauugcuuuaaauaguaguagccagguacagugacacgugccuguagucccagcuacuugugaggcggcugaggcgggcagaucucuugaagccaagaguucaaggcugcaguauacuaugauggcaccugugaguagccacugcacuccagccagggcagcaucacaagauccugucuuggccaggugcgguggcucacgccuauaaucccagcacuuugggaggcugaggugggcagaucacuugagaucaggaguucgagaccagccuggccaacaugaugaaaccuugugucaaaacccuucaucaaaaaauaaaaauaaaaaauuagcugggugugguggcacacgccuguaaucccagcuacuugggaaacugaggcaggagaauugcuugaacccgggagguggagguugcaguaagcccagauugugccacugcacuccagccugggugacagagcaggacucugucucaaaaaaaaaaaaaaaaaaucccgucucaaaaaaaaaaaaaggaaaauaauuuaguagugguuuaacuaaagguauggcuuacgaaauguauuguauuuuguagauaccuaucuggaaacaacaggcgagaccuggagauggaccugugaucuggguaagacaguuaauacagagaguauugacgcauuaugacuuguaaccccuuaguguucuguauguuuugguaaagcagaagugaccuaagcaguagagaaaggcuaugguaauuauuaauaaauugaccuuuugagaauagauguuauuugaucuaagguagaaacacuguaggcauauuuucuuuuaacuuuuuguuuugaaauuauuauaggaaugauuuuaaaugguggauauauuugugaucuagacucuuaccauuuagcacaggaaggaacuuuggcuacacauuagaauuaucuggagacuguuaaaaauguaguuuucggcugggcgcgguggcucacaccuguaaucccagcaguuugggaggccaagguggacggaucacuugaggccaggaguucaagaccagcuuggccaacauggcgaaacaccaucucuaauaauaauacaaauauuaggccgggcgcaguggcucaugccuguaauuccagcacuuugagaggcugagguagguggaucacuugaggccaggaguuugaggccagucuggccaacauggcaaaacuccgucucuacuaaaaaaaauacaaagauuaacugagccugguggcacucaccuguagucccagcuacucgggagguugaggcaggagaauugcuugaacccgggagguggaggcugcagcgagcugagauugcuucacuguacuccagcuugggugacagagagagacccugucucaauaaauaaauaauguaguuuucugauuuaguaaaucuagagagggguucaggaguuaguguucuugaugaacuccuaggugaacaugacuggcauuugaaaaauacggaucuacucccaccccuuuauuuuucagggaagaaauaaacacagaagagcaaacugaguagcucagaguggcauggucaguggcagaacugggucucacaccuggguccuuuuuaguacacaucuacaugucaccuuaacccauuccccuaaagaauggaggcuaggguugggcacgguggcucaugccuauaaucccagaacuuugggaggccgagguggguggaucaccugaggucaggaguucaagaccagccuggucaacaugguaaaaccccgucucuacuaaaguacaaaaauuagcugggugugauggcgugugccuguaaucccagcuacucgggaggcugaggcaggagaauugcuugaaccugggaggcagagguugcagugagcugaggugacgccauugcauuccagccugggcaaaaagaaugaaacuccauaucaaaaaaaaaaaaaaaaaaaauagaguuuuuaugcuaauaaacacgaaagcaaaguaaaaggaaaaugacacugaugaauuggaacaaacuccuaguuucuggguauuuauuuaaaauuauguaucauuugauuggcuucgcucauuuauuuaacauguauauauugaguguguuuuauaugccaggcuaaaaacagauuaaaaucccugaccucacagagcugacguucucaguuucguugccagcaggugaucuugcaugaaagcugcucuugcaugaaagcccaagccccucagcucuaggguuaggagcacaggcucuggaguuaggcauacuggguuuaagucccaggccucucauuggucagcugugggauccagauagguuauuuacccucugucuucagugucucccccuggucaguggggucgugaggcuuaaaugagguaaugcacaggaagcaucuuccuggugucugcuacugguacucaggaaguguuggcaguuacuguuagcagugauaccuaaccccuguuauagaugguccgugugcacgagaaaucaucccuguugcugaacagcuuagcugauuuugagucguggucuuacuccccauccuagggaaacuuggaggggaaggaccuguagccaugucucccuuacacaucucauggcagcucaagauggggaauccuguugcaagaagucuccccacacccucuggcagguuuugcuuugccucgcugcuguccuguuguagggcauggguaggccucgcugagugagcagagacaccagugaguaguagugaguaaaauucgagaacacuaaauccugaaccccuuucuagauuuacuaaaucagaaaacuacauuguuaacgcagucucuggauaauucuaauguguagccagacuacauauugccaaagucccuucccaugcuaaauggauaaaagucuaugacaucacaaauauaucugccacauuagccauuuaaaaucauuccuauaauaauuucagguugggcgugguggcucacaccuguaaucccagcacuuugggaugcagaggcaggcagaucccaugaggucaggaguucgagaccagccucaucaacauggugaaacccugucucuauuaaaaauacaaaaauuagcgugguggugggcgcuuguagucccagcuacuugggugccugaggcaggagaauugcuugaaccugggaggcagaggucacagugagccgagaucauaccacuguacuccauccugggcgauacaaugagacuucaucucaaaaaaaaaaaucauuccuauaauaauuucuuuuuuuaaauuuuauuuauguauuuuuuuuuugagauggagucucacucugucgccuaggcuggagugcaguggugugaucucggcucacugcaaacucugacccccaagguuuaagcaauuccucugccucagccucccgaguagcuggaauuacaggcauguggcacacgccuggcuaauuuuuuuauuuuuaguagagaugggauuuugccauguuggccaggcugaucucgaacuccugaccucaagugauccgcccgccucggccucccaaauugcugggaguacaggcgugagccacugugccuguccuccuguaauaauuucaaaacaaaaaguuaaaagaaaacaugccuauaguccuucuaucuuagaccaaauaacauggagcagaugguggcaucuguaggugacauccccacuccuagcacaaucagucuuuuccuggcagcugggcagacacugaaccaacucagagagugaggccgcugcucaagccugcauuccuuggcuccucaucugugccaugaaggcaauuuugggccaacccuuuuccuuugcagucccucagcugccuaguguauaggaauguggaccugaacuuacuagagaguugugaauagucauuauguaugccuuuucacaaguuguaccuucuuucuggaaagcuguccccaucaggcaagauucugcaaugggguccuuuccucugugaaacucucuuuggccauugggcuccuguccucuuccuuucuugguuggcuuuaauuuuuuauuuuuauuuauuuauuuguuuuugagacagauucuugcucuguugcccaggcuggagugcaguggcaugaucuuagcucagugcaaccucugucuccuggguucaagugauucucgugccucagccuccugaguagcuggggcuacaggugcaugccaccaugcccggcucguuguuguauuuuuaguagagacggggucucacuauguugaccaggcuggucuugaacuccugaccucaugugauccaccugccucggccucccaaagugcugggauuacaggcaugagcuaccaugcccagccuuugguugucuuuuaaaaggguugaucauuuacacacuaaugcuucuagcagcacuaugagguagaccaagcuugucuaaccugcagccuaugggcugcauguggcccaagacagcuuuaaaugcagcccaacacaaauuuguaaacuuucuuaaaacauuaugaaauuuuuuugugauuuuuuuuuuuuuuagcuuaucagcaaucguuaguguuaguguauuuuauguguggcccaagacaauucuucuuccaguguggcccagggaagccaaaagauuggacacccuggaguuagauacuccaguuaucuccauuuuauaaaagagcagagugagguugccgaggggaggggcugagauuggaaccaggcgcuuaccugcuccugccugcauugcucuccugccugcauugcucuccugccucugauguucucuguucuccacaauauccugcagcaguuuaccugguucccauucacuucucugggaacuucuugagggugagaacuuaucuuuuucaucuuugcaucugcaguucagcagcacagucuuucacauagaauagauaaugugugguucaaaaaaacugauaugggacugggcacaguggcucacacccauaaucccagcacuuugggaggcagaggcagggagaucacuugaggccaggaguucgagaccagccuggucaacauggugaaaccccaucucuacuaaaaauacaaaaauuagcugggugugguggcgcgccuguaaucccagcuacucgggaggcugaggugggaaaaucacucgaaccccggagguggagguugcagugagcugggauugugccacugugcuccagccugggugacagagagagacucugucucaaaacaacaacaacaacaaaccuguaauaugaauuagaagauguuaagagagaaacagaauuuggauaaggcggagauucuggcagggggugggagaagauaaaaaauugauucgugggaagaaagccuuuagcuggagcuugugugguagaaagagguagagaagguugcugcagauggaggggaaugacaugagcagacccauugggaggcagugguggacuguuugggggcguggaggauaggauguaucuggggaaguccagagaauaggcauucauuuuugaaucuuucuguuuugcuaagacagacuuagagccaaaggcagcacucaggcuuuuaaaggcacagcaucccuagucuuaaguauuguucuuaccucaggauuuauacagggcucaaguagaaugauauuugagaaagaaagugccuuuuaaacucuaagauauuguagaaauauaaguugguauuacuaauguugcuagguugcuuugauuucacagugcuguucucuaugagagcguuuuucuuuggaagaacucagagcaccacauugcucaugucccuugaucaccucccugaaaucccuuucagcucaucgcugguguugggcaguaccuugagucugagagugagggugagaauuaacauccacacugugacagagcugugugggaaaagcugucuuuuucuuucucccuuaguggcuacagaugaaagcuuggcuaacuucuuuuuuuaaaaaauaguuuuuccuuucuuuuaauugcaaaagugguuccaaacuagaaauuaaaguccuccuucuccucuccaggcugacccccagaagccuccuuuguuacuaguuuggagcagauccuugcagacguuuuccucugcauucacaugcaugcaaauguacuucugaaugcgcacguaugucuuuauauacagauagcuuuuaacaaauagcagguggggccggcacuguggcucacaccuguaauuccaggacuuugggaggcugaggcggggggaucacuugaggccagaaguuggagaccagccuggccaacauggugaaacaccaucucuacuaaaaauacaaaaauuagcugggcgugguggcgggugucuguagucccagcuacucaggaggcugaggcaggagaaucgcuugaacccaggaggcggagguugcagugagcugagauuaugccacugcacgccagccugggugauagagcaagacucugucucaauuaaaaaaaauauguggggccaggcaccguggcucacaccuguaauccuagcacuuuuggagacugaggcggguggaucgccugaggucagggguucaagaccagccuugccagcaugaugaaacccuaucucuacuaaaaauacaaaaaauuagcugggcaucguggugcgcgcuuguaaucccagcuacucgggaggcugaggcaagagaauugcuugaacccggcagguggagguugcagugagcugagaucaugccacugcacuccaaccugggugacgagaguaagacuccaucucaaaaaaaaaaaaaaaaaaaaaguuuccuagagguaaaauugcaguuucagaggaugugcauuuaaugacuaugaacauuuccauuauuuaaccauuucccuaucuguggacauuuagucuguuuucauguuuucaggguguuguguuugcuuuauucuauuuugcuauuauaaggagggcuguagcaguccuauauccuuuuuagugauaagguaugugucugaauacugggauuucaucauuaugaaguaacuugguuaacuucagcaacuuuuacuuuuaggauuaccauguuguuuugcuucauguuucaaguggaggacagaacuucauuuaugaucucgauacugucuugccauuucccugccucuuugacacuuauguagaagaugccuuuaagucugaugaugacauucacccacaguuuaggaggugaggacauucaagauggauuuacuuauuuucugaaguaagaauuugacgauuccacagagguucuuuuuuuuuuugacaauuguuuuguaaagaucucgucugacaucaccauugaguugauguuuaagaaugauguauuugcaacacaggagauucaaaauguuuuaaagcuuuaaaaguuaucuaucauaugaaagguugucauucuuuuaaaauuuugugugaugagaucucagacauuuaauuucaagcggguuggggauuuuucuuauauucuuuuuguuuuuguggggauaccucgugcugucaccauugagagggcugugagggcagcaucagaaaaucaugcccauugcccuugauacacaaaucgaguaaaucgaggcaaccagauauauuuuugugccuuugccuuucuguuucgggguuugguugaucauuuccuaugcuucucuaauagguaguaaaguugccuguauuacuaaccauacagaaaugcaugaguaguuuugugcaugucauaggaaaugagucgauauaaaaauggaguuagaauuucaaacaugacaucucccuaaugugaguguauauugauuuuucugcaggaaauuuagagugauccgugcagauucauauuugaagaacuuugcuucugaccgaucucacaugaaagacuccagugggaauuggagagagccuccgccgccauaucccugcauugagacuggaggugagccaagaugccuucucagauggggguucugauugaucacauacacaucagcauuuuuccuuaacggaggacaaaagucagguuguucuuugaauaaaacuccaugagugaaucccagcacuuugggaggccgaggugggcggaucacgaggucaggagauagacaccauccuggcuaacacggugaaacccugucucuacuaaaaauacaaaaaauuagccagguguggugacaggcaccuguagucccagcuacuagggaggcugaggcaggagaauggugcgaaccugggaggcagagcuugcagugagcugagaucgggccacugcauuccagccugggugacagagugagacuccaucucaaaaaaaaaaaaaaacaaaaaacaaaaaacaaaaaauuccaugaaugauaaggaggucauaggaaauacuacuucuguguguguauuagauucagaaaugaaggcacagagaauaggacuggaaggcauaagaacaugugggagaggaaggguguuaaggaucagaaccagggcaccugcaaacugcuggauuauuggauguagcuacugcggggacacugaacaucaggauacucgcaugcuugugucauuuaacagcgggacuaguagcaccuugccaugguaggguuuugugcuguggugaaagaaauccccauugcauccuuaugaugugugaaaugucacuuuggcuauauaauaaaaucugcauuagagggaggugagcgcuagcagguuuuauuguaccacuugucucauuuaugugcuuuuaggcaucaauccaguugauaauuuccugacauuuaagaagauaaaggguccuucacccuauuacuauuguuuggcauucauaugaguuugaaguauuauuuacguuuguaaguaauucacaacauucccacuuaggggugagaucaucccaacaccuggauaauacagucugugugaaagugcucugugagcucugcagcaugucagaaaaauagggcaguaguguuaguacuucaacaagggucugagcgugguggcuuaugccuguaaucccagcacuuugggaggcugagguggguggaccaccugaggucaggaguucgagacuagccugaccaauguggugaaacuccgucucuacuaaaaauacaaaaauuagccgggugugguggugugugccugaagucccagcuccuugggagacugagacaggagaauuacuugaaccggguaauugcuugaaccgggaggcagagguugcagugagccgagaucgcaccacugcacuccagccugagugacaagagcaagauuccaucucaaaaaaaaaaaaagaaaaagaaaaaaauaguuuaacggaagaaaguaaaauauacauuuggcauauuugaggggacugaacacuaagagaggguucaaacucugauuuuugaggcucucuaugaaaagcucucauaauuuaaaaaauuauauuggaauugcuuaucaguacacagagcugcuuccuggccucagugugagaacuggggaagcucccugguaaggagagggcucgaggggucugccuuagcaucuauggcaaccugcucuacagggccuggucuggccacagugugccuuuagcagcuaccuguuuccccuugagaugugagcaccuaagacagaaccuagugcaucgcaggcauuuagugaaccccuugucagcccugguccaacuggggcaauuccuuuuguuuugaugacuacuagucauuggaugcuguuuugugcugggcuuuugccagcccaauuacuauaugggcugccgaggugagcacugccagcccaauuuucuuucuuucuuuuuuuuuuguugagacucuuguugcccaggcuggagugcaguggcacgaucccagcucacugcaaccuccaucuccugaguucaagcaauuuucaugccucagccucuggauuaguugggauuacaggcauacaccaucacaccuggcuaguuuuuuuuuuuuuuugagacggagucucacucugucacccacgcuggagugcaguggugcgaugucagcucacugcaagcuccgccucccggguucaugccauucuccugccucagccuccugaguagcugggacuacaggcgcccgccaccacacccggcuaauuuuuuuuuuguauuuuuaguagagauggggucuuaccguguuagccaggauggucucgaucuccugaccucgugaucugcccgccucggccucccaaagugcugggauuacaggcgugagccaccgcgccggccacaccugguuaguuuuuauauuuuuaguagacaugagguuuugccaugugggcuaggcuggucuugaacucuuggccucaggugauccuucugccuuggccucccaaagugcugggauuacaggggugagccacugugccuggcccauauuaaccaaaaauuagccaggcgugguggugcacgccuguaaucccagcuacucaggaggcugaggcaggagaauugcuugaaucugggagguggaggucgcaaugagccaaaauugcaccacugcacucuagccugggugacagagggagacucugucucaaaaaaaagaaaacagacuuuaaauuaaugcauguuuuagauacaugcauuauuggguauguuggauuuaguuauggaauugacucuuuuuuuuuuuuaaucaagguagggucucaguauauugcuccuaccuuggccucccaaaauacugagauuauaggcaugagccaccacgcuggccaggauuaacuccuuuuuuuuuuuuuuuuuuuuuuuuuuugagacggagucuugcucuauugcccaggcuggagugcaguggcacaaucuuggcuugcuacaaccucugccuccuggauucaagcgauucuccugccucagccucccaaguagcuuggauucuaggcacccacuaccacaccuggcuaguuuuuguauuuuuaguagagacgggguuucaccacguuggccaggcuggucucgaacuccugaccucaagugauccaccccucuuagcuucccaaagugcugggauuauaggcgugagccaccacgccuggcugcuuuucgucuuucugaguaaagguugagaguagcguuccuuucuucuuuuuuuuuuuuuuuuagacaaagccuugcucuguugcccaggcuggagugaaguggcgugaucuuggcucauuacacccuccaacucccagguucaagcaauucuccugucucagccuccuaaguagcuggaauuagagaggugugccaccauacccagcuaauuuuuguauuuuuaguagagaugggguuucaccauguuggccaggcuguucucuuaacuucugaccucaagugaucugcccaccucggccucccaaagugcugggauuacaggugugagccaacaugcuuggcucagagcagccuuucaucgagggcuaauuuagccccccuacucugacaugacccuucugaggacgcuacugaacgcugcauguuacgaguucucuccacucuggcugguggugacaugaauuauuucuagcccuguggaaguucuggggauuauuagacccaccgcuucuuggugcuucuuucccuggccucaugaaguuucguuccauagaagagaagaucaguacuuagccaaagacucggggguccccucugcugaucuuuggagcucugacucucuguguaguccccucuucacugauauucuguuucccucaguuuggguguguguguuuugucaugauuggauugaaguuauacauucaaggccagaaaaccacagaagugacauugagcccuuauccauuugaauaauuuuaccuacuuuuggucuucugcauuguuuuauugcuguuaaaccaaaauuguguuuucaguggacauuuuuuuuucauauauuuuuuuagauuccaaaaugaaccugaacgauuucaucaguauggaucccaagguaggauggggcgccgucuacacacuauccgaauuuacacaucgguuuggcaguaaaaacugcugaacuuggucucaagauguggaacuguggagaaauucuaggacaugaacaagcuauccuuucaucgaggacagcaaacauuaugguacaguuggcuuggaauuaugucuuucucuuuuaauuugauugaguggaaaucugagugaauacaaauauaaaugaacaacauaaaaacuuuuguuuugacaugucaaauugaaacuugauaaagugcguacuugcuaagauauuccuguggcucaugcguuacaacacgaggacuuaagccaguaaucguuuuuguucagauagagguguggagguagagccagccccucaugucuguuuuggauguuuugugucucuccagcuacauuguaaguuccuugagggcagggccauggcccauugcucugugaaucucaaaugcccauaaaaggugcccauaaaauguuuucuugaacauuugaaugugcuguugucuggaaagggguaauauugugagcugaaucagcaauaaguauuagucuuuuuggacuaugguauuguuaaaaagacugcagcccucucagacuugagcguuaauuggcuuauuuauuuauggcuuuaaauaaaaucgauuuaacguu

SEQ ID NO: 192549 - RNA, 3926 nt, Homo sapiens
ggggccgcgcggcugccugggaggcuccgggccagccgcgguccagagcgcgcgagguucggggagcucggccaggcugcugguaccugcguccgcccggcggugaguccgcgggcccccggccgggacgcccccgccaccugcgcgcacgcgcucagacccggcggccucggcugcggugcacgcggccccggcucagccacgcgcggcggaaggcgcccugcgggggccggggcgggagagggugggagagagcaagaggggcgcacggggaggcgcaggagaggggcuggggcugccgguggguugguccccagagagcugagcuucuccucccaucccccgcaggccuccccgaauguuuccaaagaucuggggcgggagcgggcggagacugccgccaggagccucccggccgccccagggcugcgcagccacuggagcccaucacccaacuccagacgcuccuggcuccucuacgugggccgggagggacagccuugaggacuaggggagggggcacgggaccuugcagagcuccuggccggaaagggaggauugaccgcccccggcauaucaccccggagcacuggaacccgcccccgcuucuuguuuuggcacugguggugcuugcggugagguccaaggagcccagccucccugaguggaccgccgggccccuccccguuccgggacacaggagaggcucccgccccuugcuggcugggcagccccuagauaccuggcucccaggggccagcuucccugagccuggggaugagccaugagccugcagccugggccccaggggcgccccccacggccugccggcuggcucccuccgggcuccauggcccacccggccuuccuaauugccuucggcucccaccggugccuuagcucagccugguggcccagcggguugggugccacccagugagcagguggcggcaccagcuggaccuguuuguggcccuguaugcuaggacuuccucagagacagcucagggacccccccacaccagaaccucacuuuagggggguggggggaaaaggaauuggagauccuuccuccucgggcuacucccuggaggcggggauaggccccagccggacuuggcacuguuuuuggccaccuggggcucccacucccaaccccaggaugucagcccaggucucacuguccuggccugcugcucuccccuuagggccucugcgggccccucuccagaucuguucucugaggcauccuccuuacccccagugcccagcacuagcuccccaggcccgggaugucccucccacuccucugcccacggcugucccugacagaaggcagcagccucccccuccaacaccaugcacucacaaaacagagaaucacgaccccagcuggguguguuccagauucuuucuccagcagugcagaggguccugugcagaggccgaggagcaguacagcgacccaucuggcccuuuccugcuggugggaccaguggcacgcagccuugucucucggagcccauuucccagccacagaauggggaguagcagauacugaguggggugcuuuccucggaacugaguaacaucaggaauggggagugcuuucccccucagccaugccccaccuggccccaggucuccaugugaggggagcugccugggcucaaaacacugagccaucccaaggaaaauucuagauacagauuagcuaauauacacugacagauacacauauagauguguauauagauuucucuuuuuuuugagacagggucucacucuguugcccaggcugcagugcaguggcaugaucauaguucacuucagucuugaacucccuggcucaagagauccucccaccucagccucccaaguagcugaccacaggcacguaccacgcccggcuaauuuuuguauuuuuuguagaaacaggaggucucacuguguugcccaggguggucucaaaccccuggccucauaugauccuccugccuuggccucacauagcauggagauuacaggcgugagccccuguacccagccccagacuagcuaauauuaugacugaucaccauuccccauuccccauucccccaccccaggaccacuggcagaggccacucacucugccuucuuuucugugguucugagaaggcugcugaguuuccuccucuugccugugcagcccccuccugccagguuucaggagggagauagccuagagcaugucugcacugagugaggagugggucaggagagaagcagggaaguccuugugugcuggcaggucccuuccccucugcugucuguguccucaucugcaaagugggggugcauggucuuggggaggagugaggcaccacccggcccccuaaccagugugucucuccagagcaggacaggcugcuuugguuugugaccuccaggcaggacggccauccucuccagaaugaagaucuucuugccagugcugcuggcugcccuucuggguguggagcgaggugaggugcccuuggggaccccagaccuuuguccagcugugcccugcuccacucccucuccaccccucuccccugagcagacgccccagggguccuuccaggccgcucccagcagagggcucacccggccuggccacacugucucacuguguguuugagugucgcuugaccugcucgacggccaggguggggugucacugucuuugcucugccuucagcccagggccugguauacaguaauuucucaguaaauguccacuggggucaggccugggagggacacuggaggcuucccugagacagguguguccuccuuccgcagccagcucgcugaugugcuucuccugcuugaaccagaagagcaaucuguacugccugaagccgaccaucugcuccgaccaggacaacuacugcgugacugugucugcuagugccggcauuggugagugccaggccucagaccgugccuuccuccccuggccaucucccuagcccgggccggggcucagcagaggccauugcugucugucugcagccgucugucucuccccugacagccucauuucccaugcagggaaucucgugacauuuggccacagccugagcaagaccuguuccccggccugccccaucccagaaggcgucaauguugguguggcuuccaugggcaucagcugcugccagagcuuucugugcaauuucagugcggccgauggcgggcugcgggcaagcgucacccugcugggugccgggcugcugcugagccugcugccggcccugcugcgguuuggccccugaccgcccagacccugucccccgaucccccagcucaggaaggaaagcccagcccuuucuggaucccacaguguaugggagccccugacuccucacgugccugaucugugcccuuggucccaggucaggcccacccccugcaccuccaccugccccagccccugccucugccccaaguggggccagcugcccucacuucugggguggaugaugugaccuuccuugggggaccgcggaagggacgaggguucccuggagucuuacgguccaacaucaggaccaagucccauggacaugcugacaggguccccagggagaccgugucaguagggaugugugccuggcuguguacgugggugugcagugcacgugagagcacguggcggcuucugggggccauguuuggggagggaggugugccagcagccuggagagccucagucccuguagcccccugcccuggcacagcugcaugcacuucaagggcagccuuuggggguugggguuucugccacuuccgggucuaggcccugccccaaauccagccaguccugccccagcccacccccacauuggagcccuccugcugcuuuggugccucaaauaaauacagaugucccccag

SEQ ID NO: 192550 - RNA, 3926 nt, Homo sapiens
cugggggacaucuguauuuauuugaggcaccaaagcagcaggagggcuccaaugugggggugggcuggggcaggacuggcuggauuuggggcagggccuagacccggaaguggcagaaaccccaacccccaaaggcugcccuugaagugcaugcagcugugccagggcagggggcuacagggacugaggcucuccaggcugcuggcacaccucccuccccaaacauggcccccagaagccgccacgugcucucacgugcacugcacacccacguacacagccaggcacacaucccuacugacacggucucccuggggacccugucagcauguccaugggacuugguccugauguuggaccguaagacuccagggaacccucgucccuuccgcggucccccaaggaaggucacaucauccaccccagaagugagggcagcuggccccacuuggggcagaggcaggggcuggggcagguggaggugcagggggugggccugaccugggaccaagggcacagaucaggcacgugaggagucaggggcucccauacacugugggauccagaaagggcugggcuuuccuuccugagcugggggaucgggggacagggucugggcggucaggggccaaaccgcagcagggccggcagcaggcucagcagcagcccggcacccagcagggugacgcuugcccgcagcccgccaucggccgcacugaaauugcacagaaagcucuggcagcagcugaugcccauggaagccacaccaacauugacgccuucugggauggggcaggccggggaacaggucuugcucaggcuguggccaaaugucacgagauucccugcaugggaaaugaggcugucaggggagagacagacggcugcagacagacagcaauggccucugcugagccccggcccgggcuagggagauggccaggggaggaaggcacggucugaggccuggcacucaccaaugccggcacuagcagacacagucacgcaguaguuguccuggucggagcagauggucggcuucaggcaguacagauugcucuucugguucaagcaggagaagcacaucagcgagcuggcugcggaaggaggacacaccugucucagggaagccuccagugucccucccaggccugaccccaguggacauuuacugagaaauuacuguauaccaggcccugggcugaaggcagagcaaagacagugacaccccacccuggccgucgagcaggucaagcgacacucaaacacacagugagacaguguggccaggccgggugagcccucugcugggagcggccuggaaggaccccuggggcgucugcucaggggagagggguggagagggaguggagcagggcacagcuggacaaaggucugggguccccaagggcaccucaccucgcuccacacccagaagggcagccagcagcacuggcaagaagaucuucauucuggagaggauggccguccugccuggaggucacaaaccaaagcagccuguccugcucuggagagacacacugguuagggggccggguggugccucacuccuccccaagaccaugcacccccacuuugcagaugaggacacagacagcagaggggaagggaccugccagcacacaaggacuucccugcuucucuccugacccacuccucacucagugcagacaugcucuaggcuaucucccuccugaaaccuggcaggagggggcugcacaggcaagaggaggaaacucagcagccuucucagaaccacagaaaagaaggcagagugaguggccucugccagugguccuggggugggggaauggggaauggggaauggugaucagucauaauauuagcuagucuggggcuggguacaggggcucacgccuguaaucuccaugcuaugugaggccaaggcaggaggaucauaugaggccagggguuugagaccacccugggcaacacagugagaccuccuguuucuacaaaaaauacaaaaauuagccgggcgugguacgugccuguggucagcuacuugggaggcugaggugggaggaucucuugagccagggaguucaagacugaagugaacuaugaucaugccacugcacugcagccugggcaacagagugagacccugucucaaaaaaaagagaaaucuauauacacaucuauauguguaucugucaguguauauuagcuaaucuguaucuagaauuuuccuugggauggcucaguguuuugagcccaggcagcuccccucacauggagaccuggggccagguggggcauggcugagggggaaagcacuccccauuccugauguuacucaguuccgaggaaagcaccccacucaguaucugcuacuccccauucuguggcugggaaaugggcuccgagagacaaggcugcgugccacuggucccaccagcaggaaagggccagaugggucgcuguacugcuccucggccucugcacaggacccucugcacugcuggagaaagaaucuggaacacacccagcuggggucgugauucucuguuuugugagugcaugguguuggagggggaggcugcugccuucugucagggacagccgugggcagaggagugggagggacaucccgggccuggggagcuagugcugggcacuggggguaaggaggaugccucagagaacagaucuggagaggggcccgcagaggcccuaaggggagagcagcaggccaggacagugagaccugggcugacauccugggguugggagugggagccccagguggccaaaaacagugccaaguccggcuggggccuauccccgccuccagggaguagcccgaggaggaaggaucuccaauuccuuuuccccccaccccccuaaagugagguucuggugugggggggucccugagcugucucugaggaaguccuagcauacagggccacaaacagguccagcuggugccgccaccugcucacuggguggcacccaacccgcugggccaccaggcugagcuaaggcaccggugggagccgaaggcaauuaggaaggccgggugggccauggagcccggagggagccagccggcaggccguggggggcgccccuggggcccaggcugcaggcucauggcucauccccaggcucagggaagcuggccccugggagccagguaucuaggggcugcccagccagcaaggggcgggagccucuccugugucccggaacggggaggggcccggcgguccacucagggaggcugggcuccuuggaccucaccgcaagcaccaccagugccaaaacaagaagcgggggcggguuccagugcuccggggugauaugccgggggcggucaauccucccuuuccggccaggagcucugcaaggucccgugcccccuccccuaguccucaaggcugucccucccggcccacguagaggagccaggagcgucuggaguugggugaugggcuccaguggcugcgcagcccuggggcggccgggaggcuccuggcggcagucuccgcccgcucccgccccagaucuuuggaaacauucggggaggccugcgggggaugggaggagaagcucagcucucuggggaccaacccaccggcagccccagccccucuccugcgccuccccgugcgccccucuugcucucucccacccucucccgccccggcccccgcagggcgccuuccgccgcgcguggcugagccggggccgcgugcaccgcagccgaggccgccgggucugagcgcgugcgcgcagguggcgggggcgucccggccgggggcccgcggacucaccgccgggcggacgcagguaccagcagccuggccgagcuccccgaaccucgcgcgcucuggaccgcggcuggcccggagccucccaggcagccgcgcggcccc

SEQ ID NO: 192551 - RNA, 25523 nt, Homo sapiens
cuuucccggaggcuggcagaugcgcguggugcggcugcugcggcuccgggcggcucugacgcugcucggggaggucccccgccgcccggccucccggggugucccgggcucgcgcaggacgcagaagggcaguggagccagguaaggugucccagugagcaggcggcgagggcccugagcaccgggcuuggguagguccagaaaggggaguggcaggccucgugggacggccuugcccugcuuccgguuuucccaaaagucgggccaggagagcaugcgugccgcggugugaccggcccgccuccugcccgggguguacaggcccccccaugacgucgcccuugcuuccccaggcaccaccccaccaacccuauuuggggaaaucuccccucuuuuuuuccgcuugugguuucaucauuuguguagcugugccugggccucaacacuguaggguuugguuagguacuuuauaaaaagcuuauguugcugugcauggucuucugagacccgcucuuuccuggagucgguucccggguugucuccaggaccgauucugcauggcggcgggcgcucacugucauaucuacaucaccaggcacaagccgcauggauccaguggcccugguggccguugguggucccaggcgcuuuccuggaggacaugugagaagcccugccggcgcauacugggccugggguagccgcauggggaugggucucugcgcaugaaaugcuggaguuuccgaagagcuggagaguugacagccucacuggugcgugggagauccugcaggaguucccgccaggucucgcgguuuaucaucauucacuuagugcuuccagcguggcaugucucugugaccugguggugcgcuaucagcauacccauucacagcugagggccugcacagcugccuaaggccaugcugcagaaauguccugucugccugcaggagcuugggacccaaagagagccccagauggggcagggugucuugggaggagggaguucuggccugcgcuuggagcuggggcuggcugugggcccugcauugaggcacaucucuccgagggugcacaggcagguaggugcuuuccaaaaagugcugcugagcugcagucgcccagguggacagguggguuuggagcaaggucucuggcuuugaaagccagcuugugucugaugguggugcuuggugcccuggucucugcaggggugaaagaaugucacuacaaugugcagcccucaguugggcuugagcgcacacccaguggugcagcccugccuggccgcuggccggcagguuguuucaccucagugucuucaucugugaaaugagacuggugaugugacuacccuagaggcuuugugaaggacuuggcagucagggucacugucaguucuuuauuuuuauuuuuauuauuauuauuugagacaaaaucuugcccugucacccaggcuggagugcaguggugcaauuucaacucacugcaaccucugccuccuggguucaagugauucuccugcuucagccuccuugaguagcugggauuacaggcacccgccaccacgccuagcuaauuuuuguauuuuuaguagagacggggguuuugccauguuggccaggcgggucucgaacuccuggccucaagugauccgcccgccucggccucccaaagugcugguauuacaggcgugagucaccgcgccuggcuccuaucaguuaguuccgagauacacgugguuucccauuuucucacacccgacaugauccaucuucccuuauucucuaagaaggcguugucuagguuugcauccuucagggcacuuaguggugcagccuccuaccagccccacccuagacaugcuguaucagggcuggugggcucucuugaacuccuaaaaccuguaagaaaggugaggcuggucucaccugacguggaaaagcucugcagagucagcagaaccccccucuccccgagucucccuccagacuccagcugccugcagcaucugccagcuaguuuuuuuguacuuucgccauguuggccaggcuggccuugagcuccugagccugccucagccucccaaagugcugggaucacaggcgugagccaccacgcccggcuccacccuggaagguucuugagcccguuaacuucucccuacuuuaucagcuccgucucuacgucuucuaaccuugcccauucccuccucugcagaaacagccagaaaggcccuuucagaaaugucuguugcacaugcuuuccccucucagacccuucagagacuuccuguugcucugaggacacucaucccagccgaccaggcccaccaggcccccaacagcacuaccuggcuggggucacgugcaggucuccuggcucuggcaggugggggugugaucuggaaccuucuguccuugugcgucugggggaggcucagaaggugugcccaucucacucucccccauccugauggugcucccacccucucgccaaagccucucccacugaggccuuugcacuggccauccugggugcuggacuugcucuucccgcagcccugcugaccgagccugcccacugccugccagccacgccccaucucgcuccucuucucccaggcccaucucagaaucuagguucaguugagcccuucguauggguuuuggugaucugcauccgcaggacccagcgcagugcugguucagggcaggcuugggcuugccucaauggauagaugaugacuggccuggagaguuaggaugggcuguagccgccacgcuggcuguguccccccacccccuccaacacccccccaaucuccagagcugggcuugccagaagggggcgcccuggggagggggaccuuggcagggagcccuguggagccucacuguguuagugccuuacaaaaggagcccuucccugaaaaccccugaggcuucuggcuucagggccuccccucccugccccgccuccuccaccccgcccugccucuuccacccuuccacccugcccgauccucugugggcggcgguccugcgcccugcuguggugccucuccacuggcugcacugcuggacccccuuccacccagcuccucggaggcagggcucucucauaagcagccagguccuuuauuuagcaaaugaaauggucccauggagagguucccgaagauucuagaccggcucugaagggacccaucuggggagaggcccuagagccugggagaggcacguugccuuucccacuuagcugggcuugcccuuucccgcuuagcugggcuuggugggauccgugacucagcagcacacgggccucugcagguggggggcaugggcggguacacgggcauggggucugaggucagguaggguugccucccucugcaggccuuguuuuccucccccgugagguggaggccacacugcucaccugcuaggagccacagggaggagccacugugggagcggggaagaggcucaugcagggccuggcccaggagagugacacguccugucuccgucuuuaggugggagaaggagaagcacgaagacggggugaaguggagacagcuggagcacaagggcccguacuucgcacccccauacgagccccuucccgacggagugcguuucuucuaugaagguaaggaugcagggagcggcuccuccccagccugcgcuugguucccugggcgugggcucccagugggcaucuggcucgcucccucagccccccugcaggcuucuggcuaugagcgcucugugcccucuucuugcaggugaugcgugggggcugcugaccaacugacccaugcucagaggguggcaguucgggggcucccgucccugccuuuccugcugagccugcacuggcugugccuguuguguccaggacccucugggcaaagcggacccccccucccuccccccgcaccacuguguucccuguguguucugaguauacacaguacguacacugcguguacacacauggaucacagaacggucacuugaccccagcuugugauucucagcaagaagcggagcccgugguugacaugagcgcugagccacccucagaggcaggacccgggggcucuggggcagcagggcccacacaccccuccugcccuugagcccuccucucuaccccagggcccaggagcuuuggcuuggcucuugugcugcugauuuuagcugcuucagccuauuuucuucaucucugcuagaaggcauccuucuaagaaaagcaaaccucuucucccccagggcaggcccccacgccaugcugugccccucccaccagcccucccgugggcccccugccgagucacaugcacaccugaguuugcugagcuccuuugaugcaauguuuuguucaaagccuguuucuccaaagcgguacuggagcuuccacagggacagagguucuagcugugucugugggggcugcccacgggaggccaugggaccuuacugagcgucucgcgcugugccccuggccugguguagcggcugccucgccugccccacagcagcccugcaggaccucccuggccaggagggacauggcaggcgaggacugcuuaugcagggccaugguggacaguccggggagugguggugucgcguggggcccaguggggccgagccuccacagaggggcagugggagcugagccccucgggccugugcugcuggucucugggccucucguccucuguccugagaagcuaguuuggggaaggauugcugcuguuuaucagaaaugccuuccuccuucuuaccaaaugauuaugcauuuauuucucuaaaauuuucuuaugaaagcuuuucagacgugcaguugaaagaauuccuggugaacacccucguucccaccacgagccucucacucugcucgccugcucccagcucaccccccaucucuaaaccacacugaucuuagaauaaaaugcagggaauggugggacagaggccgcagaguuguaaaaggguacaccuaguuauucaguuuucugcuuugaagccuuaacuuuuauuuuacuugugaaauuuuguggaaauugguguguuuuaaaauuguacauguuccauuuucauguaauauaaauguaguagcaacguuaagugguaaaggaggagaaagcaguagcgccugaaaucuucugcagcuuucucacgacccgcucccagaucacuguggucgccaccuccacgcagguugauugucgugugucaugcagaacaugcuucugaacuuacagaagaaggccuagcuucuugcucuuggcauaguacgcacgaaagcguaguuuaaagcaaugaggucaugucagcuggaggccgagccucuggccgcucucucauacgaugugucuuccgaugccugcaggaaggccugugagauugagcguggcagcggaggaggucgccacuuuuuaugggaggauguuagaucaugaauacacaacaaaggagguuuuccggaagaacuucuucaaugacuggcgaaagguagguacccugggcggccgccacagcuguccuggaccuggcuggcuaggcgucugcgguucugcagugcugccucugaacgccccucgcaaguucucgguggccccugugugaccacucacaggugccgucauggcucuuugcagcuucgagcuccugggcucaagccauccuccugucucggccuccugaguagcugggaccauaggcggugccaguguguccagccuagugcaccucagaccuuucccuucccaggcaggcuguggauguggaggccgauuugugguccuuacuccauggaccgcugaaaggacaggggucuggcauauaagaaggagaguagaggaggccgcaugccauuucccagcccccaggaagacaugcuuggcgagaagcucuuuggaggggagggugcugccucaaggcuuuuuccuugcucauuuucaaggugacugcccuucgcccauggccugacugauuuuaugugugugccgcggauucugugcccuccgggguuucugucugccccacaccugcgaggcucgccccugacugcuugucccgcagcaucuuccuggcucuggccgggucgcguuuccucuguuccgugacucaugcuaguccauuucccuauucguggguguuugauuaauuccuguuuuaggccuuugcauguguaaagcugccaugaacauucccacgugggugagggcacauaugugugaguugccucugacaggacuuggggugaaauugcugggucacguguguccagcuuacuagcaacaccaggcugaacuguccacacgccugccgcgggugcgaggcaccuuucuagugggcacaaaaugacaccucgccgugggugugguuugcguuucccuaaugacaagugauauuaagcaucuuuugguguacugacgugucauuucaguauuuucuuucgugaacuuuugucuauuuaaaaaacugaguugcuugcguauuccucgcucauuuaucggaguuuuaaaaacgcauccugggugcagguucuuugccagacgcacaugcugugaaugucaucucccagacuuugccuuuucacuucucagugaggucuccaaacagaaaacuguaacuuaguuaugccguuuaucaaucugucuuuuauggugaguacuuuuguguccuguuuuaaguccauuaucagaaauaugauuugcaaaaaucuuucaugguguuuguaguuucuauuugcguucucuuaacaaugucuuuggaaggucaggaguuuggaauacugaugaggucccacguuucauguuuugucacagguuugcuuuuguuguuuugucuaagaaaucugcugaauucggcagcacagagauuuccuccuauguuuuuccuagaaguuuugguuuuagguuuccauugaggucagcuugguuuagguggaacucugaguuaauuuugguuauagugugggguagaggccgaggcucguguguugcaugugggugucugacugccccgagccagcugcuggagccugugcuuccuuguccccugugcaggcuccgcuucuggacccucuucuuuggccugaugccaccccucugccuuucacgacagcuuugugagguggcaccagcugcccggcauccucauucucccucuggucagcacuucuuccagucacuagcagagcuaggaagggaggcagugucacaaagcagcagaacaggaguggguggcacauccggcggccccgggagacacagggacggacccugagcccgugguuguggccgagcagggcuccauccuggcacagauggugucguaccugagcuccucggaagaggcggaucauccccaucccacagcgagacacguuugacagcagcuccugaggucucacaggccuaaguggccgagccuggacugggaccgugagcuggugcccgcaagccugggcuuuuguccaugggcugugcagaguuuuuguuguguaggaaacgaaaggagaaacaguugccugugaucugcggcucucccucaggucagugucuccuguucccgcguccuggcuuuuccugggcacuaguuuucgugugagugugaucagugugccuguaauguuuuccccacuuagcauuuuaucccgcuuagucuccacacggguagaucaucgucaaacuguuuucugcugugcuuuccaaaauucaccuugaaacugaauccccagcaccacaggacagagggagggccuuuaggagcugauugggcugugaggacuccaccuugcugcagcccuuaggauuaauuuagggccuuagggcagggcuggguggaauuagcugggccccuucuguccuucuguccccuccacugugugaggacagccuucagggcauccucucagaagcagggacugggcccuccauagacgucaaaugcugggacccugaucccagccuuccagcccccagagcugugacuaugauuuacaacugaccaguccccgguauuuuguggcagcagcacguauggacugagacuuugcccucgcgaaucccgucacguucaccagaugagcucccgaccauguauccugcucuguccggucaugacguuucugcaguugcccuuagugcggucgucauccggguuuucauacuggagaguuuauuuaggauggaucucaaaguggaauuauugggugcaaagguuuuagccaguuuuacuacugacuuguugugaaguugcuuuuggagaacugugcccuccgcugccccacccaacuccaugccugcaauaacagaaccagcucuaucuguggggucugcggggagaggcucuauuuacggggccgcaggaccgugcgcagguucugccuauugcacacacgccuccgucggacauggcgagagcgcguuucuguccgucagacauggcgagagcgcucugcaugucuguccuucagacauggugagagcgcgugucugugguuuuugcaggaaauggcgguggaagagagggaagucaucaagagccuggacaagugugacuucacggagauccacagauacuuuguggacaaggccgcagcccggaaaguccugagcagggaggagaagcagguugggcugccucgagcguugugugaccugaaguggccccugggaacgagaggccggccuggcccaaagacugagaaaggccuguggccuuagagaagccccuucucacaaagcugcucuuuucucgucagccuuagcgccccugcaugugcuuaagugucguuccgcuuccccagagcacauuugagaguaaacccgguuugaaauggauaauuuaccaucauugaucaaggguggguucccagacgggccgugggcugagggcggggcuugugcaggccagucggcuucuugcuguucugugccaugcgucucccuacaucuaacaggaaccugccgugcugugaucuccauguggccuucucagggauucccuuagcccuccuccuccauggcgggcagccacgcucccuccaccuggcuuuacugcuuaggccuaaaacagccgaagucugugcaggggccggggaguccaggccauggggugguuaggccauggcucucggugcccccugcaagcccaccugcacuguccccugccccugcaaccuccauggauugugaagggcuuugaggguccagcugaguuagccagacagagcaggguggucccggguuagcaacaacggacugaggccuguucucuucucuucacugcuaauguccacugacuguuuuauuaacucagaagcuaaaagaagaggcagaaaaacuucagcaagaguucggcuacuguauuuuagauggucaccaagaaaaaauaggcaacuucaagauugagccgccuggcuuguuccguggccguggcgaccaucccaagauggggaugcugaagagaaggaucacgccagaggaugugguuaucaacugcagcaggugcguggccgggcgggcagcaggcgggcacuggacccccgccacccgggugaggcuggcuuuucuucaccuccugggagagggaggcacaccgagaaacaugugguuggugacccccacaccauuccuguggagcucagccuguaggcguggccgggcaagggcggccuucccagggugcuucccacggggucggaaguccucgccuugcuauggcugagacuuucucccgccaaggacaccuccaugugguuuucauaucccacaccaucuggauggcccaguagcauuagguguuuugaacuuauuggagggacauuccaagugguggagaggggacugcugggccacauguuguacugugugaccacaggguggaguagggacccugccugcaggacccccaguggccaggcuguguggggcagggcacucgucgucccaguuggugcugagaggucugugcagagcggugccuugcuuggguggccgcccagccuccuggugcacuguggccuuccugugugugcagaggguagauugaguggcugcuuuugucugagcugccaggcaggccaccucugaugccagacucggucaggagccaugccaccaccauagccaccacgugggacgguugaccagagcagcuccuuuugcuugcauuccagagaauaaggucuccaaguuauguuugggucguuguucugcugcagggacucgaagauccccgagccgccggcggggcaccaguggaaggaggugcgcuccgauaacaccgucacguggcuggcagcuuggaccgagagcguucagaacuccaucaaguacaucaugcugaacccuugcucgaagcugaaggugagcgcagggcuuggcaggguguuuccuccccaggaggucccccugaggacgccggcagggagguguguaagccgggcaccggcagaggcuucugagaugggcugggagucggccagcccgugcugaggucaugcugugccagcaggcacaagccccaaagccaggagugggcaugggugcucacugccggcaucacccagcuagauuugcugccccagccccugaccacggcaccacugaguggagaagcacgagguuugggggagggagaguugacagccuccuccguuauuuaacaggaaugugaauguuuucuuuccuguuauuuucuucguuuagggggagacagcuuggcagaaguuugaaacagcucgacgccugcggggauuuguggacgagauccgcucccaguaccgggcugacuggaagucucgggaaaugaagacgagacagcgggcgguggcccuguauuucaucgauaagguaugcggccuucucgcuuccuggcggcucuucauccugguucuccuggcgaggacucccaguuggauggugcaguguggcgacgugggccugugugugggguggaaccucauucugauggggggggugugugcaugugcacacgugugugggugugaacauguguguagggugugcaugugcauuguguggugugugugcacuugugcguguggugugccuguguguggcaugucuguguggggcgugcauguguguggcgugcauguguguguggcgugcauguguguggugugccuguguguguggcgugcauguguguggcgugcguguguggugagcauguguguggcgugcguguggcgugcguguguggcgugccuguguguguggcgugcguguguguguggcgugccuguguguguggcgugcauguguguggcgugcguguguggugagcauguguguggcgugcauguguguguggcgugccuguguggcgugcauguguguggcgugcguguguggugagcauguguguggcgugcguguggcgugcguguguggcgugccuguguguguggcgugcguguguggcgugccuguguguguggcaugcaucuguguggcgugccuguggguguggcgugcauguguguggcgugcauguguguggcgugcguguggugagcauguguguggcgugcguguguggcgugcguguguggcgugcauguguguggcgugccuguguguguggcgugccuguguguggcgugccuguguggcgugccuguguguggcaugcguguguggcgugccuguguguguggcgugccuguguggcgugccuguguguggugugccuguguguguggcgugcauguguggcgugcguguuuggcaugccuguguguggcgugcguguguggugugccuguguguggcgugccuguguggcgugcaugugugugugugcauguguguggcgugccuguguguggcgugcguguguggcgugcgugcguguguggcgugcguguguggcguguguggcgugccuguguguggcgugcguguguggcgugcguguguggcgugcguguggcgugcguguguugcgugcguguggcgugcguguguguugcgugcguguguggugugcguguguggcgugccuguguguggcaugcaugugugugugcauguguguggcgugccuguguguggcgugcguguguggcgugcgugcguguguggcguguguggcgugccuguguguggcgugcguguggcgugcguguggcgugcguguguggcgugcguguguggcgugcguguguggugugcguguggcgugugugugugacgugccuguguggcaugcauguguguggccugcauguguguggcgugcauguguguggcgugucuguguguggcgugcguguguguggcgugcaucuuuggcgugccuguuguguggcgugccuguguguguggcgugcguguggcgugccuguguggcgugccuguguggcaugccuguguguggcgugcguguggugugcauguguguggcgugcguguguggugagcauguguguggcgugcguguguggcgugccuguguguguggcgugcguguguggcgugccuguguguguggcaugcaucuguauggcgugccuguggguguggcgugcauguguguggcgugcauguguguggcguguguguguggcgugcguguguggcaugcauguguguggcgugccuguguguggcgugccuguguguguggcgugccuguguggcgugcguguggcaugcguguguggcgugcguguggcgugccuguguggcgugccuguguguguggcgugcauguguggcgugcguguuuggcaugccuguguguggcgugcguguguggcgugccuguguguguggcaugcaucuguauggcgugccuguggguguggcgugcauguguguggcgugcauguguguggcgugcguguggugagcauguguguggcgugcguguguggcgugcguguguggcgugcauguguguggcgugccuguguguguggcgugccuguguguggcgugcguguggugugcguguggcaugcguguguggcgugcguguggcguguguguguagcgugcguguguguguagcgugcguguguggcgugcguguguggcgugcguguguguggcgugccuguguuuguggcgugcguguguggcguaccuguguguggcgugcguguguggcaugugugcguggcgugcgugcguggcgugcguguguggcgugcguguguguggcgugccuguguguggcgugccuguguguggcgugcguguggcgugcgugcguguggcgugcgugcguguggcgugccuguguggcgugcguguguguggcgugcguguguggcgugcguguguguggcgugcguguguggagugcguguguguggcgugcguguguggcgugcguguggcgugcguguguggcgugcguguguguggcgugcguguguguggcgugcgugugcacgcaccacccacuuugaccauuccccaccaacuagcuggcacugagagcaggaaaugagaaggaggacggugaggcggccgacaccgugggcugcuguucccuccgcguggagcacguccagcugcacccggaggccgauggcugccaacacgugguggaauuugacuuccuggggaaggacugcauccgcuacuacaacagagugccgguggagaagccggugagugcccucgcgccagcugcccccgcuaugugacacguauuugcucuggaugucugggggcgugccggagcugccguggggucuguggcccguuugccacguccugccugcugggugaggccugcugugccggggcugaucgggguaaaggugaaggagaggcugugcaccaugguagacccaaggguucacaagggagcuggucgggggcugaaaagggcacgugugucacgccagcuucgucuccugccccccggccggagcaucucccagggcugcuggaggaaggcacugcagacccagugguuuaacagacguuuauugucgcucagcccugggggccagagucugagucaaggugcuggcagagccacaucccgcccacacucggggaggauccuccugccuucccagcaucugguggggccacggauccugcguguccuuggccugaggcugccucaucccagucucugccuccguugucacauggccaucuucucccugcaucucugccucugcguguucucacaaggacgcugucguauuggaguuagggcccagcccacucuuucuaugacuucaucuuaucagucucuaaagacccuguuuuuaaauaaggucacguucuggccaggcaugguggugcacuccuguaaucucagugcuucgggaggcugaggugggaggaucacuugagcccaggaguuugagaccacuugggcaacauaaugagacccugucucugaaauaauaauuuaaaaaaacagccgggcaagguggcucacgccuguaaucccagcacuuugggaggccaaggcggguggaucacgaggucaggagaucgagaccauccuggcuaacauggugaaaccccgucucuacuaaaaauacaaaaaaaauuagccgggcaucguggcgagcgccuauagucccagcuacuugagaggcugaggcaggagaauggcgugaacccaggaggcggagcuugcagugagccaagauggcaccacugcacuccugccugggugacaaaaugagacccugucuucuuuaaauuuuuuuucuuuuuucaagacggugucucgcacuguugcucaggcuggaguacaguggugagaucuuggcugacugcgaccuccgccuccuggguucaagcgauucuccugccucagccucccgaguagcugggauuacaggugccugccaccaagcucagcugauuuuuguauucuuaguagagacaggguuucaccauguuggccaggcugguguugaacucuugaccucgugaucuaccugccucagccuuccagagugcuggcauuacaggcaugagccacuguggcuggcugagaccguucuaaaaaaaaaaaaagguuacauucugagguucuggugaggauaugaauuucgggaacacuuuucaccccaguacaccugggaggggcugcccucuuuccucugcugcagggacuaguggcugcccaccacccccacagccccuagcuccaccagcauagaugcccagagggaugaguguggucgggaagggcuggguagaucucuggucuccagacuggcuugaaggaagacuggaaccuggggagcauccucaccuuugaauggcuguccugaagagucacgguguccccugucugggugggcgccacgucgcagugacguuggacagauccacgcacgaacucccugcaccucaaaagcacaaaugugacucaggcugggcgcaaggcccacaccuguaguccagacaccuugggagggcuaggugggaggguugcuggagcccaggaguuggaggcggcagugagcuaugauugugccacugcacuccagcccaagugacagagccagaccuagucucuaaaaauuaaaaaaaaaaauaaaaaaauuaaugugacccaaccgugggauggaguggagccguugaaaaacagaaauggaaguuuggggacagguguugagggcagcagagaaacaggagucccuggcagggcccggccucaggcagucuggucgggaagucauuccuaaggaaugaauuaaucggagguaggagacagaagccaacacacgaaaggaagaggcaaggaggugcucaccacagugccccugccguggugaagcaucggcuguggugcaggccuggauggggaguugcacucuguccagacagaggacuagccagccauuugcagugcuguccaggggagcacucgguaacggaaugcaugugauguagagaaaaaggcgggacauaaagccucgucaagaucagcggugugaaaccaaacguguagaggaagaugagggaagaagccagaagucgggagcugugggcuggggcuucccgccaugucccggugccuguggguuuguagaaugggguucaucagccauggugccaggcugaugagggggccaguugggggugcggggccuccugcccgugucuggugagggagggcugccaugcuggugcuggagagagcaacacagaggccacagcaaccuccgcccuggagccgaugcccagcgcucagggagggugccugccacuuguaggaggaccagcaggugaaacugaggggagggcaggcaugggugcaggugcaggcuggcguuuccucggagcaggguuggucuuuccagaagggaauuaauguccucuccccaaagggacugguggagggagguuggacacaggaaccccgaaggcccugagguccugugaugucagaugagugucucacauuacaagggugugggcucaccugguggaaauccggcauugauggaagaaggagccggggacucugggccaccugccgcggucacccaggggguuugcagggcaggagucacgcccaccuccugagcacgcugccugugcgugugguagcggugacugccacacuggagggugggggccgugucacgggaggaugccgacaggugacggugaugcugcucgggccaccuuccucagggaagccucccgugggcucccaggcucugcguagacgcccuucagguccucacuggauucggguuuuuucuguccucugaaauuccuucuuucuccuucagguguacaagaacuuacagcucuuuauggagaacaaggacccccgggacgaccucuucgacaggcugaccguaagccggcucguguuuccucagcagugggcggcggcaggacccagugagagggcgugggcgcugagucuggcccaggguuuuguccugacccaacggcugacauguccuuuccuucccgcgggaggcugggacggccccgcaaaaccacguaauuauagagaccauuuuccuccccagacgaccagccugaacaagcaccuccaggagcugauggacgggcugacggccaagguguuccggaccuacaacgccuccaucacucugcaggagcagcugcgggcccugacgcgcggugagccugccccacacccacacucagcgcggggggagcacggccccugccccagaccgggcuccccggcuggcccuuguugagugagccucgggguggggccgcuucuuugggaaaugggcugagguugugggcuggcugcuuggcagccuagguggccagaguccuggggaggaggagggagguucuggcucucgggaccccaggcaucccagccacguucucccugcggggcggccccuacugcugagcccuacucaggccccauggccuggugguguuccucagcuccuccucaggguucuuucuugaaggcccaggaggccucugcacuuuccagugguucugucccucccacccucagcugucugagcaccccgaccucugggccucuguccacggcccugucucagcuucagggcccucugcucuuuguccccugccaucaaccuggggaugcugucuaagcuuggcgagggccucuccucccucugucccuggcgcugccccugcuccgugauguccgggcugcucugugauguccgggcagauuggacgcacagacuguccagagggugccucccaccccggcgcccaccgcacuccccaagcagggcuuccuggaggaggcgccgaggcugggugcucaggggcgcugacgcucggcauguguuucgcgugcacccgugggccucagaggccggugcugugcugcccuggggacaaccuuggagcuggggcagcacuggggcugugggaugcggaggagcuagcuggcauccaggugagagccccaggagaggagacgcccccuccacugagggaggcagaagauucugggugagggcauaggggccgaggccgggccugggagaggaaaugaaggugcugggcccacuguggacgugcuuccagagcugggugggccaugcaggaugggcgugaaggaguggccgcuccaguaggugccuuggggccagugcuuacguucucugaaccucauucuugacuggaaaauggagacaacgugguaccuugaggggaugucgccaggggaagccgggugcuggggacuugugacaggcagggacccacagacucgccaggggaagccaggugcuggggacuugugacaggcagggacccacagacucgccaggggaagccgggugcuggggacuugugacaggcagggacccacagacucgccaggggaagccgggugcuggggacuugugacaggcagggacccacagacucgccaggggaagccgggugcuggggacuugugacaggcagacucgcccguccaggcggcugggccuccuccuugccauggggccugggaaggcccggguggugcuaccugugcuguggccccacgugaagccuuguugcugugguuaaagacgcugggcccugcucucgaggccaccuuggagggucacugacccuuggcccucacucuccccaucccagugggugccugugugaguggaaggggcugcgcuguguggcgcguuaaggccggcucagggcagacagggaggguggccggccccgugggugcugccucugacagcccgugccucucagccgaggacagcauagcagcuaagaucuuauccuacaaccgagccaaccgagucguggccauucucugcaaccaucagcgagcaacccccaguacguucgagaagucgaugcagaaucuccagacgaagguagcagcucccaggagagcccccagcccagcccucaagggaccccucccccuccccagagccucggcacaggccugggagccagcugcggugggcacguaggguguggaagggugugggcacaggggcuggugcgggauggggaggggcagcccugucuggacccuuuuccugcagauccaggcaaagaaggagcagguggcugaggccagggcagagcugaggagggcgagggcugagcacaaagcccaaggggauggcaaguccaggaggugaguacccgugcccucagacgccuucucccggggcccugucccaacccguaggguccagccccacagggucggugggagacgacccuuguugucuccuugugcggagacgagagauuguagaaauaaagacacaagacaaagagauaaaagaaaggacagcugggcccgggggaccacuaccaccaagacgcggagacugguaguggccccgaaugucuggcugcgcuguuauuuauuguauacaaagcaaaaggggcaggguaaagagugugagucaucuccagugauaggugagaucacgugggucacauguccacuggacacggggcccuucccuguuuggcagccgaggcagagagagagagaacaguuuacgccauuauuucugcauaucagagacuuuuaguacuuucacuaauuuucuacugcuaucuagaaggcagagccagguguacaggauggaacaugaaggcagacuaggagcaugaccacugaagcacagcaucacagggagacgguuaggccuccggauaacugcgggcgagccugacugaugucaggcccuccacaagagguggaggaguagagucuucucuaaacuccccuggggaaagggagacucccuuucccggucugcuaaguggcagguguuuuuccuugacacugaugcuaccgcuagaccaugguuggccuggcaauaggcaucuucccagacgcuggcguuaccgcuagaccaaggagcccucugguggcccugucugggcauaacagaaggcucgcacucuugucuucugguuacuccucacuauguccccucauaucucuguauggccugguuuuuccuaggcuaugauuguagagcgaggauuauuauaauauuggaaaaaagaguaauugcuaccaacuaaugauuaaugauauucauauauaaucauaucuaugaucuauauauaguauaacuauucuuauguauuuuauuauacuggaacagcucgugcccucagucucuugccucagcaccuagguagcugccgcccacaccaacccagauguggcagcuucagacgcgccuucccauggccaguuuuguuuuccucuucaauuguuauuuugugauuuuuuuuuuuuuuuuuuugagauggagucucugucgccaggcuggagugcgcuggcgcggucucagcucacugcaaccuccgccucccggguucaagugauucuccugccucagccucccgaguagcugggguuacaggugcgcgccaccacgcccggcucauuuauuuauuuaguagaaacgggguuucuccauguuggccaggcuggucaaacuccuggccucaagugauccuccugccuuggcaucucaaagugcugggauuacaggcaugagccacugcaccuggccaacuuugugauuuuuaaaaauacaaacuauaugccuuguggacaagagugggacacauggagccgugggaggaggagacccuggccgccaaggagguuugugauugucauuguggggucaggaaaugagaagaaggugccagacucuucuccagggcggcggcaccauccccuccccaccagcagugugugagggcuccgauuccucuguccaggcgccacuguagggucaguuuuccaugugucgauuagagcccagugggugugaaggagcgucuggccgugggugcucuuugcaggugcuuguugcccacuucuguaucgucucuggagaaugacugcucagguccucuguccauuuuccagucggguuguuguuuuauuauugacuuguaagagcucgucgauguuucgcccacucuuggguugucuuuguucuuucuuuuuuuuuuuuuuccuuuggagacagagcauugcucugucgccaaggcuggagugcaauggcaugaucucggcucacugcaaucucugccuccagguuucaagcaauucuccugccucagccuccugaguagcugggauuacaggcacccgccaccaugcccggcuaauuuuuuuguauuuuaguagagacgggguuucaccauguugcccaggcuggucuugaacuccugagcucaggcaaucugccugucucggccucccaaagugcugggauuacaggugugagucacuacucccagcccuauuuuuuuuuuuuuuuuuuggugauggagucuugcucugucacccaggcuagagugcaguggcgugaucuuggcuuacugcaaccucugccuccuggguucaagcgauucuccugccucagccucccgaguagcugagacuacagacacacaccacuauaccuggcuaauuuuuguauuuuaguacagaugggguuucaccaugucggucaggcuggucuugaacuccugaccucgggugauccacccaccucggccucccaaagugcugggauuacaggugugagcaacugcgcccggccacaucuuucuucuuucuuguugguguccugugacacauuuaagauuuggaugagucagcgugcugagaaggcuuugccuaacccaaggccaugaagauagauuucucuguuuucuccuaagagguuuauugguuuacucuuacauuuaggucauugguucugaguuaauuuuuguguguggucugagggaagggcccagggucauucucuugcauguggacagccagaugucucagcauccuagcucaccauagucucaacuugcugggcucaagcaauccucccgccucagccuccugaguagcugggaccacaggugccaacggccacaacuggcuaauuuuuacacuaagaaaauuuuuguauguugcccaagcuacucuugaacuccuggcuuuaagcaauccugccuuggccucccagagcucugagauuaaaaguaugagccaacaugccuggcccuuaggacuguaucuauaaaggccauauuguaugcaaacagagauaguuuuacuuuuucuuuuccaaucauaugccuuuuauuucauauuuuugcauuauggaccuggcaggaaucuccaguacacuggacaugagugggcagccuugccuuguuccugauacugggggcaaaacucucaugcuuuuaucauggaauaugauguuaacuguagguuuuucacagaagcuguuuguuaaguuaacaaaauuuacuucuauuccuaguuuguugagguucuuuuuuuuuuaucaugaagagcauuggauuuugucaaaugauuuucugcaccuguugagaucuuguuuuugucccuuccuuauauugauaggauguauuauacuaauugaucagauaugaaaccauccuugcauuccugggauaaauccuacuugagcaauuguguaaucauuuuugucuauugcuggauucaguuugcugauauuuuguugagguuuuugcaucuguauucaugagcauguuagucuauaguuuucuuaugaugucauugauuuugguaucaagguaauacugguaacgaguugaauaauauuuaauauaauaucuaauauuucaugaaaguuuaugaaaaauuggugccuuuuuaaagagagagucuugcuguguugcucaggcuggucuugaacuccugggcucaagcaguccuccgaacucagccuccugaauagcugagacuauaggcuugcacugcacugccuggcuagggucaguuuguuaaaugaauucaccagugaaaccaucuaggccugggcuuuucuuugggagacguuuaaaguuacugauauaaucacuuguuauaguucuauucauauuuucuauacuuugugaguugguucugguaguuuguaucuuucugggaauuuguuuagucuagggugucuaacuggcuggugcccaguuauucauaguauucccauauuaucuuuuuuauuucuuuagugauguucccucuuucauucauuccucauuauuguggcugcgguucuuuuuuuuuuuuuuuugacacagagucucucacucuguugcccaggcuggagugcaguggcaugaucucagcucaccacaaccucugccucccggguucaaacuauuuuccugccucagccuccugaguagcugggauuacaggugcacggcaccaugccuggcuaauuuuuguauuuuuaguagagacggaguuucaccauguuagccaggauggucucaaucuccugaccucgugauccacccgccucggccucccacagugcugggauuacaggcgugagccacugcuccuggccuggcugugguucuuaaaggguaaaaguuuucucuucaggaugagcauccggagaugcaggggucuguuuuuaaugguggcgugugcgaaggaaaugucaauuggaacaaaggguauucagugaaaaauaaggcugugacucaccccugaccuccuguccccagaggcagcugcuguaaaauuucuuuagcauuuccuggccaggcaagguugcucaugccuguaaucccaacacucugggcagccgaggcaggcagaucacuugagguugggaguuugagaccaucauggccaacauggugaaacccugucucugcuaaaaauacaaaaaaaaaaaaaaaaaaaaaaaucaugugcgugguggcacaugccuguagucccagcuacucaggaggcaggagauucacuugaacccgggaggcagagguuccagugagcugagaucaugcaacugcacuccagccugggugacaaagcaagacuccgucucaaaaaaaaaaaaaaaaagccaagagaaauuucuuaagcauuuccagaaggacugugugugcgugcuggcucuuccucuguuuucccuccuuguuuucacauaaauagcagccccucaugugucccucggccccuggggauguggcucaugcugggaaggcacuuccccggaccuaugcuucuggcccggcgggcugccccauucucagccguauuuuugcaggcgcaaguuugucuuuccacgcacauucgaguguuuguggcacaaauuccuagaagaguuggggucagagguugcaugugugggugauguucuggcauuggagggugcaaguaauguggaaagggcaucucugugcugaaauuugcuuucccuaaggaggcaggaaggagggcuuagcggcuucccggagguuaaaggacauuuguguuugcuuucucgggccuggucucgcugcccucauccuguuugggccggccucagucuguugugucgagcaucucacccuccugcgagucagguccugacgggcugcucacccuccgcccacggcccuccucuguaucugacuuggcagcugggguggggcugagcuuccaccuuugaucccggcuggucuuuugcugugauggaugacugaugacaaugacagggacagggcugcacugggagggaaggcggcagggccagagaagugcaggucuccucagguggcgcuaguccagcgcggggccucgcggccuccucuucucuugccaguguccuggagaagaagaggcggcuccuggagaagcugcaggagcagcuggcgcagcugagugugcaggccacggacaaggaggagaacaagcagguggcccugggcacguccaagcucaacuaccuggaccccaggaucagcauugccuggugcgugugccuggggucucaguucccaccuguggccuauggggggccuggguuuuccaggaggccucuguucagucccagcauugcccuugucccguguccccuggggucagcacaggcccucccugugacagggacccaugaugcugaguccugugucaucagcucucccugcccugaacguucggauggacagggugaagugggggugcugacaguggccugggacucggaggcaucaggagggccuguggagcucagccugcccacagggagugggagguggcugagcgcccugcucgguggacaccuaggccacagcagguugucuuugacaccucgcugaugcuccaggguggcggcaugcguggggugggguuggccuagaggagcaggucccagcuacaccaggcggcucuggugucucugcugcauggaggacgcucgcccuugccgagcacccugaccuggccuucaaggugggugaguugccugcuugccugggcugaugcugccucccgcaggugcaagcgguucagggugccaguggagaagaucuacagcaaaacacagcgggagagguucgccugggcucucgccauggcaggagaagacuuugaauucuaacgacgagccguguugaaacuucuuuuguauguguguguguuuuuuucacuauuaaagcaguacuggggaauuuuguacaauaa

SEQ ID NO: 192552 - RNA, 17528 nt, Homo sapiens
agcuuggaugagucuaaaaacaugccaaagugagacaucagacgcaaaagaacacauaguaaaugaauccauuuguaugaggcucuaaaccaagcaacacuaaucuaugaggauagaaagugguuaucuggggcuggagugggcuuaacuaggaaaaggcaaaagggaacuucuuugggugacagaaacguuuuugguucuggcgguggugguuacacaggugguggugguuacacagguguauagauuuuucaaaaccuuguacacuuaaauaggcguuuuacuauaugaaaauugaaucucaauaaaguugauuaaaauggucugguaaaaucuacauuugaaacaucucuaguaaugcugauuuuccagaaaauguagaucucuuuuuugaauuauuuguccugagacguucaggguugguaguauuuaagaacucaaaauauggccucaugagaaaaaaauuauaucguuacaaaacuggacuuugggguucauguccagaugaaauucagagguaaagacuaacaguuuggcgaggcggcuguccacuguccauuuaccucgccugcuuucgaacaguccuagccaaaaagccaucugucauggcuccauguuucugcagauuccucuccuggacccuauuuucuucuucagcugcucucuacugaucucuggcccagcugaaaugucaccucuucuguaaggccuucccagcucugugccacagcaggcacccccucaccugugcuccuucacaccugagggcacauacuuaacucacccuacugugaucuccgucuuccccacuacacgguggaugacuucaggguaguggguugcucaucuguuuucccaacauugaggacuauuccuuauagauaucaauacauuuugaaaugacacaaugagccagagagcauggaaaaugacaagagcucaguucaaccucagaacugcuacaacagaagaguuacguagcgcauugagacugugccuuucgagugagacagaaagauacagacaaguaaguaaagaccuucucuugagaccugccuccuccuguccccacuguuccagcugagccaggugucaaugcccuccagaucaaguagacaguucugcaugagcuguaagguggcacacaggagggcguggaugugcacaggauauugccugcaacuucuaaguaggagcagcagacaguagcagggcugagaagauacuucuaacagaaucguagauuauacugauacaaaaugaacaaacaacaaaaaaaacagccaacagcugaaaauuuuuagaauggcaguauagaaaggacaaagcaagagagaugccaauuacacauagauuuagggguguauuuuuuauugcccugugcuagacaguggacacauggaaaucaaucagauaugaucacuguccucaggaacccaacagcauagugacagagauagucuaucacaucauucugacauaugcaaguaaauauaguaauagcaguaaucacugagccacagaaguguggagagugcugccaacuaagcuugagggaaacacccauugacaugaugccugaggcuugucuugaaccaugauucagaguuaauuagcugagaagagacccuucaacaagaacaaaggcgagagagguaggaagccacguggagcacagggaagaugaagcagucgguguugcugcagcauuaaccguguggcaggaagucaggcagugggaggcagggcuccaggacgcaggaggccuuagggcacacgaugggaggccuggaguuccuccucaggacaacagggaaauggcucgggguucauacacgaguuaccuuucuucaacuuaacacaucaaaauguccuagguaacauucuccuaaaucguaagauuagauacacaguugugcuguaauaagggauuuaagucaaggauggacucugcuuaacuggggaugaaacuucuuaaaaaccuuuucuugagaccugucuucucccugccccuacuguuccagcucagagucaggugucaagcccugugacucuccugaggacagugcucacagcugaggagaagggcugagccgaguagggcugcacaguggcagguggcacccacugcaaaagcagccccauccaugacucacaaaauucugacauguccaaaucuuagaaaccacaugaauccuaauuccacgcauuuccaaacaucacucacugggcgggaaaguaauuauuuuauaaguuaccuguguguucccccuuaucuacagaccucucacccaaauguaugggggccuuacucaaggagagucccucuuggugaacccuuugauuauuuuuaacguuuguaguugaguuaaaaucucucccauacugacuacauucauagagcuucucuucaguaugaauuuucugguguugaaggaaguuugaccucugaauaaagccuuucccacaauaacugcacacauagggcuuuucuccagugugaauaaucuggugcagaagcagcuuggagcucuggaugaaggcuuucccacagucuuuacauucgaagggccuguccccagaguggaucuucuggugcucagugagaugggcuuucuggagaaacgcuuucccacauuccuuacauucauacacucucucuccaguguggauuuucuggugucgaauaagguaugaacucagaaagaaagcuuucccacacucguuacauucauagaguuucucuccagugugaauucucugaugcugggugaaguuugacgucuggcugaagcgcuucccacacucauugcauacguaaggccucuccccaguauggauccucugaugcugaaugagcuuugaacuccgaauaaaggcuuucccacacucauugcauucaaagggucucucuccggugugaauucucugguguucaauaaggucugagcgaugacggaaugccuucccacauucuuugcauucauacuguuucacuucuguguggaucugauaauggcgaaugaggcucgagcuccuuaugaaggauuucccacauucauugcacucauagggccuuucucccgugugaauccucugauggcgaauaaguaaggagcucugacugaagccuuucccacacucuuugcauucaaaaggucucucucuggugugaacucucuggugccuaaucaggucugaacugugacaaaacgccuucccacacugcgcacauuugaagggcuuuucuccugaaugaacgcgcugaugcucaaugagaccugaauagugaaugaagucuuucccacacacauuacagacguagagucucucuccagugugaauucucugaugcuccauaaggugugagcucuggccaaagccuuucccacacugaucgcacguguaagguuucuccccagcaugcgaaauccgaugccuaacuagguccgaauuaaacgugaagguuuugccacagauauugcaaggauuggcuucccccucuaugagcucucucugaagcagaagaaggucugaauucagaauaugguuucuuccugacuuggugcacacuugagcugucucuccugucuggaucuuccaaugggucacugucaccugcuugcagccccuguccugagagggggaacuccccaggcucugaccuucuggauuucccaagagcuccccuaaucugggcucguggacuuccucagacucgggagaggggagcuccaucaccgugagucugucugacgucguccuaugugaguuuucauccucagaaauccaggcuucagucaccuucuucucaccaguuccuacauuagaaucugaaacaaaagacaacaaaaucaucuuuccccuuacuuaacagauggggaucuccugaaucagggcaggauaaaauccauauccaagagguggaaaguguuuccucugccccucauccugacccaacaugcugcuacccacagcucuggucucacacccaagccugucccacauaagauggcuucuuuguggcuccacuuuuaacauccaacaccaggacagacuggucuguggugcacaacacuccucugaccauuagugaauccuggaugaguugcagagggguggggauaugcuugaacuccauuaaaaaaccgagacagauacuuuaaacaaacguauaaacacaucagcccugccaccucuucacuguuccucauuccuuccuucauguccucuucuccccuccauaccuagcuuagagcccaugaucuggggcacuguguucacuguaaguugcaugagaaucacccuccugcacagaaucgggcuccccugcccuuuccucccuccaugauacuuggaugggaaagcccaaccuuugguuaaaacgagguuguguuuugauuugugccugcacucuugcuguuuuuuuguuuguuuuuguuuuuuuuuuuuuuagauggagucucgcucugucacccaggcuggagugcaguggugcaaucucggcucacugcaaguucugccuccuggguucacaccauucuccugccucagccucccaagcagcugggacuacaggcgcccgccaccacgcccggcuaauuuuuuuguauuuuuaguagagacgggguuuuaccguguuagccaggauggucucgaucuccugaccucgugaucugcccgccucggccucccaaacugcugggauuacagacgugagccaccacauccagccagcugacugagcucuuuaaauucagagcugcuugccuaauggggccugagagcugccagcaacuccuacccuucccacuccccacaggaccuuccacuucuccuaucuucuuacaaacucagcacucccuccucccuccccacuggugaccuugcuucuuguuucaaugagaaaacagaagaaaucaggcaaggacauccacugccucccacgucuccugccagccuguaucuccacccauccucugccaggcuuguuaccuggguuaaacugcccuuguucugacuuaaaggcaacacuuccacuugugugugagcucccuuucccucucacacaugcagggacagcaccugagcacccaucccucuccuccauccugaaguccuugcccuccaagcccaccacuccccucagcaugaagaagugcgccaguucccagcgaccugaaaaaugcacgucaugggccccaugucccaccaauuacuaccccaugacucuccuccuccgcagccccauucaaagagcccccaccccacgcucgauuucuccauuuccuccuuccccugagccuacuacaguagggcucucaccccaaacauccacgucaccauaucaggggucagcuauggccacacuuccaacucaaccugcgguggcacugacacagccccgcuccuucagaagucacucuccuuaugugaaucugggacagccuuucucuguucccuacccgccucacugauagcuccucccaguguccccugacgccucaaagcccuggcgugucuagggcucagcccucaucucuguccauuacagaggggagugcacucauuaucagacaccaacgccaucuaugcugaacacucacaugccugccuccaaccuggccuucuuuccagccccaacaccugaccagcuccucacccaacaccuucauuuggaugcucucagaaguuuuucaacccuaaugcguccagccucacuucugauuuuccuccuucuauaguuuucuccauuaucucauuuguucaggccacagacacugcaauaacccuugaauccucuucccuuuguucacacuccacaucuguucaaaaccaugcccagcgccagacgcccacagccuacagggcugccaucugcaccaucgccuuucaccaugaagcgugaccaccucccaccugcuuacuucuccccuucuccagcucuuuucuacacagccagcagaauuacgcuuuaaaaucauaaaucagaugucacuuuucuacucaaaacugacaaagguuucccauccccuacucuggccccacaagggccacugggccuggacuccugcugcucacccugcccuccccuucccucuucuuuggucacacuggccccugcagucccugcccccucggagccuuugcacuuucguagaaagacuccaaagauauuugcaggguucacuccuagauguccuucaggugucuguguugacgucaccugaucagagucccuccuagucacacuauaaaacagcaaggcuggcugggcaugguggcucacgccuguaaucccagcacuuugggaggcagaggcgggcggaccacgaggucaggagaucgagaccauccuggcuaacacacugaaaccccaucucuaccaaaaauacaaaaaaaauuagccgggcguggcggcaggcgccuguagucccagcuacuugggaggcugaagcaggagaauggccugaacccaggaggcggagcuugcagugagccaaaauugugccacugcacuccagccugagugacagagcaagacgccgucucaaaaaacgaaacaaaacaaaaaaaaaaaaaacagcaaggcacccccacccucagcaugcccucucuccugccucugcuuucucugcacaguucugaccacuugaccaaucauaagucacccaaucaaagcagccaucgacugcgagaugugacacaauuuuaugaaccaugaaggaaaauaaaaguaccaauuuaaaugaaaacacuccaucaagccaggcacaguggcucacuccuguaauccuaagacuuugggaggcagaggugggagggucacuugagaccaggaguucaacgucugccugggcaagguagaaagaucccaucucuacaaaaaacauuuuuaaaaacagccaggcaagguagcacaccugugguuccaacuacaugggagacugaggcaggagaaucacuugagcccaggaaguugagacugcagugagccgugcuugugccacugcauuccagccugggugacagagcaaaacccugucucaaacaacaacaaaaaacacuccaucaauucuaacaggcaacucaauuucagagacauuaaaauauggagaaaguguaucuuagaaucaaugaauugugauauauacaugcaugcacacacacacacacacacacacgcacacaccccacaggcaacaaacuauguguuuuguugucucccccacaaguaugugagugcugugugggcaggaacuuuguucuguucuuuauccucagcaacccaaacaauuucuggcauaaaguaauacauuucaucaauaucugcuguaugaaugaauguucuaaucaugcauacauaauacacucaauacaagguaauaagccagguacaguggcucaugccuauaaucccagcauuuccaguggccaaagcaggaggacuacuugaggccaggaguccaagaccagccugggcaacauagcaagacuccaucucuaaaaaacaauuuuuuauuuagcugggugugauguugcauaccuguggucccagcuauuugggaggcuaagucaggaggaucacuugagcccagagguuugaggcuguaguaagccaugacuaugccauggaacuccaaccuaggugacagagugagacccugucucuaauuaaaaaaaaagcuccaacacuucuaguauuaaacacugaaauaaaugugaguuauacauaccuuaccuuaaagaaagauuaacagugcuugcuacagcucuuuuagaaugucuagcagguuucucaguuuuuacuggaaaaucucccauaaaaaaaaaaauuaagaaaaacaagauaauuauuuacccacuuauuuuaaugcacgguucuggguagcuggagccuauccuggcagcucagggugcgaggugagaaccagccccggauaggacagggucccaccacagggcaacucacacacccaaacucgcucaugcugggaccaaggagacaccccaauucaccuaauggacacaucuuugggacguggaggaaagcaggcggccguggggagaaugugcacacuccacacauggugcucccagccaggaaucacuuuuucccucauagauguuauaacgaaacaaugauaucugaggcucugccauggaaaggggggaagccagaauccacucucugaaagcagagaccaaaggaacagugacugcuuugagagaaaguuucuuucuuggcgccugcacuuuaccagccucaagucugaggauuugucuuuuuuuuuuuuuugagauggagucucgaucuguugcccaggcuggagugcaguggcgccaucucagcucacugcaggcucugccuccuggguucacgccauucuccugccgagcaacugggacuacaggcgcccgccaccaugccuggccaauuuuuuuguauuuuuaggagagacgggguuucaccguuagccaggauggucucgaucuccugaccuugugauccgcccgccuuggccucccaaagugcugggauuacaggcaugagccaccacgcucggccgaccauuuguauuuucucucuuuuuuuuuuuuugagauggaguuuugcucuuauugcccaggcuggagugcaauggcacgaucucggcucaucaaaaucuccagcucccggguuccagcgauucuccugccucagccucccaaguagcugggauuauaggcuugcgccaucacacccagcuaauuuuguauuuuuaguagagaugggguuucuccguguugguuaggcuggucucgaacucccaaacucaggugaucagcccaccuuggccucccaaagugcugggauuacaggcuugagcaacugcgcccgggcuuuuuuuuuuuuuuuuuaaagauagucuugcucucucgcacaggcugauugcaugguggcgugaucucagcucacugcaaccuccgccuccuggguucaagcaauucuuguguauuuuuaguagagauggggcuucuccauauuggccaggcuggucucaaacuccuggccucaagcaguccagccaccuuggccucccaaagugcugggguuacaggagugagccaccacacccagccauguauuugcuuaauuuccauauauauucugcuuaugcacugaggacccauuaauguggcucucaggaugagaaggcugacugucucgccucaagaaccuucucuuugggguucuugcugggcagugggagccgggccacugcgaagaucaguaauguugccuucccauccacuacuacugucuucaauaccucaaggccacugccaauauaaugagggaggggggaucagcccagcccagaagccaguaaauaaaacuggagguucugcucguuuaaaaaccagagcugcaccagguacagcggcucaugccuguaaucccaacacuuugggaggcuaagguggguggaucacuugaggucaggaguucgagaccagccuggcuauggugaaaccucaucucuacuaaaaauacaaaaauuauccaggugugguggcaugcaccuguaaucccagcuacucgggaggcugagacaggagaaucacuugaaccugggaggcagagguugcaguaagcagagaucacaacaccguacuccagcuugggugacaaagugagacuccaucucaaaaaauaaaaaacaaaaaccaaaaccagagcugugacgugggaugcacuggcagcaagcagccccaacagugaggauauuuucaagggaauuagguugcuggagaaacugcaagccuacccugcagaagucuguagcuagaguguucuuagcaacauucuaacacccuaaauaucuagcaacagaagacucacacaaacaauaaugcacagaaaaaaaacugccacacauaaaagcacagguggaccucacaacagacgaagugcugagcaaaagcagccaggcacaaaagagcucauauuguacgacuccauuuacauaaagcuagaaaacagagagccaaucccugguggaaggauguaagcugcaaugguguucaggagacacugucacuggcaggggcacaugguggugcccugagucacacaggugcucacuuuggaaaagcugacuggacccggaauuaugcgaccucacgcaggcacugggaugcucuauccaaccccgcuguggagggcaaugccccagccugcagucugggaauccucacucugggaacugcuuccaagaaggggacuccacccgcccagugccaagcccucucccaguuauccacugcuccaaaaacaauuuacacaaacucagcagcuuaaagcagcaugcauuuguuacccuacaguucugcaggucacacauccaggccaggccagcugggaucuccacgcagggucacgcaaagcugcaacuguaugucaucgggcugagcucucaucuggaggcccuggggaaaacugguuuccaaacucauucagauuucguggcagaauccaguucccugcaacuguaggacuaagaacccugugugcuuacuggcugugagcaggagccgccccuaggggccaccugaaucucaaggcaggcacagcacaucacauuuuucucacgcaucuaaucucagccucuguucuccaaccagauggaggaaccucugcuucccagggucugugugauuaggucaggcucucccagacgaccucccuucucaccucacugaccugggaccucccgacaucugcaagucucuucaugacaguaccagaugagugucugaaugaguaacuggaagaagggguguguacauuaggggccaggaaucuaagagaccaccucagaacucugcccuccacacccaugccaggugcccggcagguaacaggaaucuaaaacuacugucacuguuuggggcaccaugaaccgcacccauauaagaagcugaauuaucaauguguguuuccuacauccaccaccaaccggcuguuccccaucucucccuuuccuccagccucccccuucccuggauauaacaauauugagauuaggcuaauuaguaaccuuaccauggccucucacgugaaaggaggaaucccacaucucucacuuuaaaccaaaagcuagaaaugauuaagcuuugugaggaaggcaugucuaaaacucagucagaaagccgggccucuugcaucaaacggcugagcggcaaugcaaaggaaaagccccagaaggaaauuaaacgagcugcuccagugaacacacaaaugacaggauagcaagacagccuuauugcugauguggaagaagucugaguggucuggagagauuaaaacaacaacuuugcccgacagcuggugugacuggcaaccaaagcugaauccacagcaagguccuaaccguccucaauucuaugaaggccgagacgggugagggaagcugcggaagaaaagcagaaaaccagcagagguugguucaugagguuuaaggaaagaagucacuuccacacauagaagugcaaggugaagcugcaagcuuuacgggagaaacugaagcaaguucuccagaucuagcuaagaugguugacuaagguggcuacucuaaaaagauuuucaguguggauaaaaccgcuuucuauuggaagaagauggcaucuaggacuuucgcagcuagagagaagucaaugccuggcuucaaagauugaaaaggacaggcugacucucguuaggggcgaaugcagcuggugacgugaagccaauggucauuucccauuccaaaaauucuaggacccuuaagaaugaugcuaaauccacucugccuguguuggaaauggaauaacaaagccuggaugacagugcaucuguuuacagcaugguuuauggaguauuuuaagcucacuaaugagaccuacugcucagaaaaaaagauuccuuucaaaacacuacucacggccgggcgcgguggcucacgccuguaaucccagcacuuugggaggccgaggcggguggaucacgaggucaggagaucgagaccaucccggcuaaaacggugaaaccccgucucuacuaaaaauacaaaaaaauagccgggcguaguggcgggcgccuguagucccagcuacuugggaggcugaggcaggagaauggcgugaacccgggaggcggagcuugcagugagccgagaucccgccacugcacuccagccugggcgacagagcaagacuccgucucaaaaaaaaaaaaaaagaaaaaaaaaaaaaaaaaaaaaaaaacacuacucacugacaaugcuccuggucacccaagagcucugauggagaugaacagggagacugauguucuucuuuugccaacacaacgugcauucugcagccccuggcugggagucacuccaacuuucaagucuuauuaagaaauauguuucacaaggcuguaggugccauaaugauuccucugauggaucugggcaaagucagccgaaaaccuucuggaaaggagucaucauuauagaugccacgaagaacauucaugauuuaugggaggaggucaaaacaucaacauuugguauuuuggaaaaaccugauuccagcccucaugaaucuuugagggguuugagacuucaguggaggaagcaacuauagauguggugaaaauagcaagagagcuagauuuagaaguguagccuaaagaugucacugaauugcuucaaucucgugaucaaacuugaauggaugaggugcugcugcuuuuuuuuuuuuuuuuuuuuuuuuuuuaaagacagaguuucacucucguuccccaggcagaguggaguggugcaaucucggcucacugcaaccuccaccucccggguucaagcaauucuccugccucagccuccugaguagcugggauuacaggagugcgccaccacgcccagcuaauuuuuguauuuuuaguagagacgggauuuggcuauguuggccaggcuggucucaaacuccugaccucaggugauccaccugccucagccucccaaagugcugggauuacaggcacgagccaccaugcccggcugagguguugcuucuuagagaugaggaaaacaaguacgcuucuugacauggaaucugcuccuggugaagaugccgugaacacuguugaaaugacaacaaaggauuuugaagauuccauaaacuuaguugauaaaacacaggcaggguuugagaggcuugacucuaauuuugaaagaaguucuacuuggguaaaauacuagcgaacagcuuugcaugcuacagagaaaucuuuugugaaagcaagauuccacugaugugacaaacuucaucgucccauuuuaagaaacugccagucacaccaaccuucagcaaccaucacccugaucagucagcagccaucaagaaaggcaagacccuccaucagcaaaaugauuacaacuuaaggcucagaugaucaucuuuuagcaauaaaguaucuuuaaauuauuuacauuuuuagacauaaugcuauugcauacugaauaguaaccacagcauaccuaaacguaacuuuuauauacacugggaagcuaagaaguuucugugacuugcuuuguuuugcuauucacuuuauugcaguggucuggacccacacuggcacauccccaugugugggaugaaagguccacuggacacuuggguagccaaugugguucccuagcauuccuguuuccuucuuccuuuaaguguuagaaaccccaucaaauuacuaaugacugccccauaaaugacauuuccuaguguccccuuaaguuaggugaguuugugaccaagaugaggcgagaagggaagugaugugugcgugcuguccacucucuccccuccccacagugcugaugaggcagggcagccagagucccuggaggccaacccuaccuuuaagagagaauaagacaacucaaguuucuuauuugaaacaccguauuugaaucuguuacagcaacuuuaaccuacgucuuaaauaaugcuaauauacaacucaaaauauucagauucaauucuccccaugaugauaaauucaaacugggccaggugcggcggcucacaccuguaaucacagcacuuugggaggcugaggcagguagacugcuugagcucaggacuuagagaccagccuggucaacauggugaaacacagucuguauuuuaaaaagacaggccagaugcaguggcucacgccuguaaucccaacacucugggaggccuaggcaggcacaucaccugaggucaggaguucgagaccagccugaccaacauggagaaacccccgucucuacuaaaaauacaaaauuagcugggcaugguggcacaugcuuguaaucccagcuacuugggaggcggagacgggagaaugacuggaacccaggaggcggagguggaggcugcagugagcugagaucacgccauugcacuccagccugggcaacaagagcgaaacuccaucucaaaaauaaauaaauaaaaauaaaaauaaauuaaaaagggggugggccggacaugguggcucaugccuguaaucccagcacuuugggaggccgaggcaggcagaucaccugaggucaggaguucgagaccagccuggccaacaugguaaaaccccaucucuacuaaaaauacaaaauuagccaggugugguggcacacgccuguaaucccagcuucucgagaggcugaggcaggagaaucucuugaaccugggcggcagaggguggaaugagcugagaucgcgccauugcacuccagccugggcaacaagagcaaaccucuaucucaaaaaaaagaagugggagaacggugggguggagauguugguuucuuguuuuggaacucaguugauaccuucugauuuuaaauuuuaaaauggcuguuauacuaccuggaaacaagcuguuuauuuuuuuuuauuugauauauauauauauuuuuugagacagagucucacucugucgcccaggcuggagugcagugacacaauuucggcucacugcaaucuccaccucccugcaaucucugucucguggguucaagcgauucuccugccucagccucccaaguagcugggauuaugggcgccugccaccacgcccggcuaauuuuuuugcauuuuuaguacagaugggguuucacuuuguuacccaggcuggucucaaacuccugaccucaggugauccacccaccucggccucccaaagugcugggauuggauuacaagugugagccaccacggccggccagaaacaggguguuucuguuuacaagaacauaucuuaaaaccauaugugugccucuuaauaauuuucauaauuuuuuuaacuuuugagaaaguuuuuuuuuuuuuuuuaagacggaaucucacucugucgcccaggcuggagugcaauggcauggucuccacucacugcaaccuccaccucccagguucaagugauucuccugccucagccuccugacuagcugggauuacaggggcgugccaccacaccuggcuaacuuuuguacuuuuaguagagaugggguuucaccauguuggucaggcuggucucgaacucuugaccucaugaucugcccgccucuagagaaaguuuuuaaaauugcaaauaucuugcuuugaagaaacaguuaucucaaaaaggaaauagcuaucuucaguuuuugcuuaacuuuuucuuguaugaauuuaaguaaaauuaaaucaauacauuuucauuuaaagaaacugacaugaaaugcaaaaaaaaggaagccaccugacuuguggcuccacacaacaaacugacuagcauggacccaucuccuguuguaacacagaauuugcuggauaaaacaucaccugaggccaggcgcgguggcucacgccuguaaucccagcaguuugggaagccgaggugggcagaucacaaggucaggaguucaagaccagccugaccaauauggugaaaccucgucucuacuaaaaauacaaaaauuagccggacguggugccgugugccuguagucccagcaacucaggaggcuaaggcagaagaaucacuugaauccgggaggcagggggugcagugagccgagaucaugccacugcacuccagccugggcgacagagcaagacuccgucucaaaaauaaauaaauaaauaaauaaauaaauaucacuugaaauugucucaacagcagauguuguguaucaucagcagccacagcagcucuggggugucuaggggugucccaucuggcauuagaagcccccagcucuugcacccacacugguaaggggaaauuccagccucaagcucccagccagagucacuguguguugcuuacagccugaagaaauuaacaggauacaccaagcuucacccucaggaaacaggaaaagcagaaccagagggcaaccgagugagacguggacuagagcuccacuaacaucuggaccuccuugccccgcgccacaccaaggggccuacugggcgccacaggcuaggcagggagcgcuucuguuccuagugcuccccacgaugccccggaaguucagggagguaagaagcguaaggucagagaacuggagccagcugucaacugcccccgccccacccaggccauuuggcuucugcuaccggcaugcugcucagggcucugcccaaggacaacgacgagcccccuguguccucuccugggucaucuuccaugacccugaggcagcgaagacaagcucggcagcucccugagcugcuucacaccaacuaccuaugagucugaggccagcauccaggcgcugcccagacccugagagucccuggaccaugacguagccugugugugaagggagcaagacagccuugacagaagcacagagaacgccacugggauucuuaaagacgcgaagggaaaaggguaccuucaagaaaaagcaggacagcguagccacaccaccucuccccaucugggaauucuccagguccaagucuuguacuuaauucuaauucugcucaucauguuucccuccccaccccuauccccaacagcacagaagaugcuggcgcugcaucuccuccagcaccgagaggccucgaggccccagggagcggaggcaggguucaggcacagccgcgggaacgcccacacccaguccugccacaccguaaaacaugucugcggcaucaaccucacgcaggccuggcggaccugaagacugcgacacggacacucaagcccgcggcucuccggccugggcucagggcggggggaaggagagggaaccagggguacccacacggcgcuccucagggacaagaccccaggcucgggcccgaggcgggcucgcuggagagacgccgcagccucgcgggggcggccguggcugcguccgggagacugacuagccaaggccccgcuccuggacgcccuagcggggcgggcagcggccugcggaccccgcccggcccucucggcggacugugcccuggcaaggcggccgggcuccgga

SEQ ID NO: 192553 - RNA, 23116 nt, Homo sapiens
uagcauagagccugucuguuuauagaucucugccugucuuguccguccauccacuguguguauauaucuguguaucucuguggagcggggaacgggacaguuguguaaaaauccaaaauacaauucugacuaugaacaaccugcagggucaguccagguguggcugugaagccccaaccaaaccacaggacacgggguugggggaaggcagacuggcaggccagggugacccuccugaccagaggugcugcccagacccgagcccguuuguccuacuggggcuauggcggccgacccaccagugcccaagaccgcgaggcugcccugccuccccaagaccagcccugcacugggggugggggugggcggcuggcccagcuccuccggggccucuaggagacagugggguccuuggcuuugggaggcuccgagccugucagcagggagauggugggguccucggcgaagccguccccuucggagaaguaggagcccucucccagcucaaacagcaccggcaggucguugcucccgguguccacggagccgggguccagcaggaacagcggcugcgcuguguagugcaccagcugcuucccugcgggggugggggugucaaggcggugggggguugggggcagagguggggccggugggacuuggcucaccugaauccgggcugcuguucucugccucgggaggccuggggggcuccuggggagacaggagcucuuggaucugugggguggagacgguauugugagcacucccgcuggucucguucccccucaccccccgcccgccuacgcacacuggccaggcugcugucaaggucaggcaggcucaugucgggcacggucaccgaggggcugaacagcugcggaggagggagggaagucagaacagcacccgggggcggggcggggaagcggggaggcggggaggcggcgcggggaggcggggaggcggcgcggggaggcggggaggcggcgcggggaggcggggaggcggcgcggggaggcggggaggcggggaggcgcggggaggcggggcggggaggcggggcggcggggcuccacucacguccagcagggcacugguguccacgcugaagccguggcugcucagcauggucugcagguuauccagguuggaguccauagcauccaaguggucacugagcucauuccuggcccgggauaaggcgguaccugaaccagugccccaggccccacaccccaaugcccuccugugggagaagggcuccccuugacuguaccccccaggcugcacccccguguacgccugcacaggcuggagggggcagcgcauucgaggacggccuggaaggcaguggaggcucugugcccugcaggggugcggcugggccuaugcugggcaucccuuugccaugagggccugggggccuugguggcaguggacccaggagacaaggggcguauucagcuccagcacaaggaucagggauuucaguguucaggguuggugagguuucccguugcacugggaaaacagguggggcucugcucaguguguggguggcucagucccugcccuggugcugcuguggggaugagacccacggucugguggcugugaccaagaaagcccuaggccacagggcacaccugggcuaugggacggacagccaggcugggucccagaggugcccuggagacccugccugacaggaagugcagucagcaccgcagucuggauccugccaacaccagaggccgugccagagcagggaggccugucccugucaucccugucacaggcaaugaccacaggcccguggccaggggagccaugacgacacugagcccccgccacagaggggucucggcugcugccgcccaggcccgacgcucaugcccggccaggcugggucugguccacggcugugugggagggcccgagcgcuggcagagcccuccucccuccccaguggggucagcgcuaacccuggcuggacuuggccaugcggagaggaagaggggcaggggaagaggcgggcgacccuagacaucuguggagugcgagccaaacugcaagauacaaaaacaagagcccccauugcaggcaggggcuggggguguggaggccggcccugcucaccaucuccugccaugugucugggcagcacgaccugccagggcccguggccuguggcgaggguggcggcagcaggagggguggcugagagcagggcccggcagccuguccggacaugcccguggcuucuguggcguuugggacuguggggugaucuggcuggcaccugucucccuccccagccccgagcuccgagguuggggguaggguccugccucgccagcugcccugcucaguccacugggacagucggggcugaagcccagggcugugcguccaggcgcuguggguggggccaggggugggcggcacucacuuguccaggcaggcuacgcugaggcacuuuucagggguggaggugggcgggggggagggaggccggcccucgguguccguguggccccuggcguccgugagggcugugacggaggcgggggcagguucacucucccgcaggauggagucaaugagggcggucggggacaagaggguguccacggaagaugggcgcccgggacucgccuccucuacccgggggcucugaggcgggcuggggggcuccuccuugacacgcaccagggggcugcuggauaggggccugcacacgaggggggccaggugagcuggcgucucggccagccccaccucauccccaacucugcccugggcccacaggggcucgccucauugggggacaggauggcuggggugaugcggcccccaccucucgucuaugcucccgccgggggaggccauggggcuggcaggagccagcucggugaugucggagaugauggguccagagcuggccacagcaucaggggcguagaggcuggagcugcuguaggcuggggagggggccugcaaucaaaggcaggagguccaugcagugccggcaggggcaacccaccccacugccgccugcaugccugggcgggugcccugucuccggcacucaccgaguaggggcccgagccguggacgugcuccagggagaacugccggcuauacuugggcauggaaugugcugagccacugucguucagcaucagggggcuguggggaagggugcaggucagccaccaccccccaccucgggguacccggggcacagcugacagagaagggggacagcccugggccccgggugguggaugcaggcauccccaaaaccucacaucuuucucuucacccccaggauccgguuugacugcaccagugagaucaggaacugaaugagcuguggagagagaggacacaguuaccccggcccuuguggggcccccgccggcccucuggcccugcccccaccuuguugacgacuuucuguugcugggcaugcuucugccgaaggcuggccaccucccgccacagagccucauucucacugcaacagaccaggcugggucaguggggcccaaucccaugagccccagggcugagggagccccacagacccucccugucccccaugcaggagcagggguaagugugaccaugucuggccuggcccaccccaggaugagaacuuguguguggagggacugggggccagggccagggcuugcuggucccacugccccucccugccggggacaccuggugucacguaggguguuggggauggauccaugcgagccaggugcacccggauccuggcauccauccuggcaaacaccuggagggcugccuuggacacaggccaggagcagacccuugggccgcccuuccaaggccugagcagccagguuaagggaggacgguucuucaggcugcgacacuggcugucccauguccuguaggugcucagggcccucgccaggccuggagguggcucagggguggggaagagcuguccccagccaggugagcagggccaugaccgcgcuccugcugcucugggaggcugggcccugucaagccugugagucuucuugguaggccagguccacguggccggacuccaggaaucacaaagccgguggcuccugcuagaccccaugcaggagagucugaggccaaggccuccuccaugacgugggggucaagagcgccugcugcacggagccgaggaagccguacuggcauugggguucccgcaugccuggagccccaaaguggacgugagaccugagcuggccuuccgaggugggcuugccucaguuucucaggugccaccguguguuaggcuccugcuaagguuuccccagagccgcagggucccggugaggaggggcugggggcuagcuccaugggcccaggcgagugugggacagcgguuccaggaagggccugaggugggucugaccccaggcccgaggcgggugggacgggucugcugugcaaggcuuguccucaaaaguaggcuggugggucccgccaagcucggagccaggcagaagccaauggcccagagggcgcuggggaugugcagagcaggggacccucccaacccccuucugcacauggaaaacggcuggccccagagcuguugcagcagccacgggcggcggggcuggggcagaggcccaggguagaugugcguggagcgggaggguggagcugagcaccuggccccggucagggcccugcccccacagcacccggggccucuuggugggcgccaggacccgcuguggcccauaaugcuggugugggaccuacugcuucauggccaggagcuuggaguccaugcacuccugcuuccccuucaucagcugcacguccgucagcagcuuggugacgcuguccuggcggaucuuuaugucuucacucuucaggguggacaccuggauucccgagagggacaggagucacuggagcagccuaggagcuuggcaggcucaggcucguccacugcagccaggucccucaggaaggggcaggcuggggugggagcccucagggaggggcgggcggggagagcuguggcaggugagaccgggcaagggugcagggccggcacucacacuggucacuuuccucuugauguucucaaggagcugcuccuggccacgcaggaagcaugggugcuggaacuccgugucgucucucucuggcuugaccaggccgcccugcucgauguggaccacuuuccggaagccaucugcacauaacagggaagggggcagcucugccucagggcgggaccagaaccccugaagagcggccacugcuccaggaggcugcugcggggcuuggccauggucagacccugcccugcccccucagagcccaugccuggguggccgaguggccuuggucuaagggagacccuguguccccacagggcucccugcgcccgacacacguggaguacagcuccggcuucacgguucuuccauggggaccccagguucauacccacaaggacccucccccauggaagaggcggcugcuccccggcccccaggcuugcagggucccacgccaugcccuuggccagcacaggacgccccguccuucaucacaggguccuccugcuggggucccgccaucugcaggucugccucccgcaccccugcgcugccuggaggcagcacucacacauguugagcugccgcacgaagcuggccauguuguugugcuugaaguacuugggcagcaccuccuuggcaaacuggcccuggucgaacacguggaagcuguucccgcucugaaagggagacacaugggugggucacgcgugguggugaggggcagcgugcccaagccgccccuuccccaggccgccccuucugaaacgcaggcagugcacguuccaccugauggggcuggggccaugggaggcccagggggcuggcgggaggcgaguucguuccugggaccaccugccacacgggccucaucugugcagcgugaccugcauccucacugugaggcccaggacugggcggugggcagaugcgaggccuuccucucagucggaaagccccuccccagggcuuccagagaaggccacguuuccacucacaaagcauccgccgcacucuggccacauuuccacucacaaagcacccgccgcacucuggccacguuuccacucacaaagcaccuguuuaagcaggaccuuucccuugggaacagcgaaggaaauggagcccuaauuucauuacucccgaggaaaacacagucgcguucagaaauccaaauucagucuuguuuugugacgugagacaagaaacagagacagucaaacacugcauauaccuuccucuuccauuucucuaccgagcucaggcccagagcuaucaggaggcgcuggugagggaggcaucccuguuggccguggccgcgguggcucagaggggacaucgaaggcuuaggggacagcgagaagcccacacggcggggaaggggggccugaagcagggccagagaggggugaggggugucugcauaggaagggguggcugacucagugaagaaacuggugaagggcaguggggcagguuucucccugccagggaagggagcugcagaugcaaacagggaaaaagccagaaagacccccgugguguggcacuagaaguggagaaccucuuuccagcauagagagaugugaaauacacagggauguacacgugucagggagggaaacggucacggaaaggaccccaaggcagcaggagagagacggcgaaaagcgccaagccaacuuuccagaacucugaaaguuaaccaaagaauuacaguagcacggggagcauuuauucaagaaaaacagcugaaucuuaguaagaacagugggcuuugugaacuuuuuuuuuuucugagacaaggucuugcucaggcuggagugcaccagcaccaacauggcucacugcagccucugcaucccaguucaagcgauucucgugccucagccucccaguucaagcgauucucgugccucagccucccgaguucaagcgauucuccugccucagccucccgaguagcugacuauaggcgccaccacgcccggcucauuucuguauuuuuaggagagaugggguuucaccauguugcccagacuggucucgaauuccugaccucaaucaauccgcccaccuuggccuccugcagugcugggauuacaggcgugagccucugugcccagccaggcuuuguggcauuuuacaugcccuauucccacuccaucugcagccuuaaaaaccaacagcugcaguccccgugggaacagcguccuggcagccgcugcggggugggccagggcuugagcuccuccagggccccauucccagaggacugucagcaucugaccuaagaguccacucccaaggcugucucugauuugacuugaagcucuccugaauaaaaaagcuguuugccgaggugugccuguugaaaccuuuacaggugauuuuugaacgcuguggcugccugaggcagugccuggcagcuggggagaaggaggugccacuaggggcucugaaaagcucugagauauuccaggacaucucgcagccguguacacgugugagccgugcccgugcucaggaaagaccugagccagccccgagcucucacuucuggcugaccuugaggcucuguguaagcaggaagucaggcauacaguuggguuguccacugccuggccaagugcugaaggcguccccaacacacacacacacacacacagcccccggaaaagacgggagacucacuggccccaggcauucaagaacauuucugccccaucaccaccuaucucaguuaacugaacagagacggcaguggccauaaacaagaaagaacgcaaccuuuacagaauuagugccgaaaagcuaccugacagauaaccacgacaaacagcagcaaugacaaauccuggggaggugggggaguccgagcuccagagcugccacucucaaccgaugagaguuccaguuuuccagccggcugcgcugguucacgccugcggucccagcacuuugggaagccgaggcggguggguugcucaagcucaggaguuggagacuggccugggcaacauggcaaaaccccgucucuagaagaaauacaaaaauuaagugggcgugguggcgcacaccuaucaucccagcuacucaggaggcugaggagggaggaucccuugagcuccggaggugaaggcugcagugagcugugauugaacuacugcgcuccagccuggguaacagacucaaaaacaaacaaacaaacaaacaaacaaaaaacucuaguuaaaaaaaaaaauagagauaugcaaagaaacaagaagcuaggacccauaccccauacacgggaaaaaaaaaaaaaggcaaucaauagaaacuguccccaaagaagccaaaacauuggacacuggacuuacgaggcaaagauuuuaagucaaucauuucaaauauguucaaacaacuaaaggaaaccacaucugaagaacuaaaguaugagaaugacaucuuaucagagaguaucaauaaagagauaaaaauuguaaagaagcacgaaaucaaaauuauggagcugaagaguauaauaacucagauuaaaagucaaccagaggggccgggcgcgguggcucacgccuguaaucccagcaguuugggaggccaaggcaggcggaucaccugaggucaggaguuggagaccaaccugaccaacauggagaaaccccgucucuacuaaaaauacaaaauuagccaggugugguggcucaugccuguaaucccggcuacucaggaggcugaggcaggagaauuguuugaacccgggaggcagagguugcagugagccgagaucgcgccauugcacuccagccugggcuacagagugagacuccgucucaaaaaaaaaaaaaaaaaaaaaaaaaaaaauuaaccagaggggcuuaagagcagaccugacuaggagaagaaggagucagcaaacaugaagaucagucaauugaggugcuccaguaggagaaaaaaagacagaaggaauaagaaggaggagccggccaggcgcaguggcucacgccuguaaucucagcacuuugggaggccaaggugguuggaucacgaggucaagagaucuagaccauccuggccaacauggucaaaccccaucucuacuaaaaauacaaaaaaaauuaguugggcaugguggcaugugccuguaaucccagcuacuugggaggcugaggcaagagaaucgcuugaacucuggaggcagagguugcagugagccgagauugcaccacugcacuccagucuagugacagaaagagacucugucucaaaaaaauaaaaacaaaaacaaaaaugagcagagccucagagaccugugagacaccacaaaaaguguaacacagccgggcaugguggcucacaccuguaaucccagcauguugggaggcugagccaggcggaucaccugagguuaggaauucgagaccagccuggccaacauggggaaaccccgucucuacuaaaaauauaaaaauuagccggcacaguggcgggcgccuauagucccagcuacucgggaggcugaggcaggagaaucgcuugaacccaggaggcagagguugcagugagccgagaucaccccacugcacuccagccugggggacagagugagacucugucucaauaaaaaaaaaaaaaaaaggauuaaaaugccuggugugguggcucaugccuguaaucccaacacuuugggaggcugagguguguggaucguuugaggucaggaguuccagccuggccagcauggugaaaccccgccucuacuaaaaauggaaaaauuuuagugucguggcucaugccuguaaucccagcuacuugggaggcugaggcagaagaacugcuugaacccgggagguagaaguuguagugagcacagaucgugccacugcccucuagccugggugacagagcgagacuccaucuccaaaaaaacagaaacaaaaacaaaccaaaacaaauaaaauaaaagcauuaaaauaaaagacccugccacucaaucuuuguauauuggccggguguaguuacucaugccuguaaucccagcacuuugggaggccaaggcaggaggaucccuugagcccaggaguuggagaccagccugggcaacauagcgagaccccaucucuacaaaacauaaaaauucaauauccggcaaagcuaugcuuugaaaauggagagauuuccacuucuggaacagcaaugugaggaacuucauggaaguacuuccugugaaacaagcaaagcuuaaaccacuuaaagucucaaaacuguccuaaacgcauauaacagaugaacacuuacggaguaaaaucuacugacaccugguacgaacauuaagccugguggcaucugagccucagccuccucuuucccucucaccccagcucaccaugauggguacuacacucagggagaggggagcaggaagauggggacccuucuccccucaauucccaaauaagguuuccuggaucucaugggcugggcagaccaccagaguuucacauccucaccgacuccaaguugaagagacuaagauccuggugcacguggccaagaagccaggggcucccuuccuccaccuugcccaagccucagagaggagacuacccccgccacagcaggcugaggacacccaggucucugaucacccuccccacagcucccaccuaauuaaagcauuuucaaaaccacaauuuuuuuuuuuauuuuuuauauggagucucgcugucgcccaggcuggagugcaguggugccaucuuggcucacugcaaccuccgccuccuggguucaagcaauucuccugccucagcuuccuggguagcugguauuacaggcaugugccaccacgcccggcuuauuuuuauauuuuuaguagagacaggcuuucaccagguuggucaggcuggucuugaacuccugaccauaagugauccacccaccuuggcuucccaaggugcugggauuacaggcaugagccacugugccuggccuuaaaaaccacaaguuuuaaauacaguucaggcuuucuagguuaaaacaguaggguagagcacccaugcugggaaagccaggccaagaagaucagaggcugcugucuuacccagugcccagaaggguggugcagagaaaucagccuggggagagaggccguccauaaggaaagagcucugaagcucccugaggaaacucauuuuauuugaaaguucagcccaagacugcucuugggaacaacagcuccucuaaguuaagagaaacaagugaaaccgcaggcuuguucaccugcacaggaaaagcuacgaagagcccugcuggggccagaacaacccugacugaccucagacacuaccacuacucaaaaaccccaaacacgccugcaacaauaauccaaauagcgagacccccaucuauaccaaaaaaaugauagaagagacgaaaucauaaaggacccccaguggaaacucuggaguagaauaaccaaagcagaacugcuggccgugugguaaaugcugaauuucacaugcaacucccaagcugcuuuccaaagcggaugcagcauuuguguucucagcagcacgggugaguuccaggggcuccgcacccuccucagcaccuggcuguucuagucgcugucgcugcgguuuucgugugcauuccucugacaacgaacgaugcugagcaccuguucaagugcuuauuugcuauuugucuaucuuuuuuuugauguaucuguucaaaucuucugccuuuuucaauguauguuuuuucgagacagagucugcuuugucacccaggcuggagugcaguggcgcgaucugggcucacugcaaccucuaccuccugggaucaagagauccucccaccucagccucccgcguagcugggcccacaggagcacaccaccacaucaggcucauuuuuuuuuguagagaugggucucccuauguugcccaggcuggucucgaacuccugaguggaagcaaucuacccgcgcuggccucccaaaguguugggauuacaggugucagcuaccaugcucagccacuugcguuuuauuuauuauuauuauuaucuuuuuuuuuuagauggagucucgcuccacugcccaggcuagagugcaauggcgcgaucucagcucacugcaaccucugccucccggguucaugcgauucucccaccucagccuccugaguagcugggacuacaggcaccugccaucacgcccagcuaauuuuuguauuuucaguagagacgggguuucaccauauuggccaggcugcuuuugaauuccugaccuugugauccgccugccucggucucccaaagugcugggauuacaggcgugagccacggcgcccggccugccuuuuauuuuuuuuaaaugguugucuuccugaguugcaaaaaaaaauuuuuuuuuuuggagacggagucucgcugugucgcccaggcuggagugcaauggugcaguuucggcucacugcagccucugccuccuggguuccagagauucucccgccucagccucccgaguagcggggauuacaggcaccugccaccacgcccagcuaguuuuuguauuuuuaguagagacaagguuucaccauguuggccaagcuauguugccccaucugggagcaauccuuccacccgagccucugaguagcuggcaccacaggcaccaccaccgugcacggcucuucuggaugcuuuuuauuuuuuuugagacggagucucgcuuugucgcccaggcuggagugcaguggugcgaucucggcucacugcaagcucugccucccggguucacgccauucuccugccucagccucccgaguagcuaggacuacaggcacccgccaccacgcccggcuaauuuuuguauuuucaauagagacgggguuucacuguauuagccaggauggucucgaccuccugaccuggugauccgcccgccuuggccucccaaagugcugggauuacaggcgugagccaccgcgcccggccucuucuggagcuuuuaagauuuucucuucaccagccuguuccagcacuuugauuauauaauguaccuugauaugguuuugguuuuauccugcuuaagacugauauucuuggauuugugagcuuacagcuuuucaaaaauuugggaaaaauuuuggccauaauuuuuuuuuugagacagggcucuguugcccaggcuggagugcagugguacgaucauggcucacugcagccuccaccuccugcacucaggugauccucccgccucagccucccgaguaguugggaccacaggcaggcacuaccacgcccggcuaauuuuuguauuauuuauagagacagggucuugcuauguugcccaggcuggucuugaacuccugggcucaagcgauccacccaugucagccucccagagugcugggauuucgggcaggagccaccguguccagccuuuuggucauauuucuguauucucuuccccacuguuuucuggaaccucaaauacguuagaccacaugauauuauguccuugaagcucggcuaaguuuuugcaguccuuuuucucccuguacaucacuguggacaguuuccauugcuuuuaguucaggaaucuuuucuucugaaguuucuaauguuuuguuaaaccgcuccggugacucugaagaaccaccuuuuuacuuuagaauacaugcccuacaccagugucccccaucauuaacauccugccuuugugugguacaguugucucaagaacauuagacacauuguuaacuaggacccacauucuaaucagauuccuuagcuuuuuacccaauccuuccucugcuccaggacaucauccaaaauccauccaguugucacaucuucuucagucccacugacucuggcaccuuucagacuugccuaguuuuugagaaccuugacaauuuugaggacucgucaaacaguuuguggaaugucucucaauuuggauuuguuugauguuuuuucaucauuagcugggguuacguauguuuuugggaggaagaucaaagagguagagugcuguucucaucauccuaucaagaguacacaacaggccgggcgcgguggcugacgcgcccaacacuuugggaggccaaggugggcggaucacgaggucaggagauugagaccauccuggcuaacacggugaaaccccaucucuacuaaaaauacaacaaaauuagccgggcgagguggcgggugccuguagucccagcuucgugggaggcugaggcaggagaauugcuuggaccugggagguggagguugcagugagccgagauugugccacugcacuccagccuggcaacagagcgagacuccgucucaaaaaaaaaaaaaaaaaaaaaaagaguacacaacagugauacgcaugucacugcugauggugagcauggucccuggugaggcuguguugcuggaggucuccacuggaaagcugcuccuccugcuucugugcucugcucuuuggaagagggucacuagguaaagcccaggcuucuggagugaggaguuaagcaucaccuccucgaaggggaacuaucucaguaaacaauguggaauucuucuacuugggagauuaguuccagugacauuuuguccaacuugcuucuuuucuguaucuuccauuucucagucauguuuucuuauuuuuugagacggggucucgcucugucacccaggcuggagugcaguggcacgaucuuggcucacugcaagcuccaccucccggguccaagcaauucuccugccucagccucuggaggagcugggacuacaggugcccgccaccacgcccggcuaauuuuuuguauuuuuaguagagacgggguuucaccauguuagccaggauggucuugaucuccugaccucgugauccacccgccucggccucccagagugcugggauuacaggugugagccaccacgcccagcccucagucacauuuuuguguuauuucuuugagcacagggaacauuuuuauaauuguuuacugucuuuguuggcuaauccuaucaaaacugggccugcuacuggacccccuccagugacaaguccauuuuucugcuuuggcuugucugcccaugacugauuagauucuggacgugaauuuuuuuuuuuuuuuuuuagaaggagucuugcucuguugcccaggcugaagugcagugaugcgaucucggcucacugcaaccucugccucccgggcucaugugguucucuugccucagccucccaaguagcugggaccacaggcgcccaucaccacacauggcuaauuuuuuguaguagagacggcguuucaccauauuggccaggcuggucuugaacuccugaccucagauaauccgccugcuucggccucccaaagugcugggauuacaggugugagccacuucgccuggcuuccuucucucaagagugcuguguguacuccgugcuagcaggcagugguguuuccagggcuugccuugcacuuguuuccacggcauuggaguggccuuuccucugcagcuuauucugcgccacuuccaagcuguguuuccucuaaggugucaugaaagcuccuuguauuuaaaguggcuucuauacucuggcuggugggaacugaaauaaccacggcccugugugaguccugcucaucuguccccuuacacuuacucuuccccuucaaguugcucuugguccagcuccacgagguuucacugugugcaccagcaaaucggauccaacccaagaugcaagcgggcucacacgcagauugcuggagcucuuuguuuugggcguaacuccuuccuuucugguaccacaccccacacauucuagcugccucagcugccccaaagucuggguuuguuggguucucugcacgugagucugcaaauucccuccacauaaaaagccuggacaauuuugugguuuaccucaguccucgccgguuuuuucuuuucuuucuuuuuuuuuuuuugagacaguuucucgcucuguggcuggagcgcagcggcgcaaucucggcucacugcaaccucuguaucccagguucaagugauucuccugccucagccucccgaguagcugggauuacaggcacgcaccaccacgccuggcuauuuuuuuuuuuuuuguauuuuuaguagagacgggguuucaccauguuggucaggcuggucuugaacugcugaccucaggugauccaaccgccucagccucccgaagugcugggauuacagccgugagccaccgugcccggcccuaguuuuguaacgucugaacauuuucagcggcuucuuaugccuuaaggguuaaauccaaguugaacaugucaggcaaccccuaccuuaggggccauuaugaauuucacagggucugcuggugaacccaucagagaacccagugucucucucaucuuccugccucaguggaacaaggucccuccucugcugaccacaggcaccucuuggaggagucaccggucauaacuggauaucacgaaaaccugccacuggaaaugggaggccccuggcuggugcgagaugccacacgcugagaaguguaggugucagcaaaccccgcagcuugcaguaaacuuggagccuguggccucauuuucugcagcacugugaaggaccugaaaugugugugagauccugccuguagggacaccuuacauagaaagugucugugucucugaguaucuucucaaagggcucccuggcccaaaacgugaacagugccguauucuacaagguggccccacagcccaggccacaagccucuuguuccagccuccugccaagucaaagcuguaucugcugaccggugaucugggcuccugggcucggcuggccggcuguucccucuccgggucccgggaguauaggcuuuaggagcaaagggagcgcgugugugaguagcuguggcccacguguggggagcagggaccaccggagucagggcauggaagcagugaggcaggcaggaagcgcgagcaggugcagacaaaguggcucacuuuguggccccguucccuggucugguucuguccacaucugagccacccgcaccuuucucauaaacacucuucuuguuuccgcucuggaggagcuuccagcguguucucgccacacaaggaccaagagcagcacaaucgcccucaucucucaucacaucucgucacuggcugccgugcacaagugugguggcuacugcugcucaccauggcccacagggucacagggaggaggcugaggcagcagcagcccuugcugccaggugccuugagacauuugggaccaccuccuuuccuuagacagccuccccuccaccugccagaccuugaggagacccuggagccaacagcccucaauauacccgaugggagcugcuugcuuccucugggaaggcacugugagccccaccgaccccucuccagcucgcccugcacacaggcugacuccuccaaaacugagagacuuucagggccaggcuguccaucccuggucccucaauaaaggacugagcaaacacuagccuguggaguugggugggcauggggcaccggaggcaucugccuccccccaggaggccacugcagcucagcccuucugugcccugggccccuccucaccgcaccccccccaccacaccauccggggcagaggaaacacaggaggcuacagcacagagccuuuuuaauuuuuucugugcuaugcacagaagcuguaugaggacagaugugugccuucuuuuuuuuuuuuuuugagauggagucccgcucugucacccaggcuggagugcaauggcgcgaucucagcucacugcaagccccgccuccuggguucacgccguucuccugccucagccucgcaaguagcugggacuacaggcacccaccaccacguccagcuaguuuuuuguauuuuuuaauauagacgggguuucaccauguuagccaggauggucucaaucuccugaccuccugaucucgugauccgcccaccucagccucccaaagugcugggauuacaggcgugagccaccacgaccagccccagcugugugccuucuuauggccacaccaggaggcacuaugguccgggcacacaucaggcccuccagacccugcagcacuucucacagcugcugcuguggggccuccagcaucuugggccaaauaccagaucuuccaggguggggccagugggccugcugggucuuggcggcucucagaaccagggaagcagggguggcccugccugccgugggagcuccggacacgaucuguggccagggucugagugacugagcguggccaggucggcucugcuucugcaacuccucgugugcuuaugaguggacgcccugcccugccuuacuucagggaccccucacgcccugcccccugccucacugcagggaccacucugcucccaauuguccacccagagacccuccacagcggccaccugaccacuggcuuucaauggaacucucucccgcgauaggccgagggccuuggugaccuccagcucacucagucucagggagccccaggguuucagcacauccuucuagagucuuuccagcugcacccaugaggcuggggccaggugaagacagagaagcauccaggagcccacaucuaaggaggcccccacucccagcgccauccgaaugcagguaggucuuaaaaaggaaugccucagggccaggcgcgguggcucaagccuguaaucccagcacuucgggaggcugagaugggaggauggcuugagcccgugaguuccagacuagcuugggcaauacggcgagacccugucucuacuaaaaccuuaaaaagaaaaaaaaaaaaaagccaggucugguggugcaagccuguagucccagugacucagcugaggugacuggaucacuugagccugggaggcagaggcugcagcgagcugcaaucauagcccugcacuccagccugggcaacagagcgagaccuuaucuaaaaaacaaaaagugcuuccuuaaauuuugcacccaggugcccccucuggccucacccugauccugaggccuccgucuaccuggguucguucuaaccugcgugaccaucauucuagcauuugucuggcacaggucauguggcugugccuuguucucaggcuccucagccagcuggguggcuccuggggcuguaaucucaccaucucagaugucgagauuacuuuucauacuuccuuaucuuguuaauaaagaugggacaaaaucauagcuuguaaaaaacugggaugauggugaacccaguucugaggcuucacuuucugcuuuuguuugguucuccaugcugucaaauucucugaagaggcuguugcccuccugagucagcugcagcccagcaaggcccuagaagagccucugcugguggacagaggagcugcugcaugcagacgaggaagcugggcugagggccggcaccagggcacggggcagggaggcugcgggucccgggucucaugggucucaguucuauggaggugccugucaguccagguauucagucccccaaccccgucuuugggucucagugguacuggauccagguguaccuuugggagaagcuguugagaagcuggcugagggaggaccacccacgugcacgcccaugcucuuauguggauccccgggaucauaaccuuguggcugacacauuuccucuccaaggcugugcuguccuccacgacuugcuggguccccucaaggcccuugccuguguggguggggugcucaugggaaugagggucuugggaggggggggugggaaaucaaacaacacagggaugggguagcugccacaguccccaccaauggggucuccugggcagugacccggcauucugccuccaguggcugcagugggaguccugaucucaggccagggaggggacgugcaauggugguccagaccuggucccauuccuggccaggcucaguaaaguuacuggccaguuucugggccucggucucccccagguuauucagccuugagaguuagucaccaugccugugauucugccucaucuucuugugucaaauagggaggguuuuucuuggcagaauggugguaagacucugagccagaaggagacucucccagagaaggcagcagagagcaagagcaccagggccuucucaaggccuccgagagccagcugggccugggcaguagauuugugggagggugcccuguugggacucugcugacagggaguccucagggcuugugugagugcucucaaagucacaggaugggaugaucaccuccuuucuccaggccaggcagccagcgccggaaagcucugcagcccccugcgcggccuggagaagggcuuccuuccaguuuuaagucaguguuucugucucauugccaugcucgcccccagugcuacguccugcaccaaccauugccacuucauacugaccagguggaaccaaacacucacauuccaguuggcuccccaucccuccccagggagaacagauccacagguggugcaccugugaguggaguggaggcuggccacgggccucaucacaccugccuuccuugcucaaaagcccugcccagaacaugccucggucccaaaaaaggguacacugggcccuaacccacaugccucauaaucuuuaagcagaaacagcaagcagauuacgggacaggacagaucacgcuaguaggauuaagcuuagaauaucccagauaaucgcggaugccccucccccaaugggggaguuauuccccuuaacuucugaggauuaaggggaauaagaaaaagaagaagggcugggugcaguggcucacaccaguaaucccagcacuuugggaggccaaggcggguggauaacuugaggucaggaguuccagaccagccuguccaauguggugaaaccccgucucuacuaaaaauacaacaaucagccggguguggcagcacgcaccuguaguccuggcuacucgggaggcugaggcagaauugcuugaacccgggagguggaggucgcagugagccgagaucgcaccacugcacuccaaccugggugacagagcaagacucggucuaaaaaaaaaaaaaagaaaaaagaaaaagacggauaaaagaagacagaaacaugggaguauuuccuuugcacaagaauccaaggucuagaaugaagagauggugaaaugaagccagccuccaggaaggugcacugugccuuaaugggaccuggggaugggaaggccaacacagaggugucagcgggacaaacacaaaguguuucuaacaagagcaaagauuuccagucuucucuuuauuuccaaacacucuguagguaaagcagagccucaguaaacccaagaagcagaaaaccuggccuccugccuggggcagcuucaguuuagacuuuucuucauuccuaacagcauaaagaggcugugcaaaugggaggcacucagcagagccugaagaacucuggggucuuagcuccugggaggccacacaugcuugguggcacccugccggucacggugccuccaaaagcucccaaugaucaguggccuuucuuuuuuuucuuuuuuuucuuagacagggucucacucuuugccaggcugcaguggcgggaucuugguucagugcaaccucugccucccagguccagggaguccuccuaucucagccucccaaguagcuaagaccacaggcaagcaccaccacgcccggcaaauuuuuuguauuuuuaguagagcugggguuuugccauauuguccgggcuggucucgaacuccuggccucaagugauccacccgccuccgccucccaaagugcugggauuacaagcaagagucaccccacucggccaguguggcccuucuucaggucaucacuugccagccgcaggcgguggcucugccccucaccggacacgacgucacagccgggaugugaacagcagauucugaucuccaacuccagacaaucacugauuuacuucugcaaaccggagcuguccggucuugcagggucggaccauguaaacaagccugcugccaggcaacugaagacagaaacacgaauaaagaugccccauaaggaaugaaaaacaaaacuccucuugggaaacccagauuugggauucggaaacgggcuugagaucaaccugaagcuucaugacgucuuacuguuuccacugccuuuccuguuccacuacagcaacgcccuccacuucacgugccaaguccugacuuucuccuaauaguugccgacccagcaccccguaggcuguccccuggggacgccgauguccucuggggcauagcguccgcuggcgaagccgggugcuugcccuaagcgcggacacuuccgcaaccgcccaacaguuagcagaagcccaauacaagagacgccccauucuccccaucccagggaaacuucgcuggggcagggguugaaccgagugugggucucguagccgcuuucccaacuuaaggcucugggucugagcaggcucgggacccgccgcccuucucuggcgggggcagggcaggcucaccgcgcguaagcugaagugcggcagggccccuccccgcagcccucccgcgccguccgccgcggcccugcucccucccgguccccacgggccccgcgcccgcgcgcugcccucaccgggcuccagcagaugagcgcgucgguguccgggucgcucacgaggguccacagcuuggucaggaaggccgggacguugcugggccccgccgcgccggggcccacgggcagauccaucucgagcaaggagggaauaggcggagggagcggccgcaaagaggggccgagggccgggcuaacgccgucgccgcgccagccuuccgggccgcgccgccgcccgcugcgcacacacagccccggggcccagcauggccgccgccaucuugcaacgggcgcgcucccgccgc

SEQ ID NO: 192554 - RNA, 20723 nt, Homo sapiens
gcugcgagacgcuaagcggcgccgggcgggagaagagcggagcaguggucggagauguggcgaccggugaggacucucccggcccggggcgcccgagauccugcacaccagccccagagacccgagacccgcaaguccccagaccccgcccuagagacccucggggcuuuuucccucuuuuuuuuugaggcagggucucgcucugucgcccuggagcgcaguggugcgaucuccgcucaccgcagcuuccgccucccggacucaggcgauccucccgccucggccccgcaaguagcugacaccgcaggcgugaccgcucccggccgacucuguuuagcagagucggggucucgccguguugcucaggcuggucucgaauuccugggcucuagcgauccgcccgccucagccuccccgagagcugggauuucaggcgggagccgcgcccgcagcccugacgccgccugcaccgggagccgcaggggccccuccgcccagcccggaggcgggugcccggcgccccggagagcgcgaucuccagagggcaggggccccgcggggaagccucaggcgccguuccccucgcgaggcggccucccggaaucacggacgccucccugcccagccugcugccccggaccuccuucgcucgccuccccgccgggccugcccugcccugaggcggcgggcgggcgggggcugcaggccgggcucugcucugagcgccccugcgucgucucaggggcgcgccccccauggcuccgaggcccccucucucaggcucucggcgucuccccgcucccacgucgccgccgggucccguugcucugucccugcgguuaggacugcgggggggcggggcagaggccuugacacgcaucuuacccacccccuuccagaagagaugaaggggcucccagcgccguuccuuuuuuucuuggaaugucagcagagcuuguguuuggcgauaagcuagccuugcccgucuggcuauaaauagcacagauggacggcccacucgugccccagcccagcugugugaccccagggugcuucaugggccggggagguggccuucagugcagcuccuuccaggugacaaagucuucccacgugcaggccacucagucccuccccagccccagcgaguggacaggucgguuuagccucugguuaggagcugcucauggccagugagcagggcuggguccaggcggcguuugagggcuggcuggggcugacagggucacacacccugggagaaggacagugucuguggucgccagacccacuuacccugcccagacucccaaucugucucuuccuaacuuuggggacaauuaugugccucaguuuccccucauguugaggugcacagugcuguuggguuccccaggcucuggucauccguucaugguuuuuaguuucuggcaucauucugagacucggcaguugcuucucacugcugcggccgggccugucugugggagcugcauccuccucaucugcaggcgcuggaaaaccagacacgaucggacaugcaugugguucugcggccaaagcacgcccuuugguugugaacuucaugauaccugugugaguguuaccacucagaauacuugccgcuuucaagguagucagcuguggucuagagucacucuggaaugggagguguuuccguuugugcagacagacugcacacacucaccauaagaaagcaugagagguucugacagggggcacccguuucaucuuguccaaacuggaaggcuuuggaagucaggggagcugcagggauaagugucaccagggccgucucagguguguggggggaaggcccuggggacccaccgucuaaaagacggcuuaucuucuggcaguuuagaggucguguucugggugcgguuggggcugugugucacgugagaauugcccuggauugggcucugggaaguccuucugggagaugcagcugcaggcucgccccccaacccauaaccucucugggccuuggggaccucuccugugugaugggaauuucagagaggauagucugggugugcugggcgcuccacauuuggaggagacaggcucuugcucagccucaugggcccuggcaggcacuguggguuaucagugccuguugcuuggcagggccaugugggguucaauugaguccugugcuucacagcuguuggucucauucggcaggcauucauugagugccugcuuguucagagaugguugagagguggcccugcucacagucuagugggaggacagauuccguaaguugacagucacgcuggugugugaugaggacaguggcaggauaggaccacggugaacaagguggagcgggacgugagcaugagcaaggcugcugguggaccaggguagggugaugguggcccggggucuacuggagggaucucuguccuggauaagaaugggagugagagacgcagcuggagccccuucugcaaugcugguuccugaggaaagagcagaaaacuguuguuggagacagcagucagccagccaugacuuuccuggccucaccuguuugguggagccuguggaaacagcuugcguugcuggucauggaugaggugggcaguggcugggauagccaccuggagguagcucccuugcagccacuuacgagcugcuguucagagucucuccacaguccgugggcacgacugccugaucucggggccucuagccaugcaugcacuggcaccagagguggcuagggucaggaggugcaggcuggguaggcagcagguggauggcccgccuacgagucgcugcccggcugccuuggguuuuccuugugaaucagcacuugcugcaugugaccucgccaagcagggguuucugucaacccgcccucuagggauaagaggucauggacuuuucccuuuggcuuucauguuguuuggaguccucaaaauuuucuccagggcucugagcucuggccaaaaaccagcuggcaagucaguuccuuacuagguccaguguugaggaccauguuagcgucugugccacggggcaugacuggcuaugcacaguccuuuccccccaaaccgugacuugugugaagagcucucaguuggggaauuuggggaguugugagaccucauccuaggucaagugugauugggagaccaagguuuccagugagagcugugguguuuucuuucuuuuuuuuaauaauacuguaaguucuaugugguguuuucauagucacaaaaauaaagcagggccaugugucaagagucucaugguggggcuucuuuauuuauguauuuauuuuucuaaauggagucccauucuguugcccaggcuggagugcagugucucaaucuuggcucacugcaaucuccgccuaccaagaucaagcgauucuccugucucagccucccaacuaccugggauuacagguaugcgccaucacaccuggcuacuuuuuuuguauuucuaguagagacaggguuucgccauguuggccaggauggucuuaaucuccugaccucaugauccacccgcuuuggccuccaaaagugcugggauuacgggcgugagccaccgcgccugacccuugggacuucuuuacguguguccugcuagcugcagcauguccucuucuccuccaaguaaaagauguacagggucccugucuguggggucucaguaaguuguaaguuucuucaucugcuuucagaacagugaccuacguaggccacuccucccauccgggcguccaccuucaagguuggcgucugcuguaugauuccauggcugggcacuguugccacuuccuucggagaugaggacugcuuuccucuggccacuggucaguggucucagcagcaggaaauaguaaaauaguaaaugacaggucagggugcugccaagagagugcaggggcagggauggggugggucccaucccagaugagccagauggugaugccaucucuuccugcagagacugaggggacauucagagacgggguauguuugaugcccugucagcaucugaggcaucagcccugguuaagcugcguuuagccuucucuccuaugauacuuugacacucagccuugcucccaggagguaggauaguguuuccauuacggaaucaaagaugggaaccuggcuuccuggcaugaucccagcggugcuggcagucuuugcugacugacuuggugaugugguuuggcuuuguguccccacccaaagcucaucugagucgcgauucccaguguuggaggaggggccuggugggaggugaucuggucaugggggcagauucccccuugcuguuguggugauagugagugaguucucagaucugaugguuuaaaaguguguguggcacuuuccccuuugcccucucgcuugcucucucucucucuccgccccccccacugcuucacccauacugugcuugcuucccauuugccuucugccaugacuguaaguuuccugaggccucucaguggugcuuccuggacagccugcagaacugugagucaguuaaacccaggccaggugcgguggcuuacaccuguaauaccagcacuuugggaggcugaggagggcagaucacuugaggucaggaguucuagaccagccuggccaacauggugaaacuccgucucuacuaaaauacaaaaauuagcuggaugugguggcguaugcuuguagucccagcuacucggggggcuggggcaagagaaucacuugaacucgggaggcggagauuguagugagccgagauugugccauugcacuccagccugggcgacagagugagacuccaucucagaaaaacaaacaaaccuauuuucuucauaaauuacccagucuugcuuggguaguucuuuuuuuuuuuuucuugagauggaguuucgcucuguugcccaggcuggaguguaguggcgcgauuucagcucacugcaaccucugccucccggguucaagcgauucuccugccucagccucccgaguagcugggauuacguacaugcaccgcuaugcccaacuaauuuuguauuuuuaguagagacgggguuucaccauguugaucaggcuggucucaaacuccuggccucagaugauccacccgccucggccuccuaaaguucugggauuaaaggugugagccccugugcccggccuggguaguucuuuagagcagugugagaauggacucacacauuagguuuagaguuaggcugccucagacuccagcacauguaagugcugguacugguugagggcaggggcguguccuggccucguucgaccccacacaauuuccucucuuugcaggugcagcucugucauuuccacucugcucugcugcacagaaggcagaagcccuggccguccccugcuguguucuucaggagaaacgucaggggccuuccuccaagguaacgaguccuccacgggcaugcgccucucacccaggcaggcauggauggcgucugugugcaugcagagguggcagucgagggcccaaggcuggaccuucuccuguacccacaaccaaggcaggauauguuugcuccucagugcggugcacugggaccaaagacccccagggacccaugggaccgugcucaggggugggcacacccugaucacagcauuuagagcagacagcuagcaaaucgggaagggugcacauggagcgccugcucugaagagcaaaccgggucauucagagcauggaggagggcggggugacuauaggugggagucacacaagaggaagagcagcaagaagagauguggagggaugggucugagcagaaggaaaggccagacaauguccugaggccagcaaguccggaccacagugcgcagauggacgguggcaaggcaggaaggccguggaggguagauguggccaggcagggcaggcagggugagcuguccaagcgccacuggcucagugaaccuggcaggggucuccuucucccgagagcucugcaguaggacaaccugugucccugggacagaugcggccagcuacagaaacagaugggugcucaggcgccugcggcugggugcagaaacagaugugcacucagacaccugcugcacucaggauuaugggccggguguagaaacagaugugugcucaggcaccugcugcacuaaggauuaugggccggguguagaaacagaugugugcucaggcaccucccgcagucagaauuaugggccggguguagaaacagaugugugcucaggcaccucccgcagucagaauuaugggccagguguagaaacagaugugugcucaggcaccugccgcagucaggauuaugggccggguguagaaacagaugugugcucaggcaccugcugcacucaggauuaugggcuggguguagaaacagaugugugcucaggcaccugcugcacucaggauuaugggcuggguguagaaacagaugugugcucaggcgccugcugcacucaggauuaugggcuggguguagaaacagaugugugcucaggcgccugcugcacucaggauuaugggcuggguguagaaacagaugugugcucaggcgccugcugcacucaggauuaugggcuggguguagaaacagaugugugcucaggcgccugcugcacucaggauuaugggccggguguagaaacagaugugugcucaggcaccugccgcacucaggauuaugggccggguguagaaacagaugugugcucaggcaccugccgcacuaaggauuaugggccggguguagaaacagaugugugcucaggcaccugcugcagucagaauuaugggccggguguagaaacagaugugugcucaggcaccuccugcagucagaauuaugggccagguguagaaacagaugugugcucaggcaccugccgcagucaggauuaugggccggguguagaaacagaugugugcucaggcaccugcugcacucaggauuaugggcuggguguagaaacagaugugugcucaggcaccugcugcacucaggauuaugggcuggguguagaaacagaugugugcucaggcgccugcugcacucaggauuaugggcuggguguagaaacagaugugugcucaggcgccugcugcacucaggauuaugggcuggguguagaaacagaugugugcucaggcgccugcugcacucaggauuaugggcuggguguagaaacagaugugugcucaggcgccugcugcacucaggauuaugggccggguguagaaacagaugugugcucaggcaccucccgcagucaggauuaugggccgggcguagaaacagaugugugcucaggcaccucccgcagucagaauuaugggccggguguagaaacagaugugugcucaggcaccugcugcacuaaggauuauaagccggguguagaaacagaugugugcucaggcaccugcggcacucagcauuaugggcgggguguagaaacagaugugugcucagacgccucccgcacucaggauuaugggccgggugcagaaacagaugugugcucaggcaccugccgcacucaggauuaugggccggguguagaaagagaugugugcucaggcgccucccgcagucaggauuaugggccggguguagaaacagaugugugcucaggcaccugccgcacuaaggauuaugggcuggguguagaaacagaugugugcucaggcaccucccgcagucaggauuaugggccggguguagaaacagaugugugcucaggcaccugcugcacuaaggauuaugggcuggguguagaaacagaugugugcucaggcaccugcugcacucaggauuaugggcuggguguagaagcagaugugugcucaggcaccugccccacuaaggauuaugggcuggguguagaaacagaugugugcucaggcaccugcugcacucaggauuaugggcuggguguagaaacagaugugugcucaggcaccugcugcacucaggauuaugggcuggguguagaaacagaugugugcucaggcgccugcugcagucaggauuaugggccggguguagaaacagaugugugcucaggcaccugcugcauucaggauuaugggcuggguguagaaacagaugugugcucaggcaccugcugcagucaggauuaugggccggguguagaaacagaugugugcucaggcaccugcugcacuaaggauuaugggcuggguguagaaacagaugugugcucaggcaccugcugcacucaggauuaugggcuggguguagaagcagaugugugcucaggcaccugccccacuaaggauuaugggcuggguguagaaacagaugugugcucaggcaccugcugcacucaggauuaugggcuggguguagaagcagaugugugcucaggcaccugccccacuaaggauuaugggcuggguguagaaacagaugugugcucaggcaccugccgcacuaaggauuaugggcuggguguagaaacagaugugugcucaggcaccugccgcacuaaggauuaugggcuggguguagaaacagaugugugcucaggcaccugccccacucaggauuaugggcuggguguagaagcagaugugugcucaggcaccugccccacucaggauuaugggcuggguguagaaacagaugugugcucaggcaccugccgcacuaaggauuaugggcuggguguagaaacagaugugugcucaggcaccugccccacucaggauuaugggcuggguguagaagcagaugugugcucaggcaccugccccacucaggauuaugggcuggguguagaaacagaugugugcucaggcaccucccgcagucaggauuaugugccggguguagaaacagaugugugcucaggcaccugcugcacuaaggauuaugggccggguguagaaacagaugugugcucaggcaccugcugcacuaaggauuaugggccggguguagaaacagaugugugcucaggcaccugcugcacucaggauuaugggccggguguagaaacagaugugugcucaggcaccugccgcacucaggauuaugggccggguguagaaacagaugugugcucaggcaccugccgcacucaggauuaugggccggguguagaaacagaugugugcucaggcaccugccgcacucaggauuaugggccggguguagaaacagaugugugcucaggcaccugccgcacucaggauuaugggccggguguagaaacagaugugugcucaggcaccugccgcacucaggauuaugggccggguguagaaucagaugugugcucaggccccugcugcacucaggauuaugggccggguguagaaacagaugugugcucaggccccugcugcacucaggauuaugggccggguguagaaacagaugugugcucaggcaccugcugcacuaaggauuaugggccggguguagaaacagaugugugcucaggcaccugcugcacuaaggauuaugggccggguguagaaacagaugugugcucaggcaccugcugcacuaaggauuaugggccggguguagaaacagaugugugcucaggcaccugcugcacuaaggauuaugggccggguguagaaacagaugugugcucaggcaccugccgcacuaaggauuaugggccggguguagaaacagaugugugcucaggcaccugccgcacucaggauuaugggccgggugcagaaacagauguguucucaggcaccucccgcacucagcguuauggguuuccugcugguuucagcauauauggagcugcuacuguguucagcauagguagagcuccugcuguauucagcgaguauugggcuccugcuguauuuggcaaguauuggacuccugcuguauucagcgaguauuagacuccugcuguauucagggaguauugggcuccugcuguauucagcaaguauugggcucuugcuguauucagcaaguauugggcuucugcuguauucagcguguauggugauccuacuauauucaauauggggcaagcucuguuucuugcucuguacugucaugcgacucagcacgugccgaccgcagcaucuucucugucucugcugugcugaugaccauccaguugaauccugcgagguggacggugguugugauucuccacaguguaggagaccacgguccgugaggagcacagaccugccauugagcugcuuccuuuaccugaggagccauuuccaugucccauggcccauuggcugcgucucuggacagaccugaaugagaccugccccuuauggccaucuggugccgggcuuuggugcaggggcaucuggugcaggggcucagggaaggggacgcugaugcggugguguucucugcugaccacacgucagaauggcugugcacacaggagugagacguggugcugggggaggugggggcagagaucagagcccagcugaauguggggggcggcgccuccaggcugcauugucucuccucagguucuccagccccacaccccuguggaggaaggugcucuccaccgcgguagugggggcgccccugcuccucggagcccgcuaugucauggcagaggcacgggagaagaggaggaugcggcucgugguggauggcauggggcgcuuuggcagguaggagggccuggcggcaggcagggguugcggcguggcgggcggggugugugcggugcaggauugccugcuccagaugccuucacagacgaggggcgugagccugggaggccugcagagcuugcugaggauuuuacagcugcuuuucaggcguccuuuccuacaugggaaggugcuggcugaagggacagugagcacuggcggggccuauaggaggugguguagacaaggguccuccacauuggaugcagccgccacaggcccuucccuaguucagccuuggccuuaguggggaggcgcuccagcccugggcccgugccuucucccucaggcuucuaggcuggcagagaagcagcugcccugccuuccuucucuucuugccccauuccaagguuugggccugggagaggaggcugccucugucccuugcccuggagaugggcaaaaucggguuauugcugucagggcccuuucuuccuccauuaccuuacagugaagaacucagggggagggugaggacaccuucuguuggaacccuugggugggcauuccugcuuuugucagaucccggaauuccugcagccacaaagcccugcuagccugagccugguggaaccagcucuuggcuuugagagaaaccuguuagcccaaagcccuuuuuuuuuuuuuuuuuuuuuuugagacagagucucgcucugucacccaggcuggagugcaguggcgcaaucucggcucacucaagccccgccucccugguucacgccauucuccugccucagccuccugaguagccgggacuacaggugcccaccaccaugccuggcuaaauuauuuauuuauuuauuuauuuauuuaguauuuuuaguagaaacgggguuucacuguguuagccaggauggucucgaucuccugaccucgugauccacccgccucggccucccaaagugcugggaugacaggcgugagucaccgugcccagcccccaaagcccuuuugaauggagcgucagggcaggaaggaggcagggagggugugguccuguucugccugccuccgagcaucugccaggccuaggucaguuucucagcaagugccucggcuucuggugccuucagagauuucaccagaaguuucacagaaauuuccuccagcagugaguggaagcuuguggauagcugggcaccugaggauuuucagccuaaaagacaaaacagucguuccccacgugggucucccuggcaucugguuuugcuuggaguuccugcugucccugccugcagauuuuggguggcauugucugucuugcagggccauccagucucgcagccuggggugggugacgacagagccucggguccucugccuuuuucucgugacccuccgcugcagugcaugcaagggccacacagggcugccagccaccguccccugcagccugguucugaaaugucggcuuggcaggccuggguuugucucacccucuauuucauggcaugcagcugugucugguguccaccuccucggccaccggcuuggugagccugcguuuugggcucacuuugugggaaaacaucuucucacagcucgcucucaggggcugagcugggguugcagggagggaccucuguuguuaauuuucccagcagucugcacguucuccuuggcucuaagccgucacgguugcauagacaagcaggccuguggagcuucccuggcagggcacaggguagccugggaacacauccugggugacagcagcacccaugcaggggcccaggaaggagcgcgggugaggagcauggcggggccagugcaccaugagaaaaggcagcagaggucagaacaggccacagguacccaaaugaucaggggcugcccaggaagguggaagguuugggacaauguuucucugccucagagcccugucuuuaaucucugccacuccuuacauuuucuuuuuuuuuuuuuuuugagacggagucuugcucugucacccaggguggagugcaguggugcgaucucagcucacugcaaccugugcucccuugguuuaagcgacucuccugucucgccucccaagcagcugggauuucggguguguggcaccacgcccggcuaguuuuuguauuuuuaguagagacaggguuucgucauguuggacaggcuggucuccaacucuugaccucgggugaacugcucagcucggccucucaaagugcugggauuacaggugugagccaccacaccuggcccuaaacuuaaaucaccaccaggcgcgguggcucacgccuguaaucccagcuacuuugagaggcugaggcaggggaaucacuugaaccugggaggcggagguugcagugaaccaagaucacgccauugcacuccagccuggaagacagagccagacccgucucaaaaaauaaaaauaaaaaauaaaaucaccuauauguggccgggcaugguggcucacgccuguaaucccagaacuuugggaggccgagguggguggaucacgaggucaggagaucgagaccauccuggcuaacauggugaaaccccgucucuacuaaaaaauacaaaaaauuagccgggcuugguggcgguugccuguagucccagcuacuugggaggcugaggcaggagaauggcgugaacccgggaggcggagcuugcagugagccaagaucacgccacugcacucuagccugggugacagagcgacucucugucucaaaaaaaaaaaaaaucaccuauguguuuugcuuucccccaccgccccuuuuucuuuuauuuuuuggagacagucucacucuguugcccaggcuggagugcaguggcuucgucucagcucacugcaaccuccauaucccagguucaagcaauucucaugcuucggccucccgaguagcugggacuacaggugugcgcgccaccaugcccggcuaauuuuuuauauuuuuaguagagaugggguuuugccaugaugcccaggcuggucuugaacuccugaguucaggugauccguuugccucagccucccaaauggcugggauuacaggugugagcuaucauaccugaacuaaauuuaacuuuuuuuuaaaaauuuuuuaauuuuuuauuuaacuuauuuuuuuuuauuuuuugagauggaguuucgcucuugcugcccaggcuggagugcaauggugggaucucggcucacugcaaccuccaucucccggguucaagcgauucuccugucuuagccuucugaguagcuggaauuacaggugcccaccaucacgcccugcuaauuuuuguauuuucaguagcaauaggguuucaucauguuggccaggcuggucuugaacugcugaccucaagugaucugcccgccucggacucccaaagugcugggauuacaggcaugagccaccacgcaggccaugccuggaguuuuuguugggguauuaauacuugggcgggauugauugaaaaucuccaguuucucagaaaaucccaggaauucaguuuccagccccgguccucccgcucccauccccgugggccccaaaguggugggucuucgcccugagucccuucuuagcauaagcccucagggccaccauggaaaacagaggcacuccuuaucacucaggaaaucccaaggacuuaagaagggacaaaggucaguccucuguuuggguaaaguuaauucuucauugcacaugauuggacaccuuugaagauuacaggcuuguaaguauuguauaacaagagucagcaaacuguggucccugggccaagugcaggggccuaguguggcagcugucugauuugcaaauaaagcuuuauuggaacacagccaugcccaugcauugccugugaccacuuggugcacaguugcccaugugcucaugcguggccagagugccuaaaauaauuaccaucucaucuuuuacagaaauauuucacugcuucuuauuuugucaguguggguuugucugauguuugcuuguggucauauucgucaucuguuuuggcaggaaucacacaggagugacacugcuucuguccugccgggggcacaugauuucgguuucccccauuugauucccuuguaauuagccguauggaggcaguugagaugaugugucuguucucacugcuccuccacccagcaguuuguuuguuucuuuauuuauuuauugagacagucuugcucugucacucaggcuggaguacaguggcaacaucuuggcucacuucagccucugccuccuggguucaagcaauucucccagccccagucuccccaguagcugggauuacagacaccugccaccacacccagcuaauuuuuuuuuaauuuuuaguagagaugggguuucuccauguuggccaagcuggucuugaauuccugaccuuaagugauccaucugucucagccucccaaagugcugggauuauaggcaugagccacugcgccuggccuccacccagcaguuuagcacucauugauacuuuuuuuuuuuuuugagacagaguuucacucuuguugcccaggcuggagugcaauggugggaucuccgcucacugcaaccuccaccuccuggauucaagcgauucuccugccucagccuccuuaguagcuggggauuacaggcacacgccaccacacccagcuaauuuuguauuuuuuaguagaggcggguuucucuguguuggucagacuggucuugaacuccugaccucaggggauccgcccgccuuggccucccaaagugcugggauuauaggugugagccaccacacccggccuccaacauuuugugaaaaacuucaaacauacagcaauguugaaaaugcucugugaggcaaugugaaaugcaaugugaaaaugcuuugggaggccgaggagggcggaucacgaggucaggaguucgagaccagccugaccaacguggagaaaccccaucucuacuaaagauagaaaaauuagcugggcauguggugggcaccuguagucccagcuccucgggaggcugaggcgggagaauugcuugaaccugggaggcggagguugcagugagccuagacugugccacugcacuccagucugggcgacagagcgagauuccaucucaaaaaaaaaaaaaaaauuaaauuccuucucccccaagcacaagucugugggacuuuuucacaucuuuaaguuuuguuacaaaaguguuguguuuacuauaacaaauuuuaauaguagaaaaguuagagccgggcacgguggcucacgccuguaaucccagcacuuugggaggccaaggugggcggaucacgaggucgggagaucgagaccauccuggccaacacggugaaaccccaucucuacuaaaaauacaaaaaaauuagccgggcgugguguugggcgccuguagucccagcuacucuggaggcugaggcaggagaacggcgugaaccugggaggcggagccugcagugagccaagaucgccaccacacuccagccugggcgacagagcgagacuccgccuccaaaaaaaaaaaaaaagaaaccgaaacccuggccuaacccaagcacgcacuccagaugcucuacgggggccagaguggggccugaauggccggggggucgcccuggguugaugggggacacagaguccaccugagcgccagagcugcgcuucaggaaugacugugggcccuguccccaggcagguacgugagcuucacagaacgcagggacaggccucuggccauggccagccuuggagaagccacucugaccucagccccucccugugcaccuguguguggucugcccgcugccuggcgccucauuccagggcugcccagcugguccccagaguucucccagggcucccacccugauauccuccuaacuggggccaggccuggggacaccccucuaccccauccucuugccuaaaucucccccaggagcccaguaccugcucaacagauacccaggaugucccccacuuccugccuuaacugggcucucuucccugcagaccuugccuccccaggccuuggagacccacccuccugguguccuccucucuuccuaguggaccucaggcugcaggugaccuugacccuccugugaccucugcugccucagcccugcccccuugcugccauccuuuaccuucacagacagccuuggaaccccaucucuccagaggaugccaccguccauacuguccccuaccccaucucaccugggcacccuugaggguggcagggagugaggguggcauggacacaggcugcccauucugcagaucuuuuuuuguuuuuugagacggagucucgcucugucgccaggcuggagugcaguggcgcaauuuuagcucaccgaaacccgccuccugacuucaagugauucuccugccucagccuccugaguagcuggcacuacaggcacgcaccaccaugcccagcuaauuuuuguauuuuuaguagagacuagguuucaccauguuggucaggauggccucaaucucuugacuuugugaucugcccgccucggccucccaaagugcugggaucauaggugugagccaccaagcccagccucuuuuuuuuuuuuuugaaaccgaguuucgcucuuguugcccaggcuggagugcaauggcgcgaucuuggcucacugcaaccucugccucucggguucaagcaauucuccugccucagucucccgaguagcugggauuacaggugugcaccaccacacccggcuaauuuuuuuguauuuuaaguagaaaugggguuucaccauguuggccaggcuggucuugaacuccugaccucuggugauccacucaccucggccucccaaagugcugggauuacaggcgugagccacugugcccagcucugcagaucuuuuuuggacggagucucgcucuguugcccaggcuggggugcaguggugcaaucucagcuuacugcagucuccaccuccuaggcucaaacgauccuccugccucagcuuccugaggagcugggaccacaggugugcaccaccgugccugccuaauuuuuuugcauuuuugguagagacaggguuucaacauguugcccaggccagucucgaacuccugagcucaagugauccucccagcacagccucccaaugugaugggauaauugacaugagccaccacaccuggccccguucuacugaucuugagcugagacugaccugcagggccacaggacaccccacgagcucagcagcaccccuugugcucacacaggccuacgcggcuguaggcuggacccuggcuuggccucacccuugggacaugaagggcuggccggggugaggcuagaccaugagggcucugacaagaggaccaagcaccggggccccgagccugccccgcuggagacugaggccaccucugcccgcaggucucugaaggucggccugcagaucucccuggacuacugguggugcaccaauguuguccuucgagggguggaagagguuuguccuggugcccugggcacacaguggugggcaugagguggugggcugggugggacugaggaggcagccaccuguccccauguguucuccccaugccuguggucagaacagcccaggcuacuuggaggugaugucugcgugucaccagcgggcggcugaugcccugguggcaggggccaucagcaacgggggccucuacgugaagcugggccaggggcugugcuccuucaaccaccugcuuccccccgaguauacccggacccugcgcgugcuagaggacagggcccucaagcggggcuuccaggaggugagugugcgcucaggccgagggagguggggccuccagcaguggccccaggcugcucugagcaccuguccuuccagguggaugaguuguuccuugaggacuuccaggcccucccccacgagcucuuccaggaguuugacuaccagccaauugcugccgccagccuggcacaggugcacagagccaagcugcacgauggcaccagcguggcugugaagguauaugggggcugccuuguucagcagugggcuggggcggggcacaguggggccccaaguucucaccacacccucgcccagugcaggugcaguacaucgaccugcgggaccgcuuugauggggacauccacacccuggagcuccugcugcggcucguugaggucaugcaccccagcuuuggcuucagcuggguccuccagguacagccccaccccuuccccggccagcaggagcaaacacguaggcagagcugguaggagcagcugguaggcagagcuggucuucaaccgccaucuggcccccaggaccugaaggggacccuggcccaggagcuggacuucgagaaugagggccgcaacgcagagcgcugugcgcgggagcuggcgcacuuccccuacgucguggugccccgcgugcacugggacaaguccagcaaggugggcugggccaggcccuuggggugggcacagcgcugggccugcugagcccagccucuugcucuccccagcgcgugcucacugccgacuucugcgccggcugcaaggucaacgauguggaggccaucaggagccaggggcuggcagugcaugacgugagugcgggggggcgggggcgggucagggcgggcuggugcuguguccacugcaaugccucuccucuccccagauagcagaaaagcucaucaaggccuuugcugagcagauauuuuacaccggcuucauccacucggacccacauccuggcaacgguaggaauuuaccccaggggugggggucucggggugggcgcagcgcgaccuaagaggcuguaucccuaguucuggugcggaaaggcccggacgggaaagcggagcuggugcugcuggaccacgggcucuaccaguuccuggaggagaagugagcgcgggugggugggcguggggcagggcaagccucuccugccgcagggagcucauggcugcgggcccauccacacccagggaccgcgcagcccucugccagcuguggcgggccaucauccugcgggacgacgccgccaugagggcgcacgcagccgcacugggggugcaaggugagggggugcaaggugagggcgugcggggauggcuggggcaccacagaagggagucgggcggcgcggaacccacucagagcccccucccucccucccucccucccuccccagacuaccuccuguucgccgagaugcucaugcagcgccccgugcgccuggggcagcuguggggcucgcaccuacugagccgcgaagaggcggccuacaugguggacauggcccgcgagcgcuucgaggccgucauggcggugcucagggagcugccgcggcccaugcugcuggugcugcgcaacaucaacaccgugcgcgcuaucaacguggcccucggcgcccccguggaccgcuacuuccuuauggcuaaaaggucgguggcccgaggaggcgcccgggccgugguggggcugguguggggcugacgcggcgcuaacgcgggugugugcagggcuguccggggcuggagccgccuggcgggcgccacguaucggggugucuacggcaccagccuccugcgccacgccaaggucgucugggagaugcucaaguuugaaguggcgcucaggugaguggccgcggggcagguggguggcgggggccugcuccccacccaccugugaccugugaccugacccacgcaggcuggagaccuuggccaugcggcugaccgcccuccuggcucgugcucugguccaccugagccucgugcccccagcggaggagcucuaccaguaccuggagaccuagggugcagccgcccagggccggcggggcccuuuucaccuugggcugacggagguggcggggcuagagguguagacaccccgagccccgugggcacucgcacuggggggcugugacagcagcugggccaggaggccguguaaugaccacacacuccucucaagcaa

SEQ ID NO: 192555 - RNA, 15704 nt, Homo sapiens
cggaaguuugcggggcggggcggacgcggguggccaaggcccguuuccggcggcgucgcgcguuugcgagccucgggugguccucagggagggugagucggcgcggcgggcgcggacucggguugcccucgguccgagugaucccuggucgcuuccuuagcccucccgccuucggcauugggguccccgcgucccccgggccuccaggcgggaaagcgcgggggcuuugcggggccuugagcgccuggugugggagguggucgagcccagccacccucccccgcggcggcgcgaggugggcuucguuuggccgagucucgcagcuccccgcagaccccgcucguggcggccacgguguccggggccugaguaaggcgagcuccagcugcggccuuuucuucaggccugggucuacucccggggcccugacuccuccugcgaaaucaccuccuucuagagccuuuucucuuucuauuuauugccccggaaggccuaggauaagugacaguggaggaaggaacggugccuugggugggguaggcuguuugucuucucuaaauucugguugcuauuccgggcauuccuacugucaggagccagguggggggaucagccuaccugugccggugaccuggggcuuccacccacaaaccacuuucugggccagaagcugccauacgaagacucuuuuucccauuccgaccucccgggggaaugccugggcagguagagggucuggggucauuggcuuaauugaggugaacgauuuauaucagauuacaucccugugccugguuccauccuggcgacaggugagcuggagacuggaauuuauguacuugagggcagggguuuccauguccacucuugucuucccuacaguuugucauuuuugcuccugccuucuccaaccuccagucgcucacugccuuccccaaccuccagucgcucacugccuucccuugcugccgggaauuuacccacacugguucauccaaccccauuucuucuugcuucaggcccuuucacaugcuauuccugcugccuggagugcucucuccaccuccauuaccuuggccgaggucccuggggaagugacccauuacacugaacguucuagucuaaguggcuuucauaguucccuguacuugagcgcugucgugguugcagugugcuuauuugugugguuauuuaacucuuuccuccgccagacugcuucgugaaggcaggguccucguguccacuacuguauccccauuacucagugccuggcacguggcauccacuucuuacggcuuuguggagugagucacacaugccacacacacauacacucuaaagaggaacaagaguucagugggccuccuucacucaagugccauggcugcuucagcccagccccaugucccugcuagagaaaucuggggcuggagguaaaggagcagagagcacaguacccccuugauuagccuggaaguugggcuucuggcaccuugaccucuaauccuuucauaauugccaacaggucucucggccagaacacguggaugcccacccaccacugagccucaugguaggaagcuugacugccuccuuccccucgcauguccugugaaggcccaccuccugcucugcccacuggcccugggcccagacccuaccuuggcccuugcugggcuuaggaaggcccccuugcccccaaccccaagguagugagcaaaccccugcccaaaccagggccuaauugaggcucuugaggggggaggguuguaugaccaccauggacuggguuccuuccuccuccccgagacugccccuccccagaauauuagaggcagaggaguccuggugagcgucucgcccaaccccauggggcagcugccugagacaugucaugaggcagcgccagaagggggcuggcacccagggauuccuggggugcugguguguguccuuucaggaggugguaacauuuggcgauguggcugugcacuucucucgggaggaguggcagugucuggacccuggccagagggcccucuacagggaagugaugcuggagaaccacagcaguguggcuggacuaggugaggcugcaccuuggggccccuuccccugcaucaucagucagcacccacccagccaggccuccaucagaggcugggguaugcaggccaaacgcucagacccuugugggcuccacagggggcuuggacucaugaguggugugccaggcugguuccuagcuuugcccaugucaugggguucagcccccagggagugggugggauucugggaguuaguaaagccucuuuuuuuccuaagcuguuaaauugugagaaauagaauccaaacuugaaauagcuuagacaagaaaagagaaauuauuggguggagaaauccaaggaaaagguugugcaacgagcaagagguggcagcgacgcccacacggcugcuuugcagaugccgucauccccuugccccuccuguccugccguuagucuccucucugaacuccaccaccgccacaggcagccacugcggugcucuuuauguccaugccuguguccucacaagcuguauacugucguuggauugcaacuuggugagggggggugcgucuuaacuugggccuugcugggccucuugccugugacuaagcccucugcugcaucacacgcccgagagagugccugggcugggggaucaggaguggaacugacgcgggcaucguugguuggccaggagcuucuugggguguuggaccaggccugucccccucugucccggcuagucuggcaaaguccagcuuucuguuuugccagucagauaaguguacagugggaggcuguuguaguuugaguuugcauuucucugauuucugcugagcuugagccuauuuucacacccucauuagcuugccagguucuucugugaaauaucuguucagggcauuugcccauauucuagguccgcugugucuuauugcuuugaagguguuguuucuucauucugucuaagaugccuuacuuuguaaaacauguaguuauguacacaucauuauuuuaagaaaguuggaaugcuacugauuacacgcauuuuuuaaucauuuaauuuuacuuuauacuuuuuaaagagcccucuuagacucauuuagaugugguuuacccugucucacugaaauaggaaaagacacaugcagugaggguccuuuuuuuuuuuuuuugagauuuugagauggagucuugcccugucacccaugccggagugcaauggcgcgaucuuggcucaccgccaccuccgccuccuggguucaagcgauucuccugccucagccucccgaguagcugggauuacaggugugagccaccgugcccagccggaguaaggguacuucuaauguuucuucacagcuuuuagugaccccacucucugguuugguuaucuguguccaugcuuuccacgugauggcaaccugugggccuggccaucuagaggugcugcagcuuuucguaagugguguugggguuuucuucauccagugagcuuggugcuugagcuuucuugcuuggcauguagcagcuccaucugcugugccuguccuccucucucaggcccuguguguacacaguugcugauguaccaguaacuggaauugcagucauucccccagcagcaguuugcuucuccaggcucaaagguacagcugcuguucuuuuuccauggcuucugucuauuuauaacguccugcugcugugccaagucacaggguaaagcuuuugaagacaguguagagagcagcugaauucagcauguauuguaugauggugcuggugacuuaccugcagcagugacugagcagcuggggcaagcucgugugugcacaggcagugauggugugucacagcugccaccuggcggaugacaucaauuccuagaugcguccaagagaugggaaaggguuuuauaaaaacacuaucuuagggccgggcgcgguggcucauaucuguaaucccagcacuuugggaggcugaggcggguggaucaugaggucaggagaucgagaccauccuggccaacagggugaaacccccgucucuacuaaaaauacaaaaauuagcugggugugguggcgcaugccuguaaucccagcuacucgggaggcugaggcacgagaaucgcuugaacccuggaggcggagcuugcagcgagcugagaucgcaccacugcaauccggccugggcaacagagcgagacuccaucuaaaaaaaaaaaaaaaaaagacuaucuuagaauuuauaaaauaugguaaguaccagguuaguuuuguuuauuauaaaucacuuuuucagccggacaugguguugcaugccuguagucccagcuacuggggagagcgaggagggaggauugccugagccuggaaggucaagguuggagucagcuaugauugugccacugcaguccagccuaggcaacagagugagacccugucuaaaaaaaaaaucuucucugcuucuuuuguguuuguuaacuuuguuaggucagauuuuaauguaauuacuguguuuuugccuuauggauugucucuuugaaguuuuauuuaaaaguucuguccgggcacaguggcucacaccuguaaucccagcgcuuugggaggccaaggcgggcggauugccucaaaucaggaguucaagaccagccugggcaacacagugaaacccugucuuuauuaaaaugcaaaaaaaaaaaaaaauuagcugggcauggcaguguacaccuguagucccagcuaauugggaggcugaggcaggagaauugcuugaaccugggaggcagagguugcagugagccgggauugugccacugcacuccagccugggugacagagcgagacucuaucuccaaaaaaaaaaaaaguucuucccuggcugggugugguggcucacaccuguaaucccagcacuuugggaggccgaggcgggcagaucaccugaggucagaguuugagaccagccugaccaacauggugacaccccgccucuacuaaaaauacagacauuagccaggcgugguggcgggugguuguaaucuuggcuucucaggaggcugaggcaggagaauuccuugaacccaggaggcagagguugcacugagccgagaucacaccagugcacuccagccugggugacagagugagacuccgucucaaaaaaaaguucuucccuccuccaaggucacugagaugggcuucauuuucuccuguggauuuuauaguuuguauuucucaucuguaucccagcuccacauuuguauugggguuacguaaaaaucccuguuuuauuuuguccacacauagcuguuuuccccaacaucaucuauuaaacagucuccuuggccaggcucgguggcucacaccuguaaucccagcacuuugaaguaggccgaggugggcggaucaccugaggucaggaguucgagaccagccaggccaacauggugaaaccucaucucuacuaaaaauacaaaaauuagcugggugugguggcucacgccuguaaucccagcuacucagaaggcugagacaggagaaucgcuugaaccugggagguugagguugcagugagcugagaucgugccacugcacuucagucugggcaauaagcgagacuuugucucaaaaaaaaaaaaaaaaaaagacuaucuccuuuuccuguugacauguggagccaccauuuucaucuaugaaaugggauguuucugaacccuguucucuucccugaaucucucuugugggccagcuuccugcuuuugguuuguuuugguuuuuuuuuguuuguuuguucauuuguguuuuuggcuuuuuuuugaaauaaagucucacccugucaccugggcuggaguacaguggugcgaucucggcucacugcaaccucugccucccagguucaagcaauucuugugccucagccuccugaguagcugggauuacagcuacucaggcaugugccaccacacccggccaauuuuuuguauuuuuacuagagaugggguuucgccauguuggccaggcuggucuggaacuccugaccucagguuauccacccaccuuggucucccaaagugcugggauuacaggugugagccaccguaccuggccaguuuggcuuuguuuuuuauuuuggggugguuuuuguuuuuugcuuuaauuuuguaguguuucuuaauacuacaagaauacuaaaagaauuaaacucacccguuuaauucuuuuuuuucugggacggaguuucgcucuuguugcccaggcucgagugcaauggcgcgaucucaguucacugcaaccuccggcuguuggguucaagugauucgccgccucagccuccugaguagcugggauuacaggcaugugccacuacacccggcuaauuuuuauauuuuaaguagagaugagguuucaccauguuggccaggcuggucucgaacuaaccucaggugauccgucugccucgaccucccaaagugcugggauuacaggcuugagccaccaugcccggcugcauacuaauuuuagaauaaguugaguuccuaaaagccacuggaauuuuuauugggagugcuuugaaacuguuuucugucaauguaaaaguuuugauuuuuuugcuuugugaauguauuuuuagcugauuauugcuguaguacaaaaaugcuguugguucuggaggaugaucuuacaucuggcaacuuuguggaacucccuggguaaaucaguguugcucggugauucugcuguuuuccagcaggaggauuccugcaaaugagaguuugguauuuucccucccagcccucacuccucccaucucugccuuugcaguggccagcacaguguuaaacaggaccgugugggcauguuguguuccugauuuuaaagggaaugcaucuacauaaccacagaauuuggcuaaggaguuuuuuuuguuuuuaaucauaaauacugaauuucaaauucuuuuucugcaucauuugagacacgugauuuauuuucuuuauuaaugcaggaaauuacauuguuauauuuucuuguauuccuggaauaagccuuacuuaaaucacgauauuuauauauaaauuuugauaugccuuuggauucaacuagccaauauuguauuuuuguguuucuguucauaagugaaauggauauauauauauauguauauauauuuccuuuuuuuuuuuuuuuugagacggagucucgcucuguugcgcaggcuggagugcaguggcgugaucucggcucacugcaagcuccgccucccagguucacgccauucuccugccucagccucccgaguagcuggcacuacaggugccugccaccaugcuuggcuaaauuuuuuuguauuuuuaguagagaugggguuucacuauguuagccaggauggucuugaucuccugaccucgugauccaccugccuugggcucccaaagugcugggauuacaggcaugagccaccacgacuggccuauguuucuuuuuguguauuguccuuauguaauuuugacauguuugauaaauggcauuuggcauacaaguagaacuugguggagcuaaucuguaaaaccaucgggaccuugagcuuuuggggaaggaaagucuuggauuagcauuuaugcauuuauauuuucuuuuuuuuuuuuuuuaaagaguugggguuuugcucuguuguccagccuagaguacaguggugcgauuauagcucacugcagccuugaacuccugggcucaagugauucuuccacuugaguuucccuaguagcugggacuauaggugugcgccaccaugcucagcuguuuuuucuuucuuuguagaguuggggucugucauguugccgcaggcuagucuuaaacuucuggccucaagcaguccugccuuggccuuccaaaaugcugggauuauaggcaggagacaccuugccuggcauuuccuuugguuuuaaucuguuauauuuguaauugugucucuuauucucuguuuuuuggcagcaucuucucacuaaguggaccuugauugguuuugucaucagucauauucauguuuucaaauaacuggcuuuugguuuugccuuuuuugggggguuggguuggaggauguuuuuauuugucuuuguucucuagcucucugaauccugccccggauuuauuauuuucuuccuuuuuauuuaugugaguuugaugugugugguguuuguuuguuuugcuuuuuuaauuuuuugagacaaaguuucacucuguuucccaggguggagugcaguggcuuacugcagccuggacugccuggguuccagcgauccucccaccguguuggccaggcuggucucgaacuccugaccuucaggugauccacccgccuuggccucccaaagugcuggaauuacaggugugagccaccacgccuggccauucucaacuucuugaacuuacuauuuaccucauuuguguuuuaaaaugaucauuucuaguaaauguaucuaaaaguauaaaauuuuucuggguauaguggcauaugccuauaaucucaguuacuuaggaggcugaggcaggaggauuguuugagcccaggaguuugaggccagccugggcaacauagcgagaccacaugucugcaaagaauuuaaaaauuagcuggguguggugucacgcaccuguaguccuagcuacucaguagguugaggcgggaggauuggccuaggcuauagugagcugugauggugccacugcacuccggccugagugcuagagcaagaccguaucucuaaauaaauaacauuuuaucuuuacauacugcuugggcugcauccuauaaauucugacucauaauaaauacaguugccacuuagucauuuauuauguaguuuccaaguagcuaauggcaucuaagcaccauuuuguggugaguuucacacugaguugcauuugccugggcgcguguucugugguauguucuuuggcaugucugugacucaguuuguggcuugacccaaggcuguuucuuuguuccacauguacuuggagaggauaugcauuuucuguugaauguggaguccugccugcaucuggggguuucagcuuauuggcuauaggccuuuggaaucucugccugccucuuuccuuccaguugggggaacccugaaggaagcuucuaaacagaggccuuggcuggcccauggaucaacugcucaucucuguacugaccggcacaaagaggguaugggggcagguggccccaagaaggcagggugccaggugggcccccacaggucucugccacccagucugcagcgagggaggcaggcccugaggcauccuuugugcagggacuugaggcuggaaggacacuggcugaggacuggaccuuggagcuuucugaugcaaaaugugcuucguuugugucuauucaucguuguuuguuaccuuauuuuguaaccaccccugccucuuggagcaucucugcucucugaacugagggacaggcccgguucugcuaagugaagcuugggcuucuccuucucuuucccgaguuccagggguagaggcggacuguccuuugcagacuguuuggugacagggucgccuggagauugugggagucagguaucccuugcuguccagccacaggagguggacagaucuggacagaaagggcugcuguguccccagauucuccccacccuccacccacucucccugcaggagcuuggccugugccuuguagccccccugccccuuuccauuuggaaacuggggaagacuuagcccugugcugcacacuucccgucaugcugacacuguugucuucucugccgcacacacagcaggauuccugguuuucaagccugagcugaucucucggcuggagcagggagaagagccauggguccucgaccugcagggagcagaggggacagaggcaccaaggaccuccaagacaggugaggcuuagaucccaucgcagagaagcccuggggugaggagaaacugcaggaggggccucacaacuguggguagcugugggugagucgcgggggcuacacugggaugccugggaaugcuacuggggaagcagcauccagcaccuagaagggagcauagacccguuguggggcugccuugggagaggccaaacugcagaagagccaagacacaaaaacccaugcauuuccacaaaaacggagcuuguuuuugaaucaugucacauuuuguucuauuuuuaauuuuacucauacuuucguuaagcaaagauacaaaccuauggauccaagugaaggguuagguuuggcauucaguaaccucuccucggguaagcauauucccugaggcagcucccuucagacccucucaggcuccaggagugcauuacuuuccuguggcugccauaacaaugaaccacagacuaggaagcuuaaaacaacagaaauuuauugucucacagcuguggaggccggaaaucugaaaccggggggucagcaagcagggccgugccccccugugaaggcuuuagggaaggauccuguccugccucuccgggcagcuggugguuuucuggcaguccuuggguuccuuggcuuguggaugcgucccucacucugaucuccgacuccuucacacggcugccuucucccugcgugucuguguucauguggccaucuccuuagaaggacaccagucaugguggguuaggggccaccccagugaccucauggugacuaauuaaucugcaacgacuguguuuccaaacaaggucacauucugaggugcuucaaguuaggacuucagccuaucuugggguccucagcccuaaccagggcacccacugccuccggcaucagcuccugcugggcaggcgcccggccuggugcucugcuccccugcuuagccggugugcugcccagcaugacaagggagaugggucugcgugcaucucagcugcagaaaggaagccccucaccucccuuucaguugcugcugggucaucaccgucacuccugcagcagggcaggaccagguccuacagaggccaccggcuuguaggggccucgggaagcaaguuggacaguccaaaguugugaaaaguaggggccguggagccgggcaugguggcucacgccggccauucuagcgauuugggaggccgaggugggcggaucacgaggucaggagaucgagaccauccuggccaacacggugaaacccugugucuacuaaaaauacaaaaaauuaaccaggcgugguggcaggcgccuguagucccagcuacucgggaggccgaggcaggagaauggugugagcccaggaggcagagcuugcagugagccgagauugcgcuacugcacuccagccugggcgacagagcgagaugacgucucaaaaaaaaaaaaaaaaaaaaagcaggggcugugaucuuacuuccauucauaugcgccuaggggcugugaccuuacuuccauucauaugcgccuaggggcugugaccuuacuuccauucauaugcgccuaggggcugugaccuuacuuccauucauaugcgccuaggggcugugaccuuacuuccauucauaugcgccuaggggcugugaccuuacuuccauucauaugcgccuaggggcugugaccuuacuuccauucauaugcgccuaggggcugugaccuuacuuccauucauaugccccuaggcagcuucaaaggacaaggaggguuucugagccucuucacgcccugugggccuugcagccgcccaggaagucugcaugugaugugugggaagaguggucaggaacccuggccucacuggcucugcuggcuacucccaugugauccuuucugcucagucucccugagaaggagguucagcuauaagguggcccaguuaaaacccagccgcccauuaaaaugucuccaacauggacaggagcguuuaaagagggugccauggcagaaaagccagcuacaguuggcagaaauaguucaguggguuuauauguagcaggugguccucacugugauaaagcaacaacaaaaaaauagaaucccacaguaggugagagcugcuguugauggacccagcacuugcucgcagaccugagaguccggggcagggauguagccucuuagauaaaacaugcagcagcacaaaaccagaauacaugaagcaaggcagaaaugcccagauauguuacuuguccccagcugguacagucagcaucagauacugaaagauauuggcccagagcaguggaggagcggccaggucccagcugugcacccccacgcuuuugaccaccaccgugcccccugcugggugguuccuggcaucccccaacaaagccuugcugucagcuuggcccugcucucucugccgcugcucuuuauuuuuuuauuuuuugagauggagucuuuguugcccaggcuggagugcaguggcaugaucuuggcucacugcaaccucugccugccagguucaagugauucuugugccucagccucccaaguagccgggauuacaggcgugagccacugcaccuggccacccugcucucuuaucuucacagcaggggaaggcuugggaggagugucaagcaagcccuguugaaagagcaggcaugcugagguggugugguugugcagggaaagcagcacaugaggaccaggccuggagaugccuccuguccucacaggccuugagcaucccugcuacacaaugagguugaaagggcuuccugcucugauucuccaggacugauaggaagaccuuuggagaucccuggaagccggagacucaccaccaaugguuaggagugggcaggaaccgaagcuugaagcccuguaacugggcugugcauucaugugggguagacucgggcugguuauagcuguggcugcgugguugugguugugaacgugauugugucgugguggggaccgugguugucaugaucauagccguguguugugguugcauccugucaugguuugaucacagacaucaaggagaugucugaccucagcagaggugcccucuaggguuacagaguaggacagaagccugugcuuacuuggagaguccagaaggaacgcagaugucuggaaggccuccugggggccuccagaaacuugcagccccagggaagaagucaguguggucuuagagguggccacgcacagcccagggagaagcaggggagguggccaggugcaaguuggcagcagcagccaggaggcagcugagggggcuggguccugcucagagaagcccaccccagggaguagccaugaacggccuaggugcccagugcucuucugagcucacguaguaagucccuuggcagcucuuccagccuuguuuccucaucacaauccaugcucuccauucagaacucagacccuguacuguuuccucgccagcucggaugcuggagccccugaccccgcagcccaauccgugguagcuucccacccuucuggucuugcuuugucuccuuugccucugcauggacugugccccacaccagugccuguaggauggaccucucugcucacagaacccagcccugccccagcaaugaacauucauugcuaucgaaugagugaacaagguaaaaaguaugaaaccacuuuugagaacugucaaaggcucugccuucucuugcacguuuccaccuggggccucacagugcucagugcaacuauccugggagccuugagcccuggcccccgcauuuguagucuuaucauuucucugagcacagggccuaaggaacgucuuuguuccuguuuauuucagauucuacgauuaggacugaaaaugagcaggccugugaggacauggacauccuaaaaucagaauccuaugggacaguggucagaaucuccccacaggacuuuccucagaauccuggcuuuggagacguuucugauucugaggucugguuagacagucaucugggcagucccgggcugaaagugacaggcuuuaccuuccaaaauaacuguuugaaugaggagacugugguucccaagaccuucaccaaggacgcaccccagggauguaaggagcugggaagcagcggccuggauugucagccucuugaaagucagggagagagugcggaagggaugucccagagaugcgaggaguguggcaaaggcaucagagccacuucagauaucgcucugcauugggaaauuaauacacagaaaauuagcagaugucaagaaugccaaaaaaaguuaucugacugcuugcaggggaaacauacaaauaacugccauggagagaagccguacgaaugugcagagugugggaaagucuucaggcucugcucgcagcuuaaucagcaucagagaauccacacgggagagaaacccuuuaaaugcacugaguguggaaaagccuuccgccugagcucaaaacuuauucagcaucaaagaauccacacuggggagaagcccuacagaugugaggaauguggaaaagcuuuuggucagagcucaagccucauccaccaucagagaauccacacaggagagaggcccuaugguugucgugagugugggaaagccuucagccagcagucgcagcugguuagacaccagagaacucacacuggggagaggcccuacccuugcaaggagugugggaaggccuucagccagagcuccacccuagcccagcaucaaaggaugcauacuggggagaaagcucaaauucuaaaagccucagacaguccaagccuuguugcacaucagagaauucacgcuguagagaaaccauuuaagugugaugagugugggaaagcuuuuagguggaucucucgccugagucagcaucagcugauucacacuggagagaagccuuauaaaugcaacaaguguacaaaagccuuugguuguaguucacggcuuauucgccaucagagaacucacacuggagaaaaaccauuuaaaugugaugaguguggcaaaggcuuuguucagggcucacaccuuauucagcaucagcgaauccacacuggagagaaacccuauguguguaaugacuguggaaaagccuucagucagaguuccagccuuauuuaccaucagagaauccauaaaggagagaagcccuacgaaugccuccaaugcggaaaagccuucaguaugagcacacagcuuacaauacaucaaaggguucacacuggagagaggcccuauaaauguaaugaaugugggaaagccuucagucaaaacucaacccuuuuccaacaccagauaauucaugcaggggugaagcccuaugagugcagugaguguggaaaagccuucagccggagcucauaucuuauugaacaccagagaauacacacuagggcccagugguuuuacgaauaugggaaugcccuggaaggguccaccuuugugagccguaaaaagguuaauacuauaaagaaacugcaucagugugaagacugugagaagauauuuagguggcguucacaccuaauuauacaccagagaauucacaccggggagaagccuuauaaaugcaaugacuguggcaaagcuuuuaaucguagcucaaggcuuacccagcaucaaaaaauucacaugggauagaccacuuacauauaaauguguauauaugugaauaaaccuauagccuuaacuua

SEQ ID NO: 192556 - RNA, 15646 nt, Homo sapiens
auuuccucuggguuacggcgcaggcgcaagauaagcuaggagccgcgcgagucguagugucgcuguuugcgggucuccgcgcgggaccggggcgcagcggggucgcugaggcgagggugucaugucagacaacgaggacaagugagugcgggagcggaguggccuuugcggcaaccuuggaaggggcggaugaggcaaggcuugggucggcugaggagccuggcgucuaggggcaaugucugaggggacugggguccugagggggccggcggagccgaggaagggaagggcgggcgacccaggagcacagccccggcuggaggcacaggagggcccaggcucgaggguccagaggggauccguagaaaagguguccuucagcaaauguuccagcgagccgggcucuguaucaugcagugggaauauugaggugaaugaacaaucgucccugccucuccacgugcucacuuucuagaaaaggggucacaggcccauaaguaagcaagcaagcagguaacgguggucgcgugagcuuccccaguucuagacguauguaguauaggaguacuccagaggagggucuggggcagcuccaccggguggcauuaaauaaaagucugggacgguccuuugcaguaauuuuuuuuuuuuuuugaaacagagucuugcucugucgcccaggcuggagugcaguggcgcgaucucggcucacugcagccuccaccuccgggguucaagggauucuccugccucagccucccgacuagcugggauuaugggcgugcaccaccacgccuugcuaauugcuuguaguuuuaguagagacggguuucaccauguuggccagacuggccucgaacuccugagcuugugauccacccgccucggccucccaaagugcugggaucacaggcgugagccaccgugcccggccugcuuguaguaaucuagaugagagaagucaguagcuuauaguagggugguaggaguagagguggugagaacugguuuugaauucuggauauauuacuauuuuaaagauagagcccaaaaauuaccugugggauaugugggugcaaagagagcuagucugaagauaaaaauaagaaacgugugggauugcuaccccauucccagugagugucaguagagaagaggagaugacccguggcugagcauuagggcauuuggacauugagugcuugggggaaaagagaagccggggaggugggggaacaccaagagggugagguguccuuggagucaagugaggagagcaaguggccuaaugugccagcugauagaucaggcuaaaugagaaggagaguuggccauuggauuuagcaacguggagaucauuaaugagcuuggaaagugguuuugauggagcuguuggggugaaaggcuuuuuggagugagauuaugacaaaaugggaagagaggaagauagugaggguggacagcucuuucacacauuuuugcuucaaaggacaccauggaauuagggcuauagggggagagagaagagaaauaaggguuuuuuuuuuuuuuuuuuuagaugaggaaaagcacauguugaaaugcugauggggccgggugcuguggcuuacaccucuaaucccagcacuuugggaggccgaggaggguggaucaccugaggccaggaguucgagaccagccuggucaacauggugaaaccccaucuuuacuaaaaauacaaaaauuagcugggcaugguggcgugugccuauaaucccagcuacucgggaggcugagacaggagaauugcuugaacccaggaggcagagguugcagugagccaagaucacgccauugcacuccauccuggacaacagagcgagacuuugucucaaaaaaaaaaaaaaugcugaugggaaugauccaguagagagggaaacagugaugaugaaugaguacuagcaauauuugggggcagauggggaaaaauugaagggguaaaauggaacaaaagucggauuuacuucuucuucuuauuauuauuuuuuauuuuuugagaaggagucucgcugugucacccaggcuggagugcaguggggugaccguggcucagugcacccuccgccucucggguucaagcaauucuugugccucagccuccugaguagcugggauuacaggcgcccaccaccacacccggcuaauuuuuuuguauuuuuagcagagacgagauuucuccauguuggccaggcuggucuuggacuccugaccucaagugaugcacccaccucggccucucaaagugcugggauuacagacgugagccacugcacucagcugauuuacuuauuaaguaaauauuuauugagugcuuccuacauacugggcgagacacagaucucugcccucuuugauuuuuuuuuuguuuguuuuuuguuuugcgguggcggggggggguuuugagacggaguuucacucuuguugcccaggcuggagugcaauggcgugaucucagcucaccacaaccuccgccuccuggguucaagugauucuccugccucagccucccaaguaguugggauuacaggcaugugccaccaccacucccggcuaauuuuguauuuuuaguagagacgggguuucaucauguuggucaggcuggccuugaacuccacccgccuuggccucccaaagugcugggauuacaggcuuaaucccagagccacaauacaaagccaccaugcccggccucugaauuuuuuuuuuuuuuaauuuuucuuauuuauuuugagacagguucuuguucugucacccaugcuggaguacaguggugcaaucuuggcucacugcaaccuccaccuccuggguucaagcaauucuugugacucagccccccaaguagcugguauuacagacaugugccaccaugcccggcuaauuuuuguauuuuuaguagagaugggguuuugccuuguuggccaggcuggucuugaauuccuggccucaagugauccgcccacuucaaucuccgaaaguaccaggauuacaagugugauccaccgugccuggccccucuuugauucuuuuaagugaugcucuaaguaacugaucucuucuuccuguacaguuuugauggcgacgacuuugaugauguggaggaggaugaagggcuagaugacuuggagaaugccgaagaggucaguauucagccucaggcucccaccucugcagcccaagcugccaaaucgucugacaggugaugauuagcugaaugugucugccuucuauuuguggucaaggccccugccauaagcauucccaguuagagugagcuguguuccagucuugcauagcagaacagcccugcagggugggccugaaagcuuuuguccaugugguccacagccuguggcuucuggggcaguuaguucacugacaaguuaaacggugccuuccuucauuuggcaaacauguguugaauguuuauuauaugccaggugcuuucugcugggugggacugcuuaaggagcaaagggaagagguaagcagggcucagaugaggcaguauuuuguagccuaaaggcaaugggaagcuacugacaaacuuugagccagggcacaguccagguuacauuuuagaaaguacauuccugccucgaguaaggagugaacuggggaagggcaagagugaaaggugagaggccuguggcuuggacauaggugcugguagugcaggugaugagaaggcagauaaaagaguuauuucgguggguugguuauggggcugagaaagugaguggugacgaggacgacucucagguuucuggcuugagcaacuagguggauagguugccagccucaagaggaaaguagggcuuucugucuugugugacugaugagggaaaaaaugcaguuauguucuggagagacauggagccuucucucucucugcauggcacuuucagauaccuuuucacuugagucagaugcguccuucuccauccuucugguccccuucccaucccugucauguagauugugccuccuagauguacuucagcccugucugcauuuuucuacuccuggugccuuaaccuggcuuagaucuuauugcuuuucagccacauuccugcaggaauuguguggcugguuuuccugcuucagucucacuccagacucugcucugugugcucuucuccuuucagcacccuuucuuacuugcccacaugcucaguuacuacuggcuuuccuaaauggccucucugcuucugccacugcccccugcagaauauucgcaacagaguauccagagugauccuuucuuucuguuuuuuguuguuguuguuguuguuuguuugcuuguuuuaaauuaagaaguggugucuugcuacguugucuaggcuagaguacaauggcuauuuucagguguggucauagcgcacuacagccuugaacuccugggcucaagugauccuuccaguucagccuccugaguagcugggacugcagguucugcaccaccaugcccagcucagagucaacuuuuuuuuuuuuuuuuuuugagacggggucuugcucugucgcccaggcuggagcgcaguggggcgauguugacucacugcaagcucugcuucccggguucaugccauucuccugccucagccuucugaguagcugugacuacaggcgcccaccaccacgcccggcuaauuuuuuuuuuuuuuguaguuuuaguagugacgggguucaccguguuagccaggauggucucgaucuccugccuugugauccgcccgccucggccucccaaagugcugggauuacaggugugagccacugcgccuggccuguuuacuuaauucuuuauauaccacagaauuuauucucuugccuacaauccucuacgcaccuuuuguucuaauuauuguccacaacuaguuguccaaaccucuuucuccucuaugccuuugcauguugccuccuuccucauugguuugacagcuccugcucauccuucuaggugagcucaagccucaucccuggaguuuuccuaacccccagugugagugagguguccccaccuccucgggaacucuguugcacccuucauagcaccugcucuguuuacucuugucuccccuuuagaccauuaauugagagcagaaauuccuagcuuucuuucucagcaucuguuaacaauaucuggcucaggacaaaugcuuaguaaguaauuguuaaauauuccugccuucaccuugacuuuucuagccacuuggcccauuggcucagcuccccuaucugaaagaugggaagacuauuccuagcuuccugcuuaggguaauuuuuuugugccaggaccucuuuuacaggaccaacauucugauaccaccccaucuccaggcccucugcucucuucuggaugaggcaguuagcucuggaaucucagaccuccauuaccaggucugaggcuuggucagguuagcugacuuuccaagccucugaaaugagaacuguaaucccugccucauaagguuauuguaaggauuacaugaguuguuaggaagcaguuaugugguccccuggcaugcaguaagcauuaacgguggcuguagcgagaauugugauuguugucauuaucacucucccuguaacccaaaagugccaccugagucuuucccucuuuuuugucuugguguccaggaaggccaggagaaugucgagauccuccccucuggggagcgaccgcaggccaaccagaagcgaaucaccacaccauacaugaccaaguacgagcgagcccgcgugcugggcacccgagcgcuccagauugcgugagugauugccccuucacugucuucuccaucugucaggccacaguaagcucuuguaccgcugaucuuucccagccuggcaccugaaaacagacucucugcucucacauuccaaaaguggugccgucccugcguaccaggcauugagcuaguccccugcccucagggagcuugugaucuaauaggagaacuaggacaugaacaucugagaagucaaguaacaauaugggagaaaaacgauaaaaaaaaaaaaacagaacuagaugguugcgugucagauuagugcagcaaaaaaggugaauucagagccaauguguaccaguguaguuuuuuuuuuuuuuuuuugagauagagucucgcugagucaccuaggcuggagugcaauggcacaaucucagcucacugcaaccucugccucccagguucaagugauucucgugccucagccucccagguagcuggaauuacaggcaugugccaccaugccuaacuaauuguuguguuuuuaauagagacggggucucgccauguugccuaggcuagucucgaacgccuagcuucaagugauccaccugccucugccucccaaaguguugggauugcaggugagagccaccgcgcccggccauggugguucuuuguuguuuuauuuuccgagucaagaucucaaucuguugcccaugcuggagcacaggggccugaucauggcccauugcagccucaaacuccugggcucaagcaauuuucuuuucuuuuuuuuuuuuuuugacagagucuugcucugucucccaugcuggagugcacuggcccaaucucagcucaguacaaccccugccucccggguucaagcgauuguccugccucagccucccgcguagcugggacuacaggcguccaccaccacaccuggcuaauuuuuguauuuuuucuuuuuucuuugagauggagucucgcucuaucacccagccuggagugcaguggcgcguucuccgcucacugcaagugcugccuccuggcuucacgcccuucuccugccucagccuccagaguagcugggacuacaggcgcccgccaccgugcccagcuagcuuuuuguauuuuuaguggagacgggguuucaccauguuagccagggugguuggucucuuucuccugaccucaugauccgcccgccucggccucccaaaguguugggauuacagacgugagccaccgugcccggcuauuuuuguauuuuuaguagagacgggguuucaccauauuggccaggcuggucucaaacuccugaccuugugauccacccgccuuggccucccaaaauguugggauuacaggcgugagccaccgugcccggccggugcaauuuucuuuuuucuuuuuuuuuuuuuuugagauggagucucgcucugucgcccaagcuggagugccguggcgugaucucgguucacugcaauauccaccuccuaggaucacgccauucuccugccucagccucccaagcagcugggacuacaggugcccaccacaacgccuggcuaauuuuuuuguauuuuuaguggagaugggguuucacgguguuagucaggauggucuccaucuccugaccuugugauccaccugccuuggccucccaaaguacugggaguacaggcaugagccaccgcgccuggccggcucaagcaauuuucuugucucaaccucccaaguagcuucaagcugggauuacagguaugugccacuaugccuggcuuuguauuuuuuguggagauaggggucuugcuauguugcccaggcuggucuugaacucagccucaagugauucuccugccucagcucccaaagugcuggagcugggauuacaagcaugagcaaccauuccuggcuuuaaggugguucuugaugugagguagacuauggccaguccagcagaguggggggcccuccagcuugaaagcacgcuagagagaugaaagcacagagcaguggugggguuuuggggauuugaaaaucagcaaacuucccuccucucccacauuugggagaauaaagauucaggagauagaguagacagguggagaugcgaguguccaaugagugcagauguguuagccauaggcagugcaggccuucagaugccugcuaagguuuggggcagacuggagaacagacuggaagcacccucugccaacagauggcuuugagaaagcagggacuuucaaagaggcugggccacagaugccugcuuuuuuuccccccaggcucaccugucagaauaguuccuccuccuuucuuuugaggaguaggugaggggacagagcgggguacucuaaugguacuguggggaagcaugagacugagaacaggagccccuaccccaaacucccuauagacugaugugggaaaugguggguaucuggaggagcggggguaguucaaguagggaauaauggaaauuagccuagaaagaaaagcagcugggugccguggcucacaacuguaaucccagcacuuugggaggacgaggcagguggauugcuugagcccagaaguucaaaaucagccugggcaacauggugaaaccccaucucuacaaaaaauacaaaaauuagcugagugugguggcgugcgccuguagucccagcuacucgggaggcugacgugggaggaucaccuaaggccaggagguugaggcugcagugaacugugaucgcacuacugcacaccagccugagugacagagacuccaucucaaaacaaacaaacaaacaaacaaaaaaaaaacaaaggaaagcuggggccagauuuguggacucugugugcuuacaggggcagcaaaugcugucuguacauucuccuccuuaguguucaagcagcacugggcuguugccuccucuaguccuguagggguaaagaugaccaucaugucuacuucaauaaaggguuuuauggguggacaacauuguucucccccauuccucaguagcggaccucuucucagccugguugcacuccuugcucuuaugcauggcauuagagccacacccagugugacagccauacccaauaugccaccaacgucaggauccucugggccugcaccaucaacuaugguagccaugaacuguauguguccauuuacauuaaguacaauuaaauaaaauuagaaauucaguuucuuucucacuagccagccacacuucuuuuucuuuuauuuauuuauuuaauuuuuuuugagacggagucuugcucugucacccaggcuggagugcaguggcacagucuuggcucacugcaagcucugccucacggguucacgccauucuccugccucagccuucccaguagcugggaccacaggcaccugccaccacgcccggcuaauuuuuuguaguuuuaguagagaugguguuucaccguguuagcgaggauggucucgaucuccugaccuugugaucugccugccucggccucccaaagugcugggauuacaggcgugagccacugcgcccagccuauuuauuuuuuuuugagaaggagucucacucugucacccaggcuggagugcaguggugugaucuuggcucacugcauccuccgccucccggguucaagugauucuccaaccugagcuucccggguagcugggauuacaggcacccgccaccacgccuggcuaauuuuuguauuuuuaguagggacgggguuucaccauguucguuggccaggcuggucuugaacuccugaucucaggugauccuccugccucagacucccaaaguacugggauuacaggcaugagccaccacgcccagccuuuucuuuuauuuuuuuagagacaguuuggcucuaucacccgggcuggagugcaguggugcuaucauagcucacugcagccucaaaacuucuaggcuuaagugaucuucccacuucagccucccagguagcuaggacuacaggcuaaugccaccacacguggcuaaugucuuaauuuuuuguagagacagggucucacaaaaagacuccuggcuuccagugaucccccugcuucagccuccaaagugcugggauuacaacuagccacauuucaaguguguucaguagccacauguggcuacugguuaccauaaaggauagcacagggggauaggacauuucugucauugcagagcauucuauggggcacacuaauauaggcuaaaaguggcccaguagaaagaagaauucauaaguuauuuuuaaaacaaauagacugcuuauuugcaaguuaaacagucuuucagcacugaagaaagauacugcauuagcacuugauaggaugcugagaugauuaaagauguagucccagccgggcgcgguggcucacgccuggaauccgagcacugugggaggccaaggugggcggaucaccugaggucaggaguucgagagcagccuggccaacauggugaaaccccgucucuacuaaaaauacaaaaauuagccgggugugguggcgcgcgccuauaaucccagcuacucgggaggcugaggcaagagaaucgcuugaaccugggaggcggagguugcacugagccaagaucgugccacuaauccagccugggugacagagugagacucuguuaccaaaaauaauuaaaaaaaaaaaaaaagacauaauccccaguccuccagguguuuucuggugggggagauagaccugugcacagguacccacaacccaaggcagaugcgaguggugcuuuaugaaagguacaaagagaguuauugcagaggugacugggaaagccuugugaagggauuagaauucuaguggggacagguaaagagaguugguuuuguggguacuccaggugccagaaacagcccaaggaaagguccagguggaggcaggcaguuguggauuugugaugagggaucauaagcagcuuggggcauaaggcuggagaagaugacacugguccugugagugacagguucagaagauuagaguucauuuggugggcagugugcagcacuuaaagguuuugaggccaacauccagcauccaggccacucauaaauccaaguguccuguuuuucuuuucuuucuuucuuucuuuuuuuuuuuuuuuugagauggaguuuugcucuuguugcccaggcuggagugcaauggcaugaucuuggcugauugcaaccucugccuccuggguucaaggaauucuccagccucagccuccugaguagcugggauuacaggcacacgccaccaugccuggcuaauauuuuguauuuuuaguagagacgguguuucaccauguuggucgggcuggucuugaacucgugaccucaggugauucaccugccuuggccucccgaagugcugggauuacaggcgugagccacugugcccagccaaguguccuguuuuucuuggggagcaaagcuugauccagcucauuccagucuuuagugcucuuuccacuuaagggcuaugacaccaucugguggcuccuugccugcuguaagcucuuguacagccauaaugggacucugcacuugguaggugcagguggagucucacucugucaccuaggcuggagugcaguggugccaucucggcucacugcaaccuucaccuccugguucaagcgauucucaugccucagccucucgaguaucugggacuacaggcaugugccaccacggccggcuaauuuuuuguauuuuuaguagagacgggguuucaccauguuggccaggcuggucucaaacuccugaccucaggugauucaccugucucagccucccaaagugcugugauuagaggcgugagccacugcaccuggccagaacaacuguuuguuggguagguuuuggaugggguuucagucugguucauuagcaccaccugguggcugaugauguuugucacaucuacuucuuaacuggaugguugauguguuucucuguagaagccauggugcaagaaaaauuaaauuacuuaaggacacauucuugcacauuccaugugcauaauaggugcggaaugagugaaugcccuugaauuauuuauauuuugaaagaaagcaggcacaugcagaucagguauuuugccacauucuuuaaagcuuuauauuuugggaaaguuuaaauacuuauuaagagaggauauagggaaaguuaaauacuucaucucugcccuugggaaauuuucaggcuuuugggaguaauauaaaucgaaauauuuaguaauaaaauuaguaagcugguagcucucagacuagcugauuaucagaaucaucugggcaguuuugcaaaugcaggcucucaggccgcuucacuagagauucuauuccgggggucuggggaaggacccaggaaccuguauuuuuuagcaugcucuccuguuaauucuggauuuguuggugugaaccugagcuggaaucaucagggguggcuuccuagaggagaugggccuagaauuggcaucccuuugcuuggugguagaguccccacugugggccaaguguuaugcugggggcugggccuccguggugaaucacaugugguucugggccacuaggagcucauggucuaauguggaaaguuuccaaacaaguaguuacaguucaaugagauuggugccaagaaaaguauaugcaaaaugaguccagguacugaagagucagcacacgauuuccaggguggagacaucugaaccucucgcagguuuuuagggagaggaagagcuuguaagagcacacaaaagggaaacaacauggcgcaucuagggaaccagaaauaguuugguauggcuggaauguggaguaaauacaggaaaguagcacgggacugugcuaggaaggcaaacagggaccagacugcacucuggccugauagccaaggggagucaugacaguguuguaagcaggugagcccccugacugcuggccucaggugaaggguggggagggcugggcaggaagggcagggccucuacugagguguugugucuauagagaauggaaaugaugccgggcaugguggcucaugccuuucaucccagcaaucuggaaggcugaggcaggcggauugcuugagcccaggaguucgagaccagccugggcaacauggcgaaauguuaauuucacccaucuauacaaaaaauaaaaaaauuagcauagcuggugguguaugccuguagucccaagcaggagaauugcuugagccugggagguggagguugcagugagccacgaucuccccauugcacuccagucugggcaaugggagugaaaccuugucuccaaaaaguagagagagaaaauagaaauugaaaugaggugcacugggcacugaggcaaggcucugggguuggagcaguuagaauggugugccuuugcacaugucucccuuuccaccaggacauucugcuguggccgcuggacuccggagucugugauaggccucugccagggaagaucucuggcagugccccuacacaccacucccuacugugccugccuaccuagaagaugacguuucuagguggggaccaggaugccguuccacccucacugccuguugggcccuucucccuggguuuguagucucccuaacaccugucccuaucccuacaggaugugugccccugugaugguggagcuggagggggagacagauccucugcucauugccaugaaggaacucaaguaagucacucaaaucaugguucacuucuccaaaucucugggaggcaucuguugggcucucuguugcacccuuugcucccacuugccuggcuggagaaguugaugcuuauuccuacagauccuuaggaacagcucaccaggaaguaggaggaagagagaagaggaggcagggaaagugggagggcacugaugagacauggacgucuucuggcuguuggaauuucccuguuccugcugcaggaggccuuaccaauauucugucauucuucccccucuugucugauauaaaaacuuucuuuuucuuguaauugcuuucuuacaaaguacacucaucagccccaagaggcugcuccuaagacuucucuuugcuuguguuuugcacacaaucuguuccuucugcggcagagcuggggucaccagcccucauguacuugugacuucuccccugccacagggcccgaaagauccccaucaucauucgccguuaccugccagaugggagcuaugaagacugggggguggacgagcucaucaucaccgacugagcuggagucaucuuccugcccuugccccaugcccaauuuucauucucacuuuauauguguaaauaauaaaauauucaacuuuccaacccccuuccccucugcuuaucugcaaugucaccaccuguugcuuccccguuaccgccaugcugcguggagcaugcaccuauuccaguggcccugugacugucagcuccuuaagaagcaccaggggcccuuagccccuuuggaucccccacauccuucccuccaucucccuguuccccagagcaaaggcugcugcaggggagacaccucagcugccuuccaagcagacagacaagucuuugugcccagggagcugguugccacggaaacccccaauuuccuuuccaguggggacuggcugcaggggcuucucccuucucaggaguaucacagagcaggucucaucaagccacccauuguuuccuaaggaccugcuucgagccucuuaucgugggcucggauccccuuucaggagcagugccccagcaggaagcgugggggugugcugaucucccacccuccccaggcagagcccugcugggcaagucagcagcuggagcaaggaccgagcaccugccuaccccugcccccauggcucuguccccacuccuccucaggacucugcccacacgcuguccucuguggcccaccucuuuggugugccacacccaugccuucuuccuagccucuauaagauauccuuucccuccuauuuggggcuggugauccccugaggccuuggggacauggugcuggggugguggugcuccuggguuccagguguuacauuaagucagagcuggaguucccccuuccucugccugagguucuaauggguccucuuccuuucuccacccugcuuacccaaccugagguaagaccagucacacuggcuccucccuccuagagggggucagggggaggguguauauugacaugaacagggauagaggguaaacuggcucccugaauaugccagccuuaaccuccauuccacugccagcuccccuucaaagaggaggagcugggcuucccuaaccucugcaggaggcagggccuccaggccuaggugcagccuggcccugggaugggauguggggagugaauggugaggaucugcauuggugggagggguguccgcugcccuggagaaggguuaauucagggagcaguggacuucacacucccauccacccuccuccaagccuguggaauccuuuaaucaaguugggugcugaaauuucagcucugaaaugccgccuuugugcuggcauccaggcagccgccccagagugcgggggucacuuucucggccccauuucucuaaauggucucuuuguucccugcugggcugcucaguaucagaugugauuaaagggagaugggguuugggcuggggaggaggggaauuggggguuaacccuuaggggauagagugcaagggaaaugggacagaagggguguuuuuccuccugucuuccucuucccauucuccucuuuuggggaguccccugcuauucagcugucugggccuggcuuuugacuucucuugaauaaaaugucccggucacca

SEQ ID NO: 192557 - RNA, 70260 nt, Homo sapiens
ggggguccguuccccaacuuccucggcgcuccggacucccaagucuccgccggacccuccuuuggauauuccucgugucuccgauucugaggcauguccuccauuaacccuuaugugacucccugagugcccccaccuuccaucuuuucaucccccugcguccccaauucccaucccgagaccgcccgugucucaucucgaacuuguggaccccagggaccccagcuucgacccugaguuucuccccugaaccccagucuccuccgugugucucccucaguaucccuaacuucccgagucaauccaucucuucucuuuccccgacccucagugccucuuuaggccccauuggccguccuaauuuuccuuccugugcuccucuaagugcucacuugauuccccacuucacguccgucuccaccuuucguggugccucuacucauuucucacucccugcuucuccugccuuuccucccugcuuuuuuuccuugccuuuccucucucgcgugccuccagaccugcccccgacaugcucccuccuuccccucagccuggccaccccagagucucccaccccuaauccuguguccaccuccugcucccacagaugacuuggaagcuggugacagggagcaugugaccagggugaucaugggacugggucggggcaagccugugggugugggacagggagggcacagggcaaggggaccuguggccguauuuuuaaugggcuacccacaugaccccaacgaauaccucccccuagcuucugggucuuucccucaccugccucuuacccgcccaacaggaugucaggcagguucgguuuggcaacguugaggcugcacccuugggcugaaugcauuguuuuugaaugcauuguuuuuguuagaguuucugccuggaguuuggaaccuguuuucuguccaagucucaguuuccucaucugugacaggggaacuguaccuccugcccucguaagucugccaugagguucaaaauuugaaugagaaaauguagaagguaaagcuuuauaaccaguauggcccuguacaaauacaugauuuuacuguugggucauaggcagaauugaaaggaguggaaagggaaagggcuagaaugagaagacaaggagagaaggaugagcaggaggucccuugucuuucaguguaucauuuggcaguguuuguucaucaccucuugugagucaggcucuucuguauauguucucuucaccauucauucagucaucguuuaucuaacaaauauuuacggacugucugauguucuaggcuacccuugguguggccaaugauauucucacuucacaugagaaaaagagggcgcaugaguugcuugaggucacaccgaugagguugaagcuggaaucugacaccagagccugugugauuguccugauguguaagguuugcuacuguuuaggacacuucuuguuccuuccguggauuacuuucuuguuacaugagagacuccccaaaagggaguuucccucuuacucagcagaaugacaucacuaagagauacagaaaggagaaauuuaaauacucugugugugugugugugugugugugugugugugugugugugugucugcagacaucuauugggugugugugcugggggaaguagguaggcaaggaguaaggggccguagugaagaguguguuacaaacuucacuuuguagaggguggcucccugggagaauauguucugugucuuucacaguggauuuugauagggucaugucuuaaaugccucuucucguuuucggauggugaucucauccagucuuauuucuuuaagugccgucucuauucugucagcccacaaauuuauauccccaguccaguccagaccuuucccuggaaugacauacucaaaucuaguugcuuacucagcaccucaaacuuaggcuuuucaaacuugaaguauuuauuuauugauuuauuuauuuuuugagacagagucucacucugucacccaggcuggaaugcaauggcacgaucucggcucacugcaaccuccaccuccugauucuccugccucagccucccaaguagcugggauuacaagcaugcgccaucaugcccaacuaauuuuuguauuuuuguagaggcgggguuucaccguguuggccaggcuggucucgaacuccugaucucaagugauccaccugccuuggccucccaaaguggugggauuacaggugugagccaccgcgccaggccucaaacuuaagaguuuagaauugagcuccuguuaguucugcccuccaucccugaccccacucuucaccaaaacaugucccucccacucucuuucucaucuuaggacauaggaguauuguucauucaguugcucaggucaaagcugugagauuaucuaugaugccucucuguuucuuaccccacacccagccagagugaucuuguuaaaauguuguuucuuugcaguggccucuccucucauggcacaugccuggcccccuguugccucucugaugucacuggcuuccuugcuuuuccuggaacucgcuaaacauguuccagccccauggccuuugcacacgcucucuuugccuagcuauucauaugacuuucaucucucuccaucagguauuuauuuaagaucaauuucuuggugaagacuucucuccucacccaaucuaaaauuucacucuccaccucagcacuuccuauccccauucucugguuuuucuccucaguaguuaauugucaucuaaaaccuuuguaaauauuuaccuguuuaucuucuuuauuauuaguagcucugucuaaaauauaaguuccaggaugucagggauuuugugggguuuuuuuugguugguugguuguuuugguuuugagacagggucucacucuguugcccaggcuggagcgcaguggugcgaucucagcucacugcagccuccgccuccuggguuugagugauucucccaccucagucucccaggaagcuggaauuacaggugcacgccaccacacccagcuaauuuuuguauuuuuugguagagaugggguuucacuauguuggccaggccggucuugaacucuugaccucaagugauccacccgccucggccucccaaaguucugggauuacuggugugagccaccgcgcccggccuuguuuuguuuuaagacagggucucacugucgcucaggcuggauugcaguggcacaaucacagcucacugcagccucgaccugcuagacuuaagcaauccccccaccucagccaccuuaguagcugggacuuacaggcaugagagauaccaugccuggguaauuguuaaguuuuuguagaggugaggucucacuauauuacccaggcuggucucaaaguccugagcuuaagugauccuccuuccuuggccuccuaaagugcugggauuacaggagugaacugccgugccugaccagucuguuuuguuuacgauuguauccucagcgguuagaacaaugccugccacaauccaucucaguaaauauuuguggagugagucauaacaugggccacacuguaccgugccaccagcccaaagaucucuuaaagucaccccugucucaugugcuugggagcuccagugacaguuucggggcaguuugcuuccagcugugguccagccaagcggagugaaugaaagagaugcuuuuuccuuuugugaaaggacguuuugcucuggcucacgugagcagcagugcauuuugagacgagggccuuggcuuuuggaaucuaagagccuguugagcaagccucgcucagccaccuucuuucagcuuucuccugaaggcaguuugaggauuaagagccugaugcucuggauuccaccuaauuggguucagauccuggcaaacuguguaaccugugccccaguuuccuguguaauguggagagaccuggaccuuuucuuacagguguuuggaggguuaaauguggcaauucggccgggcgcaguggcucaugccuguaaccccagcacuuugggagguggaggugggcggaucaccggaggucaggaguucaagaccagccugguuaacauggugaaaccccguuucuacuaaaaauacaaaaaauuagccgagugugguggugcgcgccuguaaucccagcuagucuggagacugaggcaggagaaucgcuugaacccgggaggcagagguugcagugagccaagaucacgccauugcacuccagcuugggcaacaagagugaaacucugucucaaaaaaaaaaaaaaaaaaaaaguggcaauuuacccgaaacuguggugaagcgucuggcgcccugugggugcugggcagcagugggugcugauggggugugaggggaugggaucaagcccuuucccacuaacuuaggaaagagguuggaaugagcuggggucagagggaacauuugcggggacauuuugccgggaggcugccuuggagguucagaggcucagaugaccccuguguucauucaguguuuucucacccacagauugagcaccugcuguguggccagcccuuugccuagugcuguucaagagucagaggacauaggcaggcaaucccccaccacaaccugccaccccauuuccucucuuggggccuugauuucuccacaugccaaacagggagaaugauugcaccuuccuuguuucuuuuuuuuuuuuuuugagacagucucacuuugucauccaagcuuuagugcaguggcaugaucucggcucacugcagccucugccucucggguucaaagauucuccugcuucagccucccaaguagcugugauuauaggcacccaccaucacgccaggcuaauuuuuuuuguaguuuuaguagagaugggguuuuuuucucacacguuggccaggcuggucuugaacuucugaccucaggugaucugcccaucucacccucccaaagugcugggauuacaggugugagccaccgcgcccggcugcgccuucccuguuucuuugugagcuuggagguggaucacaagugugaaacccuuugccaaccgugaggcaugguggccuugugagaggacggaggccggugugugguggcaugcucccgugcuguguggcacagacggagcuacaggaaggaaguuggggcagcuuggcacucugaguggacccugaguuuccagccugcucugucuugacugggugggaggagggugcucaggagggugucacugcugccagguucugcugccaggaccauccaacaguuguuccaaucaugggacauccugucgucagcagcuggggcucgugaggccugauuuccaccucgggcaguucugugugugcuccuggaaucccccacguggccaagccugugaggucugcuuccuggccugcugccuguggguuccugucacgcaccucucgggcagcuguccggcuccucugcucucggcuuagucaagaaggaagcagaaggcuuggagucuuuccugcuuggacuaggagugagcucagccuaagugcccugacuauauauaaagcugaacuuuccagaccgaagccuggggauggaucaguccgaucacuuagggccgcuccugaaggagugcaggugcuagauacagguucucccgguggaggagcgaaccccuugugggccguuagcuacuggugggauuugagcaugguauuucccuauccguuguggagaggagcauggcagcucagagugggugggaacaguguguggucccuguuaucaccuucaagggaauaaagugugucugggggcuucagaggugcuggccccaugggcuuauaggugguucauucauucauucucauucauucauucaccaaacuuauuaaacacccacugugagucaggaacaucaugccaggugcuuagggaaacaaaucaaagcggguugggugagcagcccaagccaacagaugcacccccauucucacaugguguguguuccugugggcugggcccugggugguguggggugcuggggagaagaggaaggcacaccaggcugcagggcggaggugcggguaugaauuuucagaggagauggcaccugagcuguaucuucauggauaagaagagauuuguucauuuguccuuuguggagcacacauucagguuaagaaaguggggaggaugggcuacgcugauggagcguaugugugguauccccaagugcacugagacacgaguuugacguguucugggaagaucgauggugcggcguggcuggaguagaggugagggaugaguuggaggggugaguugggccagcucucauggaugcuggagucugggcuuucccugggaggucauggggcgccacuggccagggucagcagggagaccugcagcuggauuugcaucguacagugggcauggaggggugucaggcuggguugggaaccgugcaggcuggaagggcacucuggugcucugagcauucagagggggcagcugggccuugaaggaugagcaggggcuccagcaggaacuggagagcgcauuccagggaggacgcaagugcaggccccuuucacuacagaaaagcaguuuucacacagaccuuccaaaggggaggagaggggacugccugggccuggcagcugcggcagguagcagcaaucagagggcagggaccgcuccucccgugccugagaccugcccaggguccuucagggaauucguagcugaggaggaaccagauuuuugggacugaguucucccucaccacccgcucugagccacccucuuggucccuuguccucuacugcacuucuuccggggcuuggcuccucgucaugagaggagcuucccugggcauggcgaggggcgugacugacauagcagcccuggacaaguggcuccaggugaccuguguucacguugaucacagcacuaaccacggccccuccucucagcaccuuccccucucgagccguccagucccagugaaaaugcucaccguucaugggugggcugagcaagccccugaucucugccuuccuccguguucugaucugcuucaucugcugugaaggccucucgccauuucccccgcuggcaaacuccuguucuuccuggaaaguucagcuaaaaagucauccccuuuagggguccuucccucaggggaccgugcacuuggcgagacagggacuggucuugggucucucuguugacuguuuuaugaacccagguagucacuuccagggaacucaucagagaugcuaccauuggcuccaaucucccucuguucccacucgagguuuuuuguuucuucguuuguuuuucuuucuuucuuuuuuuuugagacagagucucgcucucgcccaggcuggagugcagugacaugaucucggcucacugcaagcuccgccucccggguucacgccauucuccugccucagccucccgaauagcugggacuacaggcacccgccaccacgcccagcuaauuuuuuuuguauuuuuaguagagacgggguuucaccauguuagccaggauggucucaaucuccugauuucgugauccgcccgccuuaaccucccaaagugcugggauuacaggcgugagccacugcgcccagcccguuuguuuuuguuuuuugguggacaucaacuuuaauuugcccuuuguuuuguuuuguuuuugaggcagggucuugcucugucucccaggcuggagugcaguagugcaaucuuggcucacugcagucucgaccucaagaggaucaagcaauccucuugccuuagccucccgaguagcugggaccacaggcgcacaccaccaugcccagcuaauuuuauuuuauauuuuguagagacaggguuuugccauguuccccaggcuggucucaaauuccugggcucaagcaauccgucugccucagccucccaaaaugcuggaauuacaggcacgagccacugugcccggccuuaauuugcccuuugaacauguacaauucagggccucucugggccucaguuucuugaucucugagaugggaagaugggauaauaauacuuguuccucccguccuucagcuccuccaggggacccucacaccagcacacucucugucagucuucccucaaugaacccagcaggcaagcuugguuuugacagaggaugggugagcagagauaaggaaaacggccagaaauaucuggcuucccucagcaggggcaccaaaauugguaccuggaaauugccuggcuuggacaggcagaauugucacugucaacccccaccaccaaaggucuugggucuuugucuuucugcuugugguguuugagagagcugcuugacacagccgaggugcggucugugucaggugaccugggcauccugggggugcagggagaagcccagguaaggaggaggaggggccggucaucaguggggaaaagugauugucuaccccacgggaaggucaaggguaggacgcugugagaagccagggggagagaugaagugaggcaugaugcggggggcccucauccaccaucccccucuugcagcugugcugggaagagccuaggcuccaggguccaagguggcagggacagaaggaagcacgugugagcacuuucucccugcuggcccgccuuccugguuggcaaugccgugaguguuccaggauguggccccguggcugucauuuccuuucuuccaccuagugauaacaauggccacuguuugugugcccacagucggccugugucccagacaccuucccuccauugcgucaucucguccuccugccuacccugaaggcuggaugccagccaagccugucguuucuguggccaugcugucguggguguguggggggcauccccuagccccaggcucuggugggggguacacaggcugggccauugacgaagggguguguggaaucuuucuuugauuucacugcaccccuggugacuuucucccucaaucugaggcucaugggugcuggaugcucuugacucucugcccuuccugggcgcaccccuccgcgucccugugggcccguccucgggguagccucucugcgcucuuccaggccaggccugagucccacagguccccaucuucccggcugcagcccccagaggcucagccuauacugcuacuuccuuugaaaacuauaaucgcuuuacauagcaucuggaaaauagggaaaaggaaaaaacaaaagcccauaaacccagcacccucaucuacucaauggcauguuuucugucagucuaucuugguuuguuuucuaucaggcuuuguuuuuucuaugcauaauauuuacucaguuaaauuuuuguuuugacaaacuuucugugagccaagcuuguggacggagaugaaaagacgagcagcugccuuugagaaacucagacucugggccagcccaucugggugccagcuuucacugcuccacccacuagcugggugacccugggcccgugacuuuaccccucuguucuuugguguucucauauguaaaaugaggauaauaauaguaaccaguucauagagugguugucagacagaaugauuaauguacguaaagcuuucaggauggugccagcaagaugcacaggaguguuugguaggaggaugacgaagcuuaccgucuggcaggaggggcaguuguaacaugcugggcugugauaguacagauguguuuaaagugagggagagcccagagcaaggagagagaaccuggcaucuggugaugguguaucaagaacauuuuaggccagacacggugacucacaccuguaaucccagcacuuugagaggcugaggcaggcagaucgcuugaacccgggcguucgagaccagccugagcaacgugguaagacccugucuuuauaauuuuuuuuuuuuuuuuucugagacggagucuucacucugucaccuaggcuggagugcgguggugcuaucuuggcucacugcaaccuccaccucccgggcucaagugauucuccugccucagucucccaaguagcugggauuauaggugcccaccaccaugcccagcuaauuuuuuuauauuuuuaguagagacggaguuucaccauguuggucaggcuggucucaaauuccugaccucaagugaucugcccuccucagccucccagagugcugggauuacgggcaugagccaccaugccuggccucuauaaaaauuguuuggaagaaauuaccuaggccuggugauacacaccuguaguccuagcuacucaggaggcugagguggaaggagguagaggcugcagugagccaugauugagccacuguacuccagccugggcaacagagccagacccuguuucaaaacaacaacaacaaaaacauuuuuaaggaggaggcugagaaccacgagaaccaagcuuggauuugaagaaggaucagggcuuucucagacagaaaaggagaggaagaacauuccagauagacaucauugagagauggcacugagccuuguaaugggacacugcgaacuuuucuucaguuguuaugaucuuuuuuuuuuuuuuuuugagacggaguuucgcucuuguugcccaggcuggagugcaauggcgccaucucagcucaccgcaaccuccgccucccagguucaagcgauucuucugccucagccucccaaguagcugggauuacaggcaugcgccaccaugccuggcuaauuuuuuguauuuuuaguagagacgggguuucuccauguuggucaggcuggucucaaacuccugaccucaggugauccgcccgagucggccucccaaagugcugggauuacaggcgugaaccaccgugccuuguugguauaauuauuaguauugaucuuuuuuccuuuucaugugccucuuagugggccccuugcuuuugucuuccuucuguccccaggguugauccugugcucagcacauaggccagggaagaauguggcugugacccaguguccacucagauguccucucucccccagggcacccauacucuguccuuagugucuuuugucuggugacaucuuggcacagaggcagagggcggccuccgucugauuggcgccuggcuuuggugacaguaccuuaggaaggcaguguauuuucugggaaccuaggaaauaacaagguaucuaauuccaucaucaacacuggggacaauuuccauggcagaaacuaugacucugaauaugcagcguaaaguuaccacccagacacugcugcuccugagucucgaauggcaucuucugcaggggcucccccaccugccccugcagaaggugcaguucguucauuuccaaggagcuugcuuuugugugcugucucucggagcucuuugggaaaccugugguagcaggaaacaaaggauuuagaccaaugccgaugauccccuugcuccgauagagugugacaugaugcuggucaccuuuugguaucuaggaggggggacauugauuuuguuugcggaagugaaaugauccaugcuggccucuuuuuuuuuuuuuuuuuuugagacagagucacccuaucgcccaggcuggagugcaguggcgcgaucucagcucacugcaaccucugccucccggguucaagugauucuccugccucagcuucccgggcagcugggacuacaggcgccugccaccacaucuggcuaauuuuuguauuuuuaguagaggcaggguuucgccauguuggccaggcuggucucgaauuucugaccucaaaugauccgcccgccucagccucucgaagugcugggauuacaugccugagccacugugucugguccauacuagccucuuugagugcugaaagguuaucucuguaacuuauuuagugagaacccuccauuugcccagggcauuacugccuauaauguauguucacaugugcuaucuccuuuggucaauaccacacacuacaggugaggaaacugagucucugcugggacacugggucaggaagcaggcaguuaaggucaccugugcacaguggcagcacagggggacagccuucuagguagccagccuggccugaggguucugucacuuuuaccucccacucaguguuguuucucuuucuuuccccuccuuuuaagaucccuccaggcccaggaucuggggacaacgcugguggggagugaucugggugucugugcaggaaaccgcugcacugggugagaugggcaugggagacugugccuggcugaccagagaccucguuuucuuccagacagagggggaagacgguggggccuccccaccugccccgcagaagaugcaguucuuuggccgccuggucaauaccuucaguggcgucaccaacuuguucucuaacccauuccgggugaaggagguggcuguggccgacuacaccucgagugaccgaguucgggaggaagggcagcugauucuguuccagaacacucccaaccgcaccugggacugcguccuggucaaccccaggaacucacagaguggauuccggugggugaugcucagcgggaacauacuucucuccuuucacucccccacgucucggauuggaggucuuauuggccgagaagcaguuucuuugagucucugucugaggggucuggagaggggugggagagaggggagacuguacucuuggaccagagggaagggcuuccgagacuccacacuucuggcccaucagugucccagcacgaggcugaggauggaagccuggguuguuucuggccuggaggcucgaccuauauggacaaagggaagaaggaaggacagggagacugagaguguccacaucagauaaggcccauggggagaaccuuuagcccuggcucuuuauuuuugguuuugguuuuuguuuuuugagacagucuugcucuguugcccaggcuggagugcaguggcgcaaucucggcucacugcaaccucugccucccagguucaagcgauucuccugccucagccuccugaguagcugggauuacaggcacccaccaccacgcccagcugauuuuuguauuuuuagcagagacgggguuucaucauauuggccaggcuggucucaaacuccugaccucaggugaucugcccaccuuggccucccaaagugcugggauugcaggcgugagccacugcaccuggccuagcccuggcucuuuaagggcauggccguucucauaggggcugcccaggguuugcuuaggaaggcuggacagagcuguugccucuuggggcaugcugggacuccccugggccugaagagaaggcucaaaagccaggacaggccugagggaaccgggccaacggcagagcugguugggaaaaggggagaagcagccaagguuccaaaugcaggccccagcagugcuuggcagacuggcaucuaguugggcucagacagauaucccuguuuccgcucaccuauccaucuggcuguccugucagccauccauucaacaugcaccaagcaccuccagugucuccagaguccugggcuucgggccaguccuggcuggccugugagaugacaaacauguccugugucuuuaaggaacguacagucuggugggggagguccggugcaaacaggcgucauagcaccccuugaggagugcugugacagagggagagccuaggaaacaguguggaucacaaggaggugauugagagcuacucugcgucuggaagagugaggaggagccuguguggcagaacaaaauggauaaggucguuccagccgugcagaaguguggaggugugagccugcaggcagguggcucugguuggaucccaggugcaugcagggcuuuggugagagugaggcugaaggaagcagcuggggacucauucugacuaaagaggcauggcaggaggggucucugaaagugucaggcugggggccaggggcugccaccaacagaagagcaaggcagguaucagggccccauccaaucaggugagaauucagagccuggcuccacaaggaaccugaggcagaggcacccacagcaggugcuugggcuaaaugcagcucaguggccagugcaggcaccaguuuuaauacaguggggccauuccagauucugagugcagauggggcugagcagaccgccuuccagcuggacucgaucaggacugacccuggacggggcaggcuugcacuuguagcuucagagcuccacugcaggcacagcugaccagggcagcggguccacuccuuggagagcuggacagccccacuuuugagguacacggcccuggggauaccacuaaucuccacguaccaauaaucaccaaguucugucaguuguaaaaucccuugacaggauuccagauuugucucagccagcuuaagccccagugugggcagaccuccaucccaggaggauuuaguccuuugucagcagcuucuuagcuacacguaagcuauucugugguacuuuauaguuuacaggauuuuuuguuuucuuuuuuuuuuuuuuuugagacagagucucgcucugucacccaggcuggaguacagugacgcgaucucggcuuacugcaagcuccgccucccagguucacgccauucuccugccucagccucccaaguagcugggacuacaggcacccgccaccacgccuggcuaauauuuuguauuuuuaguagagaugggguuucaccauguuagccaggauggucucaaucuccugaccucgugauccgccugccucggccucccaaagugcugggauuacaauuuuacaggauguuuuuaaguauguuggguuagcacauucucugccaauccguggaggugggcaaggaaggcaguauuccauuuuaugcaugagaaaauagccuugggaugauaagugauucaucccacuuauacacaggaagcagugaagaaacagaaucagugucuucugguucccaauucauuucucugugcugcuguguuguuuccauguauguauguauguauuuauuuuuuugagacguuaagucuugcucuguugcccaggcuggagugcaguggcaugaucuuggcuuacagcaaccucugccuccuggguucaagcuauucuucugccucagccucccgaguagcugagacuacaggugcgugccaccauaccuggcuaauuuuuguguuuuuuaguagagacaggguuucacuguguuagccaggauggucuugaacuccugaccucgugaucugccugccuuggccucccaaagugcugggauuacaggcaugagucaccaugcccggcuuuguuugucuuauuucuaaauuuuauugauuuauuuauuuucacagucauagcucuggagucuuuuuuaucuucuccccucuaaccugcucccacccgaaccuuuccauuucagcagauagcaucauugcaacgggcugugccagauccagccaucacauccaccuuuccagccaaagggaggguggaagggcaggaugcagaaggucaaucucccccuccucagggacauuucauggaaguugcacgcauuggccagaacccggucacauggccacagcuaacugcaaaggaugcugggaaguguugccuguguugcagacagccacgugccagucgaaaaucagagguucuuucucccuccgucuugcugcuggcucgcuucuccagaccacagucauugugcacgugucuccugcugcuccggcuguggccugcacuccucucauccucuuccaagcugcugucacagcgcuguuuccagagggcaaaucugauuggucacuccccugcuuuacuccccaagggcuuccuguuuucuuuuauuuuuauuuuuauuuucauuuuuugagauggagucucgcucugucgcucaggcuggagugcaguggcacaaugucagcucacugcaagaucugccuccuggguucaugccauucuccugccucagccucccaaguagcugggacuacaggcgcccgccaccacgcccaguuaauuuuuuuuguauuuuuaguagagacgggguuucaccaucuacucuuagccaggauggucucgaucuccugaccuugugaucugcccgccucagccucccaaagugcugggauuacaggagugagccaccgcgcccggccagcuuccuguuuucuuaacacaucaggugcuuaaugacuuaaaagggcccagugugaucaaguuucugccucuguguucucagcucaugccgccuugugcuccuggccuuugcccaggcucuugcuguggccuggaauacuccccuuucuuugccugccuuccuuccucuugcccuccccugaccugcaggcuggauuaggaguuucugcugggcaucccauggcacccgucccugcacuggggauccugcuuuccugguaggccacagaccuugugaggggagggacugugucuguuggguucaugacagugugcccagcccccagcaggugccuggcguagaucagguuuguggaacaaaugaaugugauauauuaauuuagcuuuagaguauucauugagggcugcugugugccaggcccucugugccaccuggguggaggguggaggacuguugcauugagggcaguugaaggagugagcugggaagugggagguggaggauggggacugggaugcaggguuugagguuaucaggggucccagaagcaguaaugccaaggccuaggcugugaccuggagugagggcugcgauggggugggguggggucgaggcuguggaggagggucaucagggcacugcuggagcccugggguucuccagggccggggguggucauugcaguguucucccagcuccucucaacacccugcggucuguggagagcaggccuggugcacuggacuugccucuggccagggcugaguuucugccuucuaaacgaucuuccuccuguguugcccuagaggccucuggacuguccugaguacuugacgcguguuagagugagcaugggcugcuagccuuccgcuccagguggaggaguuucuguuguucuuuugcugcuguugcugcagugagcugccaggcugagcuucuggauggaccugggggauggaauuaggagcuucugaauucuuggguuguauaaccuaaggccggagagucccacagcacugcugcugggcggagagacuggacccugcugauacagacagcgacagcagcaggagcaucugcaguuucccagcagguccugcaugccugggcuuggcacuagucuaaguaguaacucauguuauccucacgacagucccacgagguggggucauuacugaccuccuauuacagaugaggaaacagaggcuugcagaauuugagaucacacagcuggucagcguagcgauuauucagacccugucaccuggcuccagaacccacucguuuaccuuucuuacaucagggcugcuuuguaguguggcgagcugaguggagcuccacccgccugggcugauccuggcccuuccugccugaccuauggugcgggggcccuggcucuccccgugugagcccccaggggucacuuguaauaugccuguguacacuaugauagcauagauacuucuguuccugguacagauuaaucauuuacggcuggcauugacuuguaacagaugacauuugaugaaaucaaccagccucucacugguaucucagcagaaacagggcuguaccucccaggcauccugggaaggaugauagaagugugugaucugugcuucccuaccgggagcugacuuuugaggcucucuggacugggacuuugccauaaaacugcuuaucagaaaccucagauaaguggagugcccuguguccuggccacguacucuggggccagcuccuccauccauucaguccucccacaucccaucuucaccaagcagaguggaaagcggcaggucucugcgagaaaaggaggcucuguacccagccuucagugagauaacuuuagaguggggccuuguauucccuacacaggccuuguccccgacacggccucuuugcccuugcuucuccuucugcuaagaaugcuccuucccaacuccuuggcuggacacacggcuccugcucugugggccuguccuguucccacucagagccucagcaccccccauguggccaagacacagccccucuugccuuagguugccgugggucuguuuccacaucuguuuccccuccagacugcagggcuccugagggacagggccuggggccaagucuccucugcguuccugaugccugguggugugccacgcucuccgugggugcacgguaaauaucugccgaguggcuagauguauccaugguugcugaaggccaaguguguugaccagagggcgugggaaaggcuccacugggguggcugggguagagauagaccuuaagggguccagaagacuccaccagcuggagggaaaggcccuacagagacaagguacuaggaaaggcccagaggacagaggaggggcccuguggggagccugugggcaggaagggccugugcugggcuuugaaacuggggacucagguacugcucuagcgugaggguccuuggcauuuuuuuugguccaggacccccugaggucccuggggaaugagaacaggcucacacagccacuuucaagagguuugcagguccccugaggcuuagccacagaccccucccaccccagcagagacacagcagaggcuucugaguggaggccagguggcuucagccugggguucuagaagggagggaagagacacacccccguguguccuccagagccucagccuucucccugaaucuccccuuugccuccucacuguaacccacaccuggcucuccuugaaggacccgcuugccccgcagccuccugagaguuuucucucccagucccucucccacugggccuggaggugggguaggguccuccuugcccccagccuugaaucuucugucacccuacaauaccacuugcugucaccccggugauagguaucuacgagccuggggugcucccccacauccucaaagaugugagccccugacucagcguugccucugguuccugacccuccacauucacaugaccacgcgcuggccuuuaucaucgccagugacagcagcucucccguaaauacaaguuucaagcaccccacuuuccagucucugccuucugucuuuccaguucauucccucuaguccuccacccacacagugcuuuuccccauugacagggaauugcuccuggccgcuuuucccagccccaucccguucaugugccuugcuuuguacccagcauggacuccauggccugucauugucacuccuucaccuauacuuccugccuccuugcuucucucucucuucgucauccuggcaucaccaccccagaacugcuugguuucaguucuccaccauggcuaggggaacauaccuuuuugcugacugcucucacuuucuuuuuuuuuuuuuuucuuuuuuuuuuuuuugacacagagucucgcucuguugcccaggcuggagugcaguggcacacucucagcucacugcaaccuccaccuccgggguucaagcaguucucucugccucagccuccugaguagcugguauuauaggcacccgccaccacacccggcuaauuuuuguauuuuuuuuaguacagacaggguuuugccaugguggccaggcuggucuugaacuccugaccucaggugauaugccugccuuggccucccaaagugcugggauuacaggcaugaaccacccugcccggcccuauugcucucacuuugaaaucacgacaugagccacagugagccuaugaugugguuugacgucuuucugcauuucucuguucaccccucucccagaaggcaugccuccuucccuccccucagccugcagccccuuccccuccacgcuuacucucagcugauagcccugcugcugucucgcugagaaaauagaaauagccagaggagaauucccucuaccccaugcacacaccucuguccccgccuacuccacauucccuguugucagcaccgauguguuuagcugagggugguccccccauucaaggccaucaucuccugucaucuacuucuugacaccauuugaacaauuaucuccccucuuuccuacauaacacuuuccccuuuucuacuauauauuuuuugcuauggauugaaaguauccccccgaaaucauauguugaagccccaaucccucgugugaugguauuaggagguagagcacuaugggggugauuaggucaugaggauggagcccucaugaaugggauuagugcccuuagacgaagaggcaagaaagagaugaucugucucugccaugugagggcacaacgagaagauagccaucugcaaaccaggaagugaacccucaucaggaacucuaucagccagcaccuugaucauagacuuccuagccucuagaacugugagaaauaaagguuguuuaagccucccagucuguaguuuucuguuauaauguccugaccuaaguuauuuuccaucgcuauacaauggguuauuuuuuucuuuaaaaaaaaauuauuucuugacucuacuuuuuccuccagagacugcuuauauuccacugucuucauucuucuccuccuguuuucucucuuuaaacuuuucaaaaauagcaaaauauaacacauauagagaaaaugauauacagcucagugauuuaucacaaacaccuguguaaccaccacucgaaucuagagauaggacauuacagcaccccagaagcccuccuuuuguccccucuucccaaagaaggguaaccaauaacuugccuuuuaugauaaaggcuuuuuuuuuuugagauggagucucacuguguugcccagguuggagugcgguggcgcaaucucugcuuacugcaagcucugccuccuggguucacgccauucuccugccucagccuccugaguagcugggacuacaggugcccgccaccacgcccggcuaauuuuuuguauuuuaguagagacgagguuucaccguguuagccaggauggucuugaucuccugaccucgugauccaccugccucagccucccaaagugcugggauuacaggcgugagccaccgcccccggccaagauaaaggcuuuucuaucuggcuucuuuguuagcauuuuguuggcgagauugauacguuuugugugcagcugucugucauuuucauugcaauagaauuccauugucuacuauaucacaguuacucauucuacuacugaugaaaauuuggguuauuucuaguuuuuuuggugcauacaugcauacauuucugguagacauaccuagaagugaacuggcugcauuaugggccauaacuugucuucaacguuaguaaauaauaccgcccgucuguuuuccaagcagcaguaaauggcacuuucuguuacuucauaucuucuguuacuugguacugucagguuuuaaaauuuuagucauucugucgggugucuaguaguauguuauugugguuuuauuuugcauuugccugauugcaaaugaaguugagcacuuuuugauacagugauuaaccauuuggauauccucuucagugaaguaucagcucaauucucuugacuauuuaaaaaauaaaguuguuuaucuuuuucuuacagaguuuuaggaggaguuuuuugguacaugugcaguccaaauacacaccuuuugucagugauacguguucagcugcacacacgguguuuugccuuuuuauucuuuuaaugguaucuauugauaaacaugaguucuuaguuuuaaugaagucaaauuuguucaucuucuuuacgguguacuuuuugugucuuguuuaaggaaguccuucucuaucuuaaagcuuugagaagcauuccuucuuucuccuauuuucuaaaaauuguugaagaucuccuuccuuccuuccuuccuuccuuccuuccuuccuuucaucuaucucucucucacccaggccaaacuucaguggcaugaucauggcucacugcagccucaacuucccaggcucaagugauccuccugccucagccuccugaguagccaggacuacaggcacgcaccaccauaccuggcuaauuuuaaaaauuuuuuguagagacacggucucaucaaguuacccaggcuggucuugaacuccugggcucaaacaauccucccaccucagccucccaaagugcugggauuacaggcaugagucacaugucuagccuguauucuuucuuucuuaaauguuuggaagaauucauggguaaaaccaugugacccuggaguuuauuugugggaagcuuuuaaaacauggauucgauuucuuuaacaaauauaggacuaugagauuuucaucucaugucgguuuggguauguuguguuuucaaggaauuuuucuauuuuaucgaaguugucaaauuugucugcagguccccuuauuuccuuuuuaauguauggaggaucugaagggaugguacuuuguguugucucuauuucuuguuugguuuugcuagugauuugccaauuuaaaaaaucuuuccaaagaaccaacuuuuggcuuuguuuauuuuuugaaaaccugaguagcugggauuacaggcgcccaccaccacacccggcuaauuuuuuuauuuuuaguagaggugggguuucaccauauuggccaggcuggucucgaacuccugaccucagaugauccacccgccucggccucccaaagugcugggauuacaagugugagccagugugccuggcaagccgcuuuuuaaauggcaccaaucccauucaugagggcagagcccugaugaucgaauuaccuccuaauggccccauuucuuaauacuaucacacugagaauuaaguuuuaacauaagaauuuuaggaagacacaaacauucagaccauggaacauauauaaaacaguuguccuaccaacuaacagaauacacauucuuuucaagaacaccuauauaaaaauuauagacacugaccuaugcuggccauaaagcaaauaugaacaaauuucagauaccugaagagauuuagacuauguucuccaacuacagugcaauuaagcuagaaaucaauagcaaaaauguaacuauaaaugagcccguauguuugaauuuuaagcaagauauauguaaauuaucuaugguucaaaaaagaagucacagugaaauuuagaaaauaucuugacguggcggguugcaguggcucacgccuguaaucccagcacugugggaggccaaggcggguggaucaccugagguaaggaguuugagaccagccuggccaacauggugaaacccugucucuacuaaaaauacaaaacauuagccaggcgugguggugggcaccuguggucacagcuacuugggaggcugaagcgggagaaucacuugaacccgggaggcagagguugcagugagccgagauugcaccacugcacuccagccugggcaacaugagugaaacuucaucucaaaaaaaaaaaaaaaagaaaagaaaaagaaaauaucuugacccaaugaugaugcaaauacuacguaucaaacuuguaggaugaacuuccacuucuggccaugacagaggagccuguaucagacuagccuuccuauuuauauauuuauuuuugagauggggugucgcucuguugcccaggcuggagugcgguggugcaaucucagcucacugcaaccuccaccuccugaguucaaguaauucuccugucccagccuuccaaguagcuggaauuacaggcgcccaccaccacacccagcuaguuuuuuauauuuuuaguagagacgggguuucaccauguuggccaggcuggucucgacaccugaccucaggugauccaccugccccugccucccaaagugccgggauuacaggugugagccacugcgccuggccgugagugaccuuuuuaauguguuguugaauuugauuugcugguauuuuguugagaaguuuugcaucaauauccaucagggauacuggccuguaguuuucuuuuuuuauaugucuuugucugguuuuggugucagggcaauacuggccucauagaaugaguuuggaaguuuucucuccucuguuuuucauaauaguuugaguaggguugguauuaguuuuuguuuaaauguuugguaaaauuaagcagugaagccacugggucccaggcuuuucuuugcugggagacuuuucauuacagcuuugaucucauuacuuguuauuggucuauuuagguuuuggauuucuucacgguuccaucuugguagguuguguaugccuaggaauuuauccauuucuucuaggguuuucaauuuauuggcauauaauuguucacaguaaccucuaauaauccuuugaguuucugugauauugguuguaauaucucuuuugucauuucugauuuuuuuguuuggguuuucucucuuuuuuuguuagucuaguuaaagauuuauugauuuuguuuaucuuuucaaaaaacuuuauuuuguugaucuuuuguauuguuuuguuucaauuucauuuauuucugcuaugaucuuuauuauuucuuuucuucuacuaauuuuggguuugguuugcucuuuucuaguucuuuaagagacaucauuagauuauuuugaaguuuuucuacuuacuugauguaggugcuuauagguacaacuuuccucuuaguacuucuuucccuguaucucacagguuuugauauguuguguuuccauuaucauuuguuucaggauguuuuuaaauuuccuucuuaauuucuucauugaccauucaagagcauauuauuucauuuccauguguucguauggugugcaaaauaccuuguuuuugauuuguaguuuuauuucauugugaucacagaagauacuugauaugauuucaaauuuaaaaaguaauuuggcugggagaaguggcucaugcuuguaaucccagcgcuuugggaggccgaggcaggcagaucacgaggucaggagaucgagaccauccuggcuaacacagugaaaccccgucucuacuaaaaauacaaaaaauuagccaggcaugguggcaggugccuguagucccagcuacucaggaggcugaggcaggagaauggugugaacccgggaggcagagcugguagugagccgagaucgcgccgcugcacuccagccugggugacagagcaagacucugucucaaaaaaaaaauaauaacaauaauaauaauuuaagacuuguuuuguggccuaccauauggucuauccuugagaaugauccauaugcugaggagaagaauguguauucugcagccguuggaugaaauguucuguaaauaucuaauagguucaucugaucuauacugcagacuaaggcugguguuucuuuguugauuuucugucuggaugaacugucuaaugcugaaaguggaguauugaagucuccagcuauuauuguauugaggucuaucucucucuuuagcucuaagaauacuuccuuuauauaucuggguguuccaguguugagugcauauguauuuaaaauuguuacauuaucuugcugaauugacccuuuuauauaaugaccuucuuugucucuuuuuauaguuuuugucuugaagucuguuuugccucauagaauagcauagcuauuccugcucuuauuugguuuccauuugcauggaauaucuuucuccaucccuuuaguuucagucuaugugugucuuuacagguaaaguguguuucauguaggcaacagaucacugggucuuguuuuucuauccguucugccacucugugucuuuugauuggagaguuuaguccauuuauguucaauguuauuacugacaaguaaggacuuacuccugccacuuuauuaauuauuuucuuguugcuuugugaucuucuuucuuuccuuccuguucuccuuuuagugaaggugauuuucucuggugguauguuuuaauuucuugcuuuuuauuuuuuuguguguaucugcuguauguuuuuugauuugagguuaacaugaggcuugcaaauaauaucuuauaaccuaauauuuuaaacugaugacaccuuaacacugauugcauaaacagacaaacaagcaaagagaaaacuaauaaaaacucuacauuuuaacuuuguccccccacuuuuuaacuuauuguacuguuuaugucugaaaaguuguaguuauuauuuuugauugguuccucuuuuagucuuucuacucaagauaugaguggucuacauaugacaguguuauaauauucuauauguuucuguguacuugcuauuaccauuaaguucuguacuuucaagugauuucuuauugcucauuaauguccuuuucuuucagauugaaaaacucccuuuagcauuuagcaguaugugaacugcauuuuucaaguccagaauuucugcuugauucuuuuuuuuuuuuuugagauggagucuugcucugucgcccaggcuggagugcaguggcgcgauuuccgcucacugcaagcucugccucccggguucacaccauucuucugccucagccucccgaguagcugggauuacaggcgcccgccaccacgccuggcuaauuuuuuguauuuuuaguagagaugggauuucaccauguuagccaggauagucucgaucuccugaccuugugauccgccugccuuggccuuccgaagugcugggauuacaggcgugagccacugugcccagccugcuugauucuuuuaaauuauuucaaucucuuugcuaaguuuaucuguuaggauucugaauuccuucucuguguuagcuugaauuucacugaguucccucaaaacagcuauuuugaauucucugucugaaaggucacauaucucugucucuccagaauuggccacugguaccuuaauuaguucauuuggugaggucauguuuuccuguauggucuugaugcuugugauguucgucagugucugggcauugaaguuagguauuuauuguagucuuugcagucugggcuuguuuguaucuguucuucuuaggaagacuuuccagguaauaaaagggacuuggguauugugaucuaaguuuuuggucacugcagccauaucugcauuagggggcaccccaagccuacuaauacuauggcucuugcagacucguaaagguaccacuuggguggucuuggauaagaucuggaagaauucucuggauuaccaggcagaggcucuuguucucuucccuuacuuucuccccuaaaaguggagucucucucucugugcugggccgccuggagcuaggagaggggugacacaggcaccucuguggccacuaucacuaggacuaugcuggcucagaccugaagccagcacagcacugggucucacccaaggccuacagucuccacugccuggcuacugccuacguuugcuuaaggcacuagggcucuacagucagcagguggugaagccagugagauuauguccuucccuucaaggcagcaaguucccccuacccccauccugggaagguccuuagaugccaucugggaggcagggccugcagucagaaaccuuaguaaucuccccagugcucuauucuauuacagccuggcugauacccaagccauaaggcaaaguccuuccugcucuucccuccccuuuccacaagcagagaagucucucuccauggccaccacugccccagcccuguggcagugcugccaggccacugccaacguucauucagggccuaagggcucuugaagcaacugaacacugccaggccugggacucucccuuuaggguagugggcuccccucugacccagggcagguccagaacugccaccccacagccaacacuuagaaucugggaccccaagagcccucuuggugcucugccacacuguagcugagcugguaccuaggcugauuuuugcuuuuuaugaagguacuuuuuuguguguauaguucaauuugguuuuccuccagggaggacaauugguggagguuucuauuugggcaucuuuuuuuuuuuuuuuugagacggaguuuugcucuuucacccaggcuggagugcaguggcgcgaucucggcucacugcaaccucugccuccuggguucaagcgauucuccagccucagccuccccaguagcugggauuacaggugccugccaccaugcuuggcuacuuuuuuuuucaauuaaaaaguaaacuuuaaugucgaaaaugcaaacuuggggaaggcagaaagaucacacacaaggcugucgcuucacacuuggaagguugcacggcggccaggagaggcacuccucacuucccagacagggcgggggccgggcagaggcgcuccucacuugccagacggggcggcggccacaugccuggcuaauuuuuguauuuuuaguagggacggggauucuccguguuggccaggcuggucucaaacuccugacuucaggugauccacgcaccucggccucccaaagugcugggauuacaggcaugagccaccgcgcccagcccuauuuggccaucuugcuuugccuccaccuucauuugauaacagaacacccccauguaaccaccaccacaaucaagauauaagacauuucuguuauucuccaaauuuccuucacccuccuuuauaguccauggcacccaccccaucccugggcaacaccuaugugcuuccuuuuuuuuuuuccccgcaggaggacgucuuccuauaccuaugugcauuccaucacugcugcuuuuaaucauauagcguguagucuuaugagucugacuuuuucacuuagcauaaugcuuuugcaauuugugauugagcguuuucauaugauucuguuuuuucugucucuuagcuuggaaguuauacacuuuuuaguaguaacuguugggagaucguucuccaagagucucucucauauuuccauacauccugcuagcagagacauugacuaccuguuuuugucuguuuaguguugcuauaaaggaauaccuaagucugaguauuauacauagaaaagagguuuuauuugucucauggcuccucaggccauacaagaaacauggugccagcaucuuaccagugucacauggcaagaaaggaagugaggaagagaaaauaaguuguuaacugguuguuaaaaagugccaggcacgggccaggcacaguggcucgugccuguaaucccagcacuuuggguggccaaggcgaguggaucaccugaggucgggaguuuugagaccagccugaccaacauggagaaacccugucucuacuaaaaaaaauacaaaaaaauuagcugggcaugguggugcaugccuguaauccuagcuacucgggaggcugaggcaggagaauuucuugaauccaggagguggagguugcagugagccaagaucaccugggcgacaagagcgaaacucugucucaaagaaaaaaaaagugccaggcucuuuuuaacaaccaguucuuacaggaacuaauagagugaaaacucacucacccccaccccacagggagggcauucauucaugagggauccaccccuaugacccaaacaccucccauuagccccccaccuccaacauuggaaucaaaauuuaacaugagguuuggggggcagaaauccaaauuauagcacuaccuuuguuccaggcuaccuucaaaggauguuuauacagcaaacagccuuggaaaauagaguuagggucuccuuguagagcacaggguaaguuugcuuacuuuucagcauaaucaagauugugucuucuucuggagcaaaacuuugacaacaacaagcggggcaaagucugaaaccuuuugcacaucuugacagaaccuuagagauuacgagauuuaucucugccuuacucaagguccauuaguaucuuccagaacaauaaguuggucuuagaauccuuuagcuauguauucccuuccaggcuucgaugcugugugcuguuguuuuauuuaguuuuuauuuuaaacccaacaagacgcuauaccaucaauacuuauuuagauccccccacauauuuaacuugccauggugcuucauucuuucaugccucuuuaagcauccaucuaggaucguguucauuccacaugaagagaaagcuuuuggcccagcacgauggcucacaccuguaaucccagcacuuugggaagccuaggcgggaggaucgcuugagcccaggauuuccagaccagccugggcuacguggcaaaacccugucucuacugaaaauacaaaaaauuagccagguguggugguucacgucccugcuacucgggaggcugaggugggaggauuacuuaaaccugggagguugaggcugcagugagcguugauugcaccacugcacuccagcgugggugacaggagugagaccaugucuccaaaaaaaaaaaagaaggaaagaaaaagcuuuuguauuuccuuucguguaggucugcuaaugacaaagucucuggguuuuuuguuugacuagagaaauguuuuaauuuuaaccuuauucuugaagguuuuguuuuuguuuucauuuuguuuugugugcuaaguacagaauucucauuggcauuuauuuauuuagagacagagucuugcucuguggcccaggcuagaguacaguggcacgaucuccgccucccagguucaagcgauucuccucccucaaccuccugaguagcuggggcuacaggcaugcaccacuacaccugacuaauuuuuguauuuuuaguagagacgggguuucaccguguugcccaggcugaucucaaacuccugagcucaagugauuugccugccuuggccucccaaagugcugggauuauaggcaugagccgccgugccuggccagcauuuauuuucuuuucagcucuuuaaggaagucauuccauuaucucuggguuccauuguugagaagccagcugucauucuaaugguugcccuuugaagauaacuuuuuucccucugcuauuuuaaauauuuccuccuuguauuuuauuuucaacagguguaauguggcacauauaucagcaauuguuauguuacauacaauacauauugugcaacauauguaucauuaucaguuauugcuguguaacaaacuacuccagaacacaguggcuuauaaaaggaaucauuuauuuaguccuuaaaucugcaauuugagcagagcucagugggaaagccucagcuuuacuuuauauggcaccauauaagguaacucgcaacuggcaaguuggugcuggcuguuggcugguaguucauucagggcucagggcccaggaccaagagucgucaccauggcuugcuucagccuccuugaggcaugauggcugggucccaagagaagagaaauagaaacuuccagucucuuaaggcauuggucuggaagcugggacggcaucacuuuugccauauucuguugguaacgcaguuacaucgccagauuaaaggguaaagagauacaaauucccacugcucagugcaaggaauaucagugauuuuagggggcccuguuuuaaaaccccuacaaggugcuaagcguggauuucuggggcuuucuuguuuuuuguuuuuuucuauguguuuuuuuuuuuuuuuuuggugguggggucagggagggcuuauaggguauguuaaaucagcagaauaauuuuauuuauuuauuuggagauggaguuucacucuuuugccuaagcuggagugaaguagcgugaucagagauggaguuucacucuuuugccuaagcuggagugaaguagcgugaucucggcucacugcaaccuccgccccgcugguucaagcaauuccccugccuuagccucccaaguagcugggauuauaggcacccaccgccacgcccggcuaauuuuuauauuuuuaguagacaugggguuucgccauggcuagucuggaauuccugaccucaggugauccacccaccuuggccucccaaaguggugggauuacagguaugagccacugugccugaccuauaauguuuuuuaaaaaucaguuuuggaaaguuugcagacauuaacuuuucaaauguagcuuccauuugauucuuuuucuacucugccucugauccuccacuuauguauguaugcuagaucuuuuauuagauagucugugucucuuauguacucuacuauauuuuguauucuucugucucuccaugcuuuauucuguuuacucuuuccugauuauauuuuuuaauuuuguaauuuccauuugaugcuuuuuugaucauucaaaacucuucaccaaaauucuaaauuuccuuuuuuaaccucucgaauguuaucacaguuacuuuaaagucuauuuuggauaacuuaaauauuuacaguccccucacagauauguuucuuuuguauauuguuucuguugguuuucuuucaugucuuaucuccacauaugccuggugaguuuugauuauguguuggucauuguauuugcaaguaugcucguagaaauaaucuggaauggccgggcgcaguggcucaugccuguaaucccagcacuuugggaggcugaggcagguggaucacgagaucaggagaucaagaccauccuggcuaacauggugaaaccccaucucuacuaaaaauacaaaaaauuagcugagcaugguggcacguuccuguaaucccugcuacucgggaggcugaggcaggagaaucacuugaaccaggaggcagagguugcagugagccgagaucacgccacugcacuccagccugggugacagagcgagacuccgucucaaaaaaaaaaaaaaaaaaaaaaaaagaaauaaucuagagccuaguuugauguuuccuuacaaagaaugaauuuauuuuugcuucucccauugcaacuaggauaaccucagucuaguuucuggaacugaaaucacuugaggcugaacuguggucucugugagagcgugucuguguauggcucacccuuauuccuaggcuacguaguucuuuaggacccuaacccaaaguaagagauguucaucagggcucuccucuuggcagacgccugggcuccagucccuguguccugagccccaugaggcuguuacuggugcugcucgucugcccauccucuccaguaacagccaccugaacacugcaauuccuggguuuccaucauuccuuccagccuggugagucaucagugucuuuugagguauccagugccugccagcagauguuuuuuaauaauuuguccagcauuucuggcuguccucaguagguggucuguuucacauucccuagucugcuguuaauggaaaguggaaguucugagagagaaucaucguucccgucagcauucaaaugccugauuacacuuuccccauucgcuauccuuuccuuuauuugcuccucaccacagcaaaacuccucaaaaauaucuaucuuugcaaucuucagauucucacauuguguccuuaaacccacuuuaaucaggccuugguucccuccauuccacuaaaaguaauguugucaaggucgugcaugccuccgugaugcuaauuccagugaugaguuuucaguugucauucucugacauaucggcaacacuugauguggaguacccugauguugagaggcuggugagaugaaggaaaaacccagccaagggcaaugaggaauggcuuccuuccgccuccuccuucccuaucuuuguugugguuuuuguuguuucuguaacacugauuacguuauaguuuauuuaauguacuuccuuauucuauguuuuuacuuuagucauuuuguugaucuccuccauaauaacauaggcucgggccaagcacaguggcucacgccuguaaucccagcacuuugggagaccaagauggguggaucacuugaggugaggaguucgagaccagccuggccaacauggcgaaacccugugccuacuaaaaauacaaaaauuagcugggcgugguagcaagcgccuguaaucccagcuacuagggaggcugaagcaggagaauugcaggagaaucacuugaacccagggggcagagguugcagugagcugagaucgcgccacugcacuccagccuggguaacagagugagacucugucucaaaaaaaaaaaaaaaaaaaaggcuucaggagggcagagcauuuuaugcaauuguucauuaauugaccccuccauuuggcacagaucacaugcccaguaguuaacuguuaaucaacgcacucucuguggaacaacaggcuggucccguugagccaacacucucugggcacugccuucacuagacucuggcuggcugcugcgcuuguagagguaugcaagacaaaaccuuuugguauguuaaaagcccuggucagaacuuuaaguaaccaucacugacauauaaugguuaugguuuugaaagugcuuuuauagugguuuuucaucuguccucacagcaccucugggagguagguaggacagguacaguuagucucauguuucaaauggggcucagagagggaaaaggauuucccaagaucacacagcaccuuaguagcaaaacuuggacucaaccucaacacuuaaaaaugaacaaagcuggccgggcgcaguggcucaugccuguaauccuagcacuuugggaggcccaggcaggcaggucaccugaggccaggaguuuaagaucagccuggccaacaugacaaaacucugucucuucuaaaaauacaaaaaauuagccgggcaugguggcgggugccuguaaucccagcuacucaggaggcugaggcaggagaaucacuugaaccugggagauggaggcugcagugagccgagaucgugccauuguacuccagccugggcaacaagaaugaaacuccaucucaaaaaaaaaaaaaagaaaagaaaagaaaaagaaaaguuucccuuuuuuuaaauaucucauuuuaaugacugcauaauaguuuauuacauaguuauaccauaauuuauauaauauuuuguugcuguacauuuagguuaaacaauacuuacuuaguuccuacuaugaagaggggccaaguacucgaggcuggagcucucacauguggcaaugaaauuagaaaguggauauggcagggcugugguaaaauaaaauauaaaaauaauaaaugauauuaccaaagaaaaggaaaguuuuucaaaauaaaggaaaaucuagacaagcauaguggcucacaccuguaaucccaguacuuuuggaggcugaggcaggaggaacacuugaggccaggaguucaagaccagccugggcaacauagcaagacccccugucaacaaaaauaaaaaaaaauuaggccaggcacaguggcucacgguggcuagugccugaaauccuagcacuuugagaggcugagggggguggauugccugagcucaggaguucgagaccagccugggcaacauggccaaaccccaucucuacuaaaaacacaaaaaauuagccagguguggcagcacacgccuuuaaucccagcuacucuggagacugagguaggagaauugcuugaacccgggaggugaaggucgcagugaggugagauuacaacacugcacuccagccugggugacaaaaugagacucuaucucaaaaaaaaaaaaaauuagcugggcaugguggugcaugccuguaaucccagcuacucaggaacuaagguaggaggaucccuucagcccaggaauucgaagaugcagugagucaugaucacaccaccgcaccccagccuggguuacagagcaagaccuugucucuaaaaaacaaagaaagucuaaccuaaacgccauuaugucauuuacauguguauagggguguguguguguguguguguguguguguguguguguguguguguguguguuugcuugggaggggagucgggcuggagcuggccaggccgcagccuggggaccuucugauuccagcagggaugugggccgagggucccgccuuacucauuucgggucuugcuccucuguccuggcucuacagacucuuccagcuggaguuggaggcugacgcccuagugaauuuccaucaguauucuucccagcugcuacccuucuaugagagcuccccucagguccugcacacugagguccugcagcaccugaccgaccucauccguaaccaccccagcuggucaguggcccaccuggcuguggagcuagggauccgcgagugcuuccaucacagccguaucaucaggugagcaagggaacaagaccauuuggacaacguguguguaccugcuugugugggcagugggggccgcaggccucgguuccccuccauaguuugacuuaaaaaggagcagggccuggcauggucgcucacuaacgcagucccagcacuuugggaggcugaggagggaggaucacuugagacuaggaguucaagaccagccuggcaaaauagcaagaccuugucucuacgaaaaaauuaaaaaauuagcaugugucuauacuccuagcuacuugggaugcugaggcaggaggauugcuugagcccaggaguuagaguuuacagugagcuaugauugcaccacugcacuucagccugggugacagaaugagaccuugucucuaggaaaaaaaaaaaaaaaaaaaaaaaggugcugcguugcuaccagauuaaaauguaagaaggacaauguaauguuuccagaguccggagugcucaccaggugccaggucugugggagcugauuucuacccaccaugaaauugaauuuucccaacccccacaagguaucgucauuuuauuuuacuuuauuuuauuuuauuuuauuuuauuuuauuuuauuuuauuuuauguuacguuauguuauuuuauuuugagacggagucuuauucugucacccaggcuggagugcaguggcgcgaucuuggcucacugcacccucugccuccuggguucaggugauucuccugccucagccuccggaauagcugggauuacaguaaugugccaucaugcccggguaauuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgcguagcugggacuacaggcgcccgccaccacgcccggcuaauuuuuuuguguuuuuuaguagagacgggguuucaccauguuggccagguuggucucgaacuccuaaccucaggugaucugcccuccuuggccucccaaagugccgggauuacaggcgugagccaccaugcccggcccagguaucaucauucuagagagagcuaacaggacuugugcaggucacucagccagagagggugaaagaggggcuuggauccuuggugucugcccaggcugcucuucuggaagcugaaggccuccuuuugugaauccauucagccagcagauggagcagcuguugccccuggugagggcacuguccccacccuugcacagggcaccaguuggccaucuugugcagagguagccacaccuccucugagucucuauccuagauagcucaguuaagcucccaggcccagaacucaaaaccucacugcuggccgggcgugguggcucacaccuguaaucccagcacuuugugaggccgaggcggguguaucacuugaggucaggaguuugagaccagccuggccaacguggugaaaccccgucucuacuaaaaauacaaaaaauuagcaaggcgugguggcgcacgccuguaaucccagcuacucgggaggcugaggcaggagaauugcuugaacccagaggcggagguugcagugagccgagauugugucacugcauuacagccugggcaacaagagugaaacuccaccucaaaaaaacaaaacaaaacaaaaacccucacugcacuuuaguuuccaggcgugcuuuuggacagcacugucucaucucaccaucacucuguccauuuccuggggcaggcacagcagcuugugucgauaaggauauugacgcccagaaagguuaagugaauugccugaggcuagugagauauccguguucugugacccuuuccugugccaccacccugcccacuuccugcugguguggcccuggggcccaucucuuguacgagugagcaaacugaacagaaaccugauacaggucacaucagauauaauuacauucaaaucagcccaacuagcugaguggcgggaaugcucuugagcucaaauaaaccagaaaguccgaguuuccgagugcacuucccugcaugugcacuuaggucccccugccaccuuguaccacaccugcucaccucugcucacccuggcccucuccugcagcugugccaauugcgcggagaacgaggagggcugcacaccccugcaccuggccugccgcaagggugauggggagauccugguggagcuggugcaguacugccacacucagauggaugucaccgacuacaagggagagaccgucuuccauuaugcuguccagggugacaauucucaggugcugcaggugagcagggggaggggcagggugacugguacugauaccucccgguguccacgguucccuuugggccccuaggcucaggugucacucucaggccucucacugucccccauugguccuugaggccugagcuccuucauggagggugcagaccccucccuggcucuucccucccagcccuuuuccaggagccacguccucagucucuuugcuugauaaaccuggggacggccuccaacccagcaaaauaaaccccaaaaaaggcccagcuccagucaguuaguucaguuccacuuuuccugagcacaaacugugagccagaugccugccuggaggggcucgugggccagcgggaccugggcuuaaccuuuugcaagcuuguccaaucuguggcccugcaggcugcaugcagcccaggacggcuuugaauguggcccaacacaaauucacaaacuuucuuaaaacauuaugagauccaugcauggaccuuuuuuuuagaucagcuguuguuagcguucauguauuuuaugugugacccaagacaauucuucugauguggcccagggaggccaaaauauuggacaacccuauuuuacaggaauucaaaccaagcaaaccaaacugucuccaguuccuguaggcauuugugccagaggcccuccuguuaacguuuuugauuaccugggcaaaagaugugauuuuuuaauugugggcaagcagauggggugauacuauuaaauagcuauuucauauauuagauugaacagaaaaggcaggauguuggauuauguuuuauugucuagaauuagaaaauucuucuaaagaucauguucucucugccuuggcaucagaaugcaacuacguuauaccagaaaauguggauuccuuuuuuuuuuuuuuuuuuuuuuuuuuugagacagaguuucccuaugucucccaggcuagagugcaguggugcgaucucggcucacugcaaccuccaccuccuggguugaagugaugcucgugccucagcuuccugaguagcugggauuacaggcaugugccaccaugccuggguaguuuccguauuuuuaguagggaugggguuuugccauguugcccaggcuggucuccaacuccuggccuuaagugauccaccugccucagccucccaaaaugccgggauuacaggugugagccacugugcccggcccagaaaauguggauucauaucuuaugcuucuugcucucagggaagggaauucuccacccacuguugaacuccacuuucaccgagaauccucugcgcacccagcauggugccgcgcagacccugccuccaugcgggggugugcacacccgcuucucgauagucaugcacgacugcagcuguccuuuauccggugcugauuggugccugaccuugaacugaguguuguauguguuccaguuaauucuuagaauacacucaugggguggaggucauuauuccccuuuccucuccgaagaaacugagguucaguguuguuaauuaagaagcgugcccagggagggccacaaagcugagagaguggggcuugaccuuacauuggccucgaugccagcccuuugcucuuccugcugugucucuggccugccuucagguccagugggacugcugugaggugacccuggugucacauggguacacugugguuguaaugaaccucauggggacagcacugagccaaaagugagacaguaaaacccuccuagcacuuucuuuuuuuugagacagcaucuagcucugucgcccaggcuggagugcaguggugugauuguggcucacugcagccucaaccuccuggacucaggugauccucccaccucagccuccugagcagcugggacuacaggcucgugccaccacaugggcuaauuuuuuuuuuuuuugagacggagucuugcucugucgcccaggcuggagugcaguggcgcgaucuuggcucacugcaagcucugccucccggguucaugccauccuccugccucagccuccagaguagcugggacuacaggcgcccgccaccacacccggcuaauuuuuuuuguauuuuuaguagagacaggguuucaccguguucgccaggauggucuuggucuccugaccuugugauccgccugccucggccucccaaagugcugggauuacaggcgugagccaccacacccaggccacgccagcuaauuuuuaaaauuuuuuugguaaagauggggucucccuauguugccgaggcugguaucacacucuuggucucaagugauccucucaccucccaguguguuggaauuacaagcaugagccacugcgccuggccccuggcucucuuuuuaauacugcuguucuuucauugaaaacauaguaccugcauguagaaaaaaaucagucaggacagaaugaaaagcaagaaucauucccaccuggacccccagugcccauccugagauacagcuaccuuuuaaguuccuugacucagaaauguuucaugugagccacagucaugccaggucgaccccuucccucccauccacacuggcacuuggcuuuccuggugcuucucuuuacguucuuuuuuuuuagacagaguuuuugcucuauugcccaggcuagagugcaaugaugcaaucucagcucacugcaaccucugccuccuggguucaagcgauucucuuuccucagguuccugaguagcugggauuacaggugccugccaccaugcccggcuaauuuuuguaucguuagaagagacgacauuucaccauguuggccaggcuggucucaaacucuugaccucaggugauccacccaccuuggccucccaaagugcuaggauuacaggcaugagccacugcgcccggccucuuuacguucuuaucagcauccuauggagucaaacuucccuuccucuuucaucagcuccuuggaaggaacgcaguggcuggccugaaccaggugaauaaccaagggcugaccccgcugcaccuggccugccagcuggggaagcaggagaugguccgcgugcugcugcugugcaaugcucggugcaacaucaugggccccaacggcuaccccauccacucggccaugaaguucucucagaagggguaagaccuccuccccuccccaucugcuggccugcugggcuccagcucuccugucaccugucccgugccugaggcaagcaguauccaccauagaucuuagcaucuccagccucagagcagaggccccggguucacaagccucauuaggccccgccuggcccaaagaaggugcuccaucauuguaucauggguaggaaucucgguucacaaguucagcugugcaaggaggagacuuuaaaauuuuucuggcugggcgcggugucucacgccuguaaucccaacacuuugggaggcugaggugggcagaucaccugaggucgggaguucgagaccagccugaccaacaugaagaaaccccaucucuacuaaaaaauacaaaauuagcugggcguggugacacaugccuguaaucccagcuacuuggaaggcugaggcaggagaaucgguugaacccgggaggcggagguugcagugagccgagaucgcaccguugcacuccagccugggcaauaagagcgaaacugucucaaaaaauaaauaaauaaauaaauaaauaaauaaauaaaaauaaauuuauuuaauguaccuuaauuccuaggagugaaucucccucuauaaaacuggagacaaccaaucuuagcccucuuuggggucuccucuuuccagcuccccuccagguggugcuccaguucuggagucugaugcaaccccaaggcccaccuggccccuccucuaacccagcccagccugaucugaacagccccccgauggcuucagugcuccuugguuucuugugugcccagcucaaagccugggaaaugcuugguaagguggccgagugcccguccaccuagaugccucuuuccuuucuggcugguggcacguugggaggcagguacaggcucauguuuugggagccugggaaccccuggugucaggaaaauugucuucaaagggguaggggaugagauaaaaagauaaaugaauaucucaaaucucaaaauacuaucuaggccaggcgcgguggcucacaccuguaaucccagcaguuugggaggccaagguggguggaucaccugaagucaggaguucgagaccagccugaccaauauggugaaacccugucucuacuaaaaauacaaaaauuagccaggugugguggugugugccuguagucccagcuacucaggaggcugagacaggagaauuguuugaaacugggaggcagagguugcagugauuugagauugugccacagcacuccagccagggcgacagaacaagacuccaucucaagaaaaaaaauacuaucuaacaggaacaacaucuagaaugaaugaaugagccaaugaguccuucgauccuggcacugugcuaaagcaccagccucaccgaaaugaauaagccacuccaggacaggagacaccccagccacccagaaucucauagcgcagugccagacaagcagugagaaggcauggacgggcagcacucaggcagggaggcuggcacuugugccuguccucagguuguuccuuccucugggagcugcauccaccuugcuagccccauggggcauugcuagcccuucuaagggcuggaccaagccuggacaaacccuccuuuccuugaaucucccaagcacagccagaaugagcuagagcuuucagaaauacuugaccaaacagagaagauaccaacacccccagccccgcagucagguuccccauuugcagguugugaccugaguggacaccaggugaugcucuucucuacccagagggcuggcacauggccccacucuugcuugucuccagccacccugagcuguacugggcaggagcuguaauugaccaguuuucucucucuucaaacaaccucagcccucaccggucccucuguccccacacaggccauccuggguggguccagcgucccaucacauaagaggaucuuugcacagaagacaaaggaagaggcuccuaccuugaguggagcagggagaucccuuaucgacuuggcagccagcacagcccuacuccaagaaucccacggccucaguguuacugacaagugguucccucacagcucagacuaggagcucccucgcuguuuuucuuuuucuuuucuuuucuuuguuuuguuuuugagacagaguuucacucugucacccaggcuggagugcaauggcaugaucuuggcucacugcaaccucugccucccagguucaacugauucuccugccucagccucccaaggagcugggauuacaggugugcgccacuaugcccagcuaauuuuuguauuuuuaguagagaugggguuucaucauguugaccaggcuagucuugaacuccugaccucaggugaucuacuugccucgcccucccaacaugcugggauuacaggcgugagccaccgcgccuggccaccucugcuguuuuucaaugcagcugaccuuucccacaaagcucgguuugugccugcgguucucagaugguuaagccccugcugaggaagggaaacagauaaucccagacagugagauggaggcugagacugaggaugccugggggcugcacuaggagcucagagacggcaucaggcagcuggaguucagggaagguuugggggcagcagagcccgagccaagccauggacacuagccggagcuggccacucgggugaagacuuggggggcuccagagggcccagggaaagaagcugggccugacuccaugugccuagugcugagcaccaagcgcuggcauaagggcuguagggagcugggcagcauaaauccugggccugugcugggcaccccuaauaauagagaacagcagcugaacacuaacgcugucccagccaccggcuuagccuucaugugggcuauuucacuauagcccagagagcugauguauuuuauucccccucuaaagcugagggccaagugugguggcucaugccucuaaucccagcacuuugggaggcugaggcaggaggaucgcuugagccuaggaguuugaggcuacagugagcuaugaucaugccauugcccuccagccugggugacaaagggaaauccugucucaaacaaacaaacaaaaaacagaugaggaaaccagggcuuagagagauuaaguaauuugcucaaagucaggcagucaguaagugccagaccugggaauuaaacccaugugggcuguccuaguaauugcacuaaaaaaaaaaaaaaaaaaaagcuuuauugagauauaguuccuauuccauacaauccaccuauugaaaguauacaaugauucugauauauuauguuuauuuuuuccaacugugauagauuauauauaacauaaaauuugccauuuuaaccacuuuuguuuuuuguuuuugagacagaguuucgcucucguugcucaggcuggagugcaauggugugaucucggcuuaccguuaccuccaccucccggguucaagugauucuccugccucagccucccgaguaguagcugggauuacaggcaugcaccaccaugcccaguuaauuuuguauuuuuuaguagagacaggguuucuccauguuggucaggcuggucucgaacucccgaccucaggugauccacccaccuuggccucccaaagugcugggauuacaggcgugagccaccacacccggcccauuuuaaccacuuuuaaguguacaauucggugguuuuaaucacauuuacaauguuguccaaccauuaccccuuucuaaaacuuuucuuaucaccucaaacagaaacuguaaccauuaauaacucccgauucuccccuccccacagcccccgauaagucccauauccucucugucucucagaacuugccuguucuagaaccucguaucagugaaaucauacagcguuuguccuuuugugccuggcuuauuucacuuagcaugaugucuucaaggcucauccauguugcagcacguaucagaauuuccuuucuuuuuaaggcagaauacuauuuuguuuauccauucaguccuucacugauagacgccuggguuguuuccaccuuuugucuguugugaagaaugcugcuguguacaugggucugcaaauguccauucaagucccugcauuccguccuuugauacuuccgaccucaggugauccgccugccucagccucccaaaguguugggauuacaggcgugagacaccgcgcccagccagaaaaauuuuaaagucuucuccuugcacagcugaacuugugaaccgagauuccuacccaugauacaaugauggagcacuuucuuugggccaggcggggccuaaugaggcuugugaacccggggccucugcucugaggcuggagaugcuaagaucucugguggacacugcuugccucaggcaccgaguagaaagcaauugugcucuuucccacucugucauacugcuuccuauagcaugcaggucacugugugacucacugacagugugguaaggagguggaggguggcugugugccaggcacagaacugggcucugaaaugccuggucuuccuuacaccccagccacuccucucagcacucucuccauguugcucagcuucuggaggccaccagugaggaagcuggggcuugacuucaagcccaucugacucuaaagccaguaccagggagggugaucauugcugguggcagcaucaggaaggcuuccuggaggaggggguuaguugugccuugaggggcucaguacagccuuaaccauggugagugugcugguuggguuugcugaacuuuguuugcagugaugcucucuguaagcaguagaugaagcuccaaguccuggcuucaucccacgccacgcagacccuagcuucugcucaccaaccggggccccucucucaccaggugugcggagaugaucaucagcauggacagcagccagauccacagcaaagacccccguuacggagccagcccccuccacugggccaagaacgcagaggugaguggauccugagguggguggguggggcagggggccgggccccgcagguccucagggcccucaggaagcagguucccgagaggacccugaggcuagcacuugggggcugaccuugcagugggugugcaggcagagaaguccaugaagagcugggauccuggcagggcucugcugcucucuggcugggcggggggauccgcccugugccucaguuuccucauccaugaauucugcuuuggcgaugugaugaagucagcaaggcagugugugacaaaacucggcacaaauuguaaagugcuucccaaauagaagguggcgugaugaugauuguauuauuagucaggauucucuagagggccagaacuaacaggagauauauauauagagagagagggggguuuauuuuuuuauuuuauuuuuuuugagacggagucucgcucugucgcccaggcuggagugcaguggcacaaucuuggcucacugcaagcucugccucccagguucaugccauucuccugccucagccuccugaguagcugggacuacaggcgcccgccaccacacccggcuaauuuuuuuguauuuuuaguagagacgagguuucaccguguuagccaggauggucucgaucuccugaccucgugaucugccugccuuggccucccaaagugcugggauuauaggcgugagccaccgugccuggccuaaagggggauuuauuaaggagcauuaacucacacgaucacaaggucccacaauaggccaucgcaagcugaggagcaaggaagccaguccaagucccagagcugaaggacuuggagucugauguuugagggcaggaagcauccagcacgggagaaagauguaggcugggaggcuaagccagucuagccuuuucacauuuuuuucugccugcuuuauauucuggccgugcuggcagcugauuagauggugcccacccagauuaaggguaggucugccuuccccuacugacucaaauguuaaucuccguuagcagcacccucucagacacacccagggucaauacuuuacauccuucaauccaaucaaguugacacucauuauuaaccaucaagaugaugaugaugaugauggaugaugauggugguggugguggugcugggccuagcugcacacacagggagccuggcugggcaucuccucugaguucuuccccuaagcuaagcucuguccuccugggaggauggaggccucuggucucaucaccaggaagcacagcuugacagagaaugggaugccccagaguucauggccuacuucucaaugugaugggccaggagggagggcacugccagccucaggguaccucugcauuccaggagccggacaccgagucaggcccuuccguguagguuuggucacucauugucaucacaugcugugagguggggacuugcauucccaucuucacagaagcccugaagugcacauggcuacagugacccauccaagcgcaggcagcugggaugagugaagcugggcuuugggcucaggucugugacuccaaagccaggcuccccucccuguucccaaggcucugccagggaugugcauugccaaggcccagugagaggugauaccuuugcaggguuccagggagggaugcagggagcggggugcuucaggacaggccccagaggagccuuugcaaggagaguggguucuguuggcacuaggaaaggaccagaagccucuuaaaacagucagcacaucuuuggcuuuuugucccuagucuugggaugcugaugggaugggaggcagucuaggccccccuagaacuggggccugccccuggaauccucuugcuagcgcuuuccaacaucccaguaccuguaggccucucagagcagaaguggcagugcccacgugucccggggugcggcagcuccccgagugccugugcuaacucagccugaccgucucccgcagauggcccgcaugcugcugaaacggggcugcaacgugaacagcaccagcuccgcggggaacacggcccugcacguggcggugaugcgcaaccgcuucgacugugccauagugcugcugacccacggggccaacgcggaugcccgcggagagcacggcaacaccccgcugcaccuggccaugucggugagcccaggaccgcguguccugcccuguggggccccggugggaaugcaggagggcuguccggacuggagcccuccuccccacugucucccuccuaucgucagcugcuccaaaucaucuucccacccaaagcucaguucagacccugacuccucccucaggaagccuuccaagucccccucucagcccaaaauaacaccaccuccugugugcugugguaccuuuuccaccugugcccccauuuggcacuugcauggcacgagagggaaaaaugacagcucuggccauagacuggcccugagcaagccaugucaccugucagccucgauuuccucaucuggaaaaugguggugucaauacuuaucuggaagaguuguggaaaaguuaugguggacacuuggucacccucuacagaaugucuaagugacacacgcaguaccuggcccgagugagcauccugcuucccuucacugguccgcguguugcucucaucuucccugggaggcuguaagauccuggcaggcaaagccugagugugcagcccagcagccuguggcaggugccaggcauauucguugguuuauuauagaacacaguuccugcccucaaagcccuuacugucugguuacacaucuagaguaugaacauauuaaaccuagcagaggaggacguuacuguguuacagacauaugugugugcauguauucuuuuuuuucgagauggagucucgcacugucgcccaggcuggagugcaguggcgcgaucucggcucaccacaaccuccgccucccagguucaagcgauucuccugccucagccucccaaguagcugggacugcaggcacgugccaccaugcccagcuaauuuuuguauuuuuaguagagacgggguuucaccacguuggccaggcuggucucgaacuccuguguuggccaggcuggucucaaacuccugaccucaugauccacccgccuuggcaccccaaagugcugggauuacaggcgugagccaccgcgccccaccgugugcacguuuucuauagcaauaccguauguacagaagucuguuuacugagucucagugacagaacaugagagacccccgggacucuaaaagcugauucaggacacauucagagacauccuguuuuauaccaaaggucaaaacuuggaagagauguuguugcccaaaaggcugaaacuauaaauaguuucauuuuugaaacuguggacauuuuuagcacugggugggcccuuggaaugaucuaacucagcaguucucaaguuuuuuggccuauuugaucccuuuauacucugaaaaauuauugaggaucacaaagauuuuuuaaucaucuggauuuucuuuaucuauauuuaccauuuuagaaauuuaaagugugaaaauuucaaaauauuaauucauuuaaaaauaacaauaauaaauauauaugccuacuauguacccacaaaaauuaaaauuaaaaauuuuuuaaaaaacuuaaaaaauaacuggccagcugcaguggcucguguacaccagcacuuugggaggccaagauggucagaucaccugaggccaggaguucgagaccagccuggccaacauggcgaaagcccaucucuacuaaaaaugcaaaauuagcugggugugagaccucugaaaggguaucacguguucacagggguccccaggucuuacuuuaagaacugcugauagacuuuggucaucuucaucccaucuucacaguuuuuggcauauucaucaaccaccuuuacaauuauguacuuaaucaccucuucaaauuggcuuacuuuuauuuauuuauuuugagacagaguuucgcuuuuguugcccaggcuggagugcaauggcacgaucuuggcucaccgcaaccucugccuccuggguucaagcgauucuccugccucagcuucccgaguagcugggauuacguucaugcgccaccacaccuggcuaauuuuguauuuuuaguagagacgggguuucuccauguuggucaggcuggucuugaacuccugaccucagguguuccaccugccucagccucccaaacugcugggauuacaagcgugagccaccgugcccggccuggcuuacuuuuaaacugacuuaaauuuauuuugagagaaauguugcaucacuaccauaaauggccauccauccauccagugccaaccauaaaagguaaccaaugcagggcgcgguggcucacgccuguaaucccagcauuuugggaggccgaggugggcgaaucacgaggucaggaguucaagaccagccuggccaacauggugaaacccugucucuacuaaaaauacaaaaaauuagcugggcguaguggugggcaccuguaauaccagcuacucuggaggcugaggcaggagaauugcuugaacucgguagguagagguugcagugagcugagaucacgccacugcacuccagccugggugacagagugagacuccgucucaaaaaaaacaaaacaaaacaguaacaacaacaaaaaaucacaguuaaugcugaaaacacacacauaucuguagccauagaaguccuaauagaaugugaagaacuguuuggaaaaccccauucuagacccacagcuucauucucuaggcagggaaaucgggucccaagaagaggaaggugacaaggccagagcccacaguuccagguggccaguguguccucugaaaccaugccaugcucugcgccccugcccggccuccagguguggaaaugugugacguucuucguggggacacucccccgaaggcugccauuaggggcacguguguucgguuaccccucagggaugacacccuggacugggugggcaagauggccuucccugcccucacccacccucuccuugcuacuccugaaagccaucagcagcugaccuacuguguccccauggcuccugggucggggucacagaugcacugcaucuuuggaggcggagcuggcagagcaggggcgagucacuucuaguuucugccuggguucuuacacccuccccugugggugcuuuuaagccuguuugucagguccccagccaucaaauggcagacuuuggacuaccagauugacuugggugggggugaggaggguuccagugucuccccgugcugaggagaggcccgcugggugaguugacagguuggggcuggcagccaggggccccuuuguucuucacuuccccggcaguugcacgucuuauccucucuccaucuccaacagaaagacaacguggagaugaucaaggcccucaucguguucggagcagaaguggacaccccgaaugacuuuggggagacuccuacauuccuagccuccaaaaucggcagacguaugugcucugcacucuggggcuggaguggggugaggguuggguggauacagggaccgaggaggagggaagucccaggcaucaggugccagcauccugugcugacccgcccugcucagagcugccaggagcaccucguacucagagagggggcuuccuuacccaagcacaagggcccugagcaguagaugcaggcccaccacggggcuugcuauaccagcauccucucccgugcagcgccccccaccucagggagcuaagauucccagcagggguggggacaggagagccagcagcagccuucuuuccccaccguuggggaauucacugauggaaccacuggcuagaaugaccaagggugcaugcacuacacugcacgagcucugggcaugccugugugggcagagugcauggccaugugcugcacgcucgcacagugagccuuagcuucagagcuggacagagcagauccuccucaccagaggccuggagcccgcucuggaggguuucagcagcugugggggucacugugggcagguaccugauggcagcagugugugugugccagugcacacgugugugucugcaugcaccgcaucuaugaccuccuuuucagcaaucccauccaucaaauggaguaggugcccccuggcuggcucauuagucccuuuggaacccugaacuaucacuuagcauuuuugagaaucacugaauguggccaugggauuccugcuuucuuggcuggaguagaaggaaagaagggguucccacaggcaucgggcagggugacacugaccuccuccucccauauccuccuucccuggccuuaggaagcugcuugggauguaccagccugggggcagcacucccugucagggugggcugaggccucuggagcagcccacgugcccagggccugggagcugggacaggggacggaguguggaaaggaggggccucuccuuugcauguugacaucauuucugauccugugccaucuccccuuccccaaaccaugacaaguugucaccaggaaggcgaucuugacucugcugagaaccgugggggccgaauacugcuucccacccauccacgggguccccgcggagcagggcucugcagcgccacaucaucccuucucccuggaaagagcucagcccccaccgaucagccuaaacaaccuagguaggccucgccucccgacucccucuucuccagcugguucccaggccccuggaucacagcaggccccaccaaagcaacaggaucccuaggacggaagucacuaaaggaagccggggaggauggggccggaguugucagccucuaggcagccagcaacccacagaucccagaggccuagggugucccuggcugaugucccaugcuccguugccccugagaggauguguccugcacacagucucaggccugggcauuuccaguggcacccaugagguggcugcuguuacugcccuccuguccccagggcguucagggugggcagugaggagugcugucgggggacugggggcccgggcccucuggcuucaccugucccucuggcuucaccucuaucacacuguuugaaucucgguugggccugagaccugugugcccccuuccuggccccguggugacuuucagacguugaauguggccaggcagccagcaucugccccggugcauuccuuggugcccagggagacauccccagacuagacaggacccuucucuggacuuucugugggcuggcccacucagggaccuccauuguuugggagcgggguccccugaacagagggcagccaggagccaguccuuggugagccagacuucacuguggaggcggcagcaccuucagccaggguagcccgaccaagccuggaacucuggagaggcaccgugacuguggcuucuaguccuggcuccaccucucucuccccucccaggaacucccccuccaccucccaucuuuaucucucaauuuugcaggcagucacccaagccaggccggauggugggccuggggugcggcgucagauggguaacgcccugggccuggagaggccaccgagccuagccaugcggcauuagcucuagcucucacucccuaauccguccuucuuagcugcgcacacaccacacgcccccuccccugcacccuguccccggccucucucagccacucuucugcuucccuuguucacuguggagccgugugcccuggggagggggagacaccgcuucgcagcccucgguucugcuuugcugcuucuagacucugcacagugguggggggcugucagaguuggggucacgcgggcugcugcaccaggcaccuggggacugggcugcuugucaggaggggcagcuagucaguuggguggacgucaggcaggccuuggacacaaaggaagacauggacagaguggauggugggccugaucccggaggccacugggauuuccagaccugggaucaggacgagggaugucuccuuucauccauggacuuaaaccccgaggaacguccugacucagccuuuugacuaaaugaccuugggugaauuauggacccucuuagagccucaccugucaauagggaauaagaauucuuaggccccaggugguuauugcagcaucggcuccgaugcaagaagaagcacuuugucugaagaggacacgcaaggguauucaugccuugggguuucaagaggaagagauugaggggaaccugggagcuggcugggcaggguggggagcccuucccagagcagugggccccccuuuccacuccagcccauuucucuccuguggccuguggcucagcuuucuccugggacagaguccuuccuguggggaagggacagaugacagggggaguggggggaugagggcguggccgugggcgaggcacagcccagguuugaucuagggaccucugggguagcagggcuuggggacccaccugaccacagcaugcccugcucugugccucacagaacuacaggaucucaugcacaucucacgggcccggaagccagcguucauccugggcuccaugagggacgagaagcggacguaaguggaucgagaucgggggcagagcggggaacgugugcgcuuuccugccccucacccacccccuguugugggcucagggcuuuacucucugcacccucacagccggcgaaguggcucugcuccuagucuuauaguucucagcagagacagaacauggagagccugugucgcucguucauuaaugcugggcggugcaggcucuggagaccagcccagggugccaggcuucuuggacuugguggggcuggcgcaguguucuggccucccucccugaucuccuuauggcuagaagagggggagaugccuggguccccccuggggagaucucagcagcugcuucccacugcuccuacuggcuuccuuaaccaccucccacugcagaauaguggcgugggcugccuuccccagcaccugcuguauaccuagucccauuguaagaggcgggccugggugacaggaugcaaagagaagacgcccaggccuugcccuucaggcauaaucccgggugcuugaacucagugccagcuggcacggcaagguaccaggacaaaugcguuuccagccacugugcugucgccaccucccuugauugcugcaguugauucauuuauucuuuauuagucucucauguuccuaauagccuucccagggaggaauuuguaaccuuguuuuacagaugcagaaccugagccccugagaggugaagugacuugcucaaggucacacggagugagugucaggguggcaacucacagccgggucuuccgaacccacguccuuugugcuaccgcaggcucucucuggguucucuguggacucuauaccuagugccagcccucugcagggaaagcucucuucucagaaucagaggcagcuccacucccagggccaggcagugaucgugcagcucuguggguccucucacuucgcacucacuuccaugcuacccuguugugugcccuggagguuccccugccccaucagcauucccuccccugugcccccugcaugcucuugcacgcgggcacacgcacacacacacgcacacaugcacgcacacacacccacaugcacaugccugcggguugcccacaugcauguguugcccacaugcaaacacauggacacgcacacacaugcacacaugcaaacacacgugcaugcacacacauacacaugcgcacacauacacaugcaugcaugcacauggacacccacacacaugcacacacauguacacacaugcauguacauacacacaccugugcaggggcugaggugaggcagcugcaccugaaggggggacccacauuucccaagggaggaaaagcagauuccccagauucuggagccucagaacccugccuggagcggggcugaggcaagagucaggagaccccucgguagcuccccacuugggccuuccaagcuacagagcccugcgcccucuggguugaucucugucgccagccccgcaucuucgggaguuugcuuuggccuccagcaacaguguagucucuccccugccaccucuaggcuugcuguggggcuggguaccugguccaggaaaagaccccuagaggugggacccgggccuccuccauuuaucagcccucuugggcaccuccugcauccccuugacacacagcgcugcccagagcagaggcggcuucugcccugguggagcuuccaggucagcgcaggagagaguaaaagaaagauugcgaauggaauggaagcagccuccaccaggaagcagguggagcagcaggcgggcugugagggagggucucgauggcaucagggcaggcuucucucagcuucaucaagcugagaugggaagaugagaagaucagaggaagguuccagacugaaccaaccacaaaggcauucccccagggcauggccaaugaggacaggcaggauguggggagacgugucagggcgcgcuggagagcaugugacucaggaggcggcagaccuggguccagguccaguccgcauccauaugacuugguucccgucaccuaaccucugagcuacacucccuccgucacucaaaaauaugcacagagaguaggcgcaguggcuccugccuguagucccagcuacucgggaggaucacuugagcucagaagguugaggcugccgugaacugugauugcaccaccacacaccagccugggugacagagugagacccugucucuauaaauaaauaaauaaauaaauaaggcugggcacgguggcucgugccuguaaucccagcacuuugggaggccgagacaggcggaucacaugaggucgggaguucaagaccagccuggccaacauggagaaaccccgucucuauuaaaaauacaaaauuagcugggugugguggcgggcaccugugaucccagcuacucgggagguugaggcaggagaaucguuugaacccgggaggcagagguugcggugagccgagaucgcguuauugcacuccagccugggcaacaagagugaaacuccgucucuaaauaaauaagcacagggaugucagggagggucugccucagaggcguuugggacaaugacaugagcuaaugcugguagcaccccucccauagccccuggcaugaaccucucccuuccucccugcccccuccuccccugcuucuuccaccuuguguggaggcccugauacucugucacugcccauuccuggccuggcuguaggguccccgccccuccuuccccagccuuauuuaauuccaacagacuuuaucaggcaccugcuuuggaucaggccugauacugaccaaaaucaggugucccaaguuggggagacuggccgagauccugcugggauggcgccuggucagugaugcuaucccccgaccuuccuuucccuuucucuguugcacucuccagccccugaaauacuagacauuuguuccuuuacugcccucacccccacccucgcuguccugcauaggacagaaguuccucggguccgucugggucugucugccaggacacagcugcaggggacaagggcuaugaggguggauguaaaguacugggcuguggcaggacccuccucucucccacugcuguucccacugcagccacgaccaccugcugugccuggauggaggaggagugaaaggccucaucaucauccagcuccucaucgccaucgagaaggccucggguguggccaccaaggaccuguuugacuggguggcgggcaccagcacuggaggcauccuggcccuggccauucugcacagugagggcggccccuggggauggggccaggcggggcugagaccuguguccucaaggggccgaguuugucuucagggcuuugcaaaaagagaguggaggaguagaggagggcuauaagcacuuugaggaggcaggggcggggcugcaggugcugaggucccaggcuggaaggagaagggcugggcccaugggcuuggguuuggggaucccccgcccucuggccacagaggguagagcuggcugugugaaauuuuggcauaggaagcguuuccuaucgacugccuuaaccccuccuccccucaccccugcaaagcaggcaccaggggccacacagccugcugcacauaaggaaucccauucccagggugcacgcagcaggcagucucaggaaugaggagccacugagccucaggaugccagagcccucgccugcacacuucauuuuacugggaaauuuuacugggaaauuaaguucccagguggggagggaugacgugaagucacauagcucauccauggggucgcugggcuggagcacaguccccuagacucccagccuggcaccuccuaggccacagggcacuguguagucuccuuucacugccgcuuugcgaaggcgccuggcuugcuggacagauagccggguggucaguguugugacggcuccucuguggagcugucugagcuucuaggugcugacagguggggaggggcacugccagaucaggguccucagcuccccccaacccccuggacauuguccugggacucaacaugucugacuggugccccugccccugugcuggucagauuccauuuucuccagagcgcccccacaucuggauccuggucaugcaaagucuuggaggugcccggggaggacuccccacccuaggguggguaucagggccugugggccaggccuguguuggaugcuggggaugcagagcugagccaggcauaccccagccucaggagcagggggcucagccaguccaggaggugcuggggacagagucccaugggcggaggaggagagucaucugucaaguugccgggacguuaguguccacggcgguuuauugacugguauuucauuuccuuuugaugauucucaccauagcccugcggggugagcagauggggaaacugagaaccagagaggaucagccagugaauugggcagucaggacugggucuccagcagugugcccagcucucuaccccagccucagggucccagcauccccucucuggucuuccacaggguccaagggcgggcacgaggucugagcaggcagacugggcagaguccuagcuucuucuccaaaagggccacguccuucuucagggaccauuucuuccccauccggggucuugagacucccaggggccauggaggggauuugagaggucuccuggcugauccuccggugugggcagauggccuccuuucagcuacccucugcuuguacaucccuggcccuggggaacucacugccucacgggggaaguggggcagcuucuccuuccuggaggugcagccggccccuuggcccugucuguucugaaggcucaaaggacagggcuauuccuuguuuucugugacaaacaacgugggucuagcuuuuauaagcuuuuacucuugaggggcucuucuuuaaggaaaauaauacaaaaucaugaauacaagaugaagugcagagccguggggcuucagugguuuuugagucucuccguugcccaggcuggagugcaguggugcaucuuggcucacugcaaccuccgcucccggguucaagcgauucuccugccucucagccucccgaguagcugggacuacaggcgcccgccaccacaccuggcgaauuuuuguauuuuuaauagacgggguuucaccauguugggcaggcuggucucaaacuccugaccucaagugauccaccugccucagccucccaaagugcugggauuacaggcgcgagccaccauguccagccggaaggagguuucucucugucugucugggagguugcaaaggaagggcccagaauuuggguuugcuuaggccucgguaaacccgcuuccuccugccaccuccugcguucaggcgcucugcaggcuguucuacgggagcccugcguguggccgcugcaucuccccgccucugaccccuuuguuccuagguaaguccauggccuacaugcgcggcauguacuuucgcaugaaggaugagguguuccggggcuccaggcccuacgagucggggccccuggaggaguuccugaagcgggaguuuggggagcacaccaagaugacggacgucaggaaacccaaguaagcccuggcgcacuggggccguggccgcagcugugcccacuguggcuguucccuggggacagagggcucccuguccugcugagggagggggaagagcgccccacgcuugaggggagcagagggaacccccuucccagggaggcagagggcugggguguggcucucacuugggcaugcagacaccugcugagcgcaggaggggcguggccuggugggccuggcucugcccugccuggcucugcccugcccggcucugcccugccggcucugcccugccuggcucugcccugcccggccaggggucuggggcuugccuggagagagccugggccacccuucucugagaccaccugggcagaggcuggguuuuugcugcccaggcaaaaggaacccacuggccuuucaaaugacacggcuaaacauuuucucacauuucagacagcacucgcucccaggaucggacuacuagguuauaaucagagggcuucagucuuaccuuuaauuuaaggccuacaagacuugaacuaauuuaagucagacugaaggagaaagucacauuuccaggaaacauuuguuugggaagcccaaauccuaggacuaagcaaugcaucccguucggggcuggaugaaugguguguuccaagaggaguguuuugagcauuucugagugauuuuuucauauuuugaaagugagugucccccagucuuaggggcccggcauccccucugcggucuucccuaggguccaaggccagggaccuucaaucuuuuuucccacucuguggcuugucuuucugcucugugguguuucuagguuuuuguuuuuuguuuuuuguuuugguuuugguuuugguggcccauguucuuaaugagguagauaauauuuauaaauauuuuucuucuuguaguuugugauuuuuuccuuucuuucuuucuuuuuuuugaaacagggucuugcuguggggcccaugcuggaguauauugcugugaacacggcuuacugcagccucgaccuccuggguucaagcaguccucccaucucagccgccugagugccugggacuacuagcaugugccaacacauguauuuuuuguagagaugggguuucaccauguuguccaggcuagucuugaacuccugagcugaggcgauccucccgccuugguuucccauuacaggcaucagccaccaugcccagccuaguuugugcuuuuuauuucucguucauaaaccccuuugcugcccccaagcagcacacgauucuccugugucgagcuggaaagcucucuagaucugccuuuuacauugaggucuuuuaucaaccuggaauugauuuuuguaugagggugaaauccaagauccaauuuaauguuuuccacgugauuggccaauuuuucccagccccaucugugaagucuguccuucccuccgcuuccucagcagugggucaagcaucccucugcucuuggaucugcuccaggcuguguuuuguuccacugguuggaaagcugucucugugcccggaccacagagcauaaaaaacuaccgcuguguggugaguccuggugucuggguggcagauccuccaccuuggccuucuucaaaaacaucauggcuauucuugggggcaguagagagaaguggauacaagcauagacccugaaguuucuaccucuucucaaaaauaggaauaugccaggcaugguggcucaagccuguaaucccagcucuuugggaggcugaggcaggaggaucacuugaggccaggaggucgagaccagccugggcaacauagugagacccucaucucuacaaaaaauuuaaaacuaacaauuagcugggcaugguggcacuauggcuguagucccagcuaauugagaggcugaggugggaggaucacuugagccccggaggcugaggcuacagugggcugugaucccaucacugcacuccagccugggcaauagagugagacccugucuuaagacaaaaaaaaaaaaacaaaaacaaacaaacucacaaacuauaaaaagaaaaaauauuuauaaauucuacuccauuaagaacauggguccauccaaauaaauaaauaaaacaaaaacaccauaaagggaguaaaaagacaagccacagagugggagaaaagauuucgaauccauacauccaucaaaggacucauuuucaaaauaugaaaagaucauucagaaaugcucaaaauaguaaccaccauuuuacuuucucuuccuaugaguuuaacugcuccagguacuguuaaguaaaauuuuuaggggauaauugauuuggaccaggauucuguaccaggcccaacagaagaaacgaauauggagucauucaugccaagugaaccuaguuagcuuaggcguauacccauguaacaaauagcugaguucugguuagcuacaacagcuaagcuuuaaucaaucauagauggccaccugauucaaacaaggcaaaccaauuaagcuccacaccucacuuugguuuucagcccaucaacacugccugaccacguugcaggccagaguucuuugaaccuauucugguuuuguggccugccugacucucaguucaucaauaaaagccaauuaacaucuuuaaauuuguugcaauuuuaucuuugaccguaccuuauguaaguggaaucauacaguauuugucuuuuugugacuggcuuauuucuuucuuuuuuuuuuuuuuugagauggagucuugcucuaucacccaggcuggagugcaguggcgcgaucucggcucacugcaauuucugcuucccagguucaagugauucuccugccucagccuccggaguagcugggauuauaggcgugcaccaccaugcccggcuaauuuuuuguauuuuaguagagacaggguuucaccauguuggccaggccagucucaaacuccuaaccucgugauccacccaccucggccucccaaagugcugggauuacaggggugagccaccgugcccggccaugacuggcuuauuucacuuggcauccauguuguagcgugugucagaauuuccuuccuuuuuaaggcugaaaaacuccauugucuguuggauacacguuuugcuucuccauucauccauugauggauauuuuaguuguaaauugacugcugucaaugucggaugugcaaauaccuguuugaggccuacucucucuuacuggugccuucucuagagagaauucugauggguucaguuugaucauauuuuguuuaagauuuuuggccaggcgcaguggcucacgcuuguaaucccagcacuuugggaggccgaggugggcggaucaugaggucaggagaucaagaccacagugaaaccccaucucuacuaaaaauacaaaaaauuagccgggcgugguggcgggcgccuguagucccagcuacucagagaggcugaggcaggagaauggcgugaacccgggaggcagaucuugcagugagccgagauugcgccacuguacuacagccugggcaacagagugagacuccgucucaaaaaaaagauuuuuguguccacgcucgugggcgaacuugacccguuuuuuccuauuuuggguuuugaggaaauauuuccucuuuuuauuuuucuuggaagaguuaguauaauaguuuauuuugaauuuaugguagaacuugauaguaaauucuucuaggccuggaguuugcuuggugggaggauuuuugaugauggaauuaauuucuauagugguugugagacugaccacucgggguuucuaaauaccuuuuugaguuaguuuugguuaagugagguuuuucuaggaauguguccauuucaucuaaaucuuuaagcuuauuggcuuagaguuguucaaaauauucuguuuuuuuuuuuuuuuuuuuuuuuuugagacggaguuucacucuuaucgcccaggcuggagugcaaugacgugaucucggcucacugcaaccucugccuccuggguucaagcaauucucuugcuucagccucccaaguagcugggauuacaggcaugcgcaaccacaccuaauuuuuguauuauuaguagagacgggguuuccccauguuggccaggcuggucucgaacuccugaccucaggugauccaccugccucggccucccaaagugcugggauuacagacaugagccaccaugcccagccgauucuccuuuuucuaacgucugcaguguguguuggugcggcccccuuuucuuuccugauuuugauaacagauaacagccauguuuuaucagucuugcaacagguuuuuccauuggauuagccuuucaaaaaaaccaacuuuugcugaauugugcccccaagguuggaccaaucugacacuccuccagcacugccggagagagccuguuuugcggggauggugcggggagaagcccaccuaucccgaacagagguuggagugggcacucugcuacccaaggcccuggggugugaauuguggggaaagggaaagguggaugggcggguggcucagccguccuccugccucauuucucuccagggugaugcugacagggacacugucugaccggcagccggcugaacuccaccucuuccggaacuacgaugcuccagaaacuguccgggagccucguuucaaccagaacguuaaccucaggccuccagcucagcccucagguuuaaaccauguuugaugcauccaugggaagcgacuggcccgagaggcugugggguggugggugggagucgugcacuugccaucaggcacccucaccgugccaccagcccacccgcugcacuggucuuuauuggcugaggacagggauugcgggggagcugucaggccccuggcagguuagaaaagucccuggaaaguccucagcuguaccugccuuccaccaggacgaacuagccagagaguguggcuucguggguccugcuucugaagaguucccagccuccccucuucccgcacccccagcccccaacacgcacacccugagaucuggagugcauggguuuuaugccagucccuugugccacugggccgcccuccuuccccgccccuagaccagcugguguggcgggcggcccgaagcagcggggcagcuccuacuuacuuccgacccaaugggcgcuuccuggacggugggcugcuggccaacaaccccacgcuggaugccaugaccgagauccaugaguacaaucaggaccugauccgcaaggugagugccguaggccagagggccuggacccacugcucccuggagccaauccugugucagcaaaccaugcuagggaccgacccccaggacagcagguggcuuuuacacacgcacucauucauaugugcacacagggcaaauugaucucacuggaaccuguuccaugggugggaucugccugaagcacugugcuaagggggaucugaggaccacugugcucuaagugugcaugaguggggagggcggcaugcauaccaugaacgugccacucgagccagccuggggacaggacacaugcuugcccuugagcucaccucuguggauagacagucccacaggaaugccuguccccacggguugccggugcugugguggaggaccgugaggccucugcuaaaaggccugggggcucggaaagggcuccauggaacaggggacccauccugaggcccuuggggacagagcagugcagaaucagugaucuggaggaagagcagcagcccucucucugcagagguacagcagaggcuggcaggacccagcaugcuaggggaggcccuguggcguggcgggcggugggugaccggggugggcgagcgcgguggcugagcucagacccuggagccagggcgccucuggggguccccguucugccugcacucacugcagcuaccuaauggggccaucauagcgccugccuggggaggcugcgaggccuuggcaugcuguugucugugaaauguucacagcacugccgggagccugagcugcauccuugcugcugugguuucccgaagccccagggcguccugggcagcgcagcagaggcucugggcagacagagaagcgcccucuaggggccagaucgggcagggcgggcuuccugcaggcggcagagaccgucagacugucagacacuagccagucuaacucuccuauugcgugcggauggggagccugggacccagagugggaggcaucacccaagaucauccagcaaaucggcagcagagcuuguucggaagcaaauaagagaggcagcggccgggcgcagcggcucacgccuguaaucccagcacuuugggaggccgaggcaaguggaucaugaggucaggagaucgagaccauccuggcuaacacggugaaacccugucucuacuaaaaauacaaaaaaauuagccaggcgggcauaguggcaggagccuguagucccagcuacucgggaugcugaggcaggagaauggugugaacccaggaggcggagcuugcagugagccgagaucgcgccacugcacuccagacugggagacagagcgagacuccgucucaaaaaaaaaaaaaaaaaggcagcacccagggcucagguucaagccuuagccccuacuucccuaccacguggccccugcagcugcuucccggccugagcuucgcugagagcccucauuugcaaacugggugaucagugcccucuccacagacuggcuggagauuaaaugaaguaaugaugcaaauaccuggcaaaucaccaacaccaaggaacaccgucugccuuuccuccccuggccacgacuugacuugggccagcaucagauggggugggcgggauccuucuugcagcugguguaugugugguccuguugguacacagaugcuguccugagcagauggcaugugaugcccgcaccagccguucuggggucacgugcaagaggcuggcuggaaaucaugccaggcaugcucuugccaccagagaccucuugcccuguucucaugugccccagagcccagucuugggccuccccuugacgcuccccuucgugcccccuaccuguggaaggucucuucugacugccccuguccuguucccaacagggucaggccaacaaggugaagaaacucuccaucguugucucccuggggacagggagguccccacaagugccugugaccuguguggaugucuuccgucccagcaaccccugggagcuggccaagacuguuuuuggggccaaggaacugggcaagauggugguggacugugugagugugggccccucccccaggccacuucccucagggucuguagcccaggucgauggcuuccccucauccuguggggccuuugguguuggaggagacagcagggcucuguccaucgccuuuagccagcuggagggagagagaguccacaguucagagucucagugcggggcagggacccucagugaccaccagcagggggguuuucaaacgcuuuuuagcugcggaucccuuucugcaaacauagcgcaguguagaagcccagaauggacaaaggcuccagagcgggcugggcgcucacccuguaaucccagcacuuugggaggccaaggcaggcggaccacuugagcacagcaguuugagaccagccugagcaauauaaugagacuuugucucuaccaaaaaauuaaaaacuagcuggacaugguggugugugccuguggucccagcuacucaggaggcugaggugggaggauugcuuaagcccaagaggcagaggcugcagugagcugugaucaugccacugcacuccagccugagcaacagaaggagaccuugucucaaaaagaaagaaagaaagagagagagagagagagaggagggagggagggaaacuucagggagaggggacauggaggccugucgacucagccgcuacccuuucccccacucaucaucccugaaagggcacugcugagaccucugccccucugauugcacagcugggacagucccugcagucccaggaagggguuuugcccgagccgcucugcugcuguguggcucagccugacucgaaagagccuggggcuccccaggcuggggcuccgagagugcagggcagggccgggcggggugcgggccgggcggggugugggcccggcacucaccaaggcugcuucucaccagugcacggauccagacgggcgggcuguggaccgggcacgggccuggugcgagauggucggcauccaguacuucaggugagggcucagccgccccagcccuuggccccgugcccuggcguggucggacucaccgaccuuccccucccagcccuaguguggacuuucccuuccccaagggucugcucuguuccccaagcccacccugguccuagcuggcguccccugcccagccugagcauccuagggugacccccuccucccuggcccgaacagauugaacccccagcuggggacggacaucaugcuggaugaggucagugacacagugcuggucaacgcccucugggagaccgaggucuacaucuaugagcaccgcgaggaguuccagaagcucauccagcugcugcucucacccugaggguccccagccucucaccggccccagcugaccucguccauucagccccugccaggccaagcccagccacugcccucccgggcagaucugggcccaggcaccucugaguccauagaccaggccugggagaaugccaagcugccugcccgaggcugguccugaaggccugucucccacuaaccccgccuuccagcacuuucugucauuccaggcugggaaagucuagagcccccuuuggccccuuucccugacugucaaggacaacugacucccccaucagcucaaacauuaaggguacccgggcacaaccguaccccugcccccagccccagccucccugagggccugccgggcugccucugccccagcccccagcaagggcacucccaggcuuccuggugggugcagcccacucccucugcccucugcuccguucccugggggcugggacuaaagaaaugggugucccccaccccaucagcugggaaagcccaggccgcaggagugggaugcccguuggacuuugccccucacacuggcccagccccucacacugccccaccccgagaacccucagcucucaaaggucacuccugggaguuucuucuucccaauggaaguggcuuaagagccaaaacugaaauaaaucauuuggauucaaguuca

SEQ ID NO: 192558 - RNA, 15363 nt, Homo sapiens
gggcggcggcgcgcgggugcgaucgcggagcugugaggcgcaggcagggcucuggggcaccuagagaccggggccggagacguggcagccgcccugcccgccagaaaguuuccuagaaguuugcugggcgcgggcgcacgacugacuggcuggaccaugaacguguuccgaauccucggcgaccugagccaccuccuggccaugaucuugcugcuggggaagaucuggagguccaagugcugcaagggugaggggcgccuggcagggaggugcgggacccccucucuggccagccucaugccccugcgugcagggcagggcgcuccaggugucugcucaggguggggacuccggcguggggguccuugaaacuuugcggagcuccacuuccaaaaacaauguaaaguuguauaaaaucagaggaggaggaccccucgagaugaugggaggcggguggguuuguuccugcacagacgcccccucagguuggcagugucacugcugguuggaagaggggguuauaagggaggugacaaccccucccucccaccaguuacacccauuguuccuuccaccaucgacuguggggagaagcagauaugcacucaggaacggcccacgauucucaaggucuucucuucccugccccuucccagaccccaccccgccccccaaagugagcccucgucccuccccugccugcauguguggcaccgguggcugugauguggcaggagggcaccagccgggcucaggcggguauggagcugccucuaaacggaagccggggaaggcuggagggguccccuguuugcauucuggcugcccugcuggggguuuggagaagcuuggaggcuggacucgcggucgccaacagauccagagccacgaaaggcugccagagccuccuccagccaucuuuguccaccggcauccucguggugcccucccugugccuggcacugggugugcagaggcaggagugagcucaggcuccucguggggcugaggaggcugagaaggcugagagugggccccgaaggcccuguggaaggagcagcuccgugcuggucccggaggacgagcaggugucaauccaggaagugugugcuguggagggcuccggggaugaagaggcauggaggucaccaagcaccgggcaucccccgggaagggugggcagccagauuugggguggucuggagggagaugaguccaggagggaggcugguccagaugugaaagggccuuuucugccaggccagggaguugggucuggggagcccuucaugguuugggagccgggaaggggccuggaagggggccugaacagguugcuuugcaagcuuugagagaaaaggcacagagcagggggaggccuggcaggguggggguuggugcagacaugagcaacaguacgguguggagggagugguucuaggccuggaggccauuuggguuuggggucucuggagagacagguacagagacaguucagguucuuccucaggggagguggccaggaaugcugagugggggacccggagcagcaggcccuggugaggggagaaucagcuccaaccucuuccugcacuuuugcagaaggcccugcacggagugagcaaccaugaccaagaggggacacugguaccuggccgcugucugccagacacugcugggcaccuagaauacagcccggacagcagaggcccagcccugguggagcugacuuucuuuuauuuauuuuuuauuuuuauuuuuuaacagaguuucgcuuugucccugaagcugaaguacuguggugugaucucggcucacugcaaccuccaccucccagguucaagcgauucuccugccucagccuccugaguagcugggauuacaggcacgcaccaccacacccggcuaauuuuuguauuuuuaguagagacgggguuucgccauguuggccaggcuggucuugaacgccugaccucaggugauucacccaccucggccuccgaaagugcuggugcugggauuguaggcgugggccacugcgcccacuucuuuuuuuuuuuuuuugagacagaguuuuguucuauccccuaggcuggagugcaguggcgcaaucucggcucacugcaaccucugccucccagguucaagcuauucuccugcuucagccuuccaaguagcugggauuacagacgcccgccaucacacucagcuaauuuuuguauuuuuaguagagacgggguuucgccauauuggccaggcuggucucgaacuccugggcucgagucacaggugugagccaccaugcccggccaagugguggaccugacuuucuagugguaggaagccaucaauaaacaauaguccuaggaaacugagcaaaugacacgguuuguuggaggccauagugaguacuaugggaacagaaaaagggcagcuggguggcagggaugggccugugugugcacagagagaagucagaggugauggaggcagggccugguaugaccucaacagacccagccccaaagaccagagacuugggcuucacucucacuccuccccuugacucgcugugugacccugggccuguguuuucccauuugucaaaugggagugagggcugccccuggcagugggguccaccuaugcuuaguggaccccggagggacucuggccaguccaggcucacauuguccucugugucccgggucuccaugugcagcuuccugguggaaaugauuguuuucaaaagugugaaaacuauugugcucaagaucaccggggggcugggcacaguggcucacaccuguaaucccagcacuuugggaugccaaggcggguagaucacaugaggucaggaguucaagaccagccuggcacguggcgaaaccccgucuccacuaaaaauacaaaaaaauuaucugaguaugguggcaggugccuguaaucccagcuacucaugaggcugaggcaggagaaucgcuugaaccugggaggcggagguugcagugagcugagauugcaccauugcacuccagccugggcaacaagagcagaacucugucucaaacaaacaaacaagcaaaacaaaacugaagaucacaaggguucccaaagugcuaaggaaaaugugaguaaaacccaggggacuggcaggcugaggaugaagagaaaagagggguaggggaaggcccaagcgggugaccaagcgucccccaccagggcugccucccaggcaguccuucguggggcugagggcuucucugucaaagucugugugagggcucagugagaugaacaucaggccaucccagagcuggccucaggucaguauggccucccccagugggguucauuacccacugccagccccacuguugcccucaccccggcuagugcacgugcgcgcgugcuagaccccccagagggacucagguucucacugagcacuguguauuccucagcucaguccugccacucugcaugaggggccguuuggcaggugaggaaugugagaccgaggcucgcccuaaagccagcacauucuccagaauguuagggacuucagggguguuccuucuugcucauuaaaaauguucccccaggcugggugcaguggcuuacccauguaaucccagcacuuugggaagcugaggcaggaggaucaccugagcccaggaauuugagaccagcuugggcaacauggcaaaaucuugucucuagaaaaaauauaaaaauuagcugggcaugguagcaugugccuguagucccagcuacucaggaggcuaagguaggggggucauccgagccugggagguugaggcugcagugaucugugauugugucacugcacuccagccugggugacagagugagacccugccucacaaaaaaagaaaaaaaaauguucucccaccccaaaugucuggaaccagagggaugguuagagaaggcacaguucagggguacaggggaaccagacccugaauuagacagcacaguaguucccccuuauccacggaggauauguuccaagacugccaguggaugccugaaaccacggguuaaaccaaacccuauauauauacuguuucuuccaucugauaaccaagacugcuguccgggcacaguggcuuacgccuguaaucccagcacuuugggaggccgaagugggcagucacuugaggucaggaguucgagaccagccuggccaacacggugaaaacccaucucuacuaaaaacacaaaaauuagccgggcaugauggugggcgccuguaaucccagccacccgggaggcugaggcaggagaaugacuugaacccgggaggcagacguugcagugagucgagaucgcaccacugcacuccagccugggugacagagugagacucugucucaaaaaauaaauaaauaaauaaaaaguggccaaaggacacuaaggagcaugacaacaaaaugcagcauggauuccgggauggaauccaggaauggaaaaagggcagcagugggaaaacuggugaaaucagaauaaagccuggaguucagucaacagugcucuacugauguugauuucuuuguuuugauaaaguacugucacuaaauacgauguuuuuuuguuuuguuuuguuuuguuuuuuaagacagaguuuugcucuuguugcccaggcuggagugcaauggcacgaucucggcucacugcaaccuccaccuccuggguucaagcgauucuccugccucagccucccaaguagcugggguuacaggcaugagccaccacaccuggcuaauuuuguauuuuuuaguggagaugggguuucuccaaguuggucaggcuuggucucaaacucccaaccucaggugaucugcccgccucggccucccaaaguguuggauuacaggcaugagccaccgcccccggcccaaauacgauguuaacacuagauauagcuggauaugugggauucucuguacugucuuuacaacucuguuguaaaucuaacauucuuucaaaauaaaaaguuaaaaaaagaaagagaccaaagugggucaagaaacagcauuuagacugggcgcgguggcucacgccuauaaucccaacacugagagaaugagguaggaggaucacuugggcccaggaguuugagaccaggcugggcgacauagugaaacucugucucuacaaaaauaauaauaauaauaauuaauaauaaaauuugccagucugaugguuugugucuguaguuaccagcuacucgggaggcugagauaggagaauuguuugaguccaggagauagaggcugcagugagcuaugauugcaccacugcaccccagccugggagacagaguaagacccuuucucuaaaaagaaaaaaauaaaaaagaaagaaacaucauggagaguaugaacccuuuuuugucaacucagugcauccaugugcaucauauguguacacauaggugucauguguguacauguucacaaagauauggaaggaugaacacuagggguuuggaauauuuuuaucuuugcaucuuuguauauuguuugauuuuuguuuugcaaagaguaaauauaggcauaacuuuuguaacuagaaaaaaggcuuuuuggcugggcguggugggucaugccuguaaucccagcacuuugggaggccaaggcgggcagaucacuugaagucagaaguuugagaccagccaugaccaaccuggcgaaacuccgucucuacuaaaaauucaaaaauuagccaggcgugguggcaggcaccuguaaucccagcuacuucggaggcugaggcaggagaaucacuugaacccaggaggcagagguuguggugagccgagaucacgccacugcacuccagccugggcaacagagugagacuccaucucaaaaaaagaaaaaagaaaaaagaaaaaaggcuuuuuaaaucuuacaguuugaaaaauaaaauagaaugcuccccuggcccugaaccuuccucugccugcucuggucucccuggugaaucaacaccuuguaaagucagugaguuguuccuccuaagacugagcuuuggggacugucaguggaacucuggggguggagugaagagaagccucaacaacccccaccaagcccgacucacaccacccccgacauccuccccagagcaagagcccaggcaggcacacgcagggggacugggaacucgguguucgugucuuuauuuggagacugggagacagauuacaguuuaaugagaggaacgacgacucaagugauccgaugggaagggugaguuuccuggcccuuagggagcgacagugcccuggacaggaggucuuugagugggaguggacacucuagaggccuccccagcuccaggcugugcaccucuugagggugggcaggcuugggagucuguguccucauugucuccugucuacccuuggccacaggcaucucugggaagagccagauccuguuugcucucgucuucaccaccagguaccuggaccuguucaccaacuucaucuccaucuacaacacaguaaugaaggugaggggcugggugaugaugguugggggaagccaccaagcccccacaaacugugagguagccugcuuggaaacucauucuguggagccaggccgaccuggguuugaauccugacuuugcugcuuaguggcugcaagaccucaucuugggccucuuuguaugucaguguccucgugcaaaaaugaggacagggcugggcacuguggcucaugccuguaaucccagcaauuugggaggccgagucgggcggauggagaccauccuggcuaacaaggugaaacccugucucuacuaaaaauacaaaaaauuagccgggcgugguggcucaugccugcagucccagcuacucaggaggcugaggcaggagaguugcuugaacuugggaggcggagguugcagugagccgagaucgcgccacugcacuccacccugggugacagagugagacucugucucaaaaaaaaaaaaaaaaaaaaaaaaaagacaguaccauuacuuagcucagaggguuugguugggaacauuaaaugagauaauaaauguaaauguaaaaaacccugccauauauuaaacauucaauaaagggucacaccuguaaucccagcacuuugggaggccaaggcgagaggaccgcuugagcucaggagucugagaccagccugggcaaugcagugagacuccgccucuacauaaaauuuaagaaauuuagcugggcguaguggugcucaucuguggucccagcuacucaggaggcugaggugggacaaucaccugaucuugguagaucaaggcugcagugagccaugaucaugccacuguacuccagucugggcaacagagugagaucccgucucaagaaaaaaaaaauuauuuaggugauagagaaggauuagagagcuacuucagggaguguggucagggcaucuucaaagagaugacauguaagcugacagcuuagugacaacaaggaaccagccauguaaagaucaaaggacacaccuucuuucuguuuuuuuaagacggagucucacuguuuucuguugcccaggcuggagugcagcagcgcaaucucagcucacugcagccuccaccuccugguuucaagccgggagcuugccuugugccucagccucccaaguagcugggacuacaggcaugugccaccauguccagcuaauuuuuguauuuuuaggagagacaggguuucuccauguuggccaggcuggucucacgcuccugaccucaagugguccacccaccucgaccucccaaagugcugggauuaugggugugagccaccaugcccagccaagauguagauuuuaguuggacacauuaucuaauaggaaucuuauuucuugugcaguggugcgaucauggcucacugccucaacuucccgggcugaagggguccucccaccucagacuccugaguagcugggacuacaggcacgcaccaccaugccuggcuaauuuuuuuguauuuuuaauagagacaagauuucaccauguugcccaggcuggucucaaaccccugggcucaagugaucugccugugucagucucccgaaguucuggaauuaccaugaucagcuaggagucuuuuuuuuuuuugagacggagucucgcucugucgcccaggcuggagugcaguggggcaaucucggcucacugcaagcuccgccucccggguucacgccauucuccugccucagccucccgaguagcugggacuacaggcgccugccacugcgcccagcuaaguuuuguauuuuuaguagagacaggguuucaccuuauuagccaggauggucucgaucuccugaccuuguuaucugcccgccucggccucccgaagugcugggauuacaggugugagccauugcgcccggccaggagucuucuuuuuuguuguuguugaaauggagucuugcacuguggcucaggcuggggugcaguggugcaaucucggcucacugcaaccucugccuccuggauucaagcaauucuccuaccucagccuccagaguagcugggauuacaggcacccaccaccacgcccggcuacuuuuuguauuuuuugauagagacgggguuucacuauguuggccaggcuggucucaaacuccugaccucgugaucugcccaccuuggccccccaaaguguuggaauuacaggcgugagccaccacaccuggcccccccuuuuuuuuuuuuuuuugagacagaguggagugcaguggcacgaucuuggcucacugcagucucugcucccggguucaaguuauuuauuuauuuauuguuuagacagaaucuagcucugucgcccaggguggagugcaguggcgcgaucucggcucauugcaaccuccaccucccaaguucaagagauucugccucagccucccgaguagcugggauuacagaugugugccaccaugccuggcuaacuuuuuuuuuuuuuuuuuuguauuuuuaauaaagacgggguuucaccauguuagccaggauggucuccugaccucgugaucugcccaccucggccucccaaaguguugggauuacaggcauuagccaccaugcccagucuuuuuuauuuugagacagucucccucuguugcccaggcuggagugcaguggugugaucucggcucauugcaaccuccgccucccagguucaagcgaauucuccugccucagccuccugaguagcugggauuacaggugcacaccaccaugccuggcuaauuuuuguauuuuuaguagagacgggguuucacuauguuggccgggcuggucucgaacuccugaccucgugauccacccuccucggccucccaaagugcugggauuacaggcgagagccaccgugccuggccuaggaaucuuauuucuaaggaacaaggguuccaugggggaauucuaucuugcagggcuauugagaagaucacaugagauaacauacagcaccuagaaaauauuuaacuaaagugaguuguccuuuucuuccauaucagagacaucccuuugggauuucaggcauguuguuacuaguugguagaguggagguugcuguuacuugugagguguugaacucauucagauuuagugaaugugaaucugaggacuggaaaucaccgucuacuuaaguucacacauguaucaaacaucaccugcuaguucauuucucagcccaagucagccuugggcauuccuggcagagacagcagacucagcccuugccauagcugaaugaggucuaggaagcucaaagaggcuaguuucuacauuuaugaaaugaaaaagugaccaccucauucacucauuccagcauuuguuuugugccagggacugaguuaggagcuggggauuaggagguggaccuugccacggaguccucucuuagaggggagauggacuuguaccuagacauuuacagagcaugugaucacgggcuaaaaugaguauguucacauggagcuauggcgacagaaugugugccucauuguagugaaaaaaagacugcuucgaggaaauaacuccaaauaggaguacaaauaggagugcucuaggccagugugguccugcuccggcaguaucagcgucacuugggaaacuuguuagaaauacaaacuuuuaaggcugggcucgguggcucaugccuauaaucccagcacuuugggaggccgaggcgggcggaucaccugaggugaggaguucgagacaagccugaccaacauggugaaacuaaaaauauaaaaauuagccgggcaugguggugcacgccuguaaucccagcuacucaggaggcugaggcaggagaaucacuugaauccaggaggcggagguugcagugagacaagacugcaccacugcacuccagccugggcgacagagcgagacuccaucucaaaaaaaaaaaaaaaaaggaagaacaaacuuucaggcccauccagaccuaugaaaucaaaagcucuuggggcaagggaagagacagcaucugugauuuuuuuuuuuuuuuuuuuuuuuuuuuuuugagacagagucucacucuuaucccccaggcuggaguacaauggcaugaucucggcucacugcaaccucugccucccggguucaagcgauucuccugccucagccucccagguagcugggauuacaggcgcccgcaugcaugccuggcuaguuuuuuuauuuuuaguagaaacaggguuucaccauguuggccaggcuggucucaaacucuugaccucaggugaucugcccaccuuggccucccaaggugcugggauuacaggugugagccuccacacccaggcagcaucuguguuuugaugcacacucauuugagaagugcuggccuggaagguuggaggccauaucaaaaugaaaucauuauaugccagaggacagcuacugugauuaggagagcuuuucugaaggagcaauggucaguuaguucaagggauguuagcaggccauaaguagucccagcuucuagggaggcuggagcaggaggaucacucgaccccaggguuugaggccagacugggcaacauuuaaaaaaaaaaaggcuaguccuuguggaagaaugcucagaagucacugaugcauauccaggaaauuguuuuaaaauuguuucaagagcccuggaaugccucugguaaauccccugaaauagaccaauccuguuucaccuaaugcuccacaaaugaaggggacgacaagggcaccuuuguucauggcagcacugucagucccaguauagaagcauggaguuauuuaaugaaagggucacugauuucaaauucuaggcaacuggacccaagauaaauugcaaacacauuuaaccucuucauguuacauuauggcagaacacugacccuuagguuugguaggcuaggagcguaguaaauaggccgggaaaugacuucauagauucgauucccaugucucucuccccuuuuaggugguuuuucuccucugugccuauguuacaguguacaugauauaugggaaauuccguaaaacuuuugacagugagaaugacacauuccgccuggaguuucuucuggucccagucauuggccuuuccuuccuugaaaacuacaguuucacucugcuggagguaagggaauggacugaguaccaguucucaaagggaaauaugcucccugcauccuucccuccagacccugggcuugccuucugcuuacaacugugaccauuacucauguaucuuucaguuauaaguugagaagaaauugacaagcuauuuacaaugcuuuaguuggaaaugagcacaucucaauagucaugaugcccauaaaccaagcaggcaucacagcccuacuucuggcuguugagacguucuguucaaccgauuagcagaucccuguaucccuguagcacaguccaggcccagaaauuucaacucaguaaguuuggacuguggcccaugaaucugcaggcaacaagcaucaugggagauucugaugcugguguuuauggacaugacuaauuuuuuauuauuuuuuugagauggagucucacucuguugcccaggcuggagugcaguggcaggaucucagcucacugcaaccucugccuccuggguucaggugauucuccugucucagcuucccaaguaacugggauuauaggcacgagccaccacacucagcuaauuuuuguauuuuuaguugagacgggguuucaccauguuggccaggcuggucuccaacuccugaccucaagugauccacccaccucggccucccaaaguucucggauuauaggugugagccuggcaacaugacuagauuuuaagaaacuguggcuucaauuaugauuuuauacuaugaaacuaucauuuaaguuauuuuuggccgggcacgguggcucaugaggucaggagaucgagaccauccuggcuaacacagugaaacccugucucuacugaaaaauagaaaaaaaaaaauuagccgagcgugguggcaggcgccuguagucucagcuacucgggaggcugagacaggagaauggagugaacccaggagguggagcuugcagugagccgagaucgcaccacugcacuccagccugggagacagagcgagacuccaucucaaaaaaauaaauaaaaaaguuauuuuuggcuggguguaguggcacaugccuguauguagucccagcuacuaaggaaggugagauggaaagaucacuugagcccaggaguuugagacugcagcaagcuaugaucaugccacugcacuccagccugggugacaacagcaagacccuaucuuaaaaaaaaaaaaauuaaaaguaguuuucuauauaaaugcucacgcuacacugugaaaaaagcaguguacuguauaaucuuucaaaaauuagaaaaaaaaacccuuauauuuaccuagagaugguagguuaaacugauuaaaauauuauaauuuuuauugagaacuuuuucccuccuuacuguaccuucuccagcaagcuauuguuuuaguaauuauguucuuuuaagaugggccucuucuuggucuugcucagucucugguugcuuucucuuuggcucagauccucuggacuuucucuaucuaucuggaaucaguggcuauccugccccagcucuucaugaucagcaagacuggagaggcugagaccauaacuacucacuaccuguucuuucugggucuguaccgggcacucuaccuggcuaacuggaucaggcgguaccagacugagaauuucuaugaccaaauugcagucgugucuggaguaguacaaaccaucuucuacugugacuucuucuacuuguaugugaccaaagguagguccugggaugacagcaaugcugacacuggccuaaggaguuacucauccauuuaauaaguauuccagcagauacagaugugaacagucaagucucugccauccacaaugcuuguguucuaaugcaagaagacaaauauuuucaauaaagaaacaaaugccauaaaaacaugcaggccaauagguuauguguacuaugcaagacagcugugagaugacauuugacagaauacuugguuaguagugaaaaacauuccagaacuuauuacaagccccaaggcaaccaccagcuuggugugauggacaaaaagccuaguggggucaaaaucuauaaaccuggagaugagucaaccaagaccaguucacauagggcagggguguccaaccuuuuggcugcccuggcccacacugaagaauugucgugggccacacauaaaauacacugauagcuuaugagcaaaaacaaacaaaaagacacuucauauguuuuaagaaaguuuacaaauucguguugggccacaaagccauccugagccgcggguuggacaagcuugaccuagcgccucguaggccaggguaaggggcuugcacuacauucugauugccaagggcagguauugggucauuaaaaaacccaauccacuagcugcuauguaggguagaaagcaguccaaguacagugacuagcuauggggcaguugcaguugaucaggaaaaaggcucuagguagaaagacauguggacacaaguucuaggacuugagaaggacugcugauuugauuguaugagauguacaauagacaauuugaggccaaucgcuaaguuuacagcuggggggaagggugccaguaaccaagucggggaucaguagguccauagucaaccggagauggacucccccuuugcuuuaacaaucgaacauauacugugagccggccauuaagagaugauaccaagauuaugcaucaaguuauaaagcaguccuuucaucagaugguaaauucuuauuucaucuccauuuucuuccaguccuuaagggaaagaaguuaagucuuccaaugccaaucugaggaccuucagagacagucuacgccuuaacaagcacaugaaggaaacuauuuugaauguucucuuuggcaacuuauccauaauuugggaucaaauguuaaaaccagaaaaguguuuaguguggauuucagcaaaaccugaucaucccacccagaagaccuucucaucaauagaucgcccuuaaagacccauuguaaggucauaaaaaaccucggccaccugcacaaagauggugccucacugcaacaagaaaccuuaaggugucuuaccgacgaaauaaaaaacauaaaugauuguucuccaaggccugagggcaagacucaugaugagcaagucaaccccaaucuggaacaaugucccuccucuuagaaugucccaacuaaagaccaguuaaaauauuaggguacguucuugugaauuuccacuuuccagguagaugaccaaauuuagguggucaagauauaaaggugucagcuaguuuuaagugugaaacuuauuucacuuucacacugccuucaggccagaagcaaaccaaauuuaccagguuuggcuggaggaguuuugugacucaucuuuuacugguuugaauuuuuucaaaccaguggcugauaccugccuuguacuuaguaccuuaauaccaauaaccuaaugguacuuaggcgaguaccauuugcacaaucacuguuuuacuuaugagcagauacagauauauccaaacccuuaccuacuagguauccugcuaggguuuucaauuccaauucuuguauuaaguuuuuuccuuucaguuuuaggugcgaaaguaaucagucaauccaauaucccccaucuuugucuugaaacaaaaacuguuuuaagacgucuacguugaauuauucagagaauuaagcaauaaaagcucacaccuua

SEQ ID NO: 192559 - RNA, 17198 nt, Homo sapiens
aggcggcaggaggcgggugggucaagguaacucugggcuacagaguccuugcuggggguucggggagcgcuuggaccccggcuucugggacgcgucagguacgucuccgaguccggcgucgccggccagcgcugccuggguucacucgggggcccgagcugaguaggacguccgggccucgccuggagagaggcuucaggagggccuggggaaggggacggaggccgggcgaccccgggcgguggccgcccuccucugugugucuccgcgguugugaauuggggcgguaauuccuccccguaggucgccgugaagaugauugcaugagaucgugcgugugaacguuuguugacagcuguuacuugaguccgacagcccugggggccgugcaucugcguaacauggcuaccucugaacuccuugggggacacguauaucuuugagaauccgaugaaaaccagagauuccgcccuuguuuucuuagaauuaaaguaagauaauauauuuuauggccuguugcaaacggaaaaccuuuacacaaugauuagugauuaguaucaguaucuguggacugggaaggcucuacuuacucgauccucuucccagggucguugugaggaucaagugcacagcuuccuauaaacacuaaaacacuauaacaucuugugagccagguacuauuauuauuccucagugcaaagaaagaagccgaaguccaagggggauaaaugcuggggucccacugugggugagccgcagagugaucauuggaagccaggugcucccccuucacuuccugugugcggagcacgcucgcccugggaguuucacuagaaagaagguugccaugggccagugggacagcuuguaucucaagugcacgcggaugccccagaaucccaggaucucagcugagcuguuuguggauuauuagaucugacuuaaaagguagcuaauccagacccuuccucaucuguaauacauggaugacagcucccagcuguaguguuaugagaauuagugcggucaugaguaaggugcccaguuaaagcccgagaaguaaagcagcugggccaaggucuagcaggcaacugaaggggagagccaggccccuaaacuuguuguguccagcccaugugcucaggcccagugcaguuagcaucaguggggacuugacuuauuucuccuucuucaaaugucucuagauuuuaggcaugcugggggcugcuucuuaacuguguuuuguuuauuuuguucauaaguaauacaugaauauauucucauuguaauaauucauuaaaucucgaguauauuuaauauaauuuuauauuguaccauaugaaauugucacaauuugaccuuuuuuuaaccuauaaaaugacaaguucauucaagucagucauccuauucccuuuuucagguuuaaccacuaugaacaguuugguguauccuuccagaucucuuucuuucuuuucuauuuuuuuuuucuuugagauggggucuuguucugucacccaggcuagaaagcaguggugcaauuucagcucacugcaaccucugccuccuggguucaagcaauuauccugccucagccuccugaguaucugggacaacuggcgcacaccaccacacccgacuaauuuuuguauuuuuaguagaaacaggguuucaccauguuggccaggauagucucgaucucuugaccucgugaucugcccaacucggccucccaaagugcugggauuacaggcauaagccaccguaccuggccucuuucuuuuuuuuaauacacacauauauuacuuuauuuuauuuuauuuuuuuuugagauggagucugacucuguugcccaggcuggagugcaguggugcgaucucggcucacugcaagcucugccuccuggguucacaccauuguccugccucagccuucugaguagcugggacuacgaauagaugggacuacaggcuccugccaccaugccaggcuaauuuuuuguauuuuuaguagagacgggguuucacuguguuagccagaguggucuccaucuccugaccucgugauccgcccgccucggccucccaaagugcugggaugacaggcgugagccaccacgcccggccuauucuuuuauuuucacuuugucuuaucauaugggggaaauaccauacacaucauucugcaaccugcuuucgcaguguuaaagcaugucagaagucuuucagguuaguucauauacagcuaucucacugucuuuaauugcuauuuacaauuuuauuuuuauuuuuauuuuuauuuuuugagauauagucucacuuuguuguccaggcuggagugcaguggcgcaauuucugcucacugcaaccucugccuccuggguucaagcaauucgcaugccucagccuccugaguagcugagauuacaggcgcacgccaacauacugggcuaauuuuuguauuuuuaguagaaaugcgguuuugccauguuggccaggcuggucucgaacuccuggcgucaagugaucugccugccuuggccucccaaagugcugggauuacaggugugagccacuguaccuggccuacaauugguuuuuuuuguuuguuuguuuuuuguuuuuuuuugagacagagucuugcuccgucgcccaggcuagaauacaguggcacaaucucagcucacugcaaccucugccugcuggguucaagccucagccuucugaguagcugggauuacaggcgugugccaccacaccuggcuaauuuuuguauuuuuuaguagugacaggguuucaucauguuggccaggcuggucucaaacuccugaccucaagugauccaccugccucagccuccgaaagugcugagauuauaggcaugagccaccgugcccggcuuaggcccacaauuuuauuauaagaaugugcuggccgggcacgguggcucacaccugucgucccagcacuuugggaggccaaggcgggcagaucacaaggucaggagaucgagaccauccuggcuaacacggugaaaccccaucucuacuaaaaauacaaaaaauugcccaggugugguggcaggcgccuguagucccagcuacucgggaggcugaggcgggagaauggugugaaccugggaggcggagcuugcagugagccgacaucgcaccacugcacuccagcccgggcgacagagugagacucugucucaaaaaaaaaaaaaaaaaaaaagaaugugccacaaauuauuuggcuacacccaaauuguuuggauuguuucuuauuuuuuacuguuaucaacaauagagaacauugggugugagcauguccaagucuuucuggaguguaaaauuuuagaaguagaguugcuguccaaaaaguguacacauugacaauuuugccaaguuuugagugcccuugaaagaauuauagcaucuucugauuccaccaguaauaacagugucuuuuucuucacauccucaucaaccauggguauuauucaucuuuuuaauuuuugccaauaugaugagugaaaaugcauuuuuuuaacuuuuuuuuuuugagauggaguguugcucugucacccaggcuggagugcaguggcgugaucuuggcucacugcaaccucugccucccagguucaagugauucuccugucucagccccccgaguagcugggauuacaggcucaugccaccgcgccuggcuaauuuuuguguuuuuaguagagacgggguuucacuguguuggccaggcugguccugaacuccugaccucaagugauccaccugccucggccucccaaagugcugggauuacaggcaugagccaccacaccaggccgaaaaugcaucuuuuaaugaugugccucacauguuacuaauacaaggauaaguauauacauguguauauagacacacacacaccauauguauauacacguauaccauauauguguguguacagguacauacacacacacacacacacacacgcagacgcauauacaccuucagccaacugaucauggcuaugcaccuugggaaaauugggaaacuaccccaaacccuagcauuuucaucuuuauuuauuuauuuauuuuugagacggaguuucacucuuguugcccaggcuggagcgcaaugacacgaucucccucaccgcagccuccaccuccuggguucaagcgauucuccugccucagucuccagaacuuuauucauggauauuccuauuuuauuuuuguucuguccuuuacauaagauuacagacauaagauuaaugcuuuucccucuucuaaccucuuucucuucuccagcagaaacagugccagggccuuacaauguguuuuggauggugacauagcaucaaccccccucugcaucuugguccccaccccguccccuccacuaccaagcuggaagcacucugguuuguccaaguucuaaagugcugugcccaggcccaaaugccauccccuaaguugcuggucuaugauucuuuuuauuuuuaugauuuuauuuuaguuuauuuuauuuuugagacagagucucguucugucacccaggcuggagcgcagugguguguucucggcucaccgcaaccuccgccucccagguucaagcguuucuugugccucagccucccaggcaguugggauuacaggugagcaccaccacucccggcuaauuuuuguacauuuuuaguagagacaggguuucaccauguuggccagacuggucucgaacuucugaccucaggugauccaccugccuuggccucccaaagugcugggauuacaggcgugagccacuguaugauuguuuuuaauucaaacacguaacuaccaggaaagcugucaugagcacauaaccccaaauaccuucauuuauuuauaaauuacauauacauauacuuauguauuguauguuuuacauacauuccaaagaagcuucuuaacuuuuaucauuaauuuuagugagaucaauuucucccuuaaugaaaacagccuggaaguuuuuuuuccuguucucauuggauacauaucuugcugauugugauggauucauacuuugaauucucuuuuaaugauaauggauauaaaaccuuguuucaaauagucuugaaaagauaccaaccccuccuccugccuuuuuuggcccauuucuugucagauccaguuaacccguuacugcuuuuauuucauaauguagugaaggaagaccuuacgcccaggaggagcagugagaggucggcuguuuucuuuuugcucacuugugccgucauuguuguucucuucagucuauggcuucuuagaaggauucuuuguaagcugugugcgugauauaaauuaaaauugaauaauauaggccaggcgugguggcucaggccuguaaucccagcacuuugagaggccaaguugggccagucgcuugagcucaggaguucgugaccagccugggcaacauggcgaaaccccgucucuacaaaagacacaaaaauuagcugggccuaguggcgcgugccugugaucucagcuacuugggaagcugaggugggagaaucgcuugaaccugggagguugaggcugcagugagccgagaucacgccacugcacucuagccugggcaacagaaugagacucugucucaaaaaaaaaaauaaauaaauaaauaaaauaaaaaauugggugauauauggggaaaaaaagaacacuaaccccuguuuuacaucauauacaaauauuaauucaagaugaauuauagucacaaaugugaaaugcaaacaauaauauuaccagaaguuaacagaaaauaucaucaugaccuugggguaggcaauuuuuuuuggggggcgggggacaggaucucacucugucacccaagcuggagugcagugucauaaucucagcucacugcaaccucuggcuccugggcgcaagcaauccucccaccucugccuccugaauagcugggaccacaggcguacaccaccaugcccagcuaauuuuuuguaucuuugguagagacaggguuuuguuugccauguugcccaggauggucuugaacuccuggacucaaguuauuugccugccucugccucccaaagugcuaggauuuauaggcaugaggcaccauacccagccugggguaggcaaacauuuuaaaaauacaauacaagcacuaaucauuaagaaauaauaauaaauugggcugggugcaguggcuuaugccuguaaucccagcacuuugggaggucaggaauucaagaccagccuggccaacauggcgaaacaccaucucugcuaaaaguacaaacauuaguugggugugguggcaggcgccuguaaucccagcuacucaggaggcugaggcaggagaauugcuugaacccaggaagcagagguugcagucagcugagaucacaucacugcccuccagccugggcgacagaguaagacuugaucucaaaauaaauaaauaaauaaauaaauaauuggauuucauuauaauuaagaacuucuggcugggagcuguggcucacaccuguaaucucagcacuuugggaggccgaggcagguggaucacgaggucaagagauugagaccauccuggccaacauggugaaaccccgucucuacuaaaaauacacaaauuagcuggaugugguggugcgugccuauaguccuagcuaccugggaggcugaagcaggagaaucgcuugaacccgggaggcggagguugcauuaagaaagcaaaaagaggccggacgcgguggcccacaccuguaaucccagcacuuugggaggcugagguggguggaucaccugagguugggaguucgagaccagccugaccaacauagagaaacccugucucuacuaaaaauacaaaaauuagccgggcgugguggcgcaugccuguaaucucagcuacuugggaagcugaggcaggagaaucacuugaacccgggagguggagguugcggugugcugagauggcgccauugcacuucagccugggccacaagagcgaaacucugucuccaaaaaaaaaaaaaaaaaaggaaaaaaaaagaaagcaaaaagaggucgggcgcaguggcucaugacuguaauuccagcacuuuaggaggcggagguggguggaucacuugaggucaggaguucgagaccagccuggccaacauggcaaaaccccaucucuacuaaaaacacaaaaauuagcuggguuuaguggcagguguguguaaucccagcuacuugggagguugagacaggagaaucucuugaaccugggaggcagagguugcagugagccaagauagcaccacugcacuccagccugggugacagagcgagacuguguuucaaaaaaaaaaaagaaggagaaagcaaaaagaaaaaagugggagaagauauuuucaguacuguacauauauacaguagugaaacuuguauccagcguauauaaauacccuuacaaacccuuacaaaaugaacaugauagacagcucaauuuuaaaaaauggcaaaagagggcugggcgcgguggcucaugccuauaauccuagcacuuugggaggcuguggcgggcagauugcuugaggucaggaguucgagacaagccuggccagcauagcgaaacccugucucuauuaaaaauacaaaaauuagcugggcauggugguguguuccuguaaucccaguuacucgggaggcugaggcaggagaaucacuugaaccugggaggcagagguugcagugagcugagauugugccacugcacuccagcccgaugacagagggagacuccaucucaaaaaaaaaaaaaaaaagcaaaauacaugaauaagcaugccacaaaaaaauccauauauguccaaggaguauguuaaaugaugcucaacuuaauuaguuauuugggaaaagcaaauuaaacaaugcaacaccauuacauaccugccagaauggaaaagaugaaaaagaaagugccagauauugacaaggaucucuugcaaacuacagauaggagucuaaauugguacaaugacuuuggaaaaccauuuggcagaaucuguuaaagcuaaauauaugaaugcucugugacucuauaguuauaccccuaaguauggaaccagaaaaguguacauaugcauguagauauacaugcucaagucuuauguucuuagcaguaguuuuuuuuuuucuugagacagggucuugcucuguugcccagacugaagugugcaguggugaucacagcucacugcagccucaaacuccugggcugaagcaauccuuccaccucagccuccugaguagcuaggacuacaaggguacaccaccacgccuggcugauuuuucaauuuuuuguagagaugaggucucauuauguugccuaggcuggucuugaacuccuggcaucaagugauccuccugucuuggccucccaaagugcuaggauuacuggcauaagccaccaugccuggccuagcagcacuauuuuugguggucaaaaacuggaaacaggccggguguggugguucauaccuguaauuccagcauuuugggaggcugaggcaggcagaucacgugagcccaagaguucaagaccagacuaggcaacaugacgaaacucccaucucuauuaaaaaugcagaaaauuagccagcaugguggugcgugccuauagucccagcuacccaugaggcugagaugggaggaucaccugagccugggagguugaggcuacagugaacagagaugguaccacugcacuccaaccugggggaccagaacgagacccugucucaagaaacacaaaacaaaacugcaaacagcucaaauguccaucuucuguagacaaguaaauuuugcuguguuuauacaauagaauauuauccagcaaugcaaaugaacaaacuauaacuacacacagcugcauggauaaaugucagaaacaugacguugagugugagaagccagaugcaaacgaggacucacugugcaauucugugcauguacaguggccaggugaggcuuauggagugcugaaaugcucuguaucccaaucuggagggugguuuuaaaaaaauguuuugagccagugcguugguucacaccuguaauuccagcacuuugggaggccaaggugggcaggucacuugaggucaggaguucgagaccagccuggccaacaugguaaaacccugucucuacuaaaaauacaaaaauuagcugggcaugguggcacacaccuguaaucccagcuauuuacaaggcugaggcacagagcagggcucugucucaaaaaaaaaaaucauaaauaaaaaauaaaauuuaaaaaauacuugauuuuaauuuuuuuagagaugggggucucgcugugucacucaggcuggucuugaacucuugggcucaagcaauccucucaccuuggccucccaaagugcugggauuucagguauaaaccaccacgccuggcccuggagggugguuauacuuguguaguaaaaacucaugaaaccuuacacuuaugauuugugguagacuuuucuguauuaauguuauauauauauauauuuuuuuuucuuuuuuaaccuuuuuuugguagagacgggcccugcuaaguugcccaggcuggucuugaacuccugugcucaaguaauccucccucccuggccucccaaagugcuaggauuacaggugugagccacugcucccagccuaaauaaaaaguuugcuucuccccuccuuuucuccccaaaaaccaggguguuaucaggaaaucuacuuaacuaggccuaggugaauugcaauagguugcauuaugcuaaaagcaaauguacagguuggggggguguuguugucagcuccgccaugucguggaccugcccccuuuucaggacaccucacgucaccuuccauaacagaacagguaacgugacauaugaggugcacuguugacaagugacacuggugacaagugaggagcacuguuaucaaucuggaaaggaaauauaagcauagcuuuacucauuuauuuauuuauuuuuuuaauuuauuuuugagacagagucuugcucugucacccaggcuggagugcaguggcgcaaucucggcucacugcaaccucugccuccuggguucaagcaauuuuccugccucagccucccaacuagcugggauuacaggcacccgccacuaugcccagcuaauuuuuuguauuuuuaguagagacaggguuucaccacguuggccaggcuggucucaaacuccugaccucuugauuugcccgccucggccucccaaagugcugggauuacagauaugagccaccgugcccagccauuucuuucuuuauuuuuuuuuuuuuagagacaggguaaugcucuuugacucaggcuggagugcaguggcaugaucauagcucacuggaggcucagacucauagguucaagugauccucccaccuaagccuacugaauagcugagacuacaggcacgcaccaccauaccuggcuaauuuuuguauuuuuuguagagacagaguuuugccauguuggccaggcuggucuuaaacuccugggcucaagugaucugccuaccucagccuccugagucacugagacuguaguugugugccaccaugccaggcuaacuuuuuuuuuuugagacauggucucucauucuguagccuagacuggagagcagcaguggaccacagcucacugcagccucaaccucccugggcuccagcgaccccccagccucagcuucccaaguaauugggacuacaggcaugcgccacugugugccacccaaaaaaucuuagcauaccgcguagcacaaagggagcguucagcacaugggagcuauuaccaggcgucuuaauccauuuugugcugcuguuacagauuaccacagacuggguaauuuauaaagaaaagaaguuuauuuggcucacaguucuggagacugggaaguccaagagcauggugcaaguaucuggugagggucauccugugugaggcagaaggcucacauggugagcaagugcaugagacagacagcauggcagcagaacucauccuuuugccaggagcccacgccagagaaaacuaaccuacuccaugacaauggcauuaauccauucaugagagcagagcucacauggcccagucaccccuuauacuguuaaacaauggcaauucaauuucaacaugaguuuugguggggacauucaaaccauagcaccaggaucguuaguagccacaugauaaaauguaugucuucaagauuugaagacaauggcauaaggucagugauccagcugcuuguaccccugacuuuuucugacccuaggagaagggagcacuggcuuugcuuucaucaggccaaagaugccuuucuuugggaauacguucaguccgaagaagacaccuccucggaagucggcaucucucuccaaccugcauucugugagugucgguacuggggucggccgggugugcagcaugaguugagugcugagcgugucucugaauggaaagugugguccuccagaggcaucagugcaggagggcauccuuuccguccauaucauugcuauugcggaaaacauuuuugaacucuuguuugggaaugaucgucagagcuuguuuauccaagaaccuaagaagacaaucucauuaugauauuugaccccaaauauccaaauuuuuuuuuucuuuuuugagauggagucucacucccgucccacaggcuagggugcaguggcgcgaucuugacucacugcaaccuccaccucccggguucaagcgauucuccuuccucagccuccugaguagcugggauuacaacugcccgccaccaugcccggcuaauuuuuguacuuuuaguagagacaggguuucaccauguuggccaggcuggucucgaacugcugaucucaggugauccacccgccuuggccuccccaagugcuaggauuacaggugugagccacugugcccagccaguaucauccaauuugacuucuacuuuauucugugaccuuuuccuacagagcuagcuaugcagacuggccaugucuucacagaaggcgagugggguugaacaacaaggcugugggggcugagcauucacuacagguuucaggucuuaagagucuguugucuccuguucccagugaaaaucauggugggggcagccccacuguggccagagcugggcauucuguggagcaggccaggcagaggcuuaggaucucaguuucuggugccccuaggccugaggcucccuuuccucucugccaugugugagagaugcagauacaccuggcggucccucuaggacauccucuguccuaaucccacacagcguaagagcagcagugugcuuacaugacgucugucucugaccgugacuugaagucgguccuccccuacauuguuuuccacaugcugacagguacuuguaagccuugguacuuguaaggccuccacagcgcuccauauggucacugguggauuuuauuaguuccccguuauuacaggauaaccacccagaucuugggagcagcacaaaugacccuugguggccucacuccagcucuccuuccugcccuugcccucugcacacccugugcugcagccgcccaagccccgugugaaccuccucugcgcacgcuacuccuucugccuagaauguuuaauucuagaaucuagaauagauuaauuaaagagcuauugauugauaccuuucuaugugccaggcacucuccuaagcacugggcaugcagaaguggaugaaggaggggagagaaaaacaucaaaucccugcuuucauggggcagauacuuuaacggaaggcuacagaaaauaagcaaauuuauaucagauggugauaugugccagacagcaaaacaaagcauaggccugggaugggguguggcugagcacuggggacugagcuuucauuuucaacaggguggucaggaaggccuaacugagaaagggacauuugagcacuuaccugaaggucucccuguguugagccgcuauugagggcagagcuggucauacgcaucccuggauacccaguaccgagucccgaaucggggugggugcucagugaguuguagaaaugaauaucuaggccaggcgcaguggcucaugccuguaaucccagcacuuuaggaggcugaggugggcgcaucacuugaggucaggaguuugagaccagccuggccaauguggcgaaacucugacucuacuuuaaaaaauacaaaaauuaggccgggcacgguggcucacgucuauaaucccagcacuuugggaggcugaggugggcggaucacaaggucaggaguucgagaccagccuggccaauauggugaaacccugucucuacuaaaaaauacaaaaauuagccaggugugguggcgugcgccuguagucccagcuacucgggaagcugaggcagaagaguugcuugaaccugggaggcagagguugcagugagccaagauugugccacugcacuccagccuaggcgaaagagugagacuccgucucaaaaaaaaccccaaaaauuagccggguaugguggugcaugccuguagucccagcuauucagaggccgagaugggaggaucacuugaacccgggaggcggaggcugcagugaacugagaucgcaccacuguacuccagccuuggugaaagagcgaaacuccgucucaaaaaaaaaaaaaaagaaaagaaaagaauagaauauguaaauuguacugucgcacguuaagaagcaacuccucuuccuccuaauuguuagaauuuuaugucuuuuccacaacauauguagcuccauauuaagcaaaugauaacuugggggacuauuacauuuaaaaagaauuuuucacuugauuaacaguuuauaguaggauugcuuaaacuauuaagugucaaguagguauaaaauaauucaauuuauaaauuucaguauauauagcuuuucuggaaaacaucuaauguauaaaacaguauauuuuuuaucucacaauuaaacuuuuccuguacaucauuugauuuuauggcuuuaaaaaaaucauuaaaggugccaaguaaugauuagagaaaugaguuguuggggucauauuguuggcggaagaggagcugggaugaaggcguguuccgggccugcugaaguugucacauagcaucucgcccacaguuggaucgaucaacccgggagguggagcugggcuuggaauacggauccccgacuaugaaccuggcagggcaaagccugaaguuugaaaauggccaguggauagcaggugagcugcacuuccugccauuuugucaaacaagauuguaggaggaaaucccccuuuaacugguucuguccuuccuccagagacagggguuaguggcgguguggaccggagggagguucagcgccuucgcaggcggaaccagcaguuggaggaagagaacaaucucuugcggcugaaaguggacaucuuauuagacauggugaggcaggugauggggaagagaggccuagcuucuccuuuuggggaggcuccaccucgagucacuuaauccaacagauaucuccucaaugccaguuuggccagguacguugcuuugcauccaaagccacacgcaaggaacaagacacaguuccugcccucacaguguagaggcagguggaccgaccguaagcauaauuacauaaggacccaguuggagucugcacaggaucugcacagcacacgagggagaaguuauuucugucaagucgggagagcuucccagaggaagggauaucugagcugaauguggaaggauaauggcaggaauagagguuagaugaaggcauuccaggaagagggguagagccggcucauggcuuggaagugucucauaccaaguaggcauuaaucagugcccaguacagaccagcugaggggcucacacugcauuaguguugguuucuuguggcuguuaaaaauccagcaacccacugggccuagaggagccugugaagguucagaggcaggagagcauacacuguagugguuaagagcacacacuccagagcaaaauggccuggguuccucacccagcucugcuacugacuaacugcucuguaacuuaauuucuucagcaauaaauggcauaauagcuaauugugguggugcaccccuguagucccagcuacuugggaggcuaagacaggaggauggcuuaaccucaggaguuugagagcagccuuggcugcaaaguaagaugccaucuuuuuuuuuuuuuuaaaaaaggacuaggcugggcaugauggcucaugccuguaaucuuagcauuuugggaggccaagguggacgggucacaaggucaggaguucgagaccagccugaccaacauggugaaaccuugucucuacuaaaaauacaaaaauuagcugggugugauggcaugcgccuauaaucccagcuacucaggaggcugaggcaggagaauugcuugaacccgggagguggagguugcagugggcugagaucgcgccacuguacucuagccugggcaacagagugagaccccaucuuggaaaaaaaaaaaagaaaaagacugacauuuuaggcuggauguuuuuuuauuuuuauuuuuauuuauuuauuuauuuuagacagagucucgcucuguagccugggcuggaguacaguggcaugaucuccacccacugccccacugcaaccucugccucccggguucaagugauucuccugcaucagccuccugauuagcacccgccaccacgcuuggcuaauuuuugcauuuuuaguagagaugggguuucaccauguuggccaggcuggucuccaacgccugaccucaagugaucucccugucuuggccucccaaagugcugagauuacaggcaugagccaccacgcccggccuggauguuuuuuuuuaaaaaugagcauaaucguaguaucuaccucauagugaguuaguacaagaaaagcacccagccuggccgacagagcgagaccgugucucagaaaacaaacaaaccaaaaaacaaaaacaaaaaaacccuaaggaggaaaguggcauucuauuucuagcauuuuuuccccucauccccauuaugggagcuacagcuuagaaucaauuucagcucuaaucccuuagccuuacaaucaccaguaucugccuuugacguccucugagaccugcucuccuucgugcagggagugccaugcccucgugggugacagcgugcugacagaguggacugugaauauucuucaaguacuugugguccugggucaucagggguugcauucuacccaguuacagaggguuucccaucgaggaagccagcagcaucagagaaguggcagggggccuuuccuccguguguagggccggccuugcuaacccgaaacauuuccuagaaaugugcugcuugcuaacagccgcugcuucacuuucagcuuucagaguccacugcugaaucccacuuaauggagaaggaacuggaugaacugaggaucagccggaagagaaaaugaagaccccagagacauuuauuggggaguaggauguggcugagugcuuuuuuuuuggccagacuagcggauucaguccuggaagagaguaucauauaaugagacccacaggcacuggcacccuuggguuggcaauagaaggugacauggaauggagaaaaccaagauuccagauggggauaguaacuagaaggugcuucagaugcacugccugcgggugccagucugaaaaccagaccgcacagaggccuggggcugcugaugagcuuuuuggugcucuccacacacaagcucgcaaacacacaugucccagaauagcucuguuggguuguguugggagaagcggcuggaguucauucucucacccccuuauguugguguuuggcgugugacagcaguucuacagagcucuguguuggggucauggaugagcggcucucuuggcucuuaaaggcaggccucucucuucuugccuuuaaagaauccuccuuccucacaccuggccuccucuggcuucagcuucucagcagcaagcaccagccuuccacaacaacacuauauuuuuaugcuacuuuccuguuugcacuacuacuuuuuuauuaaacgauguuaaauaa

SEQ ID NO: 192560 - RNA, 39699 nt, Homo sapiens
gccacgcgugcgcuuaggcgccgcugagcgcugacugggugcgaguggggaagcugcuaacccgacccggauuggcgcugagguggcccguggggcaggugagugcggggcgggagucagcggagacccaccggcgccuacaaguuccccucaggcgggggcugcggggcggcuguggucggacuguccgaccgagggucguaugggccgaaggcgcccacgagagaagcaccgccucgggccggagagccgccgggccgaccuugcucgcgucgccguuggaaugggggccggggacgcggcggggcggggaggucggcugcguccuccggugcggccgccccuagacggccgaggccaccucagguguucggggcgccagccggaauccaccgcgcuggcagccgggagcgguuuuacgaaaaccgcgccugaggcggggggcuuucuaaaaagagccuggcuggcucuggcaccgggacagcugcagacuccuccucagguuuaacuugcgguuuucccuuuaagauucagauccaggugcagaacccgggcucggauccaggcccgagacucggaacaccgguguguuugcauuuuagcacgggggaaacugaggcauacguuagccagaaucauccggugugguuaggacuggaauuuugaaaauuauucucauacuuaguuuacugaccuaggcucuuuuuuauuuggaaagaaaaauaaagauguuucaaagguuguuuucagugacugggugacuaguguaucuuccagucucacgcugcacguuugugguggguugauggcucuuuuuuguuuugcggugggauagagauguccuggaauguucuacaccuuucuuauucuuucuuaguaaauucaagucaaaucagacucugauucacaaaaacucauuuucaacuucgacucguuuacucguaguuuuugugacagguuugugauuagguuuauagguacauauguuucccgcuuuucuugcucuuuuaguuccaauuaucucugcacucuaaacaguugaauuacaucuuuguuuuuacacuauuucuguucuuggugauuaauuuguaauucuucuuuucuuuucuuuucuauuuuuuuuuuaagacgggaguuucgcucuugcccgggcuggagugcaaugacaugaucucggcucacugcaagcuccgccucccggauucaagugauucuccugccucagccuaccgaguagcugggauuacaggcgcccgccaccacgcccggcuaauuuguguauuuuuaauagagacgggguuuuucgccauguuggccaggcuggucucgaacuccugaccacaggugauccgcccgucucgggccucccaaagugcugggauuacaggcgugagccacugcgccaggcccgauuaauuuguaauucuauagauaucuuuccuggcuuuugauaauccuaagugaauguagcuuuuucaucccuaauuaucauaguagccugagcuuuaguucuucucccuguccccccccccuuuuuuuuuuuuuuuuuuuuuugagacggagucucgcucuguugcccaggcuggagugcaguggcgcgaucucggcucacugcaagcucugccucccggguucacgccauucuccugccucagccucccgaguagcugggacuauaggugcccgccaccacacccggauaauuuuuuguauuuuuaguagagacgggguuucaccguguuagccagauggucucgaucuccugaccucgugaucugcccgccucggccucccaaagugcugggauuacaggcgugagccaccgugccuggcccucccugucccuuuuuaagcguggagguguguggucugggaggggagagggugaggugucuauugaucagauauggguaauagguuaacauaacccaugaccagaacauuaaaaggcuguaaacaaacaauugcuucaauauaaaaacgcauaccucgugaauuuggaaacaugucagguugauagaaaagugaacucggguagaaccucacagaaaugaacccgacauuagggugaaauauugagaagggaagggaggagauaaucaucucuuuuauuuuacagccaucuuucuaugccuggaguggauguaggaacagccugcuggcucagaagcuuaaaaaaagcucuguguguuuucaguuuuucucuucuuaguucucaaugaagguuuuggcaggagcccaaaaucuuguacauuugauaauuuaacaucaguuucaucugcuuacucuccagauagccuguuauucagcuggugacgucaguaauuuuccacagcagccauucaugagcucaugcagacugucacaaggaaaugggaauagcacaaugaguguuacagaagaaaaaaagauccuguuucuuugccaucacauauuauacacagacuuagggaaucuagacuggagcacaagauaugugggagggguuagaacaccacuccuaccuguaguaauaaucauugaaaccacuuauuggaugccuucugcuuaccagacacuaguugucacaggucacuguaagugacagggccagaauuuaagucuaccugacucuaaacucugcucuuuugucugugcuguacuaccuuaucaacaacuguguucaagucuuucucauucuuaaaaauauaugaaacuuuccugugaucauauuucccuucaaauuacuaccauuucuccugcuuuuccuuucuagacuuguccuuaagaagcagacucuacauucuucucuuccauuuacuccuucauucauugcagucugacuucuacccucaacucuguugaaacuacucucaugaauuccucucaacgauuuauugaauaucuacuguguauaucaucuucuagacuuauaaagacggcuaagacauggaucuugcccucagguaguuuagagauuaaugagagaggguaguuuauacaugucaauguauguuucccacugauagggcaguuguguuuuuuguuuuuguuuuuguuuuuuugagacauagucucacucugucaccaggcuagagugcaguggggcaaucucggcucacugcaaucucugccucccgaguucaagcaguucuccugccucagccucccgaguagcugagacugcaggcgugcaccaccacacccagcuaauuuuuguauuuuuaguagagacgagguuucaccauguuggccaggauggucuccaucucuugaccucgugauccgcccuccuaggccuuccaaagugcugggauuacaggcgugagccaccacaccuggccugauagggugguuuauuuauuuuuauuuuuauuuauuuuauuuauuuauuuuugagacggagucucccucugucgcccaggcuugagugcaguggcgugaucucggcucacugcaagcucugccucccggguuuauuuacgccauucuccugccucagccuccugaguagcugggacuacaggcgccugccaccaugcccggcuaauuuuuuguauuuuuuuuaguagagacggggcuucaccguguuagccagaauggucuugaucugaccucgugauccgccugccucggccucccaaagugcugggauuacaggugugagccaccgugcccagccaauagggcgguuuuuauaguuugagaguuggggaaggaacacuuuauugugaagaugucacuggacugccaccagagagaaagcuuaaauuggucuagacuguagugucaagacugcgugcuuagguauauacuuuuagggaaaagcuguauccacugagagaugacaugguugaaagauacaguauaggcuuuagagucugacagaucugguaacugagcuacaauuucuucuuuguaauacuugccugcaauguaagcucuaugaaaguaggggcuuuguguuguucaccaccucacccccaucuccuagaacagugguaggugagcaauaaauaucuguugaauggggcccaguacggcggcucacgccuguaaucccagcacuuugggaggccaagguagaggauugcuugagcccaggaguucaagacuggucugggcaacauggcgaaaugccaucucgaccaaaaacauaaaauugccagucauggugaugugcgccuguggucccagcuacucgggaggcugaggcaggaggauugcuugggcucagcucaggaggucgaaguugcagccagccauguuuguaccacugcacuccagccuggggaagagaaugagaccuugccucaaacaaacacauuguaccaguacuaucaguaguagcauaugacugaaauaacaaggcuagauuuucaguguggcuuaugaacugauuuugacagcaccauuguuugaaugcuacauauauaaucaccuccccuuuuugaaaauuuaggcuuacuaauuuaugcucaccauuuauacaugaggagagauacauucaccucuuuucaguaggcacaguuaacuauuaacugucucuucuaauauaugccucuuuugcagugauaaacauauuucugcuuuuucuaagugugauacauguuuuguauuuguuuuucucucuacuaaugauguaaauuguuuugggagguuaacugcuuuggaauaauuaaacagcuuuaucaacaagaguaacugauaucagaaauuagauugauaggccgguugugguggcucacgccuguaaucccagugcuuugggaggccgagguaggcggaucaccuaaggucaggaguuugagacuagccuggacaacaugguaaaacccugccucuacuaaaaauacaaaaauuagcugggugugguggcaggcgccuguaaucccagcuauucgggaggcugaggcaggagaaucacuugaaccugggaggcauagguugcagugagccgagaucaugucauugcacuccagccugggugacaagagugaaacucugucucaaaaaaaaaaaaagagauugacacccccaauucagugucaaaagucuuaucuuggaaaggguauaauuuccaauuaagacagagaauuuuuuuuuuuucacuacaacaaaauuaugugacuuuucucacccuucucuagauaucuaauuagccugcaagcuaacacucuaaagacaugaaacaggcugggcuuaugucuguaaucccagcacuuugggaggcugagguggaaggaucacugaagcccaggaggucaagaccagccugggcaacauggugagacccugccucuacaaaaaaauuucuaaaaauuaaccagauaugguggcgugugcuuguggucccaccuacucaggaugcugaggcaagaggaucacuugagcucaggagauugaagcuguagugagcugugaucacaccacacaccacacacuccagccugggugacaaagggagacccugucucaaaaaacuggaaaaaaaaaaacaagauaugaaagaacagaucauuucccuuuucccucucuuguguuugaguuucguuuguaaauauccuuaauuaugugacuugaggauaggguuaaagucaaauuaccacuuuuuuuuuuuuuuuuuuuuuuuuuuuuuuuugucuuuuggaaacaguacgguagucggagcaccaacaaugaaguucaacuuacggcucugcugcuugcuuccuugcuugucugcuugcuugauugauugacaggguuuugcucuguugcccagguuggagugcaguggcaugaucauagcucacugaaaccucaaacuccugggcucaagagguccuccugcuuuaaucucaugaguugcugugauuacaggugcaugccacugcacccggccuggcuuuaccauuguaaacuucgagaacuuacaaguuaucugucaugccucauuucucucaccugcaaaaauggaauaauuagugcuacucauaguaauagcuaauauguauuagguguuugcuauauauaccagucacaguucuaagaauuuuauuuguauuaacucacaauccucacaucaacccuauguauugcuaguauuaugcccauuuacaggugagacaacagugacagaaacaguaauuugcuaaagauugguggagucaggauuagaacuuagucugacucuagaguuuaugcucauaaucuccaccuucauaguuuuuuguuuuuuuuaauuuagcauauaaucaagaaauagaguaguuuugaagauuaaauaaaaucuauauaaaauggcugugacaagcauuuacgguauuaaguacuacaguuagcuucgaguuuacaaagcauuuugcacacauuuucuuugauugucauaggaauaaccaaauaugcuugugaccaucacuguccggcaggaaacaggcacacauuuggucacuuucccagucaugcagcaugugugcagacagugcccugguguugcuccuccauaucuagaucauguggaauuugaagcaucacauuuugagaaaauuuaguagacauaaguuguuuuggccuguccagcauccaauccagguucuucuggggauaacagcucaauuuugcuuuggagaacaguucaucccugaccaacuaggugguaggcacauggcccaggucaggccaacagauguuaggcaaauagaugcuuuccuccuuuaauuugaaucuuagguugaaugacacaguaacaaaaguucaauaaacaguugcagcuccuucaucacaaccacaggcuaauuccuaauaucugggcacuagagcugcuguuguuuucaacgagcugagucuucagcuuuuccuugguuuuauguccuacuacauauccuuccaauacauuccugucuuucauaacuuaaguuacccaaagucaguuuugguggcuugcagcugagacaccuuuaacuuuuacauggcaugaggucaugucauguaagaguuaaaauaggccuggugucguggcucacgccuguaaucccagcccucugggaggccaaggcaggcggauccauugggcuaaggaguuugagacccgccugggcaacauaaugggaaccugucucuacaaaaaaaaacuuuaaaaauuauaaauagcugggcaugguggcaugugccuguagucccagcuacuugggaggcugaggugggaagauuacuugagcuugggaggucaaggcugcagugagcugugaucgugccacuguacgccagccugggugacagagcaagacccugucucaaaaaaaaaaaaaaaaaaguuaaaauaaucagcuaacuuuaaccugaagaggagagaaaucuuggagaagauguggguaucuucaaaugucugaaguauguagaauacaaaguaccccuaaaaagaccaaagaguagauauuacuagcaaacagauuucugcccacguuaaagccuaaggcagggcuauccacaggugacagacugucuugguauguggaaauagauacauccacuaaauuguucaagccaagacaagauggucaccugggaggaguaauauggguuuaguaaucuaauggggacugggugugguggcucaugccuguaauuccacugcuuugggaggcugaggcaggaugaucgcuugaggccaagaguuugagacuacccugggcaacauagcaagaccagcaucucuacaaaaaaauaagaaaaauuagccaggcaugauggugugugccuguaguccuagcuacuugggagacuggggugagaggauugagcccaacaguuugagguuauagugagcuggaauagugccacugcauuccagccugggugacacagcaagacccuguguauauuaaaaauaauaauauggccgggcacgguggcugaugccugucauccuagcacuuugggaggcuaaggcgggcagaucacuugaaggugggaguucgagaccaaccuggccuacauggcgaaaccccaucucuacuaccaaaaauacaaaaaauuagccgggugugguggcgcaugccuguaaucccaucuaccaggaagcugaggcagaagaggaacccaggaggcggagguugcagugagcugagaucacacacugcacuccagccugggugacagagcgagacucugucucaaaaaaaaacagaacaaaaccaauaauaauaaucuaauggguuguuguacugaaugaacuguaaaguucucuccaauucugagaucgugauucucugauugaaaucuaaaucugcagacuccgagaccuagaguucuuuuuagaagauuuaccugcuuuuccucacuuuuccaaccuagucucuuauauucccgcuucaccaccuaugugcugcucuuuguuucggaccucugcuuccaucagcuccucaccuucuucagguguuugcucagauuuuucuuacugagccuucccugacuaccuaauuuagaauagcagcuccugaaagugccuaugguucuuccugccucauuuuacucuguagcacuauucaucugacauacaguguggucucuuauuaauuuuuuaaguuacuucuuuccccucuagaaugcugggacuuucaaagaagggauuucuaucuauuuugagcacuucuguguucccgacacuuaaaacagugccugguacauaauaggcacucaauaaacauauguugauugaaugaguauuuccucaacacaaagucaccauugggucugcuuuguguucuaggagaauaucuagcucaugcuguccacuucguaccuuuucucuguugcuucccuuacucgcuggugccuuucucuuuuccucuucucuuuggaucacagcauuucaagacuagaagucugagaucaccucuucauaaggaccagagucccuguguaacacagcuaguuaaugaaagaugugggguggagggugacugacuguuggauuguuuaucucuguuaaacuguggucucccuaagucuugcucaguucaggcccgugcagugccugcugcagcauaugcauaucccucagugaguuauuaaguaaauaucuuccuccuucaugaaggcuuuuccauaucaaccuguaguuaucucuuuauuucuuugaacuuugguaguauuuguggucucuguucuuauuauuaaggcagggucucacuuugucacccaggcuggaaugcaguggcacaaucuccacucacugcaaccuccaccucccaggcccaagcaauccucccaccucagcuuccugaguaaucugggacuacagauuugcaccaccacgcccagcuaauuuuuguauuuuuuuguagagauuggguuucgucauguugcccaggguggucucaaacuccugggcucaagugauccacccuccucggccuccuaaagugcugggauuauaggugugagccaucgugcucggccugguuucucuuauuaacuggccuuggguuguuugccauuuuaugugucugucuggucaaugaaauuauaaucccauggacaaagacuaaauguaccuacuacagaaccuaguccugagaggcaguauaaaguagugaagugcuguccaagagaacuuuauacagugcuggaaauguucuuguaugacuauuaacauuuuuuuaaugcuguguguguauuuguaugugugugugauuaaguaauuacacuuaucugcaccacccaggaauaaucaguaaacauucuggcauuuauuucuuuauucaucuauuaauuguacauuuucuagcuuuuuuuaaccaugaauaucuauaauuuuuuuuuuuuuuuuuccugagacagggucucacucugucacccaggcuggagugcaguggcacuaucucagcucacuguaaccuccgccucccggguucaagcaauucucccaccucagcaucccgaguaguugggauuagaggcaugccccaugacaccuggcuaauucuuguauuucuaauagagauggguuuucaccauguuggccaggcuggucucgaacuccugaccucaagugaucauuacaggcgugagucacugugcccagccuauaacuuuauaaucauaaaaacaggccuggcucacaccuguaaucccagcacuuugggaggccaagguaggaugacugauugagcccaggaauuuaagaccagccugggcaacauaguaagacccucucuacaacaguaacaaaaaauuagcagggcgugguggugugugccuguaguccuaacuccuugggaggcugaggugggaggauugcuugagccugggaggucgaggcugcagugagcugugaucacaccacuucccuccagccuggacaacagagcaagacccugcucaaaaauaaauuaauaaauuaaaaauacaaguugcugcagcuucuauuuuuguaaauuguauuuucccccauugauucacauaauauaagcaauguuuuagcaugauaaugguuuagcaugauauugggaagaacgaaguaauuaggaaagguuauagaaacauuuuacuagucuauauaagccaucagaaaagagguacacgcuuuucuuuuuuuuucuuuuucuuuuuuuugagacagggccucauucuguugcccagguuggagugaagugguaugauuuuggcucauugcaaccuccaccuccagggcucaggcaguccucccaccugagccucccaaguagcugggacuacaggugugcaccaccacacucagcuaauuuuuuaaauuuuuuguagugaugaagccucacuauguugccgaggcuggucucaaacucuugggcucaagugauccuucugccuuggccuuccaaagugcugggauaagaggaaugagccaccaugcccggcuacaaggcauuuuaacgaugcaagauagugcauuuaggaacuggaaauacaaacugaaguauuauauuauuacuccaaauuuaaaagguaaaucuagaagcuaaauaacuggaguccuuuaguuucuggaaaagaacaaaugauaaauaagcaugagagcccuuuauuacuccccaacauguauguaaacuauugugcaauuuguuguaaguuaauaauucuuggggccgggcguagugguucacaccaguaauaccagcacuuugggaggccaaggugggaggauuccuugaggccaagaguucaagacuggccugagcaacauggcaaaacccugucuuuaccaaaaauauauacaaaaaacuagccaggcauggugguauaugccuuagucccagcuacucaggaggcugggguggaaggaugguuugagcccaggaggcagaaguugcagugagccaagauucgcgccacugcacuccagccuggcagacaaagucagacgcugucucaaauaauaauucuuauuuuauauuacagauuugucuuucuaucagaucagaauaaaagcuccacagagacaggauuuuguuuuguucacuguccugucuaggaucuagccuagggugugacacagaguaagcacucaugaugugaaaugagagaauaagaguggugccugccaugugaggucaggauaaguuuaggacucaucaaucugaaaaaguaagaguugagaggagacugaaauuuaaaauggcauuauguuaacagcuacaacauagcaccaguucuuccauuuaucuauugcuguuuacugaucacuccagaauuuagcagcuuaaagcaacaauaaucauuuuauuacuaucucuugcugggggauugguuguugguagguaguuuuuccugggguaucucaagcaguugcagcuaggugggacuggagucaugucuaaaguuuccuuagaugucuugggguugaugguggcugucagcugggucccaccugggacuguuggccggagcaccuauaugugaccucuccauguuaccuuaccuaccucacagcauggcagguguguucuaagagcuaaccucccaagggaacaaggugaaaaugcaugacauuuuuaugacauaaccucagaagcuacacaauaucaccauauucucuugguuaagggagucacagagguuugccuggguucacggggaguggaugggacguagaccccaccauucaaugggagaaguuucgucacauuugaagaagagcaugugugagauacguuauauuguguuagcccauuuuuggaaaauaggaucuccaugccaagcaugugauagggguuuuaagaacuuuuucacuuauucugcagguaccuauuauccuaauuuuacugauagggaagcugagguuagggaagaugaauuggccacacagccaaguggcagaacaaguugucaggcccaggccuucuugcuuccacaguaacacuguauaaaggugaagguagauuucuucagaaaguccugaaauacuauggaagguuuauuuguguaggucauaaaacagguaauuaaauaucucaugaaacaggcgauuacuacuucaaacauuuauuaaaucccuaaguacuguaguaggugcuaaugaggauucagcccuugaagagcuuucaguuuauagauaaggcaccuacacuaguaaagugagauagaagucaguaggaacggccgggugcaguggcucacaccuguaaucccagcacuuugggaggccgaggcgggcagaucacgaggucaggagaucaagaccauccuggccaacacggugaaaccccaucucuacuaaaaauauaaaaaauuagcccggcgugguggcaggugccuguauucccagcuacucgggaggcuaaggcaggagaauggcgugaaccugggagguggagcucgcagugagccgagaucacgccacugcacuccacccuuggcgacagagcgagacucugucucaaaaaaaaaaaaaaaaagucaguaggaacaaguaaauguugagaggaaguacuaaggaaagcuucacagaagugguguuucagagcuaagcacugaaagagggauggaaucuggauauuuggaaauggaagguggccuucuuagcagaggacacaauauaaauaaaggcacagaggcauguugagacaguagugaggggcccaguuggcuaaagcuuaggguacaugaagggaaaauaagagcugacucaaaaagagauuggggucuauggaaucagagcugugcuucaggggauauuaaccuacucuuuguuuaacauaaacggaaugauaaucuggagacacagaaaucuuuaggagauuuugacaguggcccagaaaaguggcagggagggucuggauuaaggcaguggaaauggagauggagaugcuagagguauuuuagagguaaaaucaguagacuugcaacugauuugauaugagaguaaaagcaggagccaaggccaggcaucauggcucaugccuguaauccuaacacuuugggaggccaaagugggaggauugcuugagugcaggaguucaagaccuuccugggcaagauaguaggaccuugucucuaaaaauaaaaauuagcaagucaugauggcaugcgcccguaguccuagcuacucaggaggcugaggagagaugauugcuugagccugggaagucaaggcugcagugagucaugaucccaccacugcacucaauuugggcaacagaacaaaacccugucucuaacaacaacaacaacgacaaaaaaaaaggagccaaaaauuacccuaaaccuuaggaucugaaugucuugggagaagaaacaggaauauuaaaaagaaucaucugagauagaauaaaaauagauuuauucaggaaacacagauuuuaagccaggcacaguggugugcagcuguauuccagucuggauaacauagggagacccccaucuccaauaaauaaacaaaaauuaaaaaaaaauuaaaaagaaauacauauuggccaggugcgguggcucacgccuguaaucccagcacuuuggaaggccaaggugggcggaucacgaggucaggagaucgagaccauccuggcuaacacggugaaacccugucucuacuaaaaauacaaaaaauuagcugggcaugguggcgggcgccuguagucccagcuacucaggaggcuaaggcgggagaaugggcauggaucugggaggcggaguuugcaguaagcugagauagcgccauugcacuccagccugggcgacagagcaagacuccaccucaaaaaaaaagaaauacauauuuuaauguguugugguauauagucaaaugaagcuauccaacaauaaguuggaaauaaucuauguugucauggcuagagauagagauuuguaauuuauaugacaguaauagcuaaauccccauucagaauagggauggacuccccauuuggaauccauuaggaauggacuaaaagaaagaagacugauguggggaaugucuuuuuugggggucuggagaaagaagaggcaguaaagaagcaguuaaauagagaagaaaaaacaauauggucugugcccucagagucauugaacaguucaagaaaccaaaguaagucagcagagucugaugcuucagggaguuucaggaaaugaagccauaggaacuggauuccaaauaaugacuaggaaaucacuggagaccuuagaaaccaguuuagguggugacagaagcuagggugaaaagcuuaaggagugaguugauugaugaagcaugggcgcuuuuaaaaaguauggcagugaggcagagggauaagagcuagaaagguaacagcuugaguggguacagggauaguugcuuuguuuuguuuuguuuaauucaggguucaggagaucuaaguauuugcaguggacacgaagccauuggagaagaaaagacugaagaugcacaaaggaaaagaguauaaaggaaauggguugaaagguucucguggguggagaauuuaacguaggaaggaagaaaaccacuuucucuucugagagggcgggcagaaagagcaaacaggugaaaagccguuuugacacggagaauaaggaaguugaggaagcuuaagucuaauaagcugagcuucguuaaagcuggaguacagucccucagcugggggugaguggcagcagagaguaguuggguuucagaagaauuaugagaaugauuugaaaguaucgcugaaggaaauaugaugaaaagucaacuagagaugaaugaagguugcugagcaaccgugaagauaaauagcauguggcuuguucccuaacuuuguccaggaggaacaugagcagaaagagcagaggaacaacuuuuuuuuuucuugaagaccgggucucacucugguugcccaggcuggagugcaguggugcaaccucagcccacugcagcgucgaccucccgggcccaggcgauucuccuaucucaacuucccagguagcugggacuacaggcgcacgccaccaugcccggcuaauuuuuuguuuuuuuuuuuguuuuuuuuguuuuucuauuuuuaguagagacaggguuuugccauguugcccaggcuggucuugaacuccugcacucaagcaauccaucugccuuggccucccagagugcugggaucacaaaugugagccaccaccucucccagccaagaggaacuuaaauggggcuagaugaggcaaaaaguugucauuaauucaugguuaguucagaugguugucuaacuuuuacaacaugggagugaaguguauggaccugauuguugaaaucagcauuauuaagugugaaauaauauaaagauauggacugcuuaacccuaagguucacaacaguaagaggacaaccucgugacguaucuucugggauuucuguugguaaugaugcugaucugaauguaauccaaugggccugucucuagcuguuuccaaguuuuugauucaguuucagauuaaaguaguagaaaucagagacuucuggucuggcuaugcugcuuuaaaucagucuuuugaccucuaguccaauuuucuuacuuuuuuuuuuuuuuuuuuuuuuuuuuuaauaaaaagacaacuagagaucaggucucgcuauguugcccaggcuggucuugaacuccuggccucaagcaguccucuugucucaaucucccaaaguguucggguuacauaugugagccagugugccuggccccuaguuucuuuuuucaaaaaguaugagagaugaacccaaaggauccuucuaacucuauaauucaugacuuugugugagucccuuugcccugcaccccaguacuaaagaaguuaauggucucuaaauauaggugcagaucuguuagagaaguugguuugcucuuaugagaauucucuccuaauuuaucuguuuaauuuugaauuuucacacacaaaaaauuuuuuuuaguugcuuugugucuuaaaucuggcuggcucccacuagauaugucaucccaagucaagauauuuuguucccgcacaugcacagauaguuccaugaucuuuucuggaaacugucugcaaaguugauaacuagaguugugcuagucaguaugguauagugagacugcugaggggucaguccuuugcugagguguaaaauggggauaaugccugugagugugcuuagcagugugaugaaugcuuaacacauauuauuuuuccuucuuucauagguuuccuucugauaccuccgucuacucacugccacagaguauaauagcauauauacucuauaauacuguauauaguguaguauaauuaccauucuuuaggguaauguuauguagguauguucauaucugcaaaugaaacauuuccgguaauuauauagaugguaauggcaaauaaaugauguaaagaugagauaguuuguugaccuguguaguuuaauuauaugaaaaauagcaacuguguaaacuauauuuaugaucuccucuuaggugcccuaaucuccuauguuaauauaaaacuuucaauauaaaugucucaguggccuucuuugccagucagcccuuaaggagcuuuauuuuccucaaaaacucuugucugcuauuuuucagagcuaccugaaagcugaguugcaguuagcuaacuaguauuuauuucacuucuacuucugggggaggugguuaucccccaccccugguagugggaaugacagaagguccaugaaguugcuuuccuuauccuuuccggaaacugccaggccauaaauauuagaggaaugaucgagggagggacucagguaaguaaccagauuacuguggaugauugauuauuugauaugaggaacuagaggagccuggcacaguuaugagugugagcaaguccgcguagggcagcugaguuuaacugguacuccugugcaggaaggggacacgcauaccuugugugcugaauucuagggugagguuccuguuucccugauauauguuuccagucuguguucucccuuacacagucacaccucagucucgccuaaaggaacacucuaucucugucacaaagaaaauauugacucagggaaggguaagcagacccagcugcaaaccuuguagcaggaguggaguucaagguagagugugauucuuagacuuacuuugcucuucugcugaugccaguuuuggaggaggcagcugagaaauuuguaugauacuauggauguucaccucagauguccuugucauaaagggugauauaaaugaucaacaaaaauuacuaggguaaccggagggggagucaguucuagaaguucugugccacuagcuccuucaucguggaguuugguaggguccagguuucaaggcugucuuuacauauugcugaguaauugcuguauuuagcagcauucugagagaacacagguggguuccaagauaacguugccaaagcauaaagugcauuggaggcaagugcgaggcagguguucagagaugaggcugcagggaguagcaggggcugcuaggucaugcagggucuuauaaaucaaguuaacaaauuuggacuuuaaagcaaagggaagguuuuaaagaugggagggaaaugaucaguuguauuuugaaagaauuucuguggcugcaggguagagagugguuggagggaggggccgagaguggaggcagagauuccaguugagagauguauaauaaucaugauggugaaaagcgacggcagccucaacuagaaaguagcaacagguuguaagagaaaggggagguuucaaaaacuuuaggaaaggccgaauaguugaggggugaagauggaaaggugaagaauccauuaaacaucauccccaaguccugccuggagagaguggguagguaggucguaauggcaacgggaccacugaaggggaggaccagguucaugaggaaaggugaugaguuaacuuggagcguggcaaauucgaagaauauggaggagcugcccaccagcuggaugugcuggucugagguugagagagaaaugcaucuuggagcuagaaaucaguuaucugcuuguagauguuaauugaaguugugagagucauccaggaguuccaggagagugcagagagcuagaggagagucgaaggcgcaacauuaaggcaucugaagaacaggcauauaggaggaggaacuggaaaaggagacuaagaaggagccagaaagccaggaggaaaaccaaaggaucaugacacauagacacccagagagacuguguguuaaggaggggaagugauuacacagcuaaaugcuacugaguggucaggugugguaagaacugcagugcaggccgggcgcgguggcucacgccuguaaucccagcgcuuugggaggccgaggcgggcggaucacgaggucaggagaucccgaccaucccggcuaacacggugaaaccccgucucuacuaaaaauacaaaaaauuagccgggcgugguggcgggcgccuguagucccagcuacuccggaggcugaggcaggagaauggcgugaaccugggaggcggggcuugcagugagcugagaucgggccacugcacuccagccugggccacagugcaagacuccgucucagaaaaaaaaaaaaaaaaaaaaaaaagggccgggcgcgguggcucacgccuguaaucccagcacuuugggaggccgaggugggcggaucaccugaggucaggaguucgagaccagccucaacauggagaaaccccgucucuacuaaaaauacaaaauuagcuggauguggugcugcaugccuguaauuccagcuacucgggaggcugaggcaggagaauugccugaaccugggaggcggaaguugcagugagccaggaucgcgccauugcacuccagccugggcaacaagagggaaacuccgucucaaaaaaaaaaagaaaaaaaaaaaaaaaagaacugcaguguagucauuagauuuaaugaacuucaucugugcuagauugacucuuuagacccagcacacacugaggacacuaauaaagcagauaugugaaauaaagagaaaacagaacucauuggccauuucacagauacggaacaagucaucuagggaaaaaaaucuaaacuuuguagaaguuccucauacucauuucauuuuuauguugaauuaaauguggggcacccuaaugucucuugcucugugauucucuaaaggucuuuaaaauuguuuucauguuuuuguuugcauaggugguaacacgguucaaaaugaaaaagguacagaacgaguaugaaguaaaagucucccugccaccuaguucccccaacauguagccuuuauuuuauaugaaaauuucuccccuuuuuaacaaguauuuucacauucuucucacucuccuuuuuuuacuuagccccugucagugacagcugcacaccauuuuauucuauagauauacuguaauuaaacaguccuguaucaguggguauugagguuuccuaauauuuugccaucugguauuuuguucucaaaaccagugcuauagggaguuacguuguauauaggucauuuugcuggcauguaggauaaauuuccagaagcgggaauugcugggccaaagaaccucugaaggauuuaauucaguucuguuuauuugagucccuggcacuuagcaugcaaugaaugguagcuauuaguaagauauguauagauggguuuguugggggcccagaggaauaggggcaccuaacacaaacuaaaggcagagagaguaucaaauaaggcuucuuagaggaggcaaugcuucagcugugccuugaagaauaagucagguaaagaggagggcauuaugagcagggggagcaguagagagccaaggcacaggaaaagagcguguuguacaucgggaccuucuaagaguuugcugugcuuauucaucaaacagucagccccugccacaugucaggcacugggcuagguaccggacauaggacagauacacauguacauaaauuauaguaucacaugaaaucaacagcagcauguacaaugauuaauucuguuggggaaggagguaggggacauggaaguuggaaagaaaggcuuguuagaggaggccacaucugagcuagaauuugaaagaauaauggucaaagaggaauucaggucagugguucucaaaguguguucccuggaccaaaagcauccgcaucaccugggagaggcagagucucagguccuacucacaccugcugagucagaaauucgggggcugggccucagcugucuggguuuuaggaagcccuccaggugauucugauacacucuguauuuugagaaccacugaucaacuggguguguugacucacgucuauaaucccagcacuuugggaggcuaaggcaggaggaugccuugagcccaggaguuugagaccagccuaggcaacauagugagacccggucucuacaaaaaaauaaaagaaaauuagccuggugugguggugcacaccuguagucccagcuacucaggaggcugagaugggaggauugcuugagccugggaguucaaggcugcagugagcucugaucauuccucugcacuccagccugggcaacagagugaaacccuaucucaaaacacaccacaaaaaguuguguucguguaauuacaagacucaaaagaagaguccagagcuuccuuugccaugauuagccuauugacuauguuuauaauccagagauuuccuuugcccugaaauuuauccugcuagaacuuaaguuugucauuuuguuugcaucuuacuguauucucaguagaaaagaaugguccugugagcauuugugcagagugcccagaagugcuucugagccuugggcucugacagccagugucucacccaaacccagcucuggcugggccugggaaccaaaugccugggcuguggcgaaaacucaggagacguggggguauaucuguaaaagcagauucguaaauagcuuuuuucccccuuagagccuguuuugcaaauugcugcacuuuuccuuguuuguaaguaucucuuuuccuuuaaacugcuuuuaguggcuuuugcuuuuggaaaaguauuuuauuaauacuucauuauaauagggagcaacugcaacccaugugaagagggacaccuggggauuuuauuucgccuuaaaaacaaucaaccaaaaccaguggguuggaaaccugaguuucaaaguauugucaguuuuuuuuuuuccagugauuauuccaguaauuacuuagacuauggcaggggaagggggcuuguuagaggaacuugaaaaauuacaggcuuuuuuuuuuuuucagcagcuuaggaaguuccugacuucacagguugcuaagaugucaaacucaugcagagcuguguuaggaaauuguuaguuacaaaugagagagaaggggauccuuuucacaguuauggauaagcuauuucuaauuguuuauacuuucuuuucuuuccuugguuuuguauaagcauuaaaucucagcagagguggauauuuaagguggugaguaguagcagcucugcaggggaagagaaaggcaagauggggagaagcuaauucacuguucucaguacucagcuucacuggugguccucagaaaaaagucaaccuucuuacucuaauguucuaauacuuaaacuguaauuauuuuuaaaauugagauauaauucauauaccauaaaauuuacccuuuuaaaguguauaauuuaccaguuuuucguacauucacuauguugugcaaccaucaucaguaucuaauuccagaacaucuacauuagcccaaaagaaaacuccguuacucauuagcagucauuuccuaucugcccuucccucagccccuggcaaccauucaucuacuuucagucuuuauggauuugccuauguuggacauuucauauaaauggaaucauacaguaugcagccccuugugacuggcuucuuucacugagcauaauauuuucaagguucauucauguuguagcacauaucaguauuucauuccuuuuauggaugaauaauauaguucauugucugcguaagcuacauuuuguuuauccaucaauugauggacuuuggauucuucucaccuuuugacuauuuuacuuuuuucuuuuuugagacagagucucacuuuguugccaggcuggagugcaguggcgcgaucguggcucacugcaaccuccgccucccagauucaagcaauucucccgccucggccucccaaauagcugggacuaagaggcgcgugccaccacgcccagcuaauuuuuguauuuuuaguagagaugggguuucaccacguuggccaggcuggucgcaaacuccugaccucaggugauccgccugccuugggucacccaaagagcugggauuauaggcgugagccacugugccaggccuauacauuuuuaaaugguugaagucauauacugucuucaugcugaugauuccacuuuucuucuguuccuucuucaacccacuccaguuggaccuucaccuugaccauuaaaauuaaaagcucuuuucaggaucacaaacaaccuucagcuugcuaagccaaggaccaguucucuguccucacauugagugacacggaugaucacccacuccuugucuuaguuuguuuugugcugcuguaacagaauaugcugggucauuuuuaaagaacagaaguuuauuucucacaguuugggaggcucggaaguccaagcguuuguugagggccuucuugcugcauccuaauauggcagaagggcaagagagccaacuccuuccgucaagccccuuuaggaggggaccuaaucccauugaugugggaggaggcuucauggccucaucaucucuuaaagguuccagcucuuaauacuaucacauuggcaacaccugaauuuuggaggggacacauuaaaaccaaagcacucuuucuagaaauacucacuucuguugguuuccacaacacaacacacuauucguuuuccuucuguuucauuggccaguucccaaauuuuguuuccugccuccuuuucugccuaacuucuaaauguuggaguguuuuaggauuugguccuaggcucccugcucugcauucccuccuuggcaaugacaucuaguucugcgcuaugcugauguuuccaacguuuacauuucuaguucugacaucugugaacuccgugcuuguaaggugcaaacuugacaucuccacuuaggagucugaucggccucccaguguaacauggccaaagcagaacucuugauuucuaaccccaaaaucugcucuuucagcaggcuucccuugucuuaguugaugggaccugcacaguugcucagguccaagaacuuggagacuggccaggcaugauggcucacgccuauaaucccagcccuuugggaggcugaggcggguggaucacgaggucaggaguucgagaccagccuggccaacauagugaaaccccaucucuacuaaaaauacaaaaauuagccgggugcgguggugggcaccuguaaucccagcuacuugggaggcugaggcaggaaaaucgcuugaacccgggagguggagguugcagugagugagauugugccacugcacucuagccugggugacagaguaagacuccugucucaaaaaaaaaaaaaaaaaaaaaauuccaguuuuugccauggcuagaagggccaucugucagcuaguuccugccuccuuuuccaacguuaucugcuacuuucccccucaucacuacucuucuagaucuucacagaccugaucguuauucucaugugagcugaaaagucauuuccugagagaggccuuccccaaccaccaauuaaaaauaaccccuccacuccuaccugccacuuuguaaccuauuguucuguuuucuucauggcauguauuauuauucugaaauuauuuacauauuuauugucuguuuucuguaacuaauaauaacuggcauuuauuaagcacaugccacgugcugaauauuguuacaaguacuacauuuucucacuuaaccucauaaguaguauagguauuauuuccauuuuacagaagaaauugcagguucaugaaagcaagaacuuuguccaucuuguuuuacugcuauaucucuaacacauggaacaguguuugggauauaguaguugcaaaaaauuuuuuuuguugguuggauagaugaaugaaaaacucccaaauugacguuucuaccucugacaucuccccauaaacauagauuuauagauguaaucaccuacuuaacagcuccacuuggauuucuaaauaagcauuuaaauuaccccauaacucuuuuuuuuuuuuuuuagacaggaucucacucugucgcccaggcuggagugcaguggcacgaucucagcucaccgcaaccuccaccucccaggcugaaccaauucuccugcuucagccucccaaguagcugggauuauaggugccugccaccacgcccagcuaauuuuuguaauuuuaguggagacgggguuucaccauguuggccagguuggucucgaacuccugaccucaggugaucugcccaucucgggcucccaaacugcugggauuacagguaugagccacugugcccagccccugccccguaacucuuaacuucuuaacuuccccccuccccaaaccuguuuuguucccauuucucucauauuaggaaauggcaucaucauaagcccaggaguacagacuggaaaccuaggccuugccuguggccacucccauucucauuccccacauccaacucugcggcaaggccuguugauucuaccucugauugugucuugaaucuguugcuucucuuuuucuccacugucacuucagccucauucuccguaaucuuuccucugcacgccacacuugccugcaagcauccacucuugucucucuacaagcuauuugcccacguagcagccagauuggagccacguacauuuuagaggugugcugaagaauaggcgccaaggagaaaaaccaggaagaaaaccaguauuugguacccuuaccuugaaaaagguauucauauauuuuuuccuuuucuaaaaaauguucauguuucuuugagcauuuauugucugauuuuaccccuuuuuagcaucuauagaagccacauuaaucuuuuuuuacuccagccuuucuuggacuuucccggcuuugugcuucucuaucuaggugaguuuuuaucgauagcuucaaguguccucuuccccuccucacagaggaaaugcagucuucagcaucugagaggccucuuagaaguauuuuugcucaggccgggugcgguggcucacaccuguaaucccagcacuuugggaggccgaggcggguggcucacuugaggucagaaguuugagaccagccuggccaacacggcgaaaccccaacucuacuaaaaauacaaaaaauuagccaggcgugguggcacaugccugugaucccagcuaccugggaggcugaggcaggagaaucgcuugaaccugggagguggagguugcagugagcugagauugcgccacugcacuccagccugggcgacagagugagacucugucucaaaaaaaaaaaaaaaaaaaaaaaagaaguauuuuugcuuauguugcuuacagcuuucauguuccaugguaaaugucuguagaaaaccaucucuguaguaguagcaacuaugcuguguuguuaagaaaauaggacacaggacaggacaggaggaccagagugaauggggggccauaucccucugaucuauaugaagagaccacaggaaauggacagaaccuuuucugccccuccccauagaugggggaaaacaggguguauaguaagaucugaccuucugugcuuuuuaaacaaaauuugccuuauaggaaauuguaagauuagcaaacuagggaguauguacauuuaauuuugaaaaauucuuucuagagcuccucaaagguuccuaaaucaauccuguuuuucaacuuucugccucucaguacuccugugacaacaggagggcagccacccugacguggcuaacucucugggcuguuccugccaacucccagauggcugcuuucaggaagguuuccauagcgaccagaggcaggaaaaaccugcccacccagcuuaacaauucacauccggcugggcuuuauagccagugggagaaguggcguguuuauauauacuuauauacauuacauacauuuauauguguguguagcauuaaagagcucaacccugcagacucuauauccagaaucuggcugggugugguggcucacaccuguaaucacagcacuuugggaggcugaggcaggaggaucacuuaagcucaggaauucaagaccagccugggcaacauagagggaccuugucucuaaaaaaaaaaauaugauaaaauauauccauaaucugaccauuucucaguguucccaccauaggaaagucaacauaccuuucacccugacuaauccaacagccuccucuauguccaccaccaccucugcaagacagccagagagggcucagagcccuccccuacuuucccagcucacugagaaugaagcccagaauccaccacacugugaggccucguaguccccugcugugucuucucccaccauucaggcuguuuccucccacucuuuccuucucauuccccagccccuccagccugcuggcugccuugcagcuguuucagcaugcccagugugcucccaacuuggggcugcuucucccuggaucuccuuucccucagguagccaugagcccucaguuccuuuuggucuuugcucaggugucccuaacccauauucuaaagagcuucuccugaacacuugauauaaauccccucucuucugauagucuccacaccuugaccuuuauuuuuccucacagcauuguaguuaucacaaucuauuucuguguuuaucauccaauucugucuuuuuuuuuuuuuuuuuuuuuugagauggagucucugucaccaggcuggaaugcaguggcgccaucucaacucacugcaaccucugccuccuggguucaagugauucuccugccucggccucccgaguagcugggacuacaggcacacgccaccacgcccagcuaauuuuuguauuuuuaguaggacaggguuucaccauguuggccaggauggucucaaucucccgaccucaggugauccacccaccucggccucccaaagugcugggauuacaggcgugagccaccgggcccagccugucaucugauucucuaauguaagggucaggacuuuuucccccacuguugugucccagcucuuagaagcugccuggcucuuaggggugcucaguccccauuugcugaugaaugaaugagugggaggacagccaagaucaggaaaggggagggacuccugagugggccuucccagccccuucaggccuccacagccagauguagcugauuucucugcuacaagcagccugcaggugcucugucacacuuuuacucugcccuuucagaaccaccaaccaaaccccugccucuggggccgauggugaugaggagucuuucucaugcucucaacugggacauguuauguggaaccauacacaguugucauuuuucuaggcuguaauggaugaauaucggcaauuuaauaugguucaacauaguuuuuaguauaccucaaugaggaggguccauauauuaacaauaacuuucuaaaaauuuuuaggacuacuaauugccugauacuuauugaguacuuauaugugucaggcagugugcuaaaggccuuauuugcaucagcucacguaauccucauaaccacaguaaggcauagguauuauuauuccauucuaucgaaaagaaaacugauacagacgugaaguaaacuugcccacgguuauaacaagugggcacaggcccacucugcuacacgaguagcagagcuaggauuggacuggagaugucuuuacuuuuuuuuuuugagacagagucucacucugucacccaggcuggagggcaguggugcgaucuuggcucacugcaaccucugccucccggguucaagcaauucuugugccucagccucucaaguagcugcgauuacagggaugcaucaccaugccuggcuaauuuuuuuguauuuuuaguagagacaggguuucaccaugguggccaagcuggucucaaacuccuggccucaagugauccgcccaccucagccucccaaagugcugggauuacaggcgugagccaccgcgcccagccaagaugucuuuacuuuuaaucauggugcagaggaugagcgcugagcccacucccucccaaagcugacacgugguuguucugccacagccauuugccaucucaggcuccaagccagcaggaggcguaauagagcacuggguuccauucccagggccaucuagcugguggccauguguccgucauuucacagggugggguuacaugguguggcagggcaaaguuuugggaguccauuuggaaacuaucagucucuccuaggcuuauuuucuguuguguaaggaaugaauguguuguaaggauugaaugaugacaugacaugcuuuuuaaaauuucuagcucagucucuuuaauguaaaaauauguaaucauccagcucauaguucugagggaaacccuauaucacauauauuuuacacugaaggaagacauuaaaauuccauucucuucacacagaaccaaccaaccaggauggcuggccuguuggggaagcagguucugccaucugguucucagcaggcaugucuggaagcaggagggagcgucucucccauuuggguaccaaagccucuguaacagucaggaauguucugcuguggccuuuauccuaaacuuggcuuggccagugugugucuggggcaggagcagaggccgggacacagcugagcugcccacaggagcuauuuuugcccccacacuuguaugucuuuaaagagaacugggauuuucucacagcuccuuugaaguggugguuugauuuuccucuuuuuugcuucucacuuaccuaauucuucccgauuuaucuagaauucccaacaccagaauuccauggcagauagcauggagaauagguucuguuauggaccaggauaacaacugucauuucugaauucucauugugugaaaaauggcaaaaguaaauuuuucuucagugccagguuuagguaaauaugauuucaaaaaccggaauguaacuugucuugaaaucuuucaaccacaucuccucguugucaccuacuuccuuucguagagugagagccuuuaauucugugguuagaaguaaaaggaaguaaaggcuuggccgggcgcgguggcucaugcuuguaaucccagcacuuugggaggccgaggccggcgggaucacgaggucaggaguucgagaccagccuggccaauauggugaaaccccgucucuacuaaaaagacaaaaaucagccgggugugguggugcaacccuguagucccagcuacucgggaggccgaggcagaagaaucucuugaacccaggaggcagagguugcagugagcugagauugcaccacugcacuccagccugaggugaccaagcgagacucugucuaaaaaaaaauaaaaauaaaaauagaaugacuuuccucuuuucucuucuaacagggcagaugauucuggaccagaugaagccugaggagccuuccagcucuaagauagcaggauaggagacuucuaagauuggagcugcagaagacuugccagcccaccagcacaaugucagguagaggcaggggcuggacuuggaaacgggguuugaagcucucacagaggagccagagggauggaagguggcuuguuuuccauaaaacaccauccagauaagagagguggagaugguagggaaggcuucuggcuggcugagaaaguuauuaaaacuuccuucucagcucugcucucuagcucuccuccuccagcucuccaacccgcagaucugcaguccucagguggagaaagaggccggaagaugaaguuuggucauguuuuguaaugugcugcuguuucuuuccccucuucuccagaaauuugcugauuucuaggagguuucuuucacucugcuccuucccuacccagcacgcuugagaugggccagucccuuuaaugcuggugcucuuagagggagaggguauuuccugauuugaauuuugccucugcauuuucuauuuuuuuuuuauuuuuuugaggcagaguuucgcucuuguugcccaggcuggagcgcaauggcacgauccuugcucacugcaaccuccgcuucuuggguucaagcuauucuccugccucccgaguagcugggauuacaggcaugugccaccacgcccagcuaauuuuguauuuuuaguagagauggguuucuccauguuggccaggcuggucucaaacuccugaccucaggugaucugcccaccucggccucccaaaguacugagauuacaggcgugagccacugcgccuggccugccucugcauuuucuugauuguucuccugguccucuuugguuuuaggaagccauacaccugccuguggcccuuucucagcccugacuccgagcauauggccccaggagaucuuggccaaguacacgcagguauagcaguuagccaggcaccagccugcugugcucccacgcugugguaugaaggggacccagcucugcaggcugcccaggaagagguggccaacucacacaggguuaugaguuccccaccagagaugguaucuuagccccauguuuccugugugaaucaaccacuguggcacuaugcucucaguauuauagggacacaacugcauaaaacauguuucuugccuugauuuuauuaucuuugaccucugagaagaacaaggaaaauagaagguugagaaauugcuagaagaagguucagagaagguugcgugguaaccagaggcggcuuuuggaagaguagccuuugaucugagcccgaaggcugggugggauuuuagcaggcaacccuguggguggcaucuuucagaccugaggcccccaacuaggggacaggcaacugacuucaaccucauccugauucuagaaggaagagucagcagagcaaccagaguucuacuacgaugaguuugguuuccguguguacaaggaagguaaacuugagccccuuuugugugucaucuugcugauguucuuuggggaggacuccgcucccuugacugaauuacucggccugugauggcugagcucugaugcgucaggguuccagauuuaaggacagaguguaucugagggugauacucucauaaguaugggagacuucugcuuuuuuugagauaaauuuuacugauccucaccugacaguaaaagcaaucguguucacuguagagaaguugaaaaauucaggcuggacgugguggcucacgccuguaaucccagcacuuugggaggcugagguggauggaucacuugaggccaagaguucaagaccaaccuagcuaacauggugaaaccccaucucuacuaaaaauacaaaauuugccaggugugauggugugcgacuguaaucccagcuacucagaaggcugaggcaggagaaucucuugaacccaggagguggagguugcagugagcugagacugcgccacugcacuccagccuaggcaacaagagcaaaccucugucucaaaaaagaaaaaagcauauuuucaauggcuguauaauauccuuuuauagugaauauacaguauuuggauaacuacuuuucuauaacugagucucuaguccauuucuguuguuuucuacuauaaauggaccuuuugguccugagugggcuauugggaaguccaucugccaggccagaacuguggcuaggacauuuuaauugacugcaacuaaucaccuucaggucacucacguuuccaauucugacaaaaguuuuccuuguucuucugauucguaggcagguauuugcagguuaaagguuuggguugagaaggacacagggaacuugcugguaugauggaaguaucuguguuuggcugggucaguggagucagaguguucacuguuacaccuuggaacugagacugcuugaugcggacaauguucagacauuuguuuaugcaccaaaauguacaccuaacauuugugcauuuuacuguagguaaagucauuaaaguuggugucuuugaaagcugggcugagggauuggcuuuugggugaauaaggacgaggcugucuguggagcucacccagggguugcugggcugccacaggagagcuugaccucauucauucaacagauaucucauggacccaacuguggguggugcagucuccacagcugcaucccugcaggcccccgaacaaaacugaagguggucucagcugcauggaguucucauuuuagugagggagacaggcaguaaacaagcauguaauauucuggagcaagaagggcuggaaaaauacuuccagggauagagaagaggggcaguaaaucauauauaaaaagguccugaaguggcccuuucagaccaugucauuggaguggagagagcaagaggaaaauggcagggggugaggacagagugggcacggcccagaggaagcagcugagggagcgcuggaaagcccuuggcuuuaagucucagcucugagcagagugacaugaucugacuugcauuuuggaagggucacuguggcugcugaggggaacagccuuugggaggugaggguagcaacagggaggucagcaggagggccacugcagugaucuggaugaaggaccauggcuuggacaagggccauggucagggguggugagacguaaaggaauccuguggguuugcugauggacugaguguggggucugggcgagggaggagccagaggugacuccgagguuuaggcugagcaucgggagaauggaggugucauuucuggauccggguaguacuaugguaggaguggcuuugaggagaaggugaagagcuuugcuccucaugggguacauguuagaggcucaccuggagcugucagaaagccauuagcuaugggaaucuggauauggugggagagagcuggccuagagccaugaagcucagacccuccugaagacggaggcuuggcugcuuggagaacacguaguagagaaugcuuuuucuuuccuccuuggcucucucuuggcagaaggugaugagccuggcuccagucugcuggcgaacuccccucugauggaggaugcuccacagaggcugcgguggcaggcccaccuggaguucacccauaaccacgaugugggggaucucaccugggacaagauugccgucucccuaccccgcucugagaagcuccgcucccuggugcuggccggcaucccacauggcaugaggccacagguaagguggccacagggacccacaggguguugagaggguccuggccccaugaucaggugucacgagaaagacugagugcccuugcggcucccuucccucagcuguggaugcggcucucuggggcccugcagaagaagaggaacucugagcuguccuaccgcgagauugugaagaacagcuccaacgaugagaccaucgcugccaagcaggugaggccgguggcacugugcaggaagagcuggaggcugugugggcucgcaggagagagggagccugccugggguucuuagagugugcccuuguugugggguaggggaggauauuugcuccuuccuugguccucugcaggccaaagaaagaauuguccaaaaggccaucagugcuguggaagggcuuggagaugggguucccaagcccggguccacuucaggaacagauggggacucuaaauauagacuccaggccucgggccacacguuuucagguggucuggcaugaaguuucccagcuggauuugaugucccggcuccacacuggcugggagcugacccugaagggaggagggugaccuugaucaggaacacaaggaauccccauuucugggggagaagcccgccuggggucugccucccucccagggugucacaaggucuuguuauugugggugccgauggcugccugacagaucgagaaggaccugcuccgcaccaugcccagcaacgccugcuucgccagcauggguagcaucggggugccccgccugcgcagggugcuccgggcccuggccuggcucuacccagagaucggcuacugccagggcaccggcauggugagcacagccccagaaagggcaguggcagccccaggacccccuccaggacccuaacaaggaguggccucccgcuacggggcaguagccccagggccuccuccaggaccccuaacaaggaguggccucccacuccggggcguccccaaggagaucggggcagcugcacguuaugcaagcagaggcgcuccccaagggaugugaaagugaggcaggccaaggaaagcagcccagggaaggccuggguuccagcaugcgugccccccaagaggcuuuugcuaauuggucucccuaggguaggggcaccuuuucuaaucugcacaaagaccuggguagaaggcccuugucccugugcccuggccagguggccgccugccuccugcuguuccuggaggaggaggacgccuucuggaugaugucugccaucaucgaggaccugcuccccgccuccuacuucagcaccacccugcuggguguccagacugaccagcggguccugcgccaccucauuguccaguaccugccucgccuggacaagcugcuccaggagcaugacauugguaaggcgccccugagccacuggcucccauucugcagcuuggaggacucaggcggguggccgaguggggauagggcacagccccccaaccauggucuuugucgcucuuuuguucucugguguucccugcccccuccccuccuuugcucuuaagcagggaggaccuugcugcaguuccggggagggagguuuccaccaccuccuccccagcggcuuuggcuccuguguuuacagagcugucccugaucacacugcacugguuccucacggccuucgccagcgugguggacaucaagcugcuccugcgcaucugggaccuguuuuucuacgagggcucccgggugcuguuccagcucacgcugggcaugcugcaccucaaggugcuccacggccccacuucaggcugaggaguaggcacccgagauggggggcaggggagcaagagaccucccugggccaggcaagaccagcccccuggccccugacaacugugccaaggcaaacgggucccugaggauggggguuggggucagcucagugccacgucccugcaaugacaaccuucuucccccauccugcccuggcauggcccaggaggaagagcugauccagucagagaacucggccuccaucuucaacacgcuaucggauaucccgucgcagauggaggacgcggagcugcuucuggggguggccaugcggcuggccggcucccucaccgauguggccguggagacucagcgccgcaagcaccuggccuaucucauugcagaccagggccagcuccugggggccggcacccucaccaaccucucucagguggcccaggauggggggccgcaccuugacccacagcacacggggaggaggggucaccuugaaguucagagcgcgggggcugcggaaaacaaaccagcccuuccugcucugccccccagccuggcccagucagaccacagcuguggggugauccaggccuccucaggcuuugugcaccucagguucugauccuggcacgguuugggaggaaggcagacccagcucugauuaucuguuuucaauucuuggagccagcgucagaggcuauuucagaugagacaguauaagccaagggcugguggguucucuuccucccggggccaggaccacccugacccacuccucuuggugcagguuguucgccgcaggacccagcggaggaaguccaccaucacugcucugcucuucggugagagcucugcgagugccaggcagugugggcaugcgggagucuguccucacgcucauguggacguggagcuuccuccucgggggccuggagugggcuguggucaccaugguucucugggccuccuaggggaggaugaccuggaggcacucaaggccaagaacaucaagcagacggaacugguggcugaccuccgggaagccauccugcgcguggcacgccacuuccagugcacagaccccaaaaacugcagcguggugagucgccagcucccugggcugcuaccaaacacggcccuaacuccuccaacccccuuggugggccuguguucacuguggcaggagcugacuccagacuauagcauggagagccaccagcgggaccacgagaacuacguggcgugcucacgcagccaccggcgccgagccaaggcccugcuggacuuugagcggcacgacgacgacgagcugggcuuccgcaagaacgacaucaucacagugcgugggggcgcuggacuaccagguccucaggcuguggcggguuccccagacucccuccaccaagccccaccccaaccccuuucccugccaagagcuucucuugugaagauguaggggucuuggccuggccuaguugcugaggagucauaucgggggugcaggaggcgcuggcccagggcacccagcuuugguuccugcuguuuuuccuccugugcagaucgugucucagaaggacgagcacugcugggugggggagcucaacggccugcgaggugggguccuuggucugcucuugagcugggagagggaggagggggugggcacagaagacuugggugacccuggccgccaccaagcuguucuccucuauacaccugccuggcuugaggucccugaagcagcugagccggcuucccacugccucagccugccugcaggcugugucugcucuguccucggcccucgugguugcuccuuacagggccuguuuuucccacaggcugguuuccagccaaguucguggaaguccuggaugagcgcagcaaagaggugaggggggugggcgggcuaggcacggcuggcacccuucuagccagggccugcgugccuagcgaguccuggccuguagcauggcagagaggacagaggagggugacuggcugcaggcgucaggcagggcuuucucagacccaucccucccaucaguacuccaucgcgggggaugacucggugacggagggggucacagaccucgugcgagggacccucugcccggcccuuaaggcccuguucgaacauggacugaagaagccaucccugcuugggggcgccugccaccccuggcuguuuaucgaggagguaagucaguggcugggcccaugacccccacccugcaccagcccugcugugcccccuaguacccaucuuagguccuuccugccccacagagaggaugggaagagcuggcagcguggugacaggugcccagucggccccaagggcuuugaaccagcaucuuccugucccugcacucacaccgugugcuguccccacaggcugcaggccgggaggucgagagagacuuugccuccguguauucccgucuggugcucuguaagaccuucagguaacucggcccggguucuucugguggggucaccagcagugggagggcggggccugacccagccccggcaccccaggagcuuugguguccccucagguuggaugaagauggcaaaguccugaccccggaggagcugcucuaccggguaagggggccuccucugccagacccuagagaccucucugggguuagccugugggggagccugagugacagcugacggugccguucccaggcugugcagucugugaacgugacccacgaugcagugcaugcacaaauggaugugaagcuccgcucacugaucugcguggggcucaagugaguguggaaaagggguuggaggagagcccuggaguggggggacccagcccagcaucaggggggguccuuacagggaacccuaaaggacaaagaaccucaggggcucagguccuuccccaaagaggguggucugggagcugcugagagacaggucagaggcuuccaccguggcugcagccagaagggccuggagcugccccugcuccccacuccuggccauguccccagugagcaggugcugcaccuguggcuggaggugcucugcuccagccugcccaccguggagaagugguaccagcccugguccuuccugcgcagcccgggcuggguccagaucaagugugagcuccggugaggaccuuacugggcuugggggauggagguggggugggaagggcuagcugggggugacaagagccuuaccaccccuuccucaccucuagaguccucugcugcuuugccuucagccucucccaggacugggagcucccugcgaagagagagguggguggugugggccucguagggccugcacugauggagcugcccaaaccguucgcgggguggcuaaggugggaacccgaagugcuggugucagcgguuaggaacuaccccagccaugcccaaggccugugaggugaggggcugcccuguuugcaggcgcagcagccccugaaggagggcguccgggacaugcuggugaagcaccaccucuucagcugggauguggacgggugacccccuccuccccagcccaaccucgggccugcgucugagguggcccaggaccccaagcugcagagcccagggaagagcagcuccagagcccuggccggggccgcgggauaucaauaucaggcugccccacuccacguuccccagcacaucccagguggugggagcagaggguacccugccccaccaggguccuuagggaugcucuaggccaaaccacaguuuguaccaaaaaccuugugaggaggugggggagccaugucugugcucaggaagagggaaggggauggggguggcuaguaggcuccuggccucuuugguuuauaaauaaacugugucugucuuugagaaagcaccuaccugucuucugugcagcuagggcugcagagcuguauucagguccaagguucugcccuuccuugaguggucuagaaggcacugcguggccccucagaugcugggacacaacagacccgggacccagcugugcuacccaccccuuccauggacugaauaagauggacuaacaggcc

SEQ ID NO: 192561 - RNA, 58585 nt, Homo sapiens
gccgaggggcuggaaaugaaaguaaagcgcuccagagccacauggacggagcugccggggcggcggcgccgggagcaggaugcggccgcccguaauuaaauagcauuuacucuuauuauuacuaauaauaauaacguaaucauaccucuagucauagcauaccauuuaucgggcucggcgcaggcccgcggggagcgcagcccggcggaggugagugcuuggcgcggcccgagccccgcggggcagaggccggggacacugcguccggagccgcccgcgcgcgaggguucggggacgcccgggccgggcagggcuggggaagaggcgaagagagcccuuuccaggccggggccgcgcgccgggccaccuggaaagugggauuuugcaaaaaauaaaucgucucuaaaaccccauuugcuccuuuuuggggaucccgguccccgugcccugccccaaaguuuaaaaguuaccguguggccgggggcaccuggcgcuggggagacuuggccgccccugcagcccccaggaggugucuugaaauuuucguggggccucucucuucggcguccggagcuucugggguguccagaugcuuugccgaccccgcgcagggggucucgggggcuggcaggggcgucgcuggcagggccccccuuccuuuuguguuguccuuggccccgcagcacccggaguuggaggggccgcggcgagggccggggagcggggccgcccgacgggccgccccuuucggcugcggcggccacgcgagcccggggauccggggccugcagccgggcccgcgggaagggggcggcaggaaaggggggcgcggucugggccugcugggcaggggggcguuuccggucgcaggaucagucucuggacuucgaggccugugggaggcccgcggccguccagggagugcuagggggcugcggaccccggcucuggcgccuggggacgggggcgcccugacggggcugggggccugggagccgccgacuccggccucauacccccauccugcccgcugcgaaccucagggccccccuccggguuugcucccuccuccuuuccccuccuuucuccucaacucugucuguuuuaggcguuuauaaggcgccugguuggggggacuuucacagacaaagccgucuucccaggggggaaaauaaucauauaaaaacagcucacucugauagaaccugauggcuguauugccaacagggcauugacggggaagacuagggggcuagggcccugcguggggagucugggggcucuaaaagggggcugggccugaguggggagcuggugaucagcgguuuuauuucucggguugcuagcuuuggcaucagacuuugaaccccaacuucuugccauauuccucagcaucugcaguucagccugaugaaaauagcagaaugcagauccuugaauuuucacacaaaugagauaauuauaguacauguagcaacuguguuggacacaaaaugcuggcagaaucuuuaguucuacuaccaauacuuccucuacacacauacagccauccccuccgugguggucuucuuuccccguguccaccucccacagaaguuggacugcaagguggaaaugacaccuggucaacaguuggauggagcauguuugagaaguggggagacuuaaggugggaagaaagaaccuguccaggagggaugagaucugaggaugggagagagacuuuguugucccugagcugggauaaaguuucuguucuguagaugcuguguguucuuagcugcuggcuuuuguauagguuagacaggaauggggguuuugguagauuauuguggggcuuagaagcuuggugggaugugcugaucucucgagucuuaguaggaaagcugagaugucgguugagacauggauagagaaucugaaaauaaucccucaaucugaaaauaauaaucccucaaauaucacuuuuuaguuuauaacaaaagggcuuucacauguguuggcucaucuguccuccauagcaacugugucagguagacauuuucuagauaagaaaccuuaggccgaauugugugucuugcuggaaagucagacagcagagguaggauucccacccaguuuucuggcuccaaaucgucacccuuucccagaguccugggccaccuuagcaaguuacuuuucauuuauuuuauuuuauuuuauuuuacuuuuuugagacggagucucgcucugucgcccaggcuggagugcaguggcgcgaucuuggcucacugcaagcuccgccucccggguucacgccauucuccugccucagccuccugaguagcugggacuacaggcucccgccacuacgcccagcuaauuuuuuguauuuuuaguagagacgggguuucaccguguuagccaggauggucuugaucuccugaccucgugauccagccacuucggccucccaaagugcugggauuacaggcgugagccaccaugcccagccuucuuuuuauuuuuugagacaaggucucacucugucacccaggcuggaguacaguagcacaauuguagcucagucugccaggcucaggcaauccuccugccuuggccucccaaagggauaggguuacaggcaugagccaccacaccuggcugcugcaaguuucuuucuuucuuucuuucuuuuuuuuugacagagucucacucuguuacccaggcuggagugcaguggcaugaucuuaggucacugcaaccucugccucccggguucaagugauuccugggcucaacauaucugaauucaagugaacuccugggcucaacauaucuacccaccucggccucccaaagugcugggauuacaggcgugagccaccucaugccugucugcaaguuacuuuucaagugccucuugugagaugcuguggggcagguuugcaauugacuuugucauuuauuaucuggcuggaaagagaaaguugauucuagugaaccaaugagaacacaagaauucuggggucagugcagugggaguggagagaagacagcucaaggcuaccuggaaaaguuagagaaggcuucuucuaggaaguagaauuugaacuucaaagaauggggaggcuugccaggguggagaagaagggaauuucuggguuagccacaauugcuucugugcugggaaguugacuuacauucucucgaauuguuauaguagcuccgugaggggugggcauuauaaucuccauuucacagaugaagaaauugaggaacacgggauuugugugcccagcccaaggucaaucugcaggauuugaauccaggccuucuugacucuugagugugcuccugcccucugcaccaccuuccucucagauacguaagcaagaacagggacuguccuauaaucccagcacuuugggaagccaaggcgagcugaucacuugaggucacgaguucgagaccagaccuggcaacauggugaaacccagucuccacuaaaaacacaaaaauuggccggcugcgguggcucacgccuguaaucccagcacuuugggacgccggggcggguggaucacgaggucaagagauugagaccauccuggccaacauggugaaaccccaccucuacuaaaaguacaaaacuuagcuggauguggcggugcauaccuguaaucgcagcuacuugggaggcugaggcaggagaauugcuugaacccaggaggcggagcuugcagugagccgagcgcuccacugcacuccagccugggcgacagagcaagacucugucucaaaaaaaaaaaaaaaaaauuagcugggcaugcuggugggugccuguaauccuagcuacucaggaggcugaggcaggagaaucucuugaaccugggggguggagguugcaaugagccaagaucacgccacugcacuccagccugggcaacagagugaaacucugucucaaaaaaacaaaaauggagacuggauggucugaauuagcaaaugaaacugggguagcauugucaacaggcuccccaagaccaaggaguucuccuaaacuggcucuguaucccagggccccgaggggcuggaccagugaaagcacucucaguagguuucuaacugcagaaagcagaauggcaguagaaggaggaccggucccugagcguggggaucugagcaaguuugguuccuuagugccugcugggugccggcccagcacccuggaggagcuuagagcuugggaugagauagauauggaccauuaaucugagcuucccaaggacaggaacugggucugauucacccucugugccuccagccccagaggcggugccaggaugacacacucagccauuguguugucaaauugaauuaugccccaauguagaggaggaagguuuauuuugcccaagaguagaagaucuuccuagaagugccauuugaacaucugaaagauagguugaaaagccagagaaaggguguucuaagcagaggcauugagauggacaaaggcagggauguauaaagaagaacaggucaccugguacagccacagucuagugggcagauacaugacauuggguucaagucaggcucugccgucaugauccuuucgauucucugggccucaguuuccccuucugaaaaggagcccugagauuugaugauauuuaaugauaacccaugcuuggggaucaggauaagaaacucagaugaaaggagcuagaaguguuuaaaaauuuuuauuaauuuaguaaucacugaaccagcaauucucuaggcccuguugcaagugcuuuuuccuaaauuagcuuauuuaauucuuuuuuuuuuuuuuuuugagacggaguuccacucuugucgcccaggcuggagugggauggcacgaucuuggcucacugcaaccuccgccucccggguucaagugauccuccugccucagccucucaaguagcugggauuacagguguccgccaccacaccuaauuuuuguauuuuuaguagagacgggguuuugccauguuggccaggcuggucuugaacuccugaucucaagugguccacccgccugggccucucaaagugcugggauuacaggcgugagccacugcacccagccuuuauuuaauucuuucaacagcccuagagggaggcacuguaauuauccccauuuuacaggugaagaaacuguggcauagagagguucagugaagugcagaaggggcagagcugcagagccaacccaggaugucuggcucuggagcuggccuggugugggccugggaaggagccucaggggagaccugagguuauucagacagcagcggguggaggugcuguagccccaggcuggaggcucagccugggcugaugaugggcugugcgucagcccccaggagccuccacagaggucagcuccuuucuuuuuuuuuuuuuuuuuugagacagagucucauucugucacccaggcuggagugcaguggugcgaucuuggcucacugcaaccucugccucccggguucaagcaauucuccugccucagccuccugaguagcugggauuacaggcacgcaccaccacaccuggcuaauuuuuuuuuguauuuuuaguagagaugguguuucaccauguuggucagacuggucuugaacuccugaccucgugauccacccgccuuggccucccuacugcugggauuauaggcaugagcccgugcugggccugaagucggcuccuuucaucacauuucauggccccuggaaaacaagcucauuuuccuuccucugucagcaccagcuacagauuccuucucaccaaauucauuccccccagggagacuguuucuuugcaggcauguugguuguguuggugccguguugguuguguuggugcugucuccccaccgggcuauggaggcccagagggagggacauuccugcauucagagcgcuuguucccuucagaaacaucugguaacuucaguucugcagcaucacagcuccucagcgucagaggcugagacacaagcuugguggggaucguggggauacgaucacccauauagcagcacauaacacccauauaacagcagcccccauaugguuaacaccacuguauaccagcaucgugcuugacauuuccuaugccuucucuuauugaauccacuuaacagcucuucaagaccagagcaaucauuggcagccccaucuuguagaugaggagccugaggcucagaaagacuaaguuaacacuucugagaucacacagcugagguagagaagggagucagaugaagccaccuggcauccgaggucuuagcugccaugcaggagacagucuucagguuacuuccaguuuccucgaagcucuuuucuuaucaaucuggaaauccuaacuaccaccaacauuuguguccugcuguguccacagucucucauuaauugucaugacagucuuuugagguaagguaagaggugucccuguuuuucagaagaaaaagacugaggcaucaucacccacccacugcucuuccuacccaguccacaaugugacuugggaggggaacaggguauuggauucccugagaccgagaaccaugucuucugauugguuuguguuacugaagugcuggagucagcugaugaucauuccuugagcacuuccugugagggcugcagggaaggugggggcucuggcccuccugggguuuuuagaggucgcccugguucagcuaugcucuuguucccuggagcaucucugugucaucccucucccuccacaggcugaggaacgcagggcagggagcccaaaguccugaguuucauucccaacuccuguucaugcuggcuguaugauggaggcauuauuauuuugucauucuuggcuucugucuccuuuucugugaaacggccguacugauccugucgaaucugcaucagggguuguaguuaugaucauuuaauagccuucagaauauuccugaaucuucuucacugucugccuugauccaggccugaaccacugcaguagccuccuaaccaaucucccaguauccucucuugucauacguccucccugcaguagccaaaaggaucuucuugcgaaauaaauaagcuccugucacucuucugcugaaaacucuccugcaguuuccugacacacgcaaaacacagcccuggcucccggcauggccugugagugguucugagaccagccucgccugccccuugcacuuugccucccacguggcuugcccuugcuuggguguugcagccacgguggccuucugaguuuuccuggaacauuaucagcuuguucccaccucagggccauugccugugcccuguccccugcuagguaggugcccucuuaccccaccuccuaucuuccauggcuggcuaccuaucucucuuaaaugucagcuuccuccuaagggccuucccuaaacucccagucugcuuuuuuuuuuuuuuuuuuuuugagacggaguuucgcucugucgcccaggcuggagugcaguggcgcgaucucgacucacugcaagcuccgccucccggguucaugccauucuccugccucagccucccguguagcugggacuacaggcgugcgccaccaugcccggcuaauuuuuguauuuuuaguagagacgggguuucaccguguuagccaggauggucucgaucuccugaccucgugauccgcccaucucggccucccaaagugcugggauuacaggcgugagccaccgcgcccggccugcuuucuuuuuuucuuuuuuugagacagagucucgcucugucguccaggcuggagugcaguggugugaucucggcucacugcaaucuugaccuccuggguucaagugauucuccugccuuagccuccugaguagcugggauuacaggugcccaccacuaggcccggccuaauuuuuguauuuuuauuagagaugggguuucaccauguuggccaggcuggucuugaacuccuggccucaagugaucugcccaccucagccucccaaagugcugggauuacaggcgugaaccaccgcauccggcccuaauguacuuuccaucacuccaugccacgcuuccugcuucagcuuccuugugacucugaucucuauuuuuacuugucgugugcauuucacgcugguuuauuugucuuccugcccauggaugacaagcugcaccagggaaaggacuuuauuaacuguguuccccuagcaccugguagggccccuugcacuaaaagugcuucaugguuauuuguugaauaaaugaauaauaguaggagguuggccacagaauagcccuugccaaacagcccacgacugggcagggaaacugcaaagaaaucaacauugauggcugagcacgguggcucaugccuauaaucccagcacuuugggaggccgaggugagcggaucacaaguucaggagaucgagaccauccuggcuaacacagugaaaccccgucucuacuaaaaauacaaaaaauuagccaggcgugguggcgggcaccuguagucccagcuacucgggaggcugaggcaggagaauggugugaacccgggaggcggagcuuacagugagcagagauggcgccacugcaguccagccugggcgacagagcgagacuccguaaaucaacauugagugauugaaaacuuacaggauaauuaugucuguugugagugcucucuacagcacccaguuuagcagaaacaugaauuucugaccccuucagggggaggcacaccagguggagcugcaaaauugucuugucagguguguaucaucaucccugucucccagaugacaaaacugaggcucagggaggugcccugaaagccagugugggacagugcugggaucugaacccagggcugguggauugcauggccuagccugccucccugucagcacaaggcacgaaagcaagcagagcagcacuggaaacucucuugaugcccaaugaugcaccacaaggauuuccaagcucccugggagcaggagcagugacuacuuaacugcucaagaggaacaggguaugccacaguguuagacagucacucuaagcucugggugauucuggcuuauuuuuuaauuuuauaauuuccaaauuuuauuuuuuaauuuuauaauuuccaaauuuauaauuuccaaagcuuuuacaaugaccuucuguuacuguuuuaaaaagggaguuuuuuguuuguuuguuuuaauggagucuugcucugucacccaggcuggagugcaguggcacuaucucggcucacugcagccuccgccuccuggguucacgccauucuccugccucagccucccgaguagcugggacuacaggugcccgccaccacccccggcuaauuuuuuuguguuuuuaguagagaggggguuucaccguguuagccaggauggucucgaucuccugaccucgugaucugcccgccucggccucccaaagugcugggauuacaggugugagccaccgcgcccagccucacuuuuuuuuuuuuuuuuuuuuagccugcauucauucgcguguauaugugcaugugugcacaucgguuuugagugggggagugacauuggcauaugcguuacacagauaucccugaccacugaaugggagcauauuggagggggugcauuggaaacuuggcaagagauguugaggguccgagagguggccgugcuuguggagaggauaugagggguugcaggguggggaaauauuuaugagguaaagguggcugagaacaggaugaugcucagagcuaugaauagagucagggaauaauggaagaggaguaggauuaggggagaagaugcugaguucaguuuggaauguguucaguuggagaaacacccaauccagcugagauggcaccaaagaggacuuuggacacagaggcaucuaagcugggucuuaaaggaugaguaggaguugggaagguguguguggcagagggcauuccagguagagggcccaagauuaagaaagggauggaagucauaggcagccuggguguuggacuuccagguaccacuacccagaagauaagagauaugagucugaaauacuggggaagggggugggccuggcaggaggaagagauaggcgagucguuaacaugacucauguuaucaugaaaugcaagagcucaucuggggagcagguagugaagagagcaggagcacugucccuuaaauggaagcucggggauguuggucuugagaccugggcagaauaagacgagcccccaacagagaaaucugcuucguuuuuuguuccucaaccaugcauggaggcaucuccaugacaauacauauagauucaauagcugcauuguauuccaugguauggaauuuaauuaacuaauuuaauucauuuuaauuaaauuaguuaauuaaauuaauccuuuacugguagacauuaagguugcuucuaguuuuccacuuacucuuaaaaauaauacauccucgggaggcugaggcaggagaauggcgugaacccgggaggcggagcuugcagugagccaaguucgugccacugcacuccagcuugggugacagagcgagacuccgucucaaaaaaaaaaaaaaaaaaaauacauccuagcucggcgugguggcucaugcccguaaucccaguacuuugggaggcugaggcgggcagaucaccugaguccagguguucaagaccagccuggacaacauggugauacccugucucuacaaaaaauacaaaaaauuagcugggcaugauggcacauuccuguagucccagcuuuuugggaggcugaggcugcaaugagcugagauuaugccacugcacuacagccugggcaacagagugagacccugucuuaaugauaauaauaauaauaauaauaauaauacguccuacaccuguagucccagcuacuuggggaggauuacuuuagcugaggaggucaaggcugaagugagccacgauggugccacugcacuccagccugggugauacagugagacccugccucuaaaauaauaauaauaaauaauaauaauacaucccuggcuggucaugguggcucacgccuguacucccagcacucugggaggcugagguggguagauugcuugaggccaggaauucgagaccagccugagcaauguggugaaacccugucucuacaaaaaauacaaaaaaaauuagccaagcgugauggugcgugccuguggucccagcuacuugggaggcugaggugggaggaucgcuugagccugggaggucgaguuugaagugaccuccagcuuaggcggcagagauccugucucaaaaacaaaacaauuauaauacauccuaugcaaauauaauugaguacauguguagggauuuucauagauuaaauucuuggaagugaaauuucugugucaaagugaaaggacauuuuaccauuuggaggaauuuuugcugcaaguaacagaauuccuagcucaaaauggggguuuguuuucucacauaaaaaaugagguggggcaguuccagaagcagguaauguuuugggucagacuuuuuuuuuuuuugagacggagucucgcugugucgcccaggcuggagugcaguggcgcgauaucagcucacuacaaccuccgccucccggguucaagcaauucuccugccucagccucccuaguagcugggacuacaggcgcccgccaccacgccaggcuaauuuuuuuguauuuuuaguagagaugggguuucaccgugacgaggucuggaucuccugaccucgugauccgcccaccuuggccucccaaaguguuggaauuacaggcgugagccaccguacccggccagaugucacaugcccuuaccaaagccaaucacuggcaagggaaaaaggccauucugauuggcuuagcccagugaagguucaccugagugccugggaaauggacaaccuugaaggagcaagaggggaaacuggcugcugggugcagccagcagggccugccuugcucauuuuaguacauguugcuaaauugcuucucaaagaugauuccaguuuacacugucaguauacguacagggagggcuugggagugccaguuucuccauccucgucaaccaggcuuucuuuucaccuuagucucaugggugaaaauuggcaucuuguguuuuuuuguguuuuugauuuuguuuuugagacagagucucucucugucgcucaggcuggagugcaguggugccaucucggcucacagcaacuuccuucggucuuucggguucaagcgauucucccgcuucagccucccaaguagcugggacuacaggcacccgccaucaugccuggcuaauuuuuuuuuuuuucguauuuuuguagggacggguuuucacuauguuggccaggcugguguugaacuccugaccucaggagaucugcccgccucagccucccaaagugcucggauuauaggcgucagcuaccgcgccuguccggcaucuuuuuuuaaucagugaguuugaguaucuuaauaauuuauuuuccugugaauuuccuuuuuauguuuuuugcccuuuuuaauuuuuauuuuauuuauuuauuuauuuauuuuuuugagauggagucuugcucugucacccaggcuggagugcaguguugcgaucucagcucacugcaaccucugccucccggguucaagcaauucuccugccucagccucccgaguaguugggacuauaggcgagugccaccaagccuggcuacuuuuuguauuuuuaguagagaugggguuucgccauguuggccaggcuggucucgaacuccugaccucaagugauccaccugccucagccucccaaagugcugggauuacaggugugagccacugcgcccaaccuauuuuuuauuuuugggauaagggucucacuguguugcccaggcuggucuugaacuccugggaucaagugaugcucccacuucgccucccaaagugcugggauuacaggcaugagucaccaugugcggcccauaaucaucauuauuauuuuuuuauuuuauuuuauuuuuugagacggagucuugcuuugucacccaggcuggagugcaguggcacgaucucggcucacugcaaccgcugccucauggguucaagugauucuucugccucagccucccaaguagcugggacuacaggcgugugccaccacaccuggcuaauuuuuguauuuuuaguagagacaggguuucacuauauuggcuaggcuggucucaaacuccugaccucgugaucugcccgcaucggccucccaaagugcuggguuuacaggcaugagucaccaugcccggccaaucauuauuauuacuuaaaaauacaggcaagacccugucuccaaaaaaaauaaauaaauaauaaaaauuuaaaaaaucugauccuggagguuuguuuggccuauaugcuucuugcuccuccaccaggugccuucucugagucaugccugacacacgcuuucaagaugcucaccucccucucuuuuuguucuuugagacagggucucacucaguugcccaggcuggcccagacagcagggaggcaagugagaggugggcuggugagccccgaugucacaacuggggacaccuuccacacgcacgugcuagagugcuagaguacaaguggcacgaucucggcucagugcauccuugaccuccugggcacaagcaauccuuccagcacagcuuccugaguagaugggacuacaggcauguaccacuauauccagcuaauuucuaguguuuuuuuuuuuuuuuuuuguagaaauggagucuugcuauguugccugggcugguuuugaacuccugggcucaagcgauccucccaccucagccucccaauuacagguaugagccacuaagcccagccguaccucccucuuuaacugagaauaaaugaccuuuuaaccacuguguuagucugcauagguugccauaucaaaauaccauagacugaguggcuuaaacaacagaaauuuauuucuuuacaguuuuggagacugggaguccuagucagugugcuggccuguuugauuuuuggugagggcucucuuccuggcuuacagaccucacuguguccucacauggccuuucuuuggugcaugcaagggaggaaacagaggaagagcaagcuugcuagugucucuuauaaggacaguaauccuguuggaucagggcccuacccuuaugcccucauuuaaccuuaauuacagguacuucuguauaggcccuaucuucagauauagucacauuagagauuagagcuucagcauaugaauuuggggaggacacagacauucagucuauaacauucuacccuucauccccccaaauucacgaccuuaucacauacaaaauacauucauucuauccaaauaguuuuuuuuuuuuuuugagacggaguuucucccuuguuucuuguugcccaggcuggagugcaauggcgcuaucucggcucaccacaaccuccaccucccagguucaagugauucuccugccucagccuccugaguaacugggauuauaggaaugcgccaccauguccagcuaauuuuguauuuuuaguagagaugggguuucuccauguuggucaggcuggucucaaacuuccaaccucagguuauccgccaaccuuggccucccaaagugcugggauuauaggaguaagccaccaugccuggccauuuuuuuuuuuuucuuuuuuugaacagggucucgcucuguugcccaggcuggagugcagcggcgugaucuuggcucacugcaaccuccgccucccagguucaagcaauucuccagcaucaccguccggagaagcugggauuacaggcgcaugccaucgcacccagcuaauuuuuguauuuuuaguagagacaggguuucaccauguuggcugggcuggucucaaacuccugaccucaggugauccacgcaccuuggccuccgaaagugcuggacuuaacagcuguaagccaccacaccuggccuuuuuuuuuuuuuuuuuuuugagacagggucucacucuguugcccaagcuggagugcaguggcacgaucacgguucacugcagccuuaacuuccugggcucaguuaguugcucuguugcccaggcuguagugcaacggcgcaaucuuggcucacugcaaccucugccucccagguucaagcgauucuccugccuuagccuccugaguagcuaggauuacaggcgugugccaccaugcccagcuaauuuuuuuucuuuucuuuuuugagaagagucuugcucugucgcccaggcuggggugcaguggcacaaucuucgcucacuacaaccucugccuccuggauucaagcgauuuuccugucucagccucccgaguagcugggauuacaggcauguaccaucacgcccaacugacuuaauuuuuguauucuuaguagagacaguguuucaccauguuggccaggcuggucuugaccucguuauccgccugccucagccucccaaagugcugggauuacaggcgugagccaccgugccuggcccccagcuaauuuuuauauuuuugguagagaugggguuucaccauguuggccaggcuggucucgaacuccugaccucaggugauccacccaccucggccucccaaaugcugagauuauaggcaugagccaccgugcccggccagaaagacagucuugaauugccaauaccauccuucccccauuccugggcaacagccauguggugcagagagagaauucauccaacaaaauauugaaucauaaccugauuuaaccuuaauuagcuccuuaugggcccugucuccaaauauaggguuuagggcuucaacauaugaaugggagagggggcacaaacguccaggccguaacacccucccuauaagaauuuucuggcugggcgcaguggcucaugccuauauucccagcacugugggagacucaggugggaggauuucuugagcccaggaguucgagaccagccugggcaacauggcaaaaccccaucucuaaaaaaaaaauaaaauacaaaaauuagccaugugugguggucccagcuacucaggaggcugaggggggaagaucaguugagcccaggagauggaggcugcagugagccaagaucacaccacugcacuccauccugggcaacagagcgagacccuaucucaaaacaaagaaauuuuuuucccagaggagggaagggugugggcuguuaggugccuguagggcuggggccuuuggucuccugacgcauuguuaaucaggcugccugaugcccaucucugcggugucacugaacccaggauccaggcugacugcauggcuuugaauaacuuuccuagccucuuggaguacuauuuuccugccugauggggauguugugagauuuaaauaaaucucaguuauuuagugacaacacauuuuuuuguagagcaaagcuagacauagaguggcccuuuuguuuaaaagcuccugugacuccucuaccuuaggguggaauccacagucugccccgucuacaaaaccucuaugggcugggugacacacguggcucaugccugucaucccaucacuuuaggaggcugaggugggaggaucacuugagaccaggaguuuaagaccagccugagaggcugggcgcgguggcucacgccuguaaucccagcacuuugggaggccgaggcgggcagaucacgagcucaggagaucaagaccauccuggcuaacaugaugaaaccccaucucuacuaaaaauacaaaaaauuagccgggugugguggcaggcgccuguagucccaacuacucgggaggcugaggcaggagaauggcgugaaccugggaggcggagcgugcagugagccaagauugugccacugcacuccagccugggcaacagagcaagacuccgccucaaaaaaaaaaaaaaaaaaagaccagccugggcaacauagugagaccuugucucuacaaaaaauuuuaaagguuagcgaggcaugguggcgcgcgccugugaucucagcugcuugggaggcugaagugggaggaucccuugagcccaggaguuugaggcugcagugaucaugccauucugggcaacagagugaaaccgucucagaaaagaaaaugaaaauaccucuacauguggucuuccugcuaaucucucugaccuuccuauucaccacccuccccacugcccacucugcuccauccucaccagccuccuugcacauucucagauacaccaacaaggcaucucccucaggaccuuugcacucacuguucccucugcccggagcccuuucccaccagguauccacagggcuggcucccucacaucauacacguagaucuccauucaaaugucaaagugagccaggcgcaguggcugaugccuauaauuccagcacuuugggaggcugagauggguggaucacuugaggucaggcguuugagacuagccuggccaacauggugaaaccccaucuguacuaaaaauacaaaaaggcugggcacaguggcucacgccuguaaucccagcacuuugggaggccaaggugggcagaucacgaggucaggcgaucgagaccauccuggcuaacacggugaaacccccucucuacuaaaaauacaaaaaauuagcuaggcaugguggcacgugccuguaguccuagcuacucaggaggcugaggcagaagaaucgcuugaacccgggagguggagguugcagugagccaagaucgcgccacugcacuccagccugggcgacagagcagaacucccucucaaaaaaaaacaaagcaaaaaguagccgggcauaguggcaagugcuuauagucccagcuacuugggaggcugaagcacaagaaucacuugaaaccgggagguggagguuggagugggcugagaucacaccacugcacuccagccugggcaacagagugagucuccggcuaaaaaaaaaaaaaaaaaaaaaggucaaaguggccucucagacugcucagaauuauagcacccugucacucuaucuuauuauuuuuucuuaauugcguguauccuuccuauauuaugugauauauuuauugucgugugccucuccacuagaacauaugcucuaaaagaaagccuuuguuggcugagcacaguggcuaacgccuguaauccuagcacucuggggggccaaagcaggcggaucaccugaggucaggaguuugaaaccagccuggccaacauaaugaaacccugucucuacuaaaaauaugaaaauuaucugggugcgugguagugcaugccuggauucccagcuacuccagaggcugaggcaggagaaucgcuugaacccaggagguggagguugcagugagcugagauugcaucacugcacuccagucugggcaauagagcgagacuccaucucaaaaaaaaaaaaaaauggggggccgggcauagugacucaugccugucauccccgcaccuugggaggcugaggcagaugaauuaccugaggucagguguucgagaccagccuggucaacauggcgaaaccucgucucuacuaaaaauacaaaaauuagcugggcaugauggugggcuccuguaaucccagcuacucgggaggcugaggcaagaggaucacuugaacccaggaaacggagguugcagugagccgagauggcgccauugcacucagccuggguaacaggggagacucuguauccaaaaaaaaaaaaaaaaagaguuuucccuugaacuugaggguguccauacgguauuguagcucaagccugugugggaaagggcaggugcccucuaugcccccuugucccuugaggguaccacacaaucuaggaguccagggggccauggggguggaggacacuggccugaggguggucaucgcccucagggacacgccucccgacauggggaagggaaugagagugggagugagagcacccaaucacaggacccacgaaguggugguggcugacggcagccuggcucuugcugacugacugauggacugugcucucuuccccagagacugauggagaggcagaaacggaaggcggacaucgagaaagggcugcaguucauucaguaagccugcaugcggcaggggcuggacggcugggugggcaaggguggguucucugagagccaugcccucccagcgcucccuuuucuugcugcugagccuuugcugccaaggcuccugugugcgcuggggugcgggcaggugggaggagccaggaaggggcugguguggcugugcgugaacuccacaugcacacaugcucccuggcccagguuacccuucaaucuuguccaguagguaauucugcccucacccuucacauuugcacucccuguuaauucucuugcaugacugcacgaguuuucugauaaaucaauggucccucuguuacaaucucagucuccgugcugggaccuucacaucugugucuucuuugagacagaaucucuccuuguugcccuggcuggagugaauggugcuccugaccuccuggacucaagcaauccugccuccaccucccauguagcugggagcauaggugcacaccaccauacccagcuaauuuuuuuuuuuuuuuuuuuugagacagagucuugcccuguugcccaggcuggagugcagugacaugaucucggcuuacugcaacuucugccuccuggguucaagcgauucuccugccucagccucucgaguagcugggauuucaggugugugccaccaugccuggcuaauuuuuguauuuuuaguagagaugggguuuugccauguuggccaggcugccuugaacuccuggccucaggugauccacccaccucggccucccaaagugcugggauuacaggcgugagccaccgcacuaggccauuuaaaaaauuuuuuuguagagacgaggucuugcuauguugcccaggcuggucucaaacuccugggcucaagugauccuccugccucagccucccaaagugcugggauuacagacaugagucacugugccuggccaauccaucaucuuuuuaaucuucucaacagcccaguaaaguagguagccuuauuuccauuuugcagaugagaaaguugagacucacagagguuaagcaacuuguuuaaggucauggagcuauugaggaauagcauucuagcccaagccugguugaccacaaaacucaaaacucacauucuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagcugggauggucucgaucuccugaccucgugauccgcccgccucggccucccaaagugcugggauuacaggcgugagccaccgcgcccggccaaaacucacauucuuucuauuguaugccucugagcacccacaugccacacuuuuuuuuuguuuguuuuugagauggagucucacucuuguccaggcuggaacgcaguggugcgaucucggcucacugcaaccuccaccucccagauucaagcaauucuccugccucagccuccugaguagcugggauuacaggcgccugccaccacaccuagcuaauuuucguauuuuuaguagagacgggguuucaccauguuggucagguuggucuugaacuccugaccucgugaucugcccuccucggccucccaaagugcugggauuauaggugugagccaccgcauccagcccgacauuuguuuuuguuuuauuucucuuuuuuuuuacacacaaaauauuuugaguaaccuuuuucucuuauugcucuuaaauagauccucagaggcauaauuaucacaacacuaaugaagcgugggcaucguggccucucacuugcacgagccccuuccgaggcccuggaaggcaugcacccuugcaauccugcguucaucauuuuguguucuuuuucuuaaauagggcuccccauaaaacuggaauucgccucuauguucccuuauauacuccccacuuuuguucucucacacagaccaguaaaacacucuuugccuuuucuuuucuuugugauggggucucccuguguugcccaggcaggucucaaucucccgggcucaagcaguuuuccuaccucagccucccacguagcugggauugcaggcgcgugcugcugugcccagcguacucccuugccuuuucucacccaugucaccgcagacugggucccuuuucacacgcccucgguauccaugcugcucucacagagcgaguguucauauugacacaacacauucuccuuccucagcgcacaacgcagucacuuuuccuggccgcuucuggaggguguccugcgcugggcugauuugauuagggguuuugggugcaccuagagcauggccccaaguucagcaccccuucccugggcuguuguccaaccccaccuugcugccauggcugggaguuugcaaacccuccucagacuuguucaucagagcgguugcuagcucaucucucuucaugggcggcagguccucucccauuuuggggagugaggguuugauuuuggggaaguguuccaauuuauucagaggccagucuggugaacaaggugacuccggccacugcugucuuccauaagaagaguucuguguccccagccucagucacugaugucuguagagcuggauucccagcccaguucucccauuuccccuacggggucauugugaagguuaagggaccagguggugcuugggguaaauguucacucucguccccuccuucuccuuuccaaaggggcguucuaggaaggcccagcuacaaggcagccuccccgaagccgucuguuggccuccuaaggcuuugcaggaagcacagugggacucacugcuuuucacaucagucccgcuauuuuugccccacuccuccuacgcuguguuggugcacgugugcuucaugugcuuagcacguccugagagcccuaagugaauugggacagguggguuggccccagcuugcagaggaccuuaagaugucuacggccgggcgcgguggcucaugccuguaaucccagcacuuugggaggccaaggcaggcggaucaugaggucaggagaucccgaccaucccggcuaacauggugaaacccugucucuacuaaaaauacaaaaaauuagccaggcgugguggcgggcgcuuguagucccagcuacucuggaggcugaggcaggagaauggcgugaacccgggagguggagguugcagugagccgagauugggccacugcacuccagccugggcgacacagcgagacucugucuggaaaaaaaaaaagaugucuuaggaccgcaugaccuaugaaagguagaguugaugcuggaagaggguaggcuggaggcaggaggccaggaagguagugauggggucuuuagugggggcaacagaggagacagacacugcagcaguauggggagggagggcaggucuggggcccagacaguggggaggcaagugagaggugggcuggugagccccgaugucacaacuggggacaccuuccacacgcaugugcauacacagcccuccuggcguugcgccucugcccaccucucacgcacuagccuaggccacucuuuccugcccaggugcuggcagcaucuccaggcaacggaaagaucuccccagcccugcauccgaugccuuccugccaagcagccuugggcgaguccuugcgccacucugagcgucuguuuuucccucuguggaaugaaggacugggagacaaagcccagcuucccuuccagccuggccauugagcccauuggagagaugaaccucaguucuccugggcugaugcccucuuucauacugagggagcauuagccacaggagggagcaggugcccagaccccaccuagaaugauuuguugaguccagcaugagggacugacaggcucagugaagaccuggcauuggguggggcguguguuaugugggauugggcaggggaggggccugagguggacucccggugccucagugucuguggaccuguggucucggauuugguuugauggggcgugguccuucccaaggccuguucuagguguuaauucccugacaacacucauacuuccugccuuuuccugccugcuccugucccuggcacuccugcugcagcagccccugcaccauccucuccuccuggccuucagcugcagcuggagccuucccccgcucugccuuggccagagucugauuuuccucuuguccuuuuccaguccugggggccuccuaggcccaaguguggcuccucccuccuuccccucauguaacugagaaagggcuuggaaugccugcuuuccuuuaggagagggcugguuuuuucagcagaggauggcuguuuuuuucagcagcagggacuggggcuagguccagggccagagguagagcuggaacugagcugggcuaggacuggcuuggggcuggggcugucuggguuggggcuggagcuggggcuguggcuggaaguggggcuggaacuggggccaggcuggagguggggcuggggucagucugcucuuucucaacaccuguaccuggcaaaaccuggcugucuggccccaaggaacaugcagguccuuccaucagaacuggaaggccugcauggcaaugauuuaggagaagaaaaccgcagucuguucacccuaguccacaaggugauggcugaggucugaguuggaggaguagcucuggaccuccaugaagcugggaccgccgggcucacccaggccucguguuuucuuuuccugauaggucgacacuaccccuaaagcaagaagaauaugaggugagugucagcugccaggcugagcaaaggugaagggcggagaugugcaggggagaggcgugggccgggugccagagcuggggccagaggucaugagcccccuacacaccuugcccccaacaggccuuucugcucaagcuggugcagaaucuguuugcugagggcaaugaucuguuccgggagaaggacuauaagcaggcucuggugcaguacauggaagggcugaacguggccgacuacgcugccucugaccagguggcccugccccgggagcugcugugcaagcugcaugucaauagggccgccugcuacuucaccauggugagccuggcacccucuuuucucuccuccucugcugcccugauccccuggaugcccagucgagccaggcccauaccccagugagccuguagaccagggccagccuccucccagccugcuuucagaauuucauugucuguucucguggcucuuaaucucaacuguacaacaugcucagcuggagagcuuuuaaaaguacggaugcauaauaaaaaguuuuuaaaaaaaaugauacugaugcccuagcccuagcccugcccuagaugaaguaaguuagaaucuuggggugacccugggccuuggugggagucugacuucuccugcuccucccucccggccccacuguuucuuccauagccucagccuccucacuguuccuuccauagccucagccuccucacuguuccucccauagccucagccuccucacuguuccucccauagccucagccuccucacuguuucuuccguagccuccucacuguuccucccauagccucagccuccucacuguuucuuccauagccuccucacuguuucuuccauagccuccucacuguuccucccauagucucagccuccucacuguuccucccauagccucagccuccucacuguuccucccauagccucagccuccucacuguuucucccauagccucagccuccuguuucuuugcggacuucagugccuuccuccuccuccuccucuccuccuuagagcugcagccuccuccucuucccuguccugugcacccacugacucagguucaugagauccugugggaggcucugcugcaggcucucuagaggaccccaugacaccucugccauccagcgaacucuucuggauaaauggcuccuggaugccucaggguuaacccuuguacacucugcacacagagcugccuucauggucucacugccucuuagagaugccauuguuacucucagcucaucauguucccaaccaaaggcagagauggaaauagacgugcuugaguggccgggcucaugguuguagaucuucaggcccuucccugcaauauccugcccgugcccacugcagccccaucagcuggacacacagacacccuugaucagagucuggacaccagagugcuuccuucucuccuggagccucgagcccugucccugacccaagacuucagcuccucugucucugccaggaagggaagcugguguuccuuccuaggcaggggcaggaggccugggggagggaggguaacagguguugaccagugaccacaugcuccucucuggcagggccuguaugagaaggcgcuggaggacagcgagaaggcgcugggccuggacagugagaguauccgggcguuguuccgcaaggcacgcgcucucaaugaacugggacgccacaaggaggccuacgagugcagcagccgguguucccucgcccugccccacgugaguguggcucugcagccacgccggugccugcucagaggccaggcuucugaccuuccggcccucacuugggcccagccaccacauccuucugugucucacuuccuccccugugacauggccaugcagauccugauguuaacacuagcucccauucucugagcgcugacugggugccaggcacugcuaggaugcauuguguguauuaacucaccuaauacuggcaauaacccuaagaggcagauacugugauuauucucauuuuaaagaugaugaggccagacacaguggcucacgccuguaaucucagcacuuucggaggcugaggcaggcggaucaccugaggucaggaguuugagaccagccuggccaacauggcaaaaccccaucucuacaaaaaauacaaaauuuagccgggcaugauggcgugugccuguuuugcuaauucuguuuaguucacaauuaagacccuuucuuggccagacacaguggcucaugccuguaaucccagcacugugggaggccaaggcgggaggaucacuugagcucaggaguuugcaacuagccugagcaacauagcaagacccuguuucaacaaaaaauuaaaaaaaaauuagcugggcaugauggcacgcaccugagaucccagcuacucaggaggcugaggugggaggaucacuugagcccaggagguggagguugcagugagcugugauugcaccauugcacuucagccugaguuugacaaagcaagagcuugucuauuaaaaaaaaaaaaagccuuucuuuaugaccaugguccccugacccauauagcauuuuagaguguccacaacagauccacaccuaggucucacugguacuuacucaugaggaggacagggcagguuucauccgcaccacagcggauagaaaggagcugggacccaguuaggguuaguaaauggccagggaaaguaacuaagggcuccuggcucugcuuuagggaacucucucuuuucccaaucuuuguugggcaaauacugaccgagcuccugcuccaugcugggcacuggggaccagagaugacuccgacccaggcccuggccucuaggagauugucagugagguaggagguagacacgugcacagaugucacagugucuuccuugcccuuuugugccuggaccccaguuuguagccaccuguuucuuuguucacugacuguucucccccuuuagauuggaaucuccaugaggccugggcccaucugcccuguucgcugggguauccuuagccccucacucuugcuuggcacguaguguauguucuguauuacagccuuggaagggaaggaaggaugguugcuguuuagugaucacuaagugugguccaggcacuguuacaagcuuucuaugcccugccuccuuggagccuuacaacccugugccucauguauguaucgucacuugcuggggguugcaggagauuguuuggcgauagaaacaaguuguagaacuauauaaugugaccucauuccuguuuaaaaaaagaaagagauggccgggcacaguggcucacgccuguaaucccaacacuuugggaggccgaggcggguggaucacuugaggucaggaguucaagaccagccuggccaacauggugaaacccugucucuacuaaaauacaaaaaaaaaaaaaaaaaaaaaaaaauuagcugggcaugguggcacaugccuguaaucccagcuacgcgaaggcugaggcaggagaaucucuugaacucaggaggcaaagguuguagugagcugagaucgcgccacugcacuccacccugggugacugagcaagacuccaucucaaaaaaucaaaaagaaagagacaauccccaaauccccacaaaacaaaacuaagcuuuuuuuuuuuuuuuuuugagacagggucuugcucugucguccaggcuggagugcagcggcgcagucuuggcucacugcaaccacugccuccugaguucaagcgauucuccugccucagccucccagguagcugggauuacaggcacccaccaccaugcccggcuaauuuuucuauuuuugguagagaugggguuucaccauguuggccaggcuggucuugaacuccugaccucaggugauccgcccaccucugccucccaaagugcugggauuacaggcaugagccacugugcccagccagaaguaagcauucuuuauaggucugcaugcaugcauuccuagaaaagagcccuaaggaaacacaucagcccagcagagugugauucccuccuggagaagccuagggugaagggggagauccagggagcacuugcugucccuguaacauucuucccuucuacagugacauugucacuuuugcugaauuuuagaaauaaaaagauuauauuaaaauaaaaacaaaaugauucauuuuccauccccaaauaaaaggaaaaacagaagcaugggauggugguccuggugccaccacucacuagcugugugacuuggacaagccagggacaccuccuggggccucacuuucucaucuauaacauggggugacuaugaccucccuccguagggcugcacagguguccaggagcacagcuuugugagcccgggcagacugacccaccgcccugugucuuguccucugcaggaugaaagcgugacucagcuuggucaggagcuggcccagaaacuggggcugcgaguucgcaaggcguauaagaggccccagguagguggguucgggacccugggagggucgguguggacgugaggaggucugaagggagggaccaggcuccguggggaaggugggugaggguggccagggcuggguuaggacagaggggagugacagcaggugaucuuccuugucuguuggcugaaagcccuggaaccuuucggaaaaggagagagcagccaccgcuucuagcucacuuuagacuccaacuguugaaaaccacucccuccccugugcuggcugacuuuagucaccuggagguggccugaguugacacuggcguccuucagcauuauguucucaacacccauauggugcaaauuugaaguguugguaucuguuuggcugguucaguuccacauagauucauuugguaccugccgagggccaggaggcugcacaagggaaacucgugacucgagucucugcugugaccuugagcaaguuaguucaucucuuuccaccuugguuuccucaucuggacgauggagauaauuuaugcccaccccagagggcucaugggaggauuaaaaagagagaauggaugggcuggacgcagugccucaugccuguaaucccagcacguugggaggccaaggcgggcagaucaccugaggucaggaguuugagaccagccugaucaacauguagaaaccccaucucuacuaaaaauacaaaaauuagcuuggggugguggcacaugccuguaaucccagcuacucgggaggcugaggcaggagaaucacuuuuuuuuuuuuuuuuuuuugagacggacucucgcucugucacccaggcuguagugcuggagugcaguggcgcgaucucagcucacugcaagcuccgccucccggguucacgccauucuucugccucggccucuccgaguagcugggauuacaggcgcccgccaccacgcccggcuaauuuuuuauauuuuuaguagagaugggguuucaccguggucucgaucuccugaccucgugauccgcccgccucagccucccaaagugcugggauuacaagcgugagccaccgcgcccagcugagaaucacuugaacccgggaggcggagguugcggugagccaagaucgcaccauugcacuccagccugggcaacgagcgaaacucugucucaaaaaaaauaaauaaauaaaaggccgggcgcgguggcucaugccuguaaucccagcacuuugggaggccgcggugggaggaucacgaggucaggagaucgagaccagaccauccuggcuaacgcagugaaagccugucucuacuaaaaauacgaaaaaauuagcgggggugguagcgagcgccuguagucccagcuacucugaaggcugaggcaggagaauggugugaacccaggaggcgggacuugcagugagcagagaucgugccacugcacuccagccugggcaacagagcgagacucugccucaaaaaaaaaaaaaaaaaaaaagagagagcaaaugggccgggugcagugguucaugccuauaaucguaguacuuugggaggccgaggugggcagguugcuugagcucaggaguucaagaccagccugggcaacauggcgaaaccguaucucuacaaaaaguacaaaaauuagccuggugugguggugcaugccuguagucucagcuacuugggaggcugaggugggaggaucacaugaaccccagaggucaaggcugcagagagccgagauugcauccagccuaggggacaaagugagacucugucucagaaaaaauuuaaaaauuaacaaauaaaaaaauagaauguuugagauggugccuagcauggugccugacacacaguagaggugugcagggagguccucugcccaggucaagguuggaagaagaaaaccccagaaucugacccagagagacagagcaguugauuuccggcaggccuggggacagggacucucgggggcgcugcagaccccagcugcuugugucagggccucuuugcugccccagcuaaggggaccuugagcaucuuuucagaaucuuuaccucugcccaccucucuccaaucucuggcaggaauuggaaaccuuuucucugcucaguaacggcacugcggcuggcguggcagaucagguaggaucggggcugaaccaaccugucucaguuuauccauuaugagagguuuggauucacucucuccggguauaaaugaccucaggcaguggguccaggggccuccgccucccuaggagguaccucccguguccacgggggcaggauguggggacaggccauggcugcuguuggcagggaguggucauugccggggagccgccgggggcagccucacucuugaacccuggccaggacacagucugggcagccuggucccacacgccuuccuucugccuccugccccacauuuccugcuguguugccuuuuuucucaccagccuuucugcagguucaggccccugggccucaaaugucuuccucuuccccacccugccuuucucugucuuuucgcuuuucaaagcccagcucaagggcaugccccugccgaaacccauccugcucucccuggcucagugacucugcuugggaggggcagccgagacugaggacucugacaaggaagagcccaacugggcccugcagccuugggcagguccuucaguuucugcauucugaaaugcggaccaucccucaacgggaacaagggaggaaagugcuugauaaccuggcacacacgacccagcaggaaaugcagugggcagucacuguggauagcugcugugcuguccugaguuggggacuccucccaagggccaagacacuugugcaccccagucaggccuggcucaucccaggggggugaggcagggccuggcacacgacugagaccccugcccgcugcucagguagacuuugaggcuuucuggaaagugagagaugggcuauaagagcacugauggagccugggguccugccaccuuguacauuaagggaaacugaggcacagaguggggaggggacggggccagugucacacagcgaggcagcagcaggccucccuccuccagagcuuugcagcacuuucuuucauucauuccauaaggaggcccacaaaacacucucggcccugggccugagagagcugcguccuugcccucagggaccucccagccugcaaaguaggcaguugaugaucugccuuuguagcacucaugguuuauaaucagaaauuauaggucaggcaugguggcucaugccuguaaucccagcaauuugggaggccgaggugggugaucacuuaauuucgggaguuaaagaccagccuggccaacauaaugaaaccccaucccugccaaaaauacaaaaauuagccgggcaugguggcaugugccuguaguuccagcuacuugggaggcugaggcaggagaaucacuugaacccaggaggcacaguuugcagugagccgagaucgcgccauuacacuccagccugagagacagaaugagacuccaucugaaaaauaaaagaaauuauuaggccuggcacauaccaggugcuccaacgagaaaacauuaaaugaaugaaaggugauuugucuaaguuuacccaguaugggccaagcacugagcuugggguuggguaugugauaaacaaaacaaaucuguuuccugcccucaaagagcucacagucuaggauggacauuaggacauuaggcagaucauuucugguuucaaacugugaugagggcugugaaggcagaguauggggagaccugggccauugagacugggagcccugauuuagacaggauucagugacauuuaagcugagaccggaagguugaagaguuaggggcagggugugcaggugaaacagcauuccagaccagguggaagguaugugcaaaggcccugaggccuggaggagcucagagugugggaggaaccaacaccaaggcagagcuggggguccuggaacaggagauagaagccagaccgcuugaccccugauaagaagcucagucuuagcauugggaaggcauugaggggaggcagcauuaauucuauucauuuauucggaagguauuuauugagcacugcuuuguacccagugucaguucagacacugggaauagagcaccaagguagcgucucaucacagcaaguggagcugggcugggcaggcacagcagaugcucaaaaaauauuuguugaaugauugaaugacugcggccagggggccacagcaaauaugggcugaaugcccagcucuccagggccaaggccgcaaagccuugcuuagucugcagccagaugaccacagauggugccauaccuggcaccaggccccccccagucccugccaggcuguucacccaucccugcaaucuugcugggcuccuccugcacauucauagaggucaggagggcaugguuagggagggcucuaagaagcccacaguggagaggaccaguucagacccugccucaugaacucaguuugcccaacaugguacagcacacaugugagcacacacaugugcacaugcacaaacggagugcccuaggacacaugagggcaggguggugucccagccagagccccuggccuuccgugaguugugcacagacacaaguaaaugcaggcugcaggggucccuguagguucuccaccaugagcaccauauucauucagccggcuggucauuucacaugugcaccuggaaguggggauggaccaggcugugcccacagggagcuucuuaugaccuaggagccaggcagaggcccugcaagacagugucugugcaagagcugucccuggcaucguggggaacaagaugcaaggagggcugugaguuccaggaacagagagcccaaggcagccuugguuggaaagggcuucagcgagccagggaagcaagacuaagaggaagggagagcuggagagggggaaauggcacucaugaccaggagcacagccugcacaaaggcuaagcagcaaaagagacagacaccccagaucacaagaccaguuccuccuauggggcucggaauagccugggcucugcaguggaacgugcuuuggaucagauccugagcacgcuccuuaucuacgcaggccacuccaccccucagagccuuggcuuccuucucuuuugcagggguccgguaccugccauuuuguggggguuauagaauuacaaugggucaaugugaaagcucccagcagggcgucugcagaagagauagagcuccauagaccuuuguugccaaacagaugucaccagaaggagugccaugcagaagggcaggaacagugagccuggcaggcuggggugauggcaugggcaggagggcugagaaggugacuuuguccugcguggccugggagccaugggcaggaucuagcagggagaaucaccgcuuucccuagagauguucaucugguaccucucuuucccucaaagacuuuauguacuuaccaugaggauagcagcucugugauccagcguggcggccuugguuuggcagccaaucuauggugggcagacacuccggagacugaagugcacacauuugccaugugcucuauggcaggcucaggugugggaaggaggugcaggguguuggugcagguauggaugggggaguguacaguuccaggggacagagucaggacaggcucuugggucagacagcccugcucugaucugugcauagcagcuuucugggcugacauuuccaugccgugggaugauaccucgcagggcgccuggaccgagggcuaaaccccacagugggugugagaugcuggccugggcuggcgugaggcaggaugcuggaugagucuagcugcugguccuguggcugcugguccugggaaaggaaggcuagugguggagucugguccuccauccggcucuccguggggacacagaaaggguggggccacccagggccucaccagggaagcaggacuugagcuggacugugaaggacucagagaaaaaggggaggguguucaggacagggaaggaugcaccacagccuggagguuggagugugggaacuguugaacgaaacagcagcucucccagcccaacuuccagaaacugugcaucuaaucaacacaggccgggcacgguggcucacgccaguaaucccagcacauugggaggccaaggcggguggaucauuugaagucaggaguuugagaucaaccuggcuaacauggugaaaccccaucucuacuaaaaaauucaaaaauuagcugggcgcgguggcucacaccuauaaucccagcacucugggaggccgaggcggguggaucacgaggucaggauaucgagaccauccuggcuaacacggugaaaccccaucucuacuaaaaauacaaaaaauuagccaggcgugguggcgggugccuguagucccagcuagucuggaggcugaggcaggagaauggcaugaacccaggaggcggagcuuacagugagcugagaucgugccacugcacuccagccugggcuacagagugagacuccaucucaaagaaaaaaaauauauauauauauucaaaaauuagcugggcaugguggcaugcuucuguaaucccagcuacucaggaggccgagauuagagaaucacuugaaugugggagucggagguuguagugagcugagaucacaccauugcacugcagccugggugaccaaacgagacuccaucucaaaaaaaaaaaguugggugugguggcucaggccuguaaucccagcacuuugggcgguugagggagguggaucaccuaagguccggaauucaagaccagccugaccaacauggagaaaccccaucucuacuaaaaauacaaaaauuagccaggcaugguggcgcaugccuguaaucccagcuacuugggaggcugaggcaggagaaucgcuugaaccugggaggcagagguuucgguaagccaagaucgcaccauugcacuccagccugggcaacaagagcaaaucuccaucucaaaaaagaauaaauaaaaauacaaaauaaaaauacaaaaaaguuagucaggcguggugacgggugccuguaauuccagcuacucgggaggcugaggcaggagaauugcuugaacccgggagguagagguugcagugagccaagaucaugccacugcacuccagcuuagggaacagagugagacucugucucaaaaaaaaaaaacaaacccaaaacacaaagcacuuccugugugccaggccccguucuaagcacuucacacauagcaagucauuucauccugauagccuuccccagcggugagugaagcaggcccagaguggauggggaacuuugcccagguuguacagccugcucaggcccagcuuuccuccagcaggaaggcagugggaucccaccuggguuuaugcccuucucugcuuccuggggggccuggggcuaccgugggagaggagagccuggggacucagggagggggcacuuuugucuuugaacugcaggccaucuguggugcuguggggggaggcuugcuaagacccuugccaccuucaccggggugaggacccugcccugugguggguggaaccaagacucagagguucucucccugcccucaaccaccccucccuagagggacagcuguggggauccacugagcccaugcccccaccugcuggcccauccagccccuugcugggcaccacaggggugaggacccagcacgugugagggcuuuuuuuuuuuuuuuuugagguagagucucgcucuguugcccaggcuggaguauaguggcaugaucucggcucacugcaacauccaccuccuggguucaaaccauucuccugccucagccucccaaguagcugggguuacaggcuccugccaccaugcccgacuaauuuuuguauuuuuaguagagaugagguuucaccauguuggccaugcuggucuugaauuucugaccucaggugauccacccaccucagccuccccaagugcugggauuauaggcauaagccaccacgccuggccgcaugugagggcuuuaaucuccccuggcacucuaagugcuccucggugcugggucaacagcauagucacguggggaggggcuggugcugggugcugggaucggggccuucccagccacagcgccacuguggcccucuccccacagggaacuucuaauggauugggguccauagaugacaucgaaacagguaauguccccgauacgagggaacaaguggaaauuggggccccgagaggucaggggagucgagcccccuccccaucccagcccuguagaugggagggccuccgagggguuccccacccugguacucccugaggcaugggagaaaacaguggguugagagcuacagacccacucaaggaggggagggcaucucuagucuggcagagaggggugcugccucuuagcuaggugcaacagucccauggccuucacuccuggcugccugcacacccccaccucuuccaaagcccuuuccccuccucuuccucauuggcuuccagaaaagguugccuuuuaagaguguccccuggagagggcauugcuuaccccagaagaaggaggcagcagugguggacauuuaggcauugagccugggccaaggauugacaucauaggacugagggccccucccugcucuggggcuguggccuuccuugaccacccccugagcaucugccagugggaucagccgauggggaaggcagggcuccuggcaagagcugaaagaagaagggaaaguguuggaugagcaucacggggcccgggacgccuccuccacccucaccaagcagugcuccccuucggcucuugcccaccccauccgcagacugcuacguggacccucgaggcuccccagcccuucuccccuccacgcccacgaugccccuguucccucacguucuggaccugcuggccccccuggacagcagcaggacccuccccagcaccgacagccuggaugacuucucagacggggaugucuuuggcccagagcuggacacccuccuggacucgcuggugagccacaccacccuccuugugcuccccugauccccucuccccgcuguguccccauugucccagggguggagggaaggccccaaugcucaugucaugugucucaggaggaggccucaguagggacuuguuugguacagaaaugaagcugcacacugggcacgguggcucacgccuguaaucccaauacuuugggaggccaaggcagcggauuacuugaggucaggaauucgagaccagccuggccaacguggugaaacccccucucuacuaaaaauacaaaaauuagccgggcaugguggcacaugccuguggucucagcuccucaggaggcugaggccggagaaucgcuugaacccgggaggcggagguugcagugagccgagaucacaccacugcacuccagccugggcaguggagcaagacuccgucucaaaaaaaaaaaaagaaaugaagcugcacaaugucuggccagaagggaccauagugagcccugcucccacaugggacaggaugaagccaggcgacagggugcaggucuccuugcuuccccaaguccugaugcugcccaggccugggcaguccuguuuuccucugaccccucccucugucccugccucauagucucugguccaggguggccugucuggcagcggcgugccuagugaguugccccagcugauacccguguuccccggcgggaccccacugcuaccaccugugguggguggcuccaucccugucuccagcccacugccccccgccuccuucggcuuggucauggaccccuccaagaagcuggccgccucugugcuggaugcccucgaucccccgggccccacgcuggacccccuggaccugcugccguacucggagacccggcuggaugcacucgacagcuuugggucgacacgaggcucccuggacaaaccugacuccuucauggguaaggccaugggugggcccguucaaccucccuggacagguugcacagugcuguggccucuuuggugccuggagaguggaguugaguuacagaucuguuuguccccaucacuccuuagcaaucccaggccaugucuguguguugccgucucugcagugcucagcacaguguggggcugggccugaggggugggugucuuguucaagaucaagcagaggagagcugcgacaguccaggccucuagacucccagucuggugcucccugcccagccucccgggacccugggucaccaggcuggugagaucccaugggaugauccugaggcugggggcggagcacaaggucauggccucccacugcaccacucugggcugggugccagggacccagggaggaagccgucuugucugggcgcugguggggcuagcuuucggcagucggacacagcccagggcacucgacugagagggcuuaacgggacugucggggcacggaggggacuucacucagccucagggccaaaggaggcuuccuggaggaagugaugacuaggcagggucuugaaggaaaaguucaccugccaggcagaggaagcaggggcacuagccuggcauggcauggcgcggggcuggcugaugagcggagcagcuggggugggggccuuggucuccgaggaccugggagcaagcuaaggaacuugggcuuucuccuacgggcagcgggaagcccuggcaaguuuaagcaaagaguggacacacucaggcugggaggcgucuuugccccuggggaguggagaggagaggauagagucagggguucagcaggaguaggagaggauguguggccugggggcuucuccgagucagcaauacauaaggggaagcccuaggaaggccccucacgccucagagccagagccacugaccccugugucuucucccugcccagaggagaccaacucacaggaccaccgucccccuagcggugcucagaaaccagcccccucggugagugacuugaguggggauccaggccucucauucccugcuggggguuguggguucuagaguuggggaaugagcccucugcaugggguaaggcacugcauuccccacggcggggcacucccagaguggauggaucaaagaugaucaccucgugcccuuccucaccaagccauaugcugggcgggcacacagagggcaccacugcccuugucugauggaagaauucaagucucagagagugaagugacuuccccaguguuaguagcaucccuggucuccagacucaguccgguccugaguuuaaaagagcaucugggccgggcgcgguggcucaugccuguaaucccagcacuuugggaggccgaguugggcggaucacaaggucaggagauugagaccauccuggcuaacacagugaaaccccgucucuacuaaaaauacaaaaaauuagccgggugugguggugggcaccuguagucccagcuacucgcgaggcugaggcagaagaauggcaugaacccgggaggcagaguuugcagugagccgagaucgcgccacugcauuccagccugggcgacagagcgagacuccgucucaaaaaaaagaaaauaauaauaaaagaacaucugaugaggggccaggcgugguggcucaugccuauaaucccagcacuuugggaggccgaggugugcagaucacaaggucaggaguucgagaccagccuggccaacauggugauaccccgucucuauuaaaaauacaaaaauuagcuggguguaguggcggacaccuguaaucccagguacucaggaggcugaggcaggagaaucgcuugaaccugggagguggagguugcggugagcugagagcacgccauugcacucuagccugggcaacaagagcaaaacuccaucucaaaaaaaaaaaaaaaagagcuugcuacacucugaccuacacuagcugugugguccuggggaauuucccuaaccucucugagucuugccuuccuccccaucugcugaugacuugggggauugggggagggcaugagcacaggcugcaaucacggccccucccauuucuaugcuuucacauucaacuugccuucaaagaaaggcucagagccaagacccaggucacccacuagccugggaccauaugcugggaccaaggugguccugauauuuuagacucuuggaccacauuacaaagaacuccccuggcugggaggguggaggaagaggaaggguccugggcugugguuuugcucuuggguaggauaggggggucauagagcacuccccacuucuggugcccuggcuggccccaguggccucagccaucauccagugcccacaauggccuccuuccuccugucacagccagagcccugcaugcccaacacugccuugcucaucaagaaccccuuggcugccacccacgaguucaagcaggccugccagcucugcuaccccaagacagguaaacuuucaccuguagacuccaccccucugcccagagaacugggaaucucaggaacaugggaucccagaucaaaagaaucccagugucucaguuggagauaagugccagaaaucagaagccccucuggggcagaaaaggaaaggggcaggaguuuggggucugucccugccaggcaccaccuucacaguccuuucuagagaaacacuaacauggucagacucacuagagagugaggacggugguagaaaaaggauggguaggccggaugcgguggcucacaccuguaaucccagcauuuugugaggcugaggcaggcagaucacuugaggucaggaguuugagaucagccuggccaacauggugaaauccugucucuacuaaaaauacaaaaaguagccaggcuugguggugcucgcuuauagucccagcuacucgggaggcugaggcaggagaauugcuugaacccggaaggcagagguugcagugaguugggaucacacuacugcacuccagccugggugacugagugagacucugucucaaaaaaaaggaggggggaugggugccaagaaugggcuccuucgaggggcuucccccagcacagucccccggucuccagggagcaaguagccaggaaggguguggugggagcuggcaggaggcccucagaggggagguagguauauaaggagggggccgauuccuacccaccgcaugggccugccagccaucacucuucaauucugcuuccggaauuaucauguguguccacccugcccauaggcccccgggcuggcgacuacaccuaccgugagggccuugagcacaagugcaagcgggacauccugcucggccggcuccggagcucggaggaccagaccuggaagcggauccggccccggcccacuaagaccagcuucgugggcuccuacuaccugugcaaaggugggugggcugcagcggggcaggcagcacagcuggggcccagccccuccacccccagccgcugcucuacuccccaucacagguagacagaacaggggugggccucacagcugcacgggaggagaaagccacggccuaggcuccuggggcccgugcaggaugaauuccacaucagaaugagcgucuucuucccuuagcagcuuccagaggcaggugggacacauuugggacauucagcuggagaccgagcccgucacuggccugugcucuggagugucaggagccuacaugacucauagggggcuggcuucucuuaccacuguagggcccugaggggccgcggggcagugugcccagcagccacaugaagcauuuaggacuggcgcauggugagggcuccauccacuugagcucucugucacucuucuguugucacuguccucauuucuggcucacaucagccugguugguauuuaauggacauccaucaugucccugacuagcuucuuucuggucccagccaagcgccuuggucccgcuguacggcgauaugugaauagucacgaauugcuaaggccuucccaguguagcccuuucauuucaccagcaugcagccucacagcucuggaggaggaaacggaggcuuugagagugcacccacggcucugccucucccccaaccuggccccuagcaguggcccgcccaggccuccugaacuugcuccuuguccucccagcagccaggcuggucuaaggacaugucacucuugggucaaaggccuccaucagccacugcccguggccagugggaugaaguccacauucugcaacaagaccuacacgugcccguauccacccccucaccccucugcccuaaccauuccccaaaugcacugacccucccugauuccgucacacacgcugugcccuuugagccuagucacccucugcuccuccuucaagcaccgccugaaucuugggaagcccuucucugcggugcuuccccuugcaaucacccccacucccacccagggaucugccccacuccuccaggucuguggccuguuuguccuugugcgccaagagccuggcagagagaugggacaaggcagacuuagagugggaggaggagaaagaaaaacaggucccacccccaggaaacagcagagcuccagguucugagccaccuuuccucucuccagauggcccagcccccagaaauuuuguuuugguuuguuuuuguuuuaugagacagggucuugcucuguugcccaggccagagugaguggugcuguuauagcucacugcagcuucaaccuccugggcuuaagccaucuucuugccucagccucuugaguagcugagacuacaggcacaugccaccacacccagcuuauucuuuaauuuuuaacuuuuuuguagagauaggguucuuaauuuguugcccagccuggucuugaaguccuugccucaagcaauucuccugccucagccucccaaaguccuaggauuacaggcaugagccaccauguccagcgcccccgccagcuuuauguauuaucucacuugauuccaacaacccagucuccuccauucauagcaaagacagcugaggcucggggaguaaugaggaauccuagcccaauucugucugacgccaaauuacaugcucuuaaccaugcaguguucuuuuccuggugaauaauuauuuuuaaaucccuuauauuugccagucacaguggcucaugccuguaaucccagcacuuugggaggccgagggggguggaucaccugaggucgggaguuugagaccagccugaccaacauggagaaacccugucuuuacuaaaaauacaaaauuagccgggcgugguggcgggugccuguaaucccagcuacucgggaggcugaggcaggagaaucacuugaauccaggaggcggagguugcagugagcugaaaucgugccauugcacuccagcaugggcaacaagagcaaaacuccaucucaaaaaaaaaaucccuucuauuuauuuagagacuuguauacuucuacaaaagcaauccuguggggugagugggguaggagugauuacuguacucugcagguguggagugcagaagcgggccuuguauuuggaaaggaauuuucagcccugccaaguccuggcagcagggggugcagcagacccugccucaccugcguuggggugcagaagggggccugguauuuggaaaggacuucccagcucugccaaguccuggcagggggugcagcagccccuggcucaccuagcuguguugggguggagcgaagcccugccuggcucauggggccagagccccacaggccgcagcgggguggcgagggugcugcgggcugcuauccccgccuggcggaacguguguccuguugccucuuugcagacaugauuaacaagcaggacuguaaguacggggauaacugcaccuucgccuaccaucaggaggagaucgacguguggaccgaggagcggaagggcacccucaaccgcgaccugcucuucgacccgcugggggguguuaagcgcggcagccucaccaucgccaagcuccugaaggagcaccagggcaucuucaccuuccucugcgagguacugcccacccacccacugccaccccauaggccauggcacagacagggcuggggaugcucccuggcacggaccaccauaggaagucagcccuggaacccgugggcuguggaggccuggucuuagaaccaguagguccuggagggucaguaagucugggcccuaggauccuaucuugcuagaggccagaucugauccagcccccucauuuugcagaggcagaaacugaggcuggaaagaaaaaucauaacccucacaccugcucuuuucugacagccagucauaggcagggcuuggcacgugguuguuuucguuucucauuccuagccugaugcaguggcucacgccuguaaucccagcacuuugggaggcugaggcgggcaaaucaauugaggucaggaguuugagaccagccuggccaacacggugaaacccugucucuacuaaaaauacaaaaauuagcugggcguuguggugcacgccuguagucccagcuaguugggaggcugaggcaggagaaucacuugaacuggggaggcaaagguugcagugagccgagaucgcgcaacugcacuagagacuccaucucaaaaaaaaauuaaaaauuagcugggcuugguggcaugcgccucccgucccaguuacucaggaggcuaaggugggaggauugauugcuugcguccaggagguagaggcugcagugagccaagaucgaaccacugcacuccagccugggugacagagugagacccuauuccaaaaaaaaaaaaaaaaaaaugucauuuccaucgucacggcagugcuggcaggcagauauccccauuuuacagauguugaggcugagauucaggguagcgaggaacugcccucagccacacagacagugccgugcagaacugagcuucaaacccaggcagccugucccuggagucaugcccaccucccagcaccagcugcugcuggugguccccacagccaaacccccaggacacaggcagauugagggccuguccggggcuucccccgcaucccuuguuguggguaugauguauuuggcacugcuuagccgucccaagcgccguguccacggccccacgucucaggccuccuccacaugccuuuccucggcccuccuggcuucaguggccauugcgcuucccugccuggguuugcccuccccacagggcgcuguccuguguuucugggcuuggaaccucucagcuggacucugaucccagcagccccacugagcuguuaauucccuccccaaagcugucccugaagaccccgcuuggccuccggagugaacuuggccccugucuccccacccagucauagcauguugagggcaggggcaguggcacgucuguguccguagagcaagggcuccagguccggguugcuggcaggguuuggugccgcucaguccaacccucaucccuggcaccaccagcccuuccccuagcucuuccaggucgggacuugugccaaccccccacagggagcauuggccugggaaucauaguucauagccaggugacagccuguaguucauaaagaacuugccauuccuuuuuaucuuuuuuuugacaugaaguaacccccugccucaggcauugggaguggugggaucagagggagggaggagggugaggaagggagccaaagcccaggucaccugugagcuggaagcagagaggcaagaccacagacccugggauucccuuccucacuccucugacccagggcagggcuugcagggacccagcuguccuuccccagcuagcuguguggggucccagcucacccccuucccagguggccaugccaggucccagcccuuccccucccugggcagaucugcuuugacaguaaaccccggaucaucagcaaaggcaccaaggacucuccgucugucugcuccaaccuggcugccaagcacagcuucuacaacaacaagugagugggacccucagcccaggcugaggccuaggggccaguggagaguccccucaggcagcucagauggcugaggaaaggcugaacugaaaggguggauguagggugcaaggaaaggggcagaauuugggaaucaaauccagccuccaccuggaaaggaugagaaucacauuugucgaacaucuacuauauuccaagcgucaucuuggguauguuaauuaucuuagcaauccugugagggaggaguuacuggcccuguuguacagaacaaaaagcugaggcuuggaaguagcuuacuuagcuuacucagcuuacucagcagacagcaagcggggggccucgucucugacuguagcccagcacccuccaaugucaugacaucagugucaggcagugaggggaggccugggucaggucuggcaccaccccuuucucccucuuguuccccuugguucugccauggugugcauauggagcccagggccugcagucagacagaccuggguccaauuccugggccaguccugucuuacguccaagccuggguuuccucgucuguaaagcugaugaugcucuaggcuccuggggcugcagugaggguaauuaagacuccuggcccagaggacaugcuugguuaguguuccucaggaugcaggaccggcucugcagaaucaagcuggaaaccugagggcggugcccuuugcuuguuggcagcuccaucuuugaacccugggggagggacaggaguaaagcagcgcugggacccaggcccaggggugccugagcauaggagcccuguuucugcccuccugugucauccauggccuggauuugguacauagaucagggggugcccagggagagccuggcacugggaagguggcccuaccaggagagaaggucagaggggcugcggacugcaucgugccccuccugccugcccgcccgccaggugccuggugcacaucguccgcuccaccucccucaaguacuccaagauccgccaguuccaggagcacuuccaguucgacgugugccgccaugaggugcgcuacggcugccugcgggaggacagcugccacuucgcccacagcuucaucgagcucaaggucuggcugcugcagcaguacucaggugaggggcaggcggugcagguggagggcaggugacucaggugagggguaggcggcgcaggugaagggagcgcaggacugacuggggugacaggccagggccccauggucgcuggagggggcuucgggagaguucaggagagguggcugcggggugggcucucugugugucccaggcaccacagaggagagaagcucugcucucagggcgcuuccaggcucggagaucuggguuuuucccuucguaggcaccguccagggagcacggagaggggagaggagcaccugggcuccugcagcaggaccucugcuugcucccuggguggucggcagcaaguccccgcuccucacugagccuccagugcucaucugggaaauggggagccccaucucuuccucacagagcugcugcggggauuggaagguguucuccacucacccaccagggauuuacugagcaccuucucuugucagggcauucagccauggucuagucgaggcccuuacuuucagagaaccuacauuuauaagugggggccagacagauaauauaucaacaggugaauaaauccuguauuccauccauucuaggaugcacauuuaccccuacugccugucaucauuuaauuagcagcauuuuguggggcggggauuuaaaauaugguacauauaacauucagugucugcuuagaguuggugaaaugcagugguagcauuucaggcgugccucaguguuaugaggaagauaaagccgagcaaugggacagagacagacucggggaugggagcauuuuagguaagauggcugggaaggccucucugaggaagugacuuuugaccagggaagggcggggagugcauuccagaagagggaccagacugaagucucugaggcaggagcaagcucugcacagaaaggauggucccuggggguagagcagcuuagucaguagaaggggaaugaggccugagagguuggaggggacugagcauguaagagucucuaggccuuaaacaggaacaacugggguuguucuaaauaugauuuacagugucuggaggaggguuuuaaguggguggaguuauaugaucugaucaguacuuugcaaaagucacucuggcugcuggguggagaucgaggagcaagggcagaagccgggagaucagggaggguggcucgggccaggguggugaugcuggaggugggagaagugguuagauucuagguguauuuugaggguggagccaacaagauguguugauggaucagauaugaaguaugagacaaaggagagcgucaagguggacucuaagaucagagcaacaggaagaauggggcuaccauguucuaagagggggcaggcuguaagaggagcagcucaggcucagugugggacgugggaagucugagcugccugguggacuucacauggagauguuggaagcagcagauguggggaucuggagguucacaggaaaggucuggccuguagauacauacuugcagaucaucagcaagaaacuggaugucaagugcagugucuugccccaaguaagcaccgaugaugauuagcugucguggagcaggggccauaggucaagguggaaggccacaucuguugugggaaagacgugagaaagauggagagcgcugaaaagagggcaggcuucauggaagaguugugagcuggaucuccaaggucgggcucaguggcaacagucugaggcuggcggggagacagacuggagaguccaugccaccaggcugggguauuugcccuuuggggacuggcaguaaagagccgugguaccacagugaaccggugagccaggcugggcaggcauggagcccuaagugccagugaggccaggggcugccaagcaggcacuaggcuugcagcccuguugagggagaugggggucagggaagggugcugagucaccggcccaagagacagggucacuggcaugggagcagaggacucccuaccacaguacagagccaauaucuuucuacugcauuuucccacucuuggcugcauuuaauucuuucacuuccagugaggcucggagcaggucuuuguucccauuuugcagauggacaaagugguucccuuguaccccaugucuuacuguggcugggcugagaauagggcuccuccagcugggccucgggggucccuggcaccucguggacccccugccucccuccuugcugagcaccuugaaagaugccugugucugcccccacccuccccaggcaugacccacgaagacaucguucaggagucuaagaaguacuggcagcagauggaggcgcaugcggggaaggccagcagcagcaugguaaggccuucugauacuaugccauuauucagauuuugugaauuguccccaaauuacaaacaggaaggcucuaauuuuacaauagagaaauguuuacaauggaggcaccucgaauaaguuaugaaaguaacuuggauaauguacacauucagcuguugugucucauuuuauuuuauuuuauuuuauuuuauuuugagacagggucuugcucugucacccagccuggagugcagugguaugaucauggcccacugcagcuuccaccuccuggucucaggugauccuccugccucagccuccugaguagcugggauuacaggcaugcaccaccacaccuggcugauuugucuauuuuuuaagaccgugggucuggggauguggggcuugccaucuugcccaggcuuaucugaaacuccugggcucaagcaauccucccaccuuggccucccaaagugcagcgauuacaggcaugagccuugucgugucucuuuuucaucucccuugaugaagaaacgguucuuuagucuuugccuuguguugcauugagguuuuugaagagccagauguuuuguaaaagguccaucccucugggcucgugugaguuuccucauuccacagaggugaugucguguucucagcucacacaucaggggaugcgucaucucagugugucccuucacuggugacaaucuaauuaaacuuucauaacuugauucaaggugccuccauuguaaacauuucucuauuguaaaauuagagcuuuccucuuuguaauuaagacuauacuuucagggaucauuucuauaguuuguaauuaauaaaggucuucagaggcccggcgcaguggcucaccccuguaaucccaccagccuuugggagacugaggcgggcgggucacgaggucaggaguucgagaccagcguguccaacauagugaaaccccaucuguacuaaaaauacaaaaaauuagcugggcgugguggcgggcgccuguagucccagcuacucgggaggcugaggcaggagaaucgugugaacccgggagguggagguugcagugagcugagaucacgcuguugcacuccagcuagggcgacagugugagacuccgucucaaaaaauaaauaaauaaauaaaaagucuucaggaggccuggcgugguggcugacgccuguaaucccagcacuuugggaggcugaggugagcggaucaccugaggucaggaguuugagaccagccuggcaaacaugacgaaaccccgucucuacuaaaaauacaaaaaaauuagccgggcaugguggcgggcaccugcaauuccagcuacuugagaagcugaggcaggagaauuacuugaacccaggaggcagagguugcagugaguugagauugugccauugaccuccagccugggugacagagugagacuccaucucaaaaaaaaaaaagaagaaaaaaaggucuucaggagaaauacguugagaccuuguaaauaucccaguacugcucggacugacaccacugauugugguauccccucccaucccuccugaucuucgccaugguccugaagagagcaugggauuguggcauuugcagauggggaagcugaggcugagagauuguuagugacuugcccaggggcacacugaguggggcaauucccagguucucugacguccuguccggggcucgcucuucucccuccccaccugcggcauuccuguccaucacccccaggcggggaucagaacccuggcccucguaucuccuggggugggugugaggcucacaggagccaaccuaagcugcccugugcucacaucguccccagguggugggaucacuguaacuguagaugacaguggaggacccucgggcucagaggggugggcacagcgcccaggagacaguaagugugagaugaggccucugugccauccaggcaugagcacugacccuuucauccacaugaggccaccugcugauuaacuugggggaaggcugggccccuggacccuucaagaggcugaccaggguguggcagggagcagggcaggcugccggggggucccugggccaggcuggcuggcagggcugcccaccaccucgagcauucccuugcucccugacuucuuuguuccugguccucuucucuuuuucuccccucuuccuggucccugcugcccuccaucagucuccugugcaguccucuuuuccccuccccaucuguuucuuuuuccuucuggccaggagccuggcagggaaggagugaggggcuuaugggaccuuugaaagagagaacacuagcugggugugguagcucaccuguagcccagcuacucaggaggcuguggcagaaggaucccuugaggccaggaguuugagaucagccugggcaacauagugagaccccucuugccaccugcuauggcaaggagcuggugagacuaugcagucaucaacgugggcauggggucuggcucuaagggaggagcucaggacugcaguggcugucauuagugcaguggcuaagccaccauacccucggugcccccuuuaucucgcccaagaaaugguaauaaugccuuccucucacgcuucuugugagaauggaggggaacacccagaagucaguagccacauggguccacuuguugccugcuccagugcaggccgucccacgcguaaaggcaugaccucaccuuaucaucagggucacacguguguuauucuggggcugagcagcccacgaguuguccagcaccaggccaggggucagucagcaaugaggacagcuccuuccugcuccagggcaggcccugggcagggcaaugcuggggacacgguggggaguaggccacagcuucugugggggaguuccuauggcaggaggaucaugcccagcagccuggaagagcaaggggugacccugcacucgaggcuccugggaagacggggaggcuugagguuauaugagggagaggggacagcuggugcauucacagaacagcaggcuggccaauguagccagcugaggggguucaagguggcaggagacaaggcagagugagcauuuuuccuaccucuggcccccaacccugucccgggguacagaagagcaggccaaaggcuggggcguaggacagagaaggaacgugguggguggggccuuagagaccagcaaggccuugcccuggagggagggccagagaccagggccacucagacgccugucccaccgcccaaggcugacuccugccaccaccacccuaccccugccgggguggcuucccaucuccuggaccccccgcucuacagguucggcacucauagacgggugagucggucaacaggagcaguuuagagacugugggagcucacugaauggacagcugcagcuuaggagagcuccggggcaggcuucccacaggagaugcgcuugagcugaguuuugaaggauaguuucuagaacaggcuggaugaagaguggaggaagggcagcgggaacagccuguacaaacgcagggagguguggcggaacggagcuuugccaugggaaaugcagcauccacaaagcaggccucccagggaguugggcgaggcagggaccagccacagaggguggaaagaggagccccguuccaggccuggcucuccugggaagcccuugggccugcaguugggaggucacugccugccaggaagaccugggagcagaccagcuuauuccaaggcucucccagaggacaccuguguggagacuccagggccucaggccuggugccugcagcuucaccaaccccccuccccauccccccacagggugcuccgaggacacaugggcccagcaccuuugaccugcagaugaaguuuguauguggccagugcuggagaaacgggcaggugguggagccugacaaggaccucaaguacuguagugccaaggcccggcacuggugagugggaugccaggugggggcucaggugggauggggccacccuaccaccacagguguggaggccaacugagagaggccagggcucuccacagaggucacacagcacacaggcugugcccugaccucuccccaacccugcucuguccugcagcuggaccaaggagcggcggguccuucuggugauguccaaggccaagaggaaaugggugucagugaggccacugccauccauucguaacuucccacagcaauacgaugugagcgcugggauggggggcugggggucccccaggaggcagcgaugcuuuccagcgggacucagaggaucuccccacgcccaccccacagcucugcauccaugcacagaacggccgcaagugccaauauguggggaacugcuccuucgcacacagcccggaggagagggacauguggaccuucaugaaggagaacaagagugagugggcagacggggcgggcgggcccucccccggugucucuucagugcugaaugucucaauucaccagcgggcccaagagcguccacugcaccccuuugcuaccugggcccuucuccaccugccccaugccgggcccucucugaggccaggcccugaggcugagcggccuaucagcaggacuugggacgcccacggcucccaaaucaaguggggaccauggggcagaauggauggagaagccccucagcaggugcccugucccuguccccugcccaguccuggacaugcagcagaccuaugacauguggcugaaaaaacacaacccaggaaagccuggagaagggacccccaucaguucucgggaaggggagaagcagauccagaugcccacggacuacgcggacaucaugguaacgccuccgcccugcaugcucggggcugcggucggggcuguggucugagccucaccugggaggggcagccuggagggcccagccggccagcgcucagccucuccgaggugggugguccgggcagaggugugggggagcaggcacccaugauggcugugcucccagaugggcuaccacugcuggcucugcggcaagaacagcaacagcaagaagcaguggcagcagcacauccaguccgagaagcacaaggagaaggucuucacguccgacagugacgccagcggcugggccuuccgcuuccccaugggcgaguuccggcucugcgacaggugcuccugggagggcagggccuggcgggacaugggguggcccgaggagauggaguccguggccagcucuggcuccucuuggccuggagguggugugcagggaguggugaggcuuggcugugacugcagccaugggggugguggggaaggguggaugggagggcugggcucagaccuaucuagaccuuuaauuugcagcuguggggcagaucccagagagggucaggacacccagguuuucccugagcugggacccagcugcccagggagaggcuugucuucggggaggucaagcggccggccccagauggacagccuggggugggaagggcacagagcucgggcagugagccuccugccacccacaggcuccagaagggcaaagccugcccagauggggacaagugccgcugcgcccauggacaggaggagcucaacgaguggcuggaccggcgcgaggugcugaagcagaaguuggccaaggcucgcaaggacaugcugcugugcccacgggacgacgacuuuggcaaauacaacuuccugcugcaagaggacggggaccuugccggugccaccccagaagccccugcugcugcugccaccgccaccacuggggaguagggccagguguuggccgugggugaaguccuggggucagggggugggguggggccagaaggccugauagaagggucagggcaggccagggggguggggggccgcccucaucaggcagcccccagcccccugaggcccuguccaucuucuccccaccaccgccccggugugcguacccaggcgcacgugcugcagcccccggaggccccgcugaaaccugggcugcccuucccccacccccacggcucuccugguugaggagggaggggccuggcugaccccuccagcuucagccuccagcuuuaacuucugucugcuccuaaugggggcccaaagcucagggcuggggagccugggguccccacuugaaucuccagcaggaggguccuucucucccuggcccguccuccucccacccccucccccugggggcaaaucaggacacaacagagggcagaggccccauuagcuuuaaaauguagccccagguuggagcugggaacacuguacuggccacuuacccucuggggccucagcuuucccuccggaaggcugggaggaggugggcuagaugaucuuuggagcuuaaggagucccagcccuuucucugaugccaccaccugaacccugcucccucgugggccagugaaaauagacuguagguccucagagccuucagagaugauccagcccaaaccccauuuugcagagaggaaaacugaggccuagaagggaggagugguccacccacggucccagcacaaggcagagcugggaugaaaacagggcugaaaagacucagggccaauuauuggcugagcccacgguccccucagcagggaugcgauggucucugaaucagugugcagcuggggucccaggcagcgcugccugggggcuggggaggggaggcccagaggagggcuggccaugugagcaccccaugaagggaccgcccccucccaaggauggucccuuugggugcagcagcagaggucaccuccugacaugcgcucugggaaagguggcagagggcaggacaccaugagcucaggaucugugugaggugugggaggugggaagggugagggucugggggaaugcggagaaaagggaggcuugaccccgggcaccaugggccacuccaggaugggacacggccccucuuucuuggggacccaguauguccucuccucuagacccagacauacaguuauaaccgucuguccuagccccucccuaaucccuggcccucccagcugucugggacuucaguggacccccagccccugcccccacucaccaaggccucgcucgucccucucgucugacaugucugugugcaccccccuccucuccacccuaccuuccaucaaccagggcagauccaccgugcccugguuccccagacauuccagaaugccccacaucauuggcacaggaguggggcagccccggaaggaaccagggauuaggcuguaggggggugagaaggagagaagggaccaccccauucuucucaagcaaggauugccagcgcgcgcugacacagugaugggcugcccagggcuggaggggacgcuguuccucccgccgccacugcccaaccuuuccugauaaucguggcaugcgcccuuuccucuucccugccccacccccuggccgcagcaggccagcacugcagaguuugggugcuggugguguggcuguaggggaggggagaccacacccaaggugggggcuguggccauguguggccgugaugucgaugauacucguuuucccugauccgugguguugcaguccguugucaccagccuuguuucuaguguguauauaugucgcccccgugaugcauauauacacagguauuaaauauaucgcucuauauaauauuauauaugugugugguauccaaggaaucacuuuuaugagggcuaaagauaaagaauuuggccagaaaaugcagccauccuugugugauuaggaggguuucaggggccacuggacuauuugcaaggugacagggacuggagccauggcucagaggugauucgggcagccagggacaggagccacccuccccaggcccaacucugcuagcuucccagaccacccccaucgagugcggagagagugggagugcucagggaaagaaggugauuuguauuugucuccccgcugaaaagaacaggauucaaguccagaguuuucaucuucagccugugaucuguccagggacccuugggaucuggggcuuccuggccuggccagagcuggagcccccacaggguaaggaagagagagugggaggcagagugugauggggaggagggacaggaagacccuuuuaaugaugaggguaacuauuucaguugugagccuucuagggccccaggcugggaggcucagaggacugaaucugggaccuguguuccccccggcaggcagggacaagauggcauggcaagcaugggggcgggguggguggggagggaugcugcauuucucagcugggcaguaaucaauuuaaugguccuuuaaaaugucuguguauuaaaaauuuaagaauaccacacuuuaauauuaaauauucauaaggucuaguaucuugauaauaauguagauguuuuaauaacaauuuuuguccuucuuaaaauaaaaugaaagaaacuugcuucccuuagccuuuguucuagaaaauaaacuugugcacuuuga

SEQ ID NO: 192562 - RNA, 12982 nt, Homo sapiens
aucccugagcugcuucugccguugcaucuucgggacuccgccccgcgcgcggaccugcagccauggcagucaccgcccaggcagcccgcaggaaggagcgcguccucugccuguuugacguggacgggacccucacgccggcucgccagguaggacccugaagauuggaagcucccaccgggagugucacgcggacacccccgaggcugaguguggggucugcagcagcgugaccguggacacccggggaccgagugugggaugcggcgguacccggcccccugacauccggggccacccaccgggagugaggggaccuggcccucacgucacugaccccgcagcguccuugccuguguucugcuugggagugcugggguuggauccaguacuggagggaggaggcugcgagcaggggccuagcucccucccuccccggaggcugucacacgccgcuaaggccuggcucacggacgcccccgccuccugagcuggggaucccacccuaguucagcccuacgacacaccaguggucggagcuggcuucugaaccgggguuccaggcacacaagcacacagccaagcgucagucaucaucuggugggagacagggcgucucggagucuucccaccccgaccuuugcaggccugggacugggucuaguuucugaagccccaucacccacuuuaccuuccacccccagucguggagcagagagggcuucuuuucaaauucguuuaugagcucuacccacccggaugugagaggcuccaggccuagccuguuugcugugaggacacugaggaauagugaggguaagagucuaguuuucuucuaaagacucucgcuguguugagccucuuaccucugcucaguuuuucucccauugggucucauugugagugaguccccaaaagcccccucaccagcuggaugcaucaguaagcaggcuucauucaugcccucccuguggguaacccacccuccagucugggggccucaaggaccaaccaacaggucuccuagcgugggggagcagugggaugggcuuuacugggcaguggcugaugggaacccaggucuuagccuccucucuuaggucccgaaugccccuccccauccucuguggugaaguugcccuggcuugggcccuggaggccuuccugcagggguggauccgggaggaagauagcaggacuggagcaaaggugggccauuugcuugugggucacgccuguaaucccagcacuuugggaggccauggugggcagaucaccugaggucaggaauucuagaucagucuggcuaacauggugaaaccccgucucuacuaaaaauacaaaaauuaggcuggguucaguggcucacgccuguaaucccagcacuuugggaggccgaggcagacagaucacgaugucaggaguuuaagaccagccugaccaauaucgugaaacccuaucucuacuaaaaauacaaaaaauuagccaggcgugguggcaugcaccuguaauccuagcuagucgggaggcugaggcaggagaaucacuugaacccgagaggcagaaguugcagugagccgagaaugugccauugcacuacagccugggcgacagagggagacucagucucaaaacaaaacaaaacaaaaaguagaugggcguggugucgugugccuguagucccagcuacuggggaggcagaggcaggagaaucgauugaacccaggagguggagguugcagugagccaagauugugccauugcacuccagccugggcaacaagagugaaacuccgucucaaacaaacaaauaaaugaauaaaagaacuggaacaaaaguggcagggccuaggcacaguucugacuccucccucugaccuuuugcuccacaaacauaacaaccugaauaagaacagccuauuaauuugucuacgggccagccucugugcuuagugccuuuugaaaguuaauuuuuaaucguacacauuuucaugagcacacucuccugguaaagaauggaaacguaacagagaaggguaaaguccacucugaccgcacuuggggagccuggccggcuccccaaguuaaugugguuacugugguguggcuucccuccaggccuuuaucuggaucuauuugcccagagcaaauauuaagcauuguuuugugaggcuauuuuuguuauuguucuuuggcuccucaaaaaucaacuugauugugaugcuauuuuguuguuguuguuguuagagaccggggucucacucugucacucagucuggagugcaguggcgcuaucacagcucacugcagccucgaacuccugggcucaagugauucucccgccucagcuucuggaguagcugguagcugggacuacaggcaagugccaccaugccuggcuaauaucuuuuuuuuuuuuuuuuuuuggagaugaaaucucauucuugucccccaggcuggagugcgauggcaugaucucgguucacugcaaccuccaccucccggguucaagggauucuccugccucagccuccugaguagcugggauuacaggcgcuugccaccacgcccagcuaauuuuuuuuucuuuuuuuuuuugagacggagucucgcucugucgcccaggcuggagugcaguggcgugaucucagcucacugcaagcucugccucccaaguucacgccauucuccugccucagcccucccgaguagcugggacuacaggcgcgugccaccacgcccggcuaauuuuuuuguauuuuuuaguagagacaggguuucaccauguuagccaggauggucucaauccccugaccuugugauccacccgccucggccucccaaagugcugggauuacaggcgugagccaccgcgcauggccaauuuuuuuuuuuuuuuuuuuuuaauuuuuaguagaaacagaguuucaccauguuggccaggcuggucucgaacuccugacaucaagugauccacccuccugggccucccaaagugcugggauuacuggugugaaccaccgugccagcccaugccuggcuaauuuuuaaaaacuuucggccaggcacgguggcucacgccuauaaucccagcacuuugggaggcccaggcggauggaucaccugaagucaggaguucaagaccagccuggccaacauggcgaaacccugucucuacuaaaaauuuaaaacuuagcugggcaugguggcaggcgccuguaaucccagcuacucgggaggcugaggcagaagaaucgcuugaacccgggaggcagagguugcagugagcugagaucacgccaucgcacuccagccugggcagagguuucagugagccagaaucacaccacugcacuccagccuggaugacagaacaaaaauucgucuccaaaaaaauuuuuuuuuucauagagacaaugucuuccuuugcugccuaggcucuagucucaaacuccugggucaagugaucuuucugccuuggccucgcaaaguguugggauugcagaccugagccacaguguccaaccugucuaauuuuuggugucuaagcuuuguacugcuucagauccagguagaaugugggcuuccuggguucucagcacuaagugagggcuaaguggaggucccagacauguugaaagccagaaugcuaugcuuccccucuccccccauagaaaauugacccugagguggccgccuuccugcagaagcuacgaaguagagugcagaucgguguggugggcggcucugacuacuguaagaucgcugagcagcugggugacggggaugaagguaggagugaggcuggggguagagggaguggggaguuugagagauuccugggcgucuucaaagauccaguccugcuucuguggggcagaagaaauagagagagagcagccagauaguucccuuacugauuugacaaacacuugagcacuuccuauugccagggauugugccaggcccuugagaaauggcuggggcaaagcaagcagaaccugcccuuaugcaguuuacauucucauuucucccugcugagucuugauuuccucaucuuuaaaaugggcugaaccagccggcacaguggcuuacgccuguaaucccagcacuuugggaggccgaggcggauggaucacuugagaugaggaguucaagaccagccuggccaacauggugaaaccccgucucuacuaaaaauacaaaaaauuagcuggguguguuggcacgugccuguaaucccagcuacucgggaggcugaggcaggagaaucgcuugaaccugggaggcggagguugcagugagccaagaucaggccacugcacuccagccugggugacagagugaggcuacacauccaaaaauaaauaaauaaauaaauaaauaaauaaauaaauaaauaaaagggcagaaccaaugauggcuaccauuugucaaaaaugaucauguguuaaugucauugcauuugauccccacaaucacacuuuagaguaggcgugaucaucccauuuaacagaggaugacucugaaguuauccaggaaaucgacuggaccucagagccccuggucucagcccagucaaagugggugccuccaguuccucaagccagaaacuuccucgaauuuuuccuuuuccccaccucuuguuuauuccaucagcaaaccccaaaauaucucccuguccccucugucuccaucuccaccacgccaucauaguccagguaaccacgugccacccagaccccgcaacagccucugggcugugcucccugugccucccaccucccacccacuccaacugcuucgccuggcagucagagcugaaaccuccaacucucccaugcagccagccuugagaacccagugcgauggcagcuauagaacagaagggagccccucugcagaggggcaggggagcacagaguggaaaugaugcccucugccagagaguacugcauggcuuccagaggaggaagcugaaucuuggaggaugaguggcagggaagccagggaagggcgguucugacagaaggaccugcauggaugccugugugcagaggcccacaggugugacuggcuucuuuggaagaaaaccaagcugcagagggagaaaggcuggagaagcagguuguagccucagauugaacaaauggccuuugaaugugaaaccaaggguguaggcuuccucucucuuuacuugcccguggggucacagacguggucucacacucuuucuuccuccuguccucuaugugacccugaagucauugagaaguuugauuauguguuugccgagaacgggacggugcaguauaagcacggacgacugcucuccaagcaggucagugucccccagggcuuagccaggggcaccccacuuuuccauaguggagcaguccaagggggcuucuguccugggcugggggagagacacugugccugucucagggucaggcagcccaggccacgcucagagcccuguguuccuuggccagaccauccagaaccaccugggggaggagcugcugcaggacuugaucaacuucugccucagcuacauggcccugcucaggcugcccaagaagcggugaggucccaccagccuggucuccagaaccuggggccugagggaggagaagugugggucccucagagggaaccuggagauacuugggccccugauuuuuugcggggaguguggauucuuguccccuuugaaguccuaggaggcuggggucccagguggggcuagauuugaauucagggccguucugguucucucuggcuccccgcccucccucaccaccaguggaaccuucaucgaguuccggaauggcaugcugaacaucucgcccaucggccggagcugcacccuggaggagaggaucgaguucuccgaacuggacaagguaccacuagcuaugcaaucuuaggccuguagggccucagucacucaauuuaucugagccuuuauuuucucaucaguaaaauagacugggggauguguucugauuuaacugauacccuuucaggcaccuacugugugccauuguuguagacacaccugcaucuuuacaaugcugcuggucccccuuccuaggugaccagcaccaggcagccacccacugagccaggccaacaccugggaacaucauuuccaccuucccacccacaucggguccaacaacucuuauuucaucagccucucgagucagugucaaaucuguucaucugcagaacugagaccccacuuucuagauuaccccuuuccccagccccaggcugccccaacuuuccucucugucccucccuaccccuugcauagcccugccagccugcucuccagcaaugccacugagaaccuuucuuucuuuuucuuuuuggagauagagucuccaaaaaaauagauagaggcuggagugcaguggcaugaucucagcucacugcaacucccaccucccguguucaagcgauucuccugccucagccucccaaguagcuggaauuacaggcaugcaccacuacacccagcuaauuuuuguacuuuuuuaguagaggcaggguuucaccacguuggccaggcuggucucgaacuccugaccuaaggugauccgccugccucggccucccaaaguucugggauuacaggcaugagccaccacgcacagcccauuagaaccuuucaaacaugucagccgcauucaccccccagccccacccccucauuuacaauccuuccuuggcuccucguugccaacuggaugauguccuagcccccugcuauggugccucaagcccugagggcucugucuggcucuggcucuccgcgucuccuuucuaugcccuucaaguuccacuuucuauuccuggaacacaccaagguccucucaccucugccuguacugccccugcuaaaccuugaugugcauuuugcuuuucuccccaccgccucccucccucucggggauggagcaauccacccauccagaccuuuccaugcuggcccguccacgucauucugucauucucucugaccuguucgguggcucucccugcccucugcuccagcuauggccucuuggcugauucuagagugcugugccucugucagagcacacuucucucaggcccagcucgucccuccccuccuucaaauccccuuucacauccuuuucccaguggggccuccgagaguaucacauccacugcugcacuuccuccuccuuccccuaccuuauuucuccccaaguagccuuggacaacuuucaucaucuacuuuuaaaauccgaauuacugucugucccugucccagaacuguaagcuccaugagggauuucugcggcuuguucuccucuggauccccuaugcuuggcacauggcauacuuuuuguuguuauuguuuuugagacagggucuuacucuguugcccagucuggagugcagugcagugauccaguccuagcucacugcagccucgaucucucaggcucaagcgauccucacaccucagccuccugaguagcugggaccacaggugcauuacaccaugccaggcuaauuuuuaaaauauuuuguagggaugggaucucgcugugucucccaggccaguuuugaacuccuagccucaagugggccuucucccucagccuuccaaagcaccaagacuguaggugugagccaccgcaccucgcaaagaaauacccuuuuuuguuuuuuuuuuuuuggagacugaguuucgcucugucacccaggcuggagugcuguggcacaaucucggcucacugcaaccuccaccucccggguucaaacaauucuucugccccagccucccaaguaucugggacuacaggcacaugcugccacgcccggcuaauuuuuuuuuuuuagacagagucuugcucugucaccaggcuggagugcaguggcacaaucucggcucacuggaaccccugacucgcugguucaagcgauucuucugccucagccuucccaaguagcuaggauuacaugcaccacaaugcccagcuaauuuuuuguauuuuuaguagagacgggguuucaccauguuggccaggauggucucgaucuucugaccucgugauccgccugccucagccugccaaagugcugggauuacaggcguggccacugugcccggccuaauauuuuguauuuuaguagagaugggguuucaccguguugcccaggcuggucucgaacuccugagcucaggcaauccacccaccucaaccuuccaaagugauuauaggugugagccacugugcccggcaagaaauaccuuuugaaugaaugaaaugagcuguauuaucuccauuuuauaaaugaggaaaccaaggcucgaugagaagggcccugcccgaggucacauagggaguugguugcagagcaaagauuugauuuugccauuggcccucuggugccucccugagggugccucucagcucagugacuccugacucccaccugugcccugaggcuuaggggaggcagugcccacaggcacagggacuuuuuuuuuuuuucuugauagagucuugcucugucacccaggcuggagugcaguagcaugaucucagcucacugcaaccuucgcugccuaggcucaagcaauucuccugccucagccuccugaguagcugggauuacaggcccaugccaccacaccuggcuaaguuuuuugguuuugguuuugguuuugguuugguuuuggguuuuuuuuuuuuuuuuuuuuuugagauggagucucacucugucgccaggcuggagugcaguggugagaucucggcucgcugcaaccucugccucccggguucaagcgauucuccugccucagccucccaaguagcugggacuacaagcgccugccaccacgcccagcuaauuuuuguauuuuuaguagagacaggguuucaccaugcuggcuaggauggucucgaucucuuaaccuugugauccgcccuccuuggccuuccaaagugcuggaauuacgggcaugagccaccgcgcccggccuaauuuuuguauuuuuuaguagggacaggguuuugccauguucaggcuggucucaaaucccuggccucaagugaucugccuaccuuggccucccaaagugcugggauuauagaugugagccgcugcgcccggccacggggacuuuuuuuuugggguaguuaggauuggucuuaggcaaagaacccuucccccccaauacacgugcugagaaguuaucccuuccuguccacccagguucccagucccagcucuacccauuugccuuguaaccuggaaaagcaucuuuacuaacgugugccucaguuuccuuauguguaagguggggguaauagcaguucccaucccaugggcugucaugagcacuggaugagguggcacauggaccccaccuggcauggaguuggggagccacacccuaacuccccaccccagagccuucucaaguauuuuuggcucuuguuugcucccuucuggcacuggaggagcaugaaccuuccugaucugugcgcccugcccuggcccagagcugguguaaauaaaugcuuaacccagcucaucuuccagaacccugaagcggggaugaguacuucccuuccuuagaugaggacacugaggccagagggugaguaaccagcucgaggucacagugccggucccugcugaggcuggccuugcacauggggcugucuagugaccagccuuguucuccagagaagggaggugcagccagccucggccauguggaaacauuucuucagagccuggggcagucuuagugguagcccugggccuacagaguggacgcugguggggacucuggccucccuggggcccaccuaccugcuggaaagccaggccaaggcuggcagggggcucacaucccuuaucucugcuuuuccaugagagggaagcaggcaggggucauucauuacuucucuguccuuuaguccaggaaauaggcucagagaggucaggugacuugcccauggucacacagcugaggaguacaguagccaagccuggcuacuugccuucagaucucaggcuagggggugucuggcuuuauaucugacauccucccugggccacuucuccaagcuccaugcugcugaccacugccugccuuuccgccccaguccuacccggcucugacuacagggccauaccagccaccccacuccugugcuccagaauccucagcgccucuuggucccccaggauguggucagacuucccagcccggucucgagacccucugucagcugaauguccugcuggcugguuuagauguucagcugccccucagacugggcauagcugcuccccuuuguggcccucugagauggagauccugggggcuggcggggagaaugucccccugcuccacguuugcggagcugcugccagaguuccugcucagagggacggggccggccugggcacuaccuaguccccagcccagccgcgucuuugcaugcugggugcucugccaugccuggcauccugcugcccucugugaaugcccacagccaccuccucacaggucuccugcucucagcucccaugcucauuucugaguauuugcuuuguugagcugguuacagauaacaggaucgagcccugcccugagguggacacugaugugggauccagauugccccgucuccucgcccuuccuacucgugucucuccucugaggucuccuucagaagacccagcccacagccccauuggcagccccaucccuucuggauuuaggcccuggcucugccaccagggcuaggugaccuugaccaaggcacaaccccucucugagccuuaguuugcgcaucugcacaguuggggguccuacccaccuagaaugcucagcacgcucacguggacugugugcccagccagggccuggcacacagcagguccucugagcugccauccgcucccuccccucugcagaaagagaagauccgggagaaguucguggaagcccugaaaacagaguuugcuggcaaagggcugagguucucucgagguacguccacccugcagaggaccugggaggccugguacagggccccuccucaaaccaucugccccugccaagaccaggcuguggcccccaguagcuuuaguagccccuccccggcucagggcagagaggguggcugagcccgaugcagaaagggguucaguguuuacuggcccccaguuuuccccaccucauaccucagagguaaacgccccaugcccacccaguuucucaggccaaaaaaccagagccucucccuugaaugcucucccccaccccuucccaaguccaaacuccuagaagucacagggcccccugucuggaaucccaccggugcucacacuuccacugccagcagcuugucccaggcuccaacugacccugacacaacugggcuccccucugccaccucacccauuccccaguggccagagaggcuggagcuggagucaugacaugccucugcccaaaguccuccccaggcucuuccucccucuccaugugaugcccagggccugcccguccucccccuaccucuccuggccuccuccguugcugggacgcucguucucuucccugccucaggggcuguacuuugcgccccagccauccccacucggcucaggucccagcucauugccaccuccucagaggucuccccugaucacccuggccggaugagcuucccccacccacuucauggucuuguucauucuccaaccugugucauaacuuccuugaggauccuaagucugucccguguccuauuccuggcccucaguaggcacucaaggguuguugaaugaaugaaugaacaagcagcccuucuguuagccuugucugccccucccagcagggaauaacaguccccaccccugcccacaggaggcaugaucagcuuugacgucuuccccgagggcugggacaagcgcuacugccuggauagccuggaccaggacagcuucgacaccauccacuucuuugggaacgagacuagcccugugaguguggcccaccccagguuuccccuaacgcaguggacagugagaagccaggucugguggcuucuccaaugcaaaucaccugaggucaaggccagaacauggggcaacacaacagaccucuuagggggcuccuggagaacaaccauugcucaccagccccguuacacagauuggaaagcuggggccccaagaggcugggcacuuguucuacaucacacagcaagucagggcaggucugacaaggggugagaaggugggcuuccuggcaguucugaaggggcaggaggaggggcagguccguagcagccaauguggagagggacuccaccuaaauaucccuccucugcccauccucugugugcagggugggaacgacuuugagaucuuugccgacccccggacuguuggccacagcguggugucuccucaggacacggugcagcgaugccgggagauuuucuucccagagacagcucaugaggcgugaccggggcccacaucugugugucgugacuucugaagaguuuggccuaggccuaaagagagguccugguguuggauagaugccagggccccuccucuggcccaggacgccugcugcaagcccacccagauggggccagagucuguguggacaaccguccccagccagucugcuccuaguggcacuggcuucguccucccagggcccagaguguuccccaugcuccaccugguggcccaggccacagcugcugcuuguauuucgguacagaagagguuucuuucugcaccaggaggaggcgugcucaaguaucgguacgagaucuagccugcccugccugccugcccugggcgaugagguacgguggggaaggugccuauuuuagagaacuuugucacaguauuaaaguucccagaacaaaguaggugucagcug

SEQ ID NO: 192563 - RNA, 42758 nt, Homo sapiens
aacaguauauaguacaaacuuagggcucuuuauucaggcaguaaaguaaggaacagcaaagugggagggcuacaccaucaccauggcaacagaaagccucaaaaacauaaagucccucgacuuaugucggguagacucuuccuagcucaggagaaacacauuuuaacuggcugaggacaaggccaggcagccuggccacacugcggaagggcagcuggacgcgcggccucuggucaguccuggaagugcuuggugagggcuuccagcagcuccugcuucuucagcccacucuucagcccguaagcccggcaggccucuuucagcaugggcacagugaacuugcccagcguacccuugcugaugugggucuucagcuccucuucugaauacuccaccuugggccuuuugcuuccagaaccuucauuaucuggggggaaaggucaggagagagugacuggaaaugcuacauacaaguggcaucccagcuacauggcaugggggaccucguauaaucugggcugcaauuaaccauaaagcugugaugccagccuaggacaccauggggaagacuuaucucgauaagguagcuucauuuaaagugcaaaauaaaacacagaucacaccuaggaggaaauuacaaguagugugaaugccaucaguuuacccaaaacuguugcucacucuggguaagucauuccuuccuuccuuugaaaaucuuuuacagguucaugaccagccuugguaauacagugagacccuggcucuaaaguaauaaaaucaaccggccaugguggugugcaccugcagucucagcuacucagcaggcugaggcugcaggaucacucgagcccaggagguugaggcuacagugagccagugaacugugauugagccacuggacuccagccugggugacagagcaagacugucuaaaaacaaaaaaaggauauaacuucuguaucauuuuugagauggagucucacucuaucaccgaggcuggagugcaaugguguggucucggcucacugcaaccucugccucccggguucaagggauucuccuaccucagucucccagguaguugggacuacaggcgcccacuaccacaucuggcuaauuuuuguauuuuuaguacagacgagguuucacuguguuggccaggcuggucuugaacuccugaccucaugauccgcccaccucaggcucccaaagugcugggauuacaggugugagccaccgcaccuggccaacuucuguaucauuuuaaauagaaauuaaaaaaauuaaguccuggaagggugagagugcaggaaaacauucacuccuucuuggauagaggguaaaucacuguuuuggaagcaauucacugcaagaaugcauccuguggaucuauucacacaagaacacgauggaaaugcauguucacugcagcauauccaccugucaauacaggucugguuaaauaaccugguauaucuauccaaugaacuacucugcagccucauuuuuuaaaaaaugagauagguaaguguggauauaaauaacuguccaacauauauagcugaguaacaaaaauagcaaacuagaaaacaauguauuauuccauuugugcugaaauauguauguugguauguguaaauauguaugguuguauagacaguucuuuucuaaaauuuuuucauuuuuaauuuuuguggguacauacuagguauauauauuugugggguaccugagguauuuugauacaggcaugcaaugugaaauaaucacaucagcauaaaugggguauccauccccucaagcauuuaucuuuuguguuacaaacauuccaauuguauuccuuuaguuauuuuuaaauguacaauuaaauuagacuauagucacucuguuguauuaucgaauagaucuuaaucauucuauuuuuuuuuuguacccauuaaccauccccaccaaccccacaaugccucacuacccuucucagccucugguaaccauccuucuaugcucucucuccaugaguucaauuguuuugauuuuuagauuccacaaauaagugagaacauguaaaugucugucuuucugagccuggcuuacuucacuuaacauauuauugcaaaugacaggaucucauucuuuuuuauggccgaauaguacuccauuguguacguguaccacauuuucuuuaccaggcaucuguugauggacacaaguugcuuccagaucuuggcuauugugaauggugcugcaauaaacaugggagugcacauaucucuuugauauauugaucuccuuucuuuuggguauauacugacuggaucauaugguaugcuggaucauaugguagcucuaguuuucacuuuuugaggaaacucccaacuauucuccauaauaguggcuguacuaauuuacauucccaccaacaguguaugaggguucccuuuucuccacaucuuugccagcauuuguuauugucuguuuuuuggauaaaagccauuuuaacuagacugugaauagauauuucugaaaggauauugcccacugugauaagacuaucauaaaagcaauuuuuaaaaauagcccacauguccacauucagcuucucaccguguuuucucuugguaacuuucccuucaggauuguaaucugguggguaaacaagcuccuuaaacucauccaccaaggagcccagucuuuuauucauugcuucaaccuugggcacuagaaaaucaaaacacagaagaguggccuggugagucacgagccccagcuugcuguccacuuccagaacucucugagaaccagaagagagagcaccuaacugcuaaggugggaggggucuagggaaaugucuuuccagcauuuaccaaguaccuuccaacaccugcauuuacuguaauuacacauacuaccgccaggcacuguuguaaaugcuuuaaacuuacucuauuuacuccuucuaacaaccuauaggauagguaaauuuguccccaguuuuuuuuuuuuuagauuuuuuuuugagauggagucuugcucuguugccaggcuggagugcaguggcgcgaucuuggcucacugcaaccuccgacucccugguucaagcgauucuccugccucagccucuugauuuguccccaguuuuacagaggagaaaaggagagagauuacaugacuuucccaaagggcagugguacaguggagauacuaagcuagauucugggaauucaaacaagugcucaugccugcggugagcuuacagcccagugagagagaggagguggauaaaaacgaugcaguggaguugggcaacaccaugcaagaagcgacuguacaggcacacuggaacacaggagggguggugaaagauaagaagcagaaggcacugggagagaaauagcaggugacauauagcuggaagguaggguguuaaggaggacagggccagcagagaggugagaaagauggguaugaugaggucauggaagcugggaugccugccaaggaauuaggccuuauccaaagaauccccugauagcugcauggagggugaacugaaagaggguaagauaagacaggugaaguggggugugggugggaggacccauaaacaugagaagugacagaacuggcaggacuuacugauagaauaggauuuauuauuuaacugaaaucacagagcuggaaaccagaauguaagaagaauaggagugggauggggagaugacuggcugaaacagggggagcaaguaugacaggaaaaggcaacuuuggaggaaagaucauacuuuuguuuccuuuuuuguuagcuuacaacuauauuguuaaaucaagcuucugacaugagcugugucacaucaagggcaagggugaugagaugggcagcucacaugcccguauuugccaagcauggaggggagcucuugcugguguaccuagauggcacaaugcuggagccaaacugugcuccugcugcaucagaaguccccugguccacaucaugggaaccucugcaagagcacuggcucccaaucugggaaucaucuguagaguuuuaaaaguacagagaagcugggugcaguggcucuugccuguaaucccagcacuuugggaggccgaggcggguggaucaccuaaggucaggaguucaagaugagccuggccaauauggugaacccccaucucuaccaaaaaauacaaaaaucagccaggcaugguggcgggugccuguaaucccagcuacucggaaggcugaggcaggagaacugcuugagccugggagccaaagguuucagugagccgagaucccaccacugcacuucagucugggugacaagagugagaaccugucucaaaugaaugaaugaauguacugagguccagccuaugcucaguacuaaaaauaaaaauaaaaguagugagcaugguggcuuaugccuauaaucccagaacuuugggaggccgagacagguggaucacuugaggucaggaauuugacaccagccuggccaacauggugaaacccaaucacuaauaaaaacacaaaauaggccgugcgcagcgccuccugcuuguaaucccagcacuuugggaggccaaggcgggcggaucacaaggucaggagaucgagaccauccuaacccagugaaaccccgucucuacuaaaaauacaaaaaaauuaaccgggcuugguggcaggcaccuguguccuaaacuaccuugcuaggcacuaggccaccgacuucugaauuugccuaaggccugaaaggaggagaugggcuguuuagcucaaaacguuucucuuucgccagacacagcuaagcaggcaccacaguaacaaugguccaauaacucuucugcuuuuaacacuggggcuauuuugucuaaaauagaucauucugagaccagccgggccaucauggcgaaaucccgucucuacuaaaaauacaaaaauuagccgggcggggaccaacugcucgggagucugagacacgagaauagcuugaaccuaggaggcagacguaagccacuacgcccggcugcgagucgcuggauucuaaacccaaauccaccacuuauuuccucuuaaauuauuuauugauuuuuuguuuuuguuuuguuuuuugagacagcgucucgcucugucaccaggcuggagugcaguggugcaaucucggcucauugcagccucugccuccugaguucaaccgaucuuccugccucagccucccgaguagcugggacuacaggcacacgccaccacacccagcuaauuuuuuguauuuuuaguagagacagaguuuaguagagacagaguagagacauguuggccaggauggucucaaucucuugaccucgugauccacccgccucggccucccaaagugcugggauuacaggcaugagccaccgugcccagccucuuauauuauuuuuuaaauuucaccagcauguagucacagggcggccuagugcagaggcaggucucagaagccugacacucuccuccucucacuauggaaccagccaaaucuguucccuggcuguuuaagcuggucuggaaaagcuuccaaacagagggggucuggggaaugagguuaaguguuuagagaggacugggaaaugcacccaaauuacuggugcagaguggaaccaguaagaaagccucccaugaaaagaacuacucuauucaaccuccuuacaugucagguccacugcuuguuccggcuccaucaaauccaaggccaaggccuccagguuccugaagugcugcugcagcacgggguucucaaagcugucacuucuguuaaaacaauaauguaacucaacugaaacaugacaauuuaaacauugaaaaaauuagaauaaaaccaccugagauacuacagguccggggugagcugagaaaaacaccccaaguaaaacaguugaggucaggugcaguagcccaugccuguaaucccagcacuuugguaggccaagguaggcggaaugcuugagucuagcaguucaagaccagcuuggacaacauggugagacccugucucuacaaaaaauuuaaaaaucagccaggcauguuggugcacgccuguggucccagcuacucaggaggcauaggcaggaagacugcuugaguccaggagaucgaggcugcagugagccaugaucgugccacgguacuccagccuggauggcagagcaagacuuugucucaagucaacuuagaaagcaaaccagccugggcacccuggcucaugccuguaauccagcacuuugagaagcugaggcaggcggauggcuugagcucaggaguuccagaccagccugggcaacauggugaaacuccgucccuacaaaaaauacaaaaauuagccaggugugguggugcaaggguauggucccagcuacucaggagucugaggugggagaaucaccugagcccagggaggucaaggcugcagugaacuacaguaacaccacugcaaucaaaccugggugacaagagacccugucucaaaauaauaauaauaauaauaauaauaauaauaauaauaauaauaauaaauuuuuaaaaaugacaugugaaaaaaauuacguuuagugucccauuaugcaggcucugagaguuggucuauuauauaugugagagggaaugacuugaauuacuuaaucauucuuuuaagccuuuaacaauuuacacuagauuuauuuacuuuugcucauuguggaauaacaaacacaaucaaggagaagggcgaauaagaauccugcuauuuuuucaaauuuguucaaccaacuaaucuggcuaaguacagcacaacagagaaaccacaaaaucccagagucuccaacauaauaaaagguuccauucucuauauggcuuucaaaaaacuauuaauaacaaguaguaaucugucaguuugcugaaaagaguagugccauucucuuggccuaugcccaagcuguuucuaauaagauuuucaacucaggaggcaguuccagaaagccugagauugacucaccuguaugugaagcgaagcuucucaacgauagccuucaucuugcccaccugcucuggaguugccaugauuuuuucaguaaagggcaucuuccuuuuaucaucagcaaaggguaaaaagaccagcuggaagccugaagaaaggagauaaauuuucuuugauuugacuucaaguguugcagucacuuguuucucagcuccaaauucuuccuuuuauguccuguggugcuggggcuggggccccguaggccccauuucuugaacuccaccagcugguuuuuguuaucaucugccuaacagacucccucugcaguuuccagaagacugcaagggaggaggggugccccuuccuguauacaguagaucccuuaucccuggggaauauguuugaagaacccgggaggauaccugaaaccucggacagcaccaaaccugacugccgucaauugaaacauguuuguccaugucauacguucauaaauuuaauauuuaauguuuuuuuccaucuuuuuuuuuuuuugagauggaguuucacucuugucgcccaggcuggaguacagugggcaaucucggcucgcugcaaccuccgccucccagguucaagcgguucuccugccucagccuccugaauagcugggauuacaggcgccaccacgcccggcuaauuuuuguacuuucgguaaagaugggguuucgccauguuggccaggcuggucucaaacuccugaccucaggggaucugcccaccucggcuucccaaagugcugggauuacagacgugagguaccgcgcccagccuucaucuuuuuuuuuuuuuuuuugagacaggaucuugcuaucacccaggcuggaaugcaguggugugaucacagcuuacuguagccucuaccucuccggcucaaguagccuaucaaguagcugggacuacaagugaaugccaccacacuuggcuacuuuuuuuuauuuuuuugcagagacagaguuucaccauguugcucaggcuggucucaaaacuccugggcucaggcgauccaccugccacagccucccaaagugcuaagauuacaggcauuagccacagugccuggccuccuuuucuauuuuaacuaagcacuucucauguacuguggcaguaacuuuuacaguuugaggugcaacaggaaaacuagcuugggccggacaugguggcucacgucgguaagcacagcacuuugggaggcugaagcaggaggaucacuugagcucaggaguucgagaccagccugggcaacauagugagaccuugucucaauuuauguaaaaaaagaagggggggaaaaaacuauuuuuuuuuuuuuugagacagagucucgcucugucacccaggcuggagugcaguggcgcaaucucagcucacuaacuccaccucccggguucacaccauucuccugccucagccucccaaguagcugggacuacaggagccugccaccacaccuggcuaauuuuguauuuuuaguagagacgguuucaccguguuagccaggauggucucaaucuccugacaucgugauccgccaccuuggcaucccaaagugcugggauuacaggcgugagccaccacgccuggccacuaagaugaauuucuuuuuccuucuuaacaauuuuguggauagaagauuccuucuuaccauguaucuuagcaaccucagcauaaaaaaaaaaaaaaacuaaaaugaauuuuuucccuuaacaauuuugugguucgaagauuccuucuuaccauauaucuuagcaaccuuagcauauauuuuuuuccuccuuaaagucaagaacucucaccuuuucauuuaaaggaagcacuuuaugacuuucucuuuaguauauccaaacugccagcaccacuacacuugugcuuuggggccguuauuaaauaagggugaccugaacacaagcaccgcaauacugauuaccuugacagucaaucugauaaccaagacagcuacuaagugacuaacugguggguagcauuuacaguguggagaugcugaacaaacagaugauuccugccccaggugggauugugcuuuuaaguuauuucuagaauuuuccacuuaaaauuuuuggaccaugguugacuauggguaacugaaacugcagaaagcaaaacugugguugcggcccuccuguauuuacuguuccuaccuguauugccccagcaaagacccuuuaccuggcggcaguugguuccagucuccagcuuuuuugauacauccagagcuagccggacagugccuccucccuggagggcuaagucccagcuccaugggggccuucucugagcuucacccucgccccuuuuuuccuuacccucuaccacgugauaaauaaaaggaaacagguaagaguuaucaggcugauuuuaguucaguuacuggcugguucuggaaggacuaaaaaaucuacgcccuguaacuaacugcugcuaccaggugaaagccuuugcugacaaugcugaccacacugagcaaacaggaagaagcaaaucccucaccucuccucugcccuuuggucucccucuagcacccacuauagacacagccugagagccagcugugaaagaugaaauuagguuuggaucauuucagccucaguagugcagagcauaaaagggugaauuuggagcugagauacaauagcuuaguaacugagcacuccugagcaugcugaggaucaaaguuaaaacuacaguaacucaucucaaauguaaaaccaccccgagggaaaggugcuccagaacgcccaucuuuguagcuaaggaauauuaaacagaaagguuaaauuacuugcccacguugaccagcuaacaagcagcagagaugggcccaaaacaaaagcaagcaagcuuccagacacauaagcacaagauaaagucaaaucugacuuuaaaauccauggucuuuccgcuauaccucacuaucuuggcaaaccccaugguugguuuguauaggaacuaaaccaaacauuagacauuacaagggugccaaacaauggcuuuggaaagaaaggugucggcagugaggucccaagaacuugugucaguaaucugcaaacaguccccuaggcagacauuucucuauccuagcugcagaucagccuuguacggcugcgcaugcugugcaccccaucaccauauuuaguggccuuaccuggcugugcacuaaauucacccaagaaagcuuaaaaauagacauuuuuaagccccauucccagagacuaugauucaguaggucugcauuaggaguccauggaugauuccaaaguaugggcaagguucagaagcccuggaaauaucucugccacauaccuggaggagucaccugaauuuucuggucauccaacucuucuuccuguggcaccaaagccacaaaauaaggagggauguuccugcgggguguguaucugcacaaugcugcaaccuccuucuccagacacuugaugagcagagcacugaacaggguugagcucccuagaaaacaaaaagcccagugacuagccuccuaaaaagguuuccuccuuucuucucuuuuagcccuaaaguuucucuuccauuuucuuuaaagggcuuauuuuaauuuuauuauuuauuuauuugagacggggucucgcucugucacccaggauagagugcagugcugcaaucagaacucacugcagccuugaccucccaagcucaagcaaucuucccacuucugcuuccugaauagcugggacuacagucacacaccaccacacccagcuaguuuuaagauuuuuuguagagacaaaguaucucuaagucacccacgcuggucuccaacuccuaggcucaagugauccuccagccucagccucccaaaguguugggauuacaggcaugagccaccacaccaagccuuuaaagggcuuauaauaucucaacagguaaggguuggaggaccccacagcugaggggaaaauggggacagcagagacacagaaaggaaaauuuaaaaaggaauaagagguuuagaagccccaaacauuccacuuaagaaagugaauuauggccgggcaugguggcucacgccuguaaucccagcacuuugggaggcacaggcggguggaucacaaggucaggaguucgagaccaaccuggccaguaugguaaaaccccaucucuacuaaaaauacaaaaauuagcugggcaugguagugcacgccuguagucccagcuacuugggaggcugaggcagaagaaucgcuugaauucaggaggcggagcuugcagagagcagagacauugccacugcauuccagccugggcgacagagugagacuguuucaaaacaaacaaacagaaagugaauuauuggccaggugagguggcucacgcuuacaguccuagcacucugggaggccaagacagguagauugcuuaagcccaggaguuugagaccagccugcccaacauagcaaaacccugucucuacuaacauuacaaaagauuagcuggacguggugguguggaccuguagucccaguugcucgagagggugaggugggaaaucaccugagccugggagcuugagacugcagugagccaagauggugccacuggacucuagccugggugacagagugagacacugucuccagaaaaaaaaaaaaaaagcaaauuauuaaugucaguucacuuuuacugacacuagguuaaugacaugaccccaguuacuaaugaaaaccaaucgagucaaaucugggguguucaugagccauagcacaaaagaagauagggucuagacugcacaaauaaacacaacggcaagguucacauccucuuuaauuuccaacacuggagaaaaagcuguggacuuauuuugguuuuguuugcuuuuugcuaucugaugcuucaaagaauuacaugggaaauuguuuuuaaaaagcuaaauuccaggcuggacgugguggcucacgccuguaaucucagcacuuugggaggccgaggcgggugaaucaccuaaggucaggaguucgagacaagccuggccaacauggugaaaccccaucucuacuaaaaauacagaauuuagccgggcgugguggcgugcaccuguaaucccagcuacuugggaggcucaggcaggagacucgcuugaacccaggggacggagauugcagugagccgagauugcgccacuucacuccagccuaggcgacaacaacaaaaaaaugaauaaaaauauaaauauaaauaaggccaggugcaguggcucacgaggucaggaguucgagaccagacuggccaaaauggugaaaccucgucucuacuaaaaauacaaaaauuagcuagacgugguagcaggugccuguaaucccagcuacuccagaggcugaggaaggagaaucguuugaaccagggagguggagguugcagugagccgagauugcaccauuacacuccagccugggugacagggugagacacugucucaaaaaaaaaauuaaauuaaaaaaauauauauauauaaagcuaaauuccacaguccucacccgggaggcagauguugcagugagcugaaacugcaccacugcacuccagccugggugacaagaguaaaacuccaucuccaaaaaaaaaaaaaaaaaaaaaaaaaaaaaaaaaaaaaaaaaaaaaaucuguuuaacuuucuucauucccacauuuccaaaauuugagcuugaaacacuuuugguuuuuuugagacagagucucacucuauggcccaggcuggagugcaguggugugaucucagcucacugcaaccucugucucccagguucaagcgauuuucaugcgucagccucccagguagcugggaucacaggcgcaagccaccaggccuggcuaaauuuuguauuuuuaguagagacgagguuucaccauguuggccaggcucguccugaccucaggugacccauccgccucagccucccaaagugcuaggauuacaggugugagccacugcaccaggcagagcuugaaacacuuucaacauacuccauuaacauuuccuguacaguguccaagcagugcccauuuacaaagcgcugcuccguaaacugcacuguguguuagagucacucauccaugguccacgcuacuuaccaaucaccagcgacuccucuggguacacgaacagggagggccucagguaaugguguuucuucagcaguaccaacggcuugaaacccaugagcaucaaaccuggaucaucaaaccguuuuagcucuucuguuuccucuuucuccaguauaaucugacgacucccauagaucugaaggagaagaacgacaaggaucaaaugggaaggcuacgaggagaugcaaaauaacucgaagaugaugacacuagcaaguuaaaaucagcucucuucuaaggagcaggaagauggcucaccuggggcauccuccuucuccaacagggaauuaacauuuauugagugacugcagguacuuuacaccaacuacuuuaucuucuguaacaaucccaagagguagauguucaaacuguuuuagagugggacugugcuuaugaauagccacugcacuccaaccugggcaacacagugagauccucuuugcaaaaacaauaaaauaggcuaggugcagugccucaugccuguaaucccagcacuuugagagcugaggcaagacugcuugagcccaggaguucaagaccagccuggacaacauggcaagacccuaucuguauaaaaaaauuaaaaauuagcucgguauagugguacacaccuguggucccagcuacuugggaggcugagacuggaggaucgcuugagcccaggaguucgaggaugcagugugccaagauggcgccacugcacugcaaccuggguaccagagcaacucuauccccccaacacaaaaaaagaaaaaaaaaaauguacugaccugucagcaccaucccugacacacaaagcaugcuuaaaccauaucuauuuauuauuauuuauuauuugagaugcagucugucacacugucacuggcgugcaguggcgcaaucucgacucacggcaaccucccagguucaagugauucuccugcaucagccuccugacuagcugggauuacaggugugagccacugugcccagcccaaaccauaucuauuuauuuauuuauuuauuauuauuuuuuuuuuugagacagucucgcugucacccaggcagcgaucucggcucacugcaggcuccacccaccgggguucacgccauucuccugccucagccccacgaguagcugggacuauaggugcccgccaccacaccuggcuaauuuuuuuguauuuuuaguagagaugggguuucacuguguuagccgggauggucucgaucuccugaccucgugauccgcccgccucagccucccaaagugcugggauuacaggcgugagccaccgcacccggccaccacaucuauuuauuaaaugagaggaccuaugucagguacugugcuaggucucaauguggaaggcagagacacacacauauaaguacuacuuccaaggcagggcacguugacucaugccuguaaucccaauacuuugugaggccaaggcagcuggaucguuugagcccaggaauucgagaccagccuggguaacauagugagauccugucucuaugaaaaaaaaaaaaauacaaaaaauuagccaggcgugguggcaugagccuguagucccagcuacccagguggcugaggugggaggaucaacugaacccaagagguugaagcuacagucaaccaugauggcgcuacugcaaagauuauuuguauuguuuggagagagauauauauauacacacacacauacauacauauauauauauauauauauauauuuuuuuuuuuuuuguacucucuuccccaggcugugcaccaccacgccuggcuaauuuuuaguuuuuuaguagagacagggucucgcuaugaugcccaggcugaucucaaacuccuggguucaagugauccuccuucagccuccaaaagugcaugagccaccauacccaaugauguuuguauuuuauccuggauaugugacuaauaacagcuuaguagcagauucaaauuuggguuuuaugaacaaaagaacucucaagguuuuuucaaacauacuggaccaagaaagaaacucagugaccagagagcuuacugccuaugaauaaaucaauauaaaaaauuaguuacuuccaaaauggaaaagaaaauuccuuaucuuuuucuccuucaaagaguagggcaaaacucucuggcuugaaucaaaauaauauuuuagucauccuuauaggcccuaaacuuauguaaaaucucagauucuuccacauuuugcauacaggaagcaugacucauucaauuuuaauuuuugauguuaaaucccucuauagacugagcaaagguaagaggaugagaaaagacaauguucugcguccugcaucugucuuucagaugcagaaagggagauguaugucaucccaaggcacaggaaaaauaucacuagcaaaaauaaauucucucccuaaaaaaaaugaguucacuucacacuucauacuuuuccuaacuccuuaucucccuaauuaacuauaaaguauuuucugcuauuguaccugagcaagacuguuagacugacagcagcauguacugagugaugaaggggugagguuuucacugacaucucuuucagacacuggcccaguuuaacuuucuagcuaucaaaauaucacugauccagauaccacagucccaaagaguuaagucuuugugguuuaacagguuagcaagaaaggugcacauggcucguccaagugcggugguguuuacaacuaauugaucacaaccaguuacagauuucuuuguuccuuuuccauucccacugcuucacuugacuagcggaaagaaaagaaacagaagagaggaggggagaggaggggaggggaggggaggggaggggaggggaggggagggagucggagagagaaaaaagaaaaggaaagggaaggagaaggaaaggaaagaugcacauaugaaaguuauuuaacuggucagccugaucaaugucucuccuccuaguuaacucuucaguuggagaaaauucaguaagaaagcaucuuggguuagguguggugguucacaccuauaaucccagcacuuuaggaggcugaagcaggaguacugcuugagccuaggaguucgaggccagccugagcaacauagugagaccucaucucuauuaaacaaaacaaaacaaaacgaaacaaaaaaacgcugggcacaguggccaaugucuguaaucccagcaccccagcacuucgggaagccaaagcaggaggauuacuuaagaccaggaguuugacaccagcccaggcaacauagcgagacaccgucucuuuuuuuuuuuuuuuugagacggaguuacgcuuuuguugcccaggcuggagcgcaauggcgugaucucggcucaccgcaaccucugccucccggguucaagugauucuccugccucagccuccugaguagcugggauuacaggcaugcaccaccaugcccagcucauuuuguauuuuuaguagagaugggguuucuccauguuggucaggcuggucuugaacuccugaccucgguaauccaccugccucggccucccaaagugcugggauuacaggcaugagccacugugcccagucgauccagucucuuaaaaaauaaauaaauaaauaaauuagcugggugugaugucacaugccugugaucccagcuacuugggaggcugagacagaaggaucgcuugaguccaggaggucaaggcuguagcgagucauguucgccccacugcacuccagccugggcgacacaaugagacccugucucaaaaacaacaacaacaaaaggcaucucuaccuaccugagaccucuugguaucgcuaggcagaagcaaaccgccuguacuuguauuaaagguccgggucuugguuuucacugguucauuuguuucccgauagagcuuuauuggaggaggcuugagagccuucuggaccagauuauaaaugcccacagagaucacuauaucuuuguugagcuucagcuuuaaccugagggaguaaaaaaugaaagagcaugaacugaaaaacugcacuuuucuaucuaaaauucccucauaacaccaaagcuucacuguuuuauucucuccaauaauccuaagcaagcucucaaaauauaaauaugcuuuuuaauaauacaaucgaauuugcuauaccaccucagaaucuguaccacaauauauuaacuacuuaaaacaaugauaaagaacguacuacagguugcguaucccuuugcaaaaugcuugcuuaggaccagaaauguuucagauuucagauuuuuuuuggaauauuugcauuuuauaguacuuacugguugaauauucccaacccaaaaaucuaacaacccauaaugcuccaauaagcacuuccuuugaacauuaggucggugcucaaaaaaguuucagacuguagagcauuucuaauuuuggauuuucagauuagaaacacucaacccguauaauaaaaugauaguuuguauuaagcacagcacuauaucaaucaccucacagcuauucucucauuuaaucaucauaauaacccuguaaguacuguacuaguugucuugucucugcuuuuuuuuuuucgagacagagucucacacuauugguugggcuggagugcagucgcgugaucucggcucacugcaaccuccaccucccggguucaagcgauucuccugccucagcuucccaaguggcugggauuacaggcaccugccacgacacccagcuaauuucuuuuuauuuuaguagagacgguguuucaccauguuggccaggcuggucuugaacuccugaccucgugauucacccgcacuggccucccaaagugcugggauuacaggugugagcuaccauguuuggccuugucucuguuuuucuaggaucccuuccuccugcuuugaagaauaaagacccaucaugccgggugcgguggcuuaggccuguaauccuaggucaggagcucgagaccagcuuggccaacauggugaaaccccaucccuacuaaaaauacaaaaauuagccaggcaugguggcgcacgcacagucuauaaucccagcuacucgggaggcugaggcaggagaaucgcuugaaccagggaguuggagguugcagugagccaagaucgugccaccgcacuccagccuagcgacagagcgagacucuaucucaaaaaaaaaaaaaaaagaagaaagaauaaagccccaucaaaauaaggguuacuuaacaaaacaaaacaaaaaaacaccccaauuuuucuuugggaauuacccuuccccgacuacaguuuugggagaauguuagucaaacucaaguugcugugccuucuucuggccaaguggugggcauaucugacccuggagaaggccauaggacguucucaucugagagucggggucucugagcaguggccaugaaaggaugugauuccagaggauacuuucuucucauaauggcacccuaaagacacugucauuaguuccugcuacguagauuccuagaacuaauuauuugacucauacgcugaaauuagucaaggucagccuuuuuuguuuguuuuuuuuuguuuuuuguuuuuuuuuuuuaaagauggaguuucgcucuuguugcccaggcuggagugcaauggcacgaucuccacacugcaaccuccaccucccggguucaagugauucuccugccucagccucccgaguagcugggauuacaggcacccaccaccacaccaggcuaauuuuguauuuuuuaguagagacaggcuuucuccauauuggucaggcuggucucaaacuccugaccucaggugauccgcccgccucggccucccaaagugcugggauuacaggugugagccacagcccccagcucaaggucaguuuuuauugcuugccacucaagaaccuuauuauugaccuucuauaagugagggcucagagaaguuacaugacuugcccaaggacacacaauaaaaauccauauucaaacucaaguaucccuguuucaaagcucauguacuuuuccaucaugacauauuacuccagagcacuuauaccaacagcuuaagcagcaacaggaccucuugaaaauguguucugcaggccgggugcaguggcucaugccuguaauccuagcacuuugggaggcugaggcgggcggauugccugagcucaggaguuugagaccagccugggcaacacggugaaaccccaucucuacuaaaauacaaaaaaauauuagccaggcguggcggugugcaucugcagucccaguuacuauggaggcugaggcaggagaauugcuugaacccaggaggcagagguugcagugaggcaagaucgugccacugcacuccagccugggacgacagaccaagacuccaucuccaaaaaaagaaaauguguucugcaauaauaacaauguacacauauauuuacaauaugcaaaaaauucuuauauuaugggggaaaaaaagaacguaaaauaacccaugauacacauucuucucaagcacauagaacauucucuaggagagaucauauguugggccacaaaacaagucucaguacauggaaaaagguugaaaucccauaaaguauguuccuuaaccacaauggagcuaaguuagagguccacaacagaaagaaaugugggaaaaccugaaauuuuugaaaauuaaacaauacacuuauaaaaaacccaagaagaaaucacgaggaaaacauuuuucuuuuuuuuuuuggagacagggucuugcucugucacccaggcuggagugcaguggcgccaucucggcucacugcaaccuccgccucccggguucaagagauucuccugccucagccucccaaguagcugggacuacaagcacaugccacugcgcccagcuaauuuuuuuuuuuuugagauggagucucacucugucgccuaggguggagugcaguggcgcaaucucagcucacugcaaccuccgccucccggguucaagagauucuccugccucagccucccaaguagcugggacuacaagcacaugccacugcgcccagcuaauuuuuuuuuuuuuuugagauggagucucacucugucgccuaggguggagugcaguggcgcaaucucagcucacugcaaccuccgccucccgaguucaagugauucuccugccucagccuccugaguagcugggauuacaggugcccaccaccacgcccagcuaauuuuuguauuuuuaguagagacggugcuucgccauguuggccaggcuggucuggcacuacugaccucaggugauccacccgucucggccucccaaagugcugggauuacaggcaugagccagcgcgcccggccagaaaauuuaaaauuauuuugaacugcaugaaaguaaaaacacaauauaucaaaauguauacgaugcagcuaaagccaugcucagagacaaauuuacagcuuuaacacuuuuuuguuuucuuuuguuuuugagauggagucucgcucugucgccuaagcuggagugcaguggugugaucucggcucacugcaaccuccgccaaccggguucaagugauucuccugccucagucaccugaguagcugggacuacaggcgcccaccaccaagccuggcuaauuuuuguauuuuuaguagagacgggguuucaccauguugguguggcuggucucgaacuccugaccucaugauccgcccccuuggccucccaaagugcugggauuacaggcgugagccaccgcacccggccagcuauaacacuuuuaucagaaaagaacagucuccaauaaccaaaucuucacuguuguggaacaccuagcaguauuuaaagaaaagaacauguuuagacaagugucuguauaguucgaagauauacagguucacaccguggagacaacacugguuuugagcagagccacaaauagaaauuuugguuccuggggcaagcaccuaauauaccuucagaucaacuuggaaaugcaugaugugacucacagaugaguguugguaacagaugcauuacuaacaacaucaaccauuugguggcuucuuagaugugaaaaucagugucuaaaggcugcuugaaggagaguugacgauaaaugcaaccaauuacaaaacugcacaaucuucaaaaguaacuauuuuuuuuuguagacagggucucacucuauagauugcuacaguaaguuuaaauauuguuaaaaugcccagacuacccaaagcaaucuacagauucaauguaaucccuaucaaaauaccaaugacauucuucacagaaauagacaaaacaauccuaaaauguauguggaaccacaaaaucauaccgggaaauucuccagcacauugagcuuggcaaagauuucuuaaguaauacuccagaagcauaggcaaccaaagcaaaaacggacaaauaggaucacaucaaguuaaaaagcuucugcacaacaaaggaaaugaucgacaaagagaagagaaaauaucuggaaacuauccaucugacaagggauuaagaaccagaauauauaaggaacccaaacaacucuacaggaaaaaacucuaacauaaucugagauaucaucucaccucaguuaaaaugguuggagguuccugaaaauacuaaaaagaaaacuacuguaugauccagcaaucccacugcuagguauacaccccaaagaaaggaaaucuguauaucagagauaucugcacucccauguuuauugcagcccuauucacaacagccaagauuuggaagcgaccuaaguguccaucaaaagaagaauggauaaagaaaguguaguacaauggaguacuauucagccauaaaaaaugagauccugaggcagguggaucaccugagguccagaguucgagacuagccuggucaacauggugaaacugugucgcuacuaaaaauacaaaauuagucgggcgugguggugcaugccuguaauccuagcuacuugggaggcugcaggagaacugcuugaauccagaaggcagagguugcagugagccgagaucgcgccauugcagucuaaccugggcaacaagagcaagacucaggcucaaaaaaaaaggagauccugucauugguaacaacauaaauguuguugcauucacuaugcaauguuguuucacuauguuaagugaaauaagccaggcacagaaagacaaacuuugaauguucuuauuucugggagauaaaaaguaaagcaauugaacucauggacacagaaaaggaugguuaccagaggcugugaaggguaaggggguagugauggggcaguggggaugguuaaugaguacaaaaaauagaaagaaugaauaagaucuaauacuuuagagcagaucagggugacuauagucaauaauaacaguacauuuuaaaauaacuaaaggaguauaaucagauugcuuauaauacaaaggauuagugcuuaaggugauagauaacccaucuaugcugauguaauuauuacgcauugcaugccuauaccaaaauaucucauggauccuauaaguauauacaccuaccauguacccacaaaaauuaaaaauuuuuuaaaaagcguaaguuuaauauuuuucuaggccuuagcccuaaggcauuguuaguucucaauaucuccaauuuauuauuauuuauaucaaguauccauccuacaaugacuguuccacaaaauaagaacagcuaacauuuauaaauaauuaccacgggccaagcacuaugccuagguuaucucauuuaaugcucacggcaauccuaugugaaaguacaguuuuuuaauuuuuuuaauaaagagagacagggucucccuggguugcccaggcuggucuugcuucuggacucaagcaauccuccugccucggccuacuaacaugcugggauuacagacgugagccacugcaccuacccaaggagguaccauuuuuugcucccauuuuacuaaggcucagagaagucaggucgcauagcaaagggaccaggacuagaauccaaacaaucugacaacaaggccuacauuuacccacuauucuauccuccccauccaucuccaccaaaauguguaguagacuuccaaacuguaguauaaacaacaucgcaucauuucaagacaggugaagaggugacaagauacuugucugaggaaagaaaaauaguuuccaagaggaaaaggagaacaaugacaaaacuacaacuguggcaaugagugauucaaggucuccucaaaaaaauuucuuggguuuucugguagaauugucaguaaacucuuaaaaacugcuuaaaaguuaccaaaggucauggaccccuauacugaggaaaccacuccagaaugaaagcuugaggaggaacguuugaggccaggagucucagaccagccugguuaacauaccaagagccccaagucuacaaaaaaagcuacuuggggcagggugugguggcucacgcccuuaaucccagcacuuugggaggcugaggcggguggaucacaaggucaggagaucaagaccauccuagcuaacacggugaaaccccgucucuacuaaaaauacaaaaaaaucagcucggcgugguggcgggugccuguagucccagcuacucgggaggcugaggcaggagaauggcaugaacccgggaggcggagcuuguagugagcugagaucacgccacugcacuccagccugggcgacagagcaagacucugucucaaaaaaaagcuacuugggaggcugagacaggaagaccacagaagacugccugagcccaggaguuguaggcuguggugccauuguacuccagccugggcaagagugagacaccgucucuuaauaaauaaaaggcuguaggucuuuaggaagaaacaaugaguaaccuuuaggauucuaauaucaaggcucucuaaaaaaaacagaaucuaggccggacgcagaggcucaagccuguaaucccagcacuuugggaggccgaggcgggcggaucacgaggucaggagaucgagaccauccuggcuaacacggugaaaccgucucuacuaaaaauacaaaauuagccgggugugguggcaggcgccuguagucccagcuacucaggaggcugaggcaggagaauggcaugaacccgggaggcggagcuugcagugaccugagaccgcaccacugcacuccagcccggccaaaagagcaagacuccaucucaaaaaaaaaaaaagagagagaaucuaggcuacacauggacacaugguagcucacgccuguaaucccagcacauugggaggccuaaaugggaggauuucuugagcccaggaguuugcaaccagccugugcaaagcagugagaccccaucucacaaaaaauaaaaauaaaaauaaaaaauaaucagcagagcaugguggcacacgccuguggucccaguuacucagaacacugauauggggcgaucacuggagcucaggaggucgaggcuaaggugagcugugaucauacugcacucuggccugggcaacagggugagacuuugucucaaaaaaaaaaaaaaaaaaaaaaaaagaaaaagaaucuagcaaucugguucccauuggucucagguuuauaagaaaucagaaugacacaauuuuaacaaugaucauaacuaacauuuaugaguuuuugcucccuaacaggcucuguuuugugcucuucacuaacucuucacaguaaccuaaugaggcagguauuguugucaccaauuuacagagaagaauaaagcaaauaaugcacacucaugcaccacuaacauuuuggucaacaauagggcgcacauacaaugauggucuguuaagaugauaaugaagcucaaaauuuccugucaccuacugacaucauagcugucguaaguuugucgcacaaggcaucacucaugcaucuguagugaugcuguguaaacaaaccuacugugcugccaguuauauaaaaguaugcagucauguccuaggccuucacuuucacucacuacucacucagagccacuucuagucuuguaaguuccauucgugguaagugcccuaugcagguauaccauuuaucuuuauaccauauuucuuuuuuuuuuuuuuuuuuuuuugaggcggagucucacuuugucaccaggcuggagugcaguggcaugaucuuggcucacugccaccucugacuccuggguucaagcgauucucagccuccugaguagcugggacuacaggcgcgcgccaucacguccagcuaauuuuuguaucuuuaguagagaacaagguuucaccauguaggccaggauggucucaaucucuugaacuugugauccacccgccucggcaucccaaaguggugggauuacaaggcgugagccaccgugucuggccuauaucauauuuuuauuguaccuuuucuauaccuuuagauacauuuagauacacaaauacuuaccauugccuacaguaaacaguaugguaauaugcuauacagguuuguagccuaagagcaacaggcuaaccacacagcccagguguguagucaagcuguacucucugggugugugaaguacccucuauguuugcacaaugacaaaaucgccuaaugacgcaauucuaagaagguaucccuaucauuaauuaacacaugacuguacuagugaguacagcuaaggauacucuuagaccauaacugucuacccccacgaaauggagggcuguguuacuuuagagaaauaucaugccagcucuugccagagauaaagcagcaaauagcuucugcuauccugaaauaaacuauuuuagaggaagacagugaggcaguggcauagucgaguuaaguagccagucaggucagagcaauguauugcuucugguuuguuaagcaauguguagcagugcauugcuucugauuuuuuuuuuuuuuuuuuuagguagagagagggucuugccauguugcccaagcuggucucaacuccuaggcucaagcaauccgccugccuuggccucccaaacuguugggauuacaggugugagccaccgcgcccagccugcuucugauuuaagggcaguguaggcagcugacccgggcugagugcacaccugcugagugcucgcuuccuggucuccuuggcgcgaaccuuccgcaacaggucuucuagcuugcuggauuccucaaagugaacccugagguccucauccucugcuaugcugaugauaucucuguagaacaaggauaugucaaagcccccagguuucuucaggugcaucaagucaaggaagaugccuguugcaaggguaaacaaaagugagggaggaaaaaacaauuuucagcaagugagaaguucuuucaguuaaaacugaaacaugcuuuuaaaagcucccugaaaacuagacuauuaacauuuucaggacuuagaaaaagugacuaaggaaaccaacugcuauaaugacuucagacaacuuuucaaauaaucaccauucgugguaauauuaaagucaagacaacuggccaggcacaguggcucacaucugucauccccagcacuuugggagggcgaggugguggaucaucugagguccagaguucgagaccagccuggucaacguggugaaacccccaucucuacuaaaaauacaaaaauuagcuaggcacagugguucaugccuguaauuccagcuauuugggaggcugaggcaggugaaucgcuugaaucuggaaggcggagguugcagugagccaagauugugccacugcacucuagccugggggacagagugagacuccgucucaaaaaaaaaaaaaaaaaaaaaaaucaagacaaucuuguucugacagaguccuuuagacagcuaauggcauggccaucugcaguguuaauguuacacaggcaucuucuggcuucacuuuauuuuuuuauuuuauucuaaaugguaaaaagcacaugccugaagucagguacacagaaagcaauaaaacugcacugggcacaacagcacaugcuuauagucccagcuacuugggaggcugaggcugagccaagacuccugaacuccuaaaaaaauaaaaaauaaaaaaacaauaauuaagugccaauuuaagagaacggggaaauaugcccaccuguaucucggagaucaccggcuuugguccuggcccggcuggcuuuggcacugucauugccauggggguugucuucauuggugaacagcaugauccucuuaugacucaucuugaauuggacaucacuaaagagguuggcacagacccacagcacuucacugagugaguagucagauccguggcccaucaugucuuggaaacguuuuugucccugcugccccuuaaacuggucaagcucuagaauucguuuugcaccugaucagaggcagggagucaaauggaaagaaaaaucagaagaaugucaguggcugccuuuaccacaagacuaacagaaggacccuuuuucaccccagagcuguuuaacccauuuaacaaaguccacaucgagcaagguccccuuauggaggaaagcauacuccuagacaagauguaacuugcuuccuucuccacaguccucuuugaucagaguacugauauucucauauauaagggaaaagcugaucuuaaaauauuacugaccuggauuauccagcuccuguaagacguaaauauuuuuaaaauucacugaauuuuugucuuucucgguaccauagaacaccacagccaagagaucucgaucacugcuuaugaucuuacugauguacacacuuuggauacacugaaaaaaaaaauucaauuaauauuuacuuaccacuaaauggaagcuccauaagugcucaguaccuauuaguugcucaaaauaugugcacugaauuuguauauggcacuaaaauaaggcaagaucccuaccuucagggguaaugaaucagugaaaguaaugggcauaaauaucaaauuuuaacaaaaaccagaaugcaguaaguauacauuagaaguauaagcagucccugccauugaaaucagagaauuaacaauacguauauucaggccaggcacaguggcucacaucuguagcaaucccagcacuuugggaggcugaggugggagaaucacuugacccuaggagaucgagaccagccugggcaacauagugagacuccaucucuaccaaacaaaaaaaaacaaaaaaauuagcugggcauggcagcacagggucccaguuacuugggaagcagaggugaaagaucgcuugaccccaggaggugaaggcugcagugagcagagacugcaccacuacaguccagccugggcaacagagugagaccuuaucucaagaaaaaaggaaaagaaguaucagagggaggaaauugugcuaugggaguuggggcgaagcaaagcauuggaaucagaaaaccuggaguugaguccuacugaugucacuuacuuaacuggcugaauuuggacaggucaugugaucuuucaaguaccuugguaucaggaaacagaguuuauauacacaguuggcccuccauaucugcugguucugcaucuauguauucaaccaaccucaaaucucaaauauucaggaaaaacaaagaaauucccguuucaaaaagcaaaaccugaauuugccaugugccaaguacuacauugaagccaugugaaugaagugaugcauaggcauuguauuagguacuaugaguaaccuauagaugacuuaaaguauaggggaggauguguguagguuauaugcaaauacuaugccauuuuauuuaagggacuugggcauccucggauuuuggaauccacggggaguccugcaaccaauucccucaauaacaagggaugacuauauaaaauaauuacaaugcuuaaguacaugugaccugaaaauaagucaauaacuaccaguaagcgcauccuugaaauaaaacuguuuaacuacccaguuaaagacaucaguauuccaguaacaggaaaggucuaccccucuauauaaacuaaugucagcaucugguacaucaggucuuguaagagcucaucaguucacccaggcgcgguggcucaugccuauaaucccagcacuuugggaggccaaggcgagcagaugacgaggucaggaguucgagaccauucugaccaacauggugaaaccccaacucuacuaaaaauacaaaaauuaguuggaugugguagcacgugccuguaauccuagcuacucaggagguugaggcaggagaaucgcuugaacccaagagguggagguugcagugggcugagauugcgccacugcacuccagccugggcaacagagcgagacuccaucucaaaaaaaaaaaaaaaagagaguucaucaguucuaggggccuaccuaauucuggagcacuaacaaaauuaagucuucgggccagguacaguggcucaugccuauaaucccagcacuuugggaggccaacacaggaggauugcuacagaaguuugaaacuagccugggcaacauggcaaaacaaugucucuacaaaaaacaaaaaaauuagcugggcaugcacaugcuuguaguccccacuacucagcuacucaggggugcugaggcaggaggaucaccugagcacaggaggucaaggcugcagugggcagagaucaugccacugcacuccagccuagaugacagagcgagacccugucucaaaaaaaaaaaaaaaaauuaaguuuuggaaccugcaaagcugaggaauaaaccaaccauggugauccccuccauguccugccugagcucuagcuggccuucguccacagcuauucucuccuuaaaugcagaacauguacuauagcuagucacugacaacaauccacauggcaaguagucauuuccauaaauauuuuaaucuacucugaggagucuacaaacuuuuaaaagaaucugguaagggcuccuuuuagguucuaaaaauuaaaaacaaaaacuaaaacagaauuuuagaaaauguuuucuauugcuuaucaacuacugaauacuuauuaucgguuaucaaauugugcucaucuaugaaugucucauuuccuuccuaccuaacacuacauuuucuucugaggucuuuaggcaucaaggguuccauuaacucucugaaauuacagguagaauugugaguacuaucuuuuuugaggggaagguauguagcugucaucauauccucaaagagguccacgguuggccaggugcgguggcucaugccuguaaucccagcacuuugggaggccgaagugggcagaucacgaggucaggagauggagaccauccuggcuaacauggugaaaccccaucucuacuaaaaaacaagaacaaaaaauuagccgggugugguggugggugccuguagucccagcuacucaggaggcugaggcaggagaauggugugaacccaggaggcagagcuugcagugagccaagagccagggcagcaaagcgagacuccgucucaaaaaaaaaaaaaaauagguccacggucuaaaaaagguuaaagcacugcucuucaaaguaauggucuccaaaucaguaacaucagcaucaccugacaauuuacuagaaaugcaaauucuugguccccauucuagacauagagaaucagaaauuuugauuguggggcaagguucuguagucuguguuuuaauguccugcaaguaauucuguuugagaaccacuuuaaauuaacgauuguuuuuauucauaguucuauuauuuuauuuuacauacacuuuuuuuuuuugagacagagucuggcucuauugcccaggcuggacugcaauagugccaucucggcucacugcaaccucugccucccaggugcaagcgauucuccugccucagccucuggaguagcugagacuacaggcgcacgccaccacacccagcuaauuuuuguauuuuuaguagagacgagguuucaccauuuuggccaggaugguuuugaucucuugaccucgugauccgcccaccucggccucccaaagugcugggauuacaggcaugagccaccgcgcccagccuuuucuuuuuuuuuuuuuuuccaagagacagggucuuacucuguugcccaggcuagaguucacuggcacaaucauagcucagugcagccucaaacuccugggcucaagcaauccucucaccccggccuccugaguagcugggacuacaagugcacaccaccacacccagcuuauucuuuuuuuuuggugcaagauauucuggugugccaacuacaagaacuauuucuuguuuucuugagauggagucucucucugucacccaggauggagugcaguggcgugauccuggcucacugcaacguccaccuccccaguucaagcaauucuccugccucagccuccugaauagcugcaacuacaggccugcacuaccaugcccggcuaauuuuuguauuuugaguagagacagaauuucaccauguuggccaggcuggucucgaacuccugaccucaagugauucacucaccucagccucccaaagugcugggauuacaggcgugagccaccacacccugccuaccaagaacuauuuguacacaaauuagaacaugaaaaguuucuguucaguuccaaauucuaaaauuaugagacaugagauauauaauaaaucugugaaaauucuucucuacgaaguacacaaaagaaacaguaaucccucucccucucccucucccuaucccucuccccacggucucccucuccccacggucucccucucccucucuuuccacggucucccucugaugccgagccgaagcuggacuguacugcugccaucucggcucacugcaaccucccugccugauucuccugccucagccugccgagcaccugcgauugcaggcgcgugccgccacgccugacugguuuucguauuuuuuugguggagacgggguuucgcuguguuggccaggcuggucuccagcuccuaaccgcgagugauccgccagccucggccuccggaggugccgggauugcagacggugucugguucacucagugcucaauggugcccaggcuggaguacaguggugugaucucggcuugcuacaaccuccaccucccagccgccugccuuggccucccaaagugcccagagugcagccucugcccggccgccaccccgucugggaagugaggagugucucugccuggccgcccaucgucugggaugugaggagccccucugccuggcugcccagucuggaaagugaggagcgucucugcccagccgccaucccaucuaggaagugaggagcgucucugcccggccgcccaucgucugagauguggggagcgccuuugccccgccgccccgucugggaugugaggagcgccucugcccagccgugaccccgucugggaggugaggagcgucucugcccagccgccccaucugagaagggaggagacccuccacccggcaaccgccccgucggagaagugaggagccccucuguccgggagccgccccgucugagaagugaggagccccuccgcccggcagccaccccaucugggaagugaggagccucuccgcccagcagccgacccguccgggagggagguggggggucagccccagccaggccagccgccccauccgggaggugaggggcgccucugcccagccgccccuacugggaagugaggagccccucugccuggccagccgccccguccgggagggaggugggggggucagccccccgcccugccagccgccccguccaggagggaggugggggggucauccccccacccggccagcagcccuguccgggaggugaggggcgccucugcccggccgccccuacugggaagugaggagccccucugcccagccaccaccccgucugggaggugugcccaacagcucauugagaacgggccaugaugacaauggugguuuuguggaauagaaagcggggaaagguggggaaaagauugagaaaucggaugguugccgugucuguguggaaaaaaguagacaugggagacuuuucauuuuguucuguacuaagaaaaauucuucugccuugggauccuguugaucugugaccuuaccccacaacccugugcucucugaaacaugugcuguguccacucaggguuaaauggauugaaggcagcaugcucguuaagagucaucaccacucccuaaucucaaguacccagggacacaaacacugcggaaggccucaggguccucugccuaggaaaaccagagaccuuuguucacuuguuuaucugcugaccuucccuccacuauuguccuaugacccugccaaaucccccucugugagaaacacccaagaaugaucaauaaaaaaaauaaauuaaaaaaaaaaaaaaagaaacacuaaucuuuuuaauuaagcugaaauuuagauuuucuaagugaacaauuaagagguauuuaauacauucacaaugugccaggcauaguggcacaugccuuaaccccagccacacaggaggcugagguggguggauugcuugagcccaggaguuccaaaccagccugagcaauagugagacaccaucucaaaaaaaaaaagcaaggccgggugccauggcucacgccugcaaucccagcacuuuggaaggccgaggcgagcagaucacgaggucagggguccaagaccauccuggccaauauggugaaaccccaucucuacuaaaaauacaaaaauuagcugggcauggugacacgugccuguaaucucaccuacucgggaggcugaggcaggagaaucgcuugaaccagggagucagagguuguagugagccaagauugugccacugcacuccagccuggugacagagcgagacuccaacucaaaaaaaaaaaaaaaaaaagcauaaaugcacacacaaggcugggcgcaguggcucacaccuguaaucccagcacuuugggaggccgaggcaggcggaucacuucaggagauugagaccauccuggcuaacacggugaaaccccgucucuacuaaaaacacaaaaaauuagccaggcaugguggcaggugccuguagucccagcuacucuggaggcuaagguaggagaauggcaugaacccgggaggcggagcuugcagugagccaagaucacgccacugcacuacagcccgggugacagagcgagacuccgucucaaaaauaauaauaaaaauaaauaaauaaauaaauacacacacaaacauucacaauguugugcaacuaccaacucuaguuccaaaaaauuuucaucaccccaaaagcaaaccccauacccauugagcaguugcucccuguuccucucuucccugugccucagguaaccaaccaccccucugcguuaagaacuuaccuauucuggauauuucauguaaaugaaaucauacaauauuugacuuuuuguaucuggcuucuuucacuuagcauaauacuuucaagauucaucuacuuuguaguauguaucaauuauucauuccuuuucauggaauguauaucuauaugccacuguuuagccauucaaaauguuuuggaauaagauagaggugguggcugcauaacauugugaauguguuaagugucacugaauuguauacuuucaaauaguuaauuuuauguuacaugaaacacaaccucaauuuaaagaaacaagaacaggucagguacagucaaucacgccaauuucuccacagccuugccaacacuuauuuucugcugguguuuuuuaaauuuuaguuuguuuauauagugggugugagugguagcucauuaugguuuucauuugccuuucucuaaugacuaaacaugcugaguaucuuuuccugugcuuguuggacaucugcauaucuuuggagaauuguuuuuuuuuuuuuuuuuuuuuuuugagacagagucucacucuguugcccaagcuggagugcaguggcacaaucucggcucacuguaaccuccgccuccuggguuuaagagauucuccugacucagccucccgaguaccugggacuacagaagcgcaccaccaugccuggcuaauuauuuuugcauuguuaguagagacaggguuucaccauguuggccaagcuggucuccugaccucaugauccgccugccucagccucccaaagugcugggauuauagacaugagccaccacgcccagcuggagaaaugucuuuucaaguccugugccuguuuuaaaauugaaguugccuuuuuauuguagccaucuuccccaaccacaggcaguagucaacucccaaguaucacucacucuuuuccacacuauaacugugggaacuucccuucuuccuuuauacuuccaucucugcaagaggaggagccuacuucuuuuuucuguuugaccuccugggcucaagcaagccucucgccucggccuccugaguagcuaggacuacagguuugcaccaccacaccuggaugauuuguguauuuuuuguagagacgggguuucuccauguuaccagguuggucucaaacuccuaggcucaagugaucugcccgucucggccucccaauguccugagauuacaggcaugagccgccaccaugcccagccaauacuguuuuuaaauuugucuuaaauuaaaagguagucuuaccuggaugcucaugucaaaaggugucaacucaucuucacucugagauucaaacauagccuuggaggcaucaaccaaaaaaaucaaacuaucucuuccugaauauuuauagucuccuauggggaaaaaaauggaagaaaauguuuguccuuguuuucguauuuguuuaccauauaagauaaauaaaggccauaaaggaaaguauaaccuaauaaauuauuauaaggugaacaaccauaaaaucuccaccuaugucaggaaauugagucuugccagacaccccagaaaucccucuuacauucccucccaauuacaacacccaccuccccaaaaaagucaauauccugacuuuuuuuucugagauagggucacacucccaucacccaggcuggagugcagugacgcgaugauagcucacugcaaccucgaacuccugggcucaagccaucauccugacucagccuccugagcaacugggacuacaggugugugccaccaugaccagcuaauuuuuuaaguuuacuguagagaugguauugugcuacacugcccaggcugaucuaaaacuucugagcucaggcaauccuccccaccaggccucuauuuuuuuuuuuuuuuuuuuuugagacggagucucgcucuguugccaggguggaguacaguggcacaaucucggcuuacuacgaccuccgucucccagguucaagcgauucuccugccucagccucccaacuagcugggauuauagacgcccgccaccacucccagcuaauuuuguauuuuuaguagagacgcaguuuuaccauguuggcccagguuggucuugaacucccggccucaggugauccacccaccucagacucccaaagugcuaggauuauagacgugagccaccgcaccccaccccgcccuggccuaagagcugggauuauaggcaugaucuaccacacacccaccccuuacguuucuuuauaauuuuaucacccaaaccuacauuucuaaacauuagcuuugacuuaauuuucuaaagccucuucaucuacagauacccucucuuuuuucccuuguaauuuaucuucugaagagccaagaugcuuuguguuauacacuuuuccacauucugaauuuugcugauugccuuuuuaaaaaaauuaauuaggcggggcacaguggcucaugccuguaaucccaacacuuugggagaccaaggcgggaggaucacuugagaucaggaguucgagaccagccuagccaacaugguuaaacccugugucuacugaaaauacaaacauuaggcugggcgcaguggcucacaccuguaaucccagcacuuugggaggccgaggcgcgcggaucacgaggucaggaggucgagaccauccuagcuaauacggugaaacccugucucugcuaaaaauacaaaaaaaaauuagcugggcguggugguggacaccugcagucccagcuacucgggaggcugaggcaggggaauggcaugaacccgggagggggagcuuccagugagccgagaucacgccacugcacuccagccuaggugacagagugagacucggucucaaaaaaaaaaaacaaaaaaaaaaacaaacaaacauuagccaggugugguggugcccaccuguaaucccagcuaaucaggaggcugaggcaggagaaucacuugaaccugggaggcagagguugcagggagcagagaucacaccacuacucuccagccugggccacagagcaagacucugucucaaaaaaauaaauaaaaaauaaaaaauuauuuuggcugggcacaguggcucacgccuguaaucccagcacuuugggaggccgaggcauguggaucacgaggacaagagauugagaccauccuggacaacauggugaaaccccaucucuacuaaaaauacaaaaauuagcugcguguaguggcgcaugccuguaaucccagcuacuauggaggcugaggugggagaaucgcuugaaucugggacgcagaggcugcagugagccaagaucgcgccacugcacuccagccugcgugacagagcgagaacccgucucaaaaaaaauaaaaauaaauaaauggccaagcacgguggcucaugccuguaaucccagcaccuucagaggccgagacauguggaucacaaggucaagagauugagaccauccuggacaacauggugaaacgccaucucuacuaaaaauacaaaaaauuagcugugugugguggcgcaugccuauaauuccagcuacuagggaggcugaggcaggagaaucacuugaacuugggaggcagagauugcagcgagccgagauuagucacugcacuccagccuggcgacagagauuccaucucaaauaaaaaaauaaaauuauugaauuaauuauuuuagaaacagucuuguucucucacacaggcuggaaugcaguggcgcaaucauagcucacugcagccuugaacuucugggcuugagcgauccucugccguggccucccaaaguauugggauuacaggcaugagccaccuugccuggccugccgauugaccucuuuugguguagauuaacagaguccucuguccuuccuacuaaggaccuagagaggcuuaaucugauucagguuuucuuucuucagcaugacuuuaucauaaguaacauauuuuuuccuaaaaagguauauaaugucuggucaucuccaaguagcugggauuacgggcaugugccacuaugcccagcaaauuuucuguauuuaguagacaugggguuucaucauguuggucaggcuggucucaaacucccgaccucaggugauagccugccucagccuccuacucccaaagugcugagauuacagccgugagccacugugcauggccugcugcuucuuaauaaguuuaauuagcugucuccuggagaacaaaauggcaaugugugucaagaaccuuaaacaugcgaugacgcgaucuuggcucaccgcaaccuccaccucccguguucaagcgauucucccgccucagccuccugaguagcaggauuacaggcaugcgcuaccacgccuggcuuauuuuguauuuuuaguagagacaggaucucaccauguuggccaggcuggucuugaacuccugaccucaggugaucugcccaccuuggccuccaaaaaugcugggauuacaggcaugagccaccgugccugaccuauuuuauuuuauuuuauuuuauuuuugagacggagucucgcucugucgcccaggcuggagagcaguggcgcaaucucggcucacuacaagcuccgccucccggguucacgccauucuccugccucagccucccgaguagcugggacuacaagcgccugccaccacgccuggcuauuuuuuuguauuuuuaguagacacaggguuucaccguguuugccaggauggucucgauguccugaccucgugagccacccgccucggccucucaaagugcugggauuacaggugugagccaccgcgcccggccuuauuuuuuauuuuauuauuauuuuuuugagacagagucucacucugucgcccaggcuggagugcagugaugcaaucucagcucacugcaagcucugccucccggguucacgccauucuccugccucagccuccagaguagcugggacuacaggcgccugccaccacgccuggcuaauuuuuuguauuuuuuuaguagagacgggguuucaccauguuagucaggauggucucuaucucccgaccuugugauccaccugccucggccucccaaaguacugggauuauagaggugagccaccgcgcccggccccuauuuuauuuuuuuugagauagaguuucacucuguugcccagacuggagugcaguguugcaaucucagcucacuguagccucugccuccccgguucaagcaauucucgugccucagccucccaagcagcugagacuacaagugcaugccaccacagacucagcuaacuuuuguauuuuuuaguagagaugggguuuugccauguuggccaggguggucucgaacuccugaccucaagugaucugcccgccucagccucccaaaguguugggauuacaggcgugagccaccacacccagacaaauuacaguauauuuauugagauuacaagugugagccaccacacccggccaaauuaugguauauuuaaaaugagcuauaggccacgcacaguggcucacaccuguaauuccagcacuuugggaggccgaggugggugaaucaccuaaggccaggaguucaagaccagccuggccaacauggugaaacacugccucuacuaaaaauacaaaaauuagccgagugugguggcgcacacgccugucaucccagcugcuugggaggcugagaugggagaauagccugaacugggguggcggagguugcagugaaccgagauugagucagugcacuccagccugggcgacagagcaagacucugucucaauaaauaaauaaauguauaugcacuaucguuacaauacaagaaaucagauaggccaggcgcaguggcucacacuuguaaucccagcacuuugggaugcugaguagggcggaucacaaggucaggagaucaagaccauccuggcuaacacagugaaaccccgucucuacuaaaaauacaaaaaacuggccgggcgugguggugggcgccuauggucccagcuacucgggaggcugaggcaggagaauggcaugaacccgggaggcggagcuugcagugagccaagaucgcgccacugcacuccagccugggcgacagagcaagacugucuccaaaaaaaaagaaaaagaaaucagauacagucugggcauggaggcucaugacuauaaaccuagaacuuugggaggccaaggcuuggggguaucgcuugaggccaagaguuugagaccagccugaucaacauagcaagauccugucucuacaaaaaauuaagaaauuauugggaguuggcggcacuuguagucccagcuacugagguagcugaagcaggaggaucacuugagcccgggaguuugagguuacagugagcuacgaugaucucaccacugcacuccagccugucucuauuaaaaaauuaaaaaauauauauauuucauuaggaaauaaauauugaaagauacuugaaagaaaaauacaaaaaugucaaaaugcugguagugguuguguuagagugguagauuauagcaaauuuuuuucuuuuuuguauuuccuauguuucucacuuuuuuuuuuuuccugagagagucucauucugucacccaggcuggaaugcaguggcgccaucucggcucacugcaagcuccaccucccagguucgcaccauucuccugccucagccucccgagcagcugggacuacaggcgaccgccaccacgcccggcuaauuuuuuguauuuuuuuuuuaguacagacgggguuucaccguguuaaccaggauggucuugaucuccugacaucgugauccgcccgccucggccucccaaagugcugggauuacaggcuugagacaccgcgccuggccguuucucauuuuuaauaaaaauauucaaaauuuuucugcucaggaguuaaauuaaccaguaugaagauuacauguaccccuauuucucuuccuuuguuuuauguguuacuguguugccugcacauacacucccaaacguggaggcuauagugagggaaucaaucacuuuccuguaacuguguugcuugcguuuauucuuugguugguguaguuauugcagggugggggcauuuuuacacugagguccuggaaugguaacacuacuuuccuggaugagaagggucucaccugaaccacuuaagaugacaaaaaauaccuauggucauggccauuuaucagggaccaaaagaugucaaacuaccaguguccaaaaaaaacuuagggcacacuagaguaagaucugcauauaagagccuaggguagcucugcgaaguucaaaggaagaaaagaauuucagaauuaucugggaggagaagggcaggccaucaaacagcaaaguccauccagcagagauaggcagggaaggucuuucuuccacacaccgaauggcacuacaugcugaagucacuuaccacuugcuucaagguucucuucuuguucuuccucugcuucuucaucgcccucgguuuuguaauaugacucccacccugacauguuggcuacugcucacuaggcgaaagacguuaacgucaguaacaggcaaauuuaaaucgaaaaaauaccgaccucuagguucuugugagaucuguucuaaaagcuugguuaguagugaggaauguggacgguaaauccugcugccucgaaagcucggcagucggacugcauguaaaugcgcaugggggccaucccaguagcugccucaucucagcuaucccucacguuucagggccggcggcggcccgcggaagccagaucccggaggucccgcccccgacgccauuuagacggugagggauucccgcuccaggauucuaugcugacuaacggacccccucguccucaauaccgcccaaaaaccuccccaaauuccucaaucacgcccaaugagaucucaaacgcagacaggccucaagcgcaggcgggccgcaagcgcaggcgggccucaaacgcaggcgggccucaaacgcgaggugccgccuccuucccgaggaaggagcguggucucgagucugucgcugcuccucggauucgcacacuuaaggcuaacgcuaacccucuagcaaggcuaugggggcgcgcgagaccgaccgagcgaagcgggacgaggccaggccuagcuggcgaacaacacaaauggauaacggcccgcuuaccuuuggcgcagggaagcgaccaacuuggacagaagacgacaauccacgcaugcgc

SEQ ID NO: 192564 - RNA, 5359 nt, Homo sapiens
ucaguucuugaaccuguguugauguuuauucugccacugagagguacaccaggguuuccaaagacaguaggaauauuucuguucucuguguauauugaacagcugugcaccuaagcagggugccugaguaggaaguuaauuucauuuuaagggcuggagcuuguuacaaguagcggagccaagccuuugcacauccauuuucuucagaacccaaggaaaacuagcccaucuugacagcucuacuuuugcgccuguuagugcugcccugaucccugacaggaagagcuggcuaauuuuagauaaucugugcccugacacugaagugucuaaucauaggggcuauagaaacaacuacauuaacaagucguccagccucaugcccaaugucacaauuuuugaacagauggccuccuuccuuccuguuuacugacaugcaaggcucugagaaaaauaauucaauccaauuuacagcaaacaccacauuucaagaaaagggaaagaacaggugauguguauaccaaggucccacuugcucaggcaaaaagaggcugcagaaaauugguucaucaauggaauucuaucacaaagugaccauuguauagugaguuuauuugugcucuaaaauaguaucaacgugcaucuuuccacugaaugacuucauggaucguggccaacauagaacuuggauaggaaauccuuuggccuuggcgcuucuguuucauggaagaaccgcauaacauguguccgcugcuuccauacuuuaauuguuucuuccaguucgaucuuucccugaacagugaggagagaggucaucagucaaaguugucaaguugaaggcauaugacacugaaggccaggauucuauucucugcucagcauggacuuguugaaugaccuugggcaaguaacuacucugucugggcaaaguuucuaugucuggacaaugagguggucaggguaaaucauuucugacacuuuucagauucuuuaacucugugguuaacugguaccaagaggagaaacauacagguuaacaggcuccuaucccaugacuaccuaaccugacuggcuuaacuuauguuucugcuuaucauuucuucuguuacugacuggucuaugcugaagcucccauugaugcuaacgugacuggccagggggacagaaucagccccaggauuugaguccauuuauacaggacucauaaccacccuaacugccucuuccagcuguaaacuggcauucagaugaagugguaacuucuagggaugagguucaagaagaguucaaacuuuccucccuauaucuuuuuuuaugguuauaaaaugcaagucccaguggauguucccuugaugaaucuuaucuauuuaaccagaugauaaccuccaaguucaaguauuucucugaaacacagcaauaaucacugccgaaccaguagcugcuuucuaaacuuggagacaaaauguucauuuggaaagacuaagaaguaguggacaaguuggcugaucuuuuaaauuggucagggagggucaguuaccuuaaugaccagaagaucaaccacccuggggucugugacaugggcauucuucauaaacauuucucggacuuuaucccgucccauuuucacagugauguccagcuggaauuggugcacuagagagaaaaacaugacucaggguagaaauuguaugguuaaauaaaaccuagagucaaaugauacucauugaacacauacaggucgcccauucauuucuucaccaaaaaauuagccugacccuaggcuaggugcuugaggaugagacaugugauucaugguauuugcucucaaggaacuuauuauuuguuuggggaaaaagaccacugaauuugaagaggcaguaaagcauuguucaagaguuugaacaaccuggguucaaaucccagcuuuuguuagcuauaugaucccguguaaguuaacuuucuugugccugaguguauuuuuuaaaaaauuauuuuaugggcugggcgcgguggcucacgccuguaaucccagcacuuugggaggccgaggugggcggaucaugaggucaggagaucgagacuacccuggcuaacacagugaaaccccgucucuacuaaaaauacaaaaaauuagccgggugugguggugggugccuguaauuccagcuacucgggaggcugaggcaggagaauggugugaacccgggagguggaccuugcagugagccgaggucgcaccacugcacuccagccugggugacagagcgagacuccgucucaaaaaaaauaauaauuauuuuauuagcugggcgcgguggcucacgccuguaaucccagcacuuugggaggccaaggcagguggaucaccugaggucaggaguucaagaccagccuggccaacauggugaaaccccgucuccacuaaaaauacaaacaugagccgggcaugguggugggugccuguaaucccagcuacucgggagacugaggcaggagaaucacuugaacccgggagguggagggugcagugagcugagaugggccacugcauuccagccugggugacagagugagacugugucucaaaaaaaaaaaaaaaaaaaggcugggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucaggaggcugaggcaggagaauggcgugaacccgggaagcggagcuugcagugagccgagauugcgccacugcaguccgcaguccggccugggcgacagagcgagacuccgucucaaaaaaaauaauuauuauuuuauuagcugggcgcgguggcucacgccuguaaucccagcacuuugggaggccaaggcagguggaucaccugaggucaggaguucaagacagccuggccaacauggugaaaccccguuucuacuaaaaauacaaaaguuagccaggugugguggcacgcaacuauaaucccagcuacucgggaggcugaggcauggggaaaucacuugaacccgggagguggagguugcagugagccaagaucgcgccauugcccuccagccugggagacaagagcgagacucugucucaaaaaaaaaaaaaaaaaaaaaagugaguuaucauuacuguuuuuuucauuaaauacuuaaaauuuuacuuuuguuuuuuauuaaugcucaggcuguucuaaguucucaacacuauuacuuauuccccuuccuugauuugauuccucagcuggaguccugaugauggauaccauaaaacccguguggcacagguuugaguaacuggccagcuacagaucacugaucuuccccauagggaugcauacuccuugaccccuucuuuucucuccucuucccuugcuuucuaggcuccuguagcccucugccuucuuuuccuccucucaagacccuucugacuuugggacuuucuucccaaaacagaauuugagggaaggucuugggaggggucgguuuagaaagagcuggauccucagagucaggauaccuggguucugucuucuacuuggccacugauuuacccuucacaagccacccuuuuugaaugugguccuccuucccccagcaccuuccuccugcaaccagagaggguucuggguacuccuagaaguauucugccaggcaaacauuauguuuucaaacugcugaauuugaaugcaccaccccgaaacacacacacacacacacacacacacacugcuacagucacuccccacacacaucuuuuaucugccugccccugaaggcaucugaauuugcagucccugaaccagcagaucacucaaguuucuccuucucuaguaucgcguggguuuaaguucuggucaguagcaauuuuuccaaaagucagcuugaagacagggacucuguggagcagacacaguucucauaugucaaagaaccggguucugcuuggaagcugcugcuaaggaaagcccuauaaauaacaaaaauaacaacaaaaacaacggcagcagcuaauauuuaaugaguuaaauaugcaucaaguccuguucuaagcacucuagauauuuuaacuuaauacaguaaccuucugaagaaggaauuauuauucccauuuuaaagaugaagaaacugaggaauagaugaaauaacuggcccaaggucacacagcuaguugagggcagcgccugaagaaaaguccgugcuccuaaccaccacauucuaccgccuuuucacacacacaagcagggacucgacagcccugaggaguggcaccgugcuccagcucacucaaaaacaccucuuucucgcacuuugggaggccgagacgggcggaucacgaggucaggagaucgagaccauucuggcuaacacggugaaaucccgucucuacuaaaaauacaaaaaaaaauggccggcgugguggcgggcgccuguaaucccagcuauucgggaggcugaggcugaggcaggagaaugacgugaauccgggaggcggagcuugcagugagccgagaucgcaccacugcacuccagccugagcgacacagcgagacucugucacaaacaaaaaaauccaacgggcaucuauaauuacacucugcaacucuagacuuuggguucuggguacaacaguggcucggccugggcccugggcacaucacuucaccucucggugccuccgcugccucacccacaaagugagugugucacugacagucaucguccucccgccaauugcgaaggacaaaagagaccaaagcuccgauagcacguacgaaugcuaggcacggccggucugaccaccgcgccgccgccagguccggcccaugguaggcucgggugacccucuuccccugaagcacccgcagucgccucugcccaaguuggugaccucagcugggcccaugagaaaccccggccgggccggcuacgaccuugagcggcggccuccggguccccacguaagccgcuaccucucaccaguguucggcaccucccgauaccaggcgcgguagagcucgcgcacccuccgcuuggccucguucaugucccgacugaaaaugggcuucacgaaggugcuggcgguagaaguagcuuggcggacgccgcuccccgccaucuugccaaagcauccacuccacaaccccaccccuuugcaagcagcgcgugcggaccgcgggcgaaugucuuuucccauuggcuaaggaggaacgccccgccuguaugcugggugggcgggaggaugacucugaggcucuc

SEQ ID NO: 192565 - RNA, 55427 nt, Homo sapiens
caagguuaaaaugaaguuuauuauuuuuuugauuuuuugauuuuuuuuguuuuuuguuuuuuuaaauaaaacuguuugugaaacagcuauuuuauccccauggcagagugaccccugaaagaugcacuaaccccuucuuaaggccauaacaagauuuuuuuguacuuuuuucuuuuuuuaaaacucagauauuuaaaaauuauacaauuuacaaaacaaaacaacacaacauaaagaaucacguagcauggggcugccuaucugacagguccucuuuuccuuuauaaaaaugaaagcaaaaagaaaaagggguuaaauggguguuccuggucagcuuaacccacucugaucacagcgacagucccuccccgucccugccuacagcucacacugccagcucuggcaacacaggccuggaccuccucccauccccacgggucccugugggucagggcacagcugccuggaaugugcugaggacagggggccccagaggagggucaucccuugauuuugcugcugcuguguacacuugaugggguccuugagguccucaccagccacagugacccaggacacagcuaugaccucaggcaucugccaauuucacccccaaaaagaaaaaauuaaaaaaaaaaaaccauaaauaaauaguguuucuggaaaugaaaaaaaauuuauuuuuguguuuaaacaucauuccccuacucuugaaaacauggaccaucccuguauuucccccucccccaaaaccuucccacuuugagacaaauuaaugacaaaaggaugguucugcugugguuugcuuuuucaauccugggucuaguguuuucugaacuggugugagacaggcuaaagaucaacgccacacacacaccccguccuucaugagaugaggguuuguucaguucaaucucacauuuaaauuucacuugucaucggaacaaauuuggagaucuuuaacgagauaauuuuaaaacagaaucaaaagggauagcgcaccuuucauuuaaacaaagucuuuccagacuaaaaauagauuuauauauauauauuuaucccucccuuuuaauuccccccacccuuuccccaucaucccaccccuccccccuccccccacauugucacuauggagauuguguccauggaaacagccauuccaacgucuugggucuuucuuuccuguggugucacugguuugagugugaugugagaacuuaaggaagugcuggcaugggcaggcacgcgggcggggcggggcggggcagggcaggguguggcugcacgguaggacgauuuccauuccaucacgaguguccaccaccuucucaucuccacagucucaccuggaagacaagggacacacagugaaggccaggagccuccacaggguccaccaccaacagccgcuguuccgugguaccccugggagcuuucagcagggagccugcacucacgccccucugcagaugugcugcugauaugggacacacccgagaccaaugccagggccacuguguggcucuggaucuggaaugugauuaaaggcagcaaugaccuagugggggugcugggguuggacucugagggcuccucagggcaugucugccuuccuagugcauaaaggaaccaguacagcagagaacucccugaccucagggcaggccccacuuguggggcagcuggugggguuuugccagugucaggaccccaguugugacugaaaccuacaguaccuggucaaucuguggaagaaacuucucgaaguccagccuuuuaggacaguuucacagcugccucuagucaacacagcuaguuguuuguuuuugagacaagacaucgcucugucgccuuggcucccugcagccuugaccuccugggcucaagcaauccucccaccucagccuuccaaguagcugggacuacagguacacgccaccaugcuuggcuaaugacagucuuuuuuuuuuuuuuuuuuuuuuuuuuuugagacagucuugcucuauugcccagacuggaguguaguggugugcucuuggcucacugcagccucugcccccuggguucaagugauucuugugccucagccucccaaauagcugggaucacaggugcacgccaccacacccggcuaauuuuuguauuuuuaggagagaugugguuuugccauguuaggcuggucuagaacuccuggccccagcugaucugcccaccucggccucccaaaguguugggauuacaggcgugagccacuacaccuggcccacagucaguucuucaugcuuaaaaagaacacucuucccauggccucuaacagggagggcagguuuucugaggcucagacagagcuggacuauguuaauccuuucgaccucucaggaaccugagaccccuaggucucccauccccaggcuggagggcuucucuccucuuccagcccaugugcagaaggggauucugauggcccacguaggacagauggauuguaccaaaggucccuguggaacgcuucaugggccaucugauguggaaaggucucaaagacaaacagcaguuuccuaggaaucaguccaguaaaauuucaccagaagccagaagugguggcagccuugccccuccuucacuugcuaucugccaaucacugugcuuaagacugucacuggggcucaccuaacugcuuccucaagaccaauuuggugcccuccccugacaaaccccaagaacccaagugucaccagcccuuucugcuuccauaaaguucacacacgcagaacugcuaaggcggcuggggccugcgggagcuaagauugagcuguucccaagcacguacaugcacaugcucuugcccaaggagguuccugacuacuuggcagaaaacaccaauaagcaggaacacacacagaggccauggcacaacaucaccacagacaaguaaaagcaagcccugggaaugcaggccagcaguugagcuaaugggcaccuaccuccaagaacacagaagggugucaucuuguuggggcugcaggaugcccgugugaaucaaggccaaugcccacacguacccugccaggcucugcucaaggaggggacagggcaggguuugcccucuuuaccaauacacagcagucuugggccugcaccccaaucuugcucauuacucagaagaacaggaccccacaccagcuccccagugaagaaugaagcacaugucagcagccagggucugccuggccaguuggcucugcgagcugcuacuugugggccccucccuggggcgcgugguggcccaggcagcggcaguuccucagcaccugcagccuggggcucugcccucuauagccuucguguuccucaggucugaugacuagaccagcccaaacacacgauauccugaauguaaugggacccuaacuuuucaagaguuacuuuaaaaaaguuguuccuucaguagggaaauuaggaaggaaggaaaauucucuaagcacuaugugccaggcccugggcuagaagcuuuacagauauuauaucacaguaacguggaucugccugacccccaucuucaagagagcuaaagcucaggaaggcgacacauguagcccaaagcgacguggccagaggugggacuggggcuuucccaacugggcccuaggggcugcguaugcuagggcaugggguguggcugagagacggcuggguccccgacagugagccugggagcagcccuggugccagccagccugagcagcaggagcgaccugccgccccugugcugaagacugugaauucucuuuuaaagaacaucaccuugcuccccagcugccagcauccaggguuucgucuugggccaacaccuucccaggcucccucacuuguucccucccuucccuucucgcucacacuguccuuucugcuccccuuuggccucauccguggccugaacccgggacgccauccucgcguccuuccacaucagacuccaagccugccuuucccaacugcagcaaaaacucaucaucucaacaccacucacccuggccaggauucgcccagagcccauuuccucauuucuaaaacagacacuaauuccgacuagagagggaggauaugaagggaaaccuaauucugaaucuauacugauuaagggcaccgauggucaggguccaagagcccuuuuuucccugggaugcacucauuucuuucuuuuuuuuuuuuuuuuuuuugagauggagucucacucugucguccaggcuggagugcaguggcacgaucucagcucacugcaagcuccacgucccggguucaugccauucuccugccucagucucccgaguagcugggacuacaggcgcccaccaccacgcccggcuaauuuuuuguauuuuuaguauuuuaguguuuuaauuuuuuguauuuuuguauuguuagccaggauggucucgaucuccugaccucgugaucugcccgccucccaaagugcugggauuauaggcguuagccacugugcccggccugggaugcacucauuucuuuaacacagacucacuuggcacuagcauaguuacaugccccgcucugggcuaggcuuugauggugcaaagacagacguggucccugcccuaauggagcuuacagucuaguggagagacagguaguaaacaaguaaaugaucugaaauuguggugaugcuaggauggcugcaagcgaggaggggggcaauggagacaaggauuuagaaagggaaaggcuucucugaggaaguaggauuuaagcugagacccaggagaugggagccuguuuucaacaugaagauggggagccaaaguguuuccagcacaaggaacugugugugcagaagcccagaggaaggaagccuggucccugaggagcuggaggcagccaggggccuggagagucaccugagacuuccauagggcucuggaaggcaaggugagaugucugggcuuuguguggaagaugacaagaaucucugacguagagaagggacaggacuggagggaggccuaaugaagauugcacuuggcugcugagcaguggcagggaggcgggcacuauagcagccacaaugccugggcuggggcugguggggaaggaaaguggacagacucaggcucuccucuggagguguaacccuggacugccucuggaccaguuuggggaaaggggaacucuagaaugugacauucaugcauacacacaaauggacugugugauguccagcuccaggggcaggggggccacgccccguucccugccuugcucagcguccauccauggcuguucugugcaggguacauagcauccaggaugcagcauuagcccugaucaagguuaugcuucccaugugcuggaccacagggccuguuagggcaagcuggggccuccuuguuuaauucacgacaggaggaagagcuggguauagggacuccacugucaaaagcccugccaaccaaugacacaagccagcaaggcaacccccuuggcacaaagagacagugggcaaccacgggccugcagaaggacuuuuccccuccgcacuccuggcgagggucagguaccagauaccucacaggcugggaggcaggggcggcaucuuuuaaccccaagccuuggguauuuuuugcuauaagagacagcugcaggguccaaucugcugccuugaccccuccaacucccaagagaaacccacagcuaggcauggcagaucaacgggcugagagccagugugcugugcuggcacuuagagacauuucccaauggaaucucaaaagguuggcacugcuauuccuguuuuuacagaagaaaccgaaguacagagacauggaguagucugaucuuagucacacagcaccuaucauaucacucugucagaacauggcgcacuaggaggcagacacacacgcacauucgcugucuguucccugccuugucagggcacccaauaaugguggcucucuguccccagcauggggcccaagaugaguccuccuuuagucagaggugugauucuauccccagucaccagggcuucuaccacaaaugaaggacggugaccacccucaaugucacugcugaacugggaaaccaggaaaagcuauaugccuugugggaacagcacauaaaaaacauuucagauggacaggacuggaugcagugaguccauccucucccuccaagagcugaauggaaugguucaaccucaauggaccugagacgacucucuucaaugggugaggccacuucaucacugugcuucaacccagaaggaugaagcucauuguucuguucaagaguuggccgggcgccguggcucacgccuguaaucccggcacuuugagaggucaaggcgggaagaucacuugaugucaggaguucaaggccagccugggcaacauggugaaaccccaucucuacaaaaaauacaaaaauuagcugggcgugguggugcacaccuguagucccagcuacucgggagggcugaggcgggagaaucgccugaaccccagagauggagguugcagugagccgagaucgugccccuguacuccagccugggcgacaaagugagaauccgucuccaaaaaaaaaaaaaaaaagagucaagggcccugacagcuaggaaggaaggcccaagaaugacuagagaggaacagaugaacaaaauccccaggagauuuguccaccaggcccagggccugaacuuucuuuuucucaaacacagaugcaauuccaggacaaaaacaaaaaacacuuaagcucuuuccuuaaccaggucuucuaggacacauuccaggaauacgcaucgugguccccuacagaacuugacucuaaccaucuuggccugugcuggcacaggggugacaaugggaaggcacagugacacccucaggagcguagggacaugcaggagggccaacagaaacaguccuuucaaaaccacgcaaugcaauggcugccuuguccuaagggcuaaucccaggaaaaggagcaggcagugcugcccagcagguucuggaaaaccagcagccacucgcugaugguggcaauguacuccaaguccaagaggcuucauuugcucaucugguuccucugacccaggaacacauggaauggcuuccacccaccuccccacuuugcucugaucccuucacugccagcccuacuccccggaagaggaaagagaaaggcaccacacucaacgcucuaucaagaaggcacucagcagcccccacuugacuucucaaauggcguggcagccgaggggccuucuccggaaauuaguagugguaacaaggaggagggcacguuccagaagguggucaggcacaugguggugccggaagggacacgucuagcguagcugugugagucaaacuccugaggucgacacagaaguccucccauuugagagaaaugaccccucaaugaauauuucugagacaacuaguccuccugccccauccuguagcagcaagugccacaagguacauuuugguuuuucuuuucuuuacaaccuauuucccuucaugccucagugacgcagggagggugaaggagcagcauggagcucagaggccugcagcuucuagagaccccaaguccuaucauccuguuuucacagaugccugccaagagggccgugaccacaauaaucccacacaaacucacagcaagcacaacucaaucacaagaauuuuuuuucuuuuuuugagacagggucucacuguggcccaggcuggaauguagcggcacgaucauggcucacugcagccucaaccuccagguuugaucaagugauccucccagcucagccuccugaguagaugggacuaaaggcauguaccaccacgcacggcuaauuuuuuuuuuuuuuuuuaauguagacacagggucucacuguugcccaggcuggucuugaacuccugggcuuaggcgauccuucugccucagccucccaaagugcuggcauuacagguaugagccaccaugcccagccucgagauuuuuaagaguaaaauuaaaucagaugcuagagucuacuaaaucuuugaggauuuuucuuuccuuuguacuucugcaaaaaggaauccuucauaauacuggaaaaaaaagauuucuaauaacaaaacccaagaguucuguuguuuucaaaggaaaacacaccauaagcuuuacagaaauguaguaaauuaaaaagaagagaccuuugacuggaacccuuucugagacgggggaaagagcaggggcuacuggcaagagaugcccugcccaagaaagagaccuaaaagccuguuguguccacucacaaggccaccccuggccagcugugcccugaagggcugccuucaggaacagucacccugcaccccauuggcaguggacaguuuagaagcccccacuccuuuccacagauaaucuggggagcuaaguaaccaauggaagaacacugcauccaccuggcguugucauccacaggaugaaaugcugguggcagagcauagagcgagcaggagggcagaggcaacgacgccugcugggagccgggcaggaugcagggagcccgguggccccgacucaccugugcuugcuguccuuuccauucccacgagcacacugccccccucacccccgcuccgacugcucugugcugaggcugccuuucgcggucuuguucugcaagggggggagagggcacggaaggggaggcugacacgggcaaaaccaagaggagacagacaggugggagaggacagugcagaaaucagggagggcaaagggaggacaggaguggcacauggaaaaggaaagaaaaggcagagucaguccugaccgacaaacaggagacauucagacaggguuuucugaggcaaaaugugacccuuaaaaaggggaguucuaaaaauaacaugcaaauuaaguaaaaauaaagagaauauaagauccugugaccacuccccgcccuuccccagaaauaauuuuuaaagaaaagcauaagcaagcaucuuucaggagcauuuugagggcagaccucucuggacaaccuccuucuaguacuuucggcccuacuagauuuaagacugcgagugaccagugaccaccaggugucagugugaccucagccagagacacagugcagccccugcaggaaacaucagguggcaguggucuccguucugauccuuucuuggggcuccuucuccauauacacccuccccacacacauaugugguauccacaaacagaccauucaccccuuaccucccacccuuuccuaaaggaagcgaccacgagaccaccuccuaaauaaacugggaaguggagcccgagacagcccauccacugugcaucaggcugcuucugcagaagcacaaccuggaagagacugagcuuccccagagccuuguggucagcucgacuucuagucugggaagaugccuuugcacaggccucaaggccuagaaccagacuuaccaaacgccaaccugugaauugggguucuauucaccucaaguggaaaucaguggcuugaucgaguuagauauucucaccucucuuaaugaacagacaaacacccccucucccaaaacacauuucuccugggauccucauaauacuccgagugcuggcccccaugccacgggucucccuucagcaucaugccccuccacccucccagggccaggaggggacuaacagccggaggcacagguggggacaggugugggugaggcccaccaacaccuggucuucaggucuuucaggaggagccacccucgaucccaucccugcugguagcucuuggggccucugacucaccuugugcuuagggcaccucaccgagaaguucuccucauguagcaaacaaucuggaagacagaaggggacagucagauggagacuucacagcuggacauagguguggucaugcuggcugggauugacagggucagacauaaagguagcaggucgcuacacuuacuucuaauaggaaaacauuagagacaacccaaguaagcuaugauaccuuaacaugauggauaucggucacuuaaaaauuaacauuugaaaagaguuaaugguauggaaaacacccaugaaacaaaacugcuugaaaaaaccaggauguacaaauguauaaaugugcuaauuuuauuaaaauguuucuacgcauuaaaaaaagacuuggggcuggguaccauggcucacaccuguaaucccagcacuuugggaggccgaggcagaaagaucacuugaauccaagagucaagaccagcuugggcaacacagugagauccugucacuauuaaaaaaaaaaaaaaaaauacugaaaggcugggugugauggcacuugccuauagucccagcuacuugggaggcugaggugagaagacugcuugagcccaggaguucagacugcaguaagcuacuaucacaucacugcacuauagccuaggcaagcaaaacugucuuaaaaaaaaaaaaaacuacuugggaggcugaggcaggagaaucacuugaaccagagagucggagguugcagugagccgagaucacaccacugcacuccagccuggugacagagcgagacuccgucucaaaaaaaaaaaaaaaaaaaaaaaaaaaaagacugaaaggaaaucuaugaauauguaacaauaauucucuuuggguaagaagauacagcugauuuaaauuuuaucuuuucuauauucccacgauaucaccaauaaaugcuauuuuaaaaauccuugauucuaggcuaaccccauuucucaggcucaagccaaagccuccuuguaaaaacacuuuaaaaucuagacgcguauuuucuucucuguacagagaaugcccaggugucugagacagaaagguggccaggcccaagagccccacugucaccuuugccccacgacccacggagacacagaagccuccaacacaaaucacauaauccacacuaaaugcuucagaggaagguaaaaucccaugaggaugcuuuuaauccuuggaggaaaaaugauucauuccaacuuguaacaugaugacagcauccuggauggcagcaaggacacaucugccuccaggugagcugagcucucacacaaggguagugcauggaucagggcaaggaaaucuaauuaaugaguucacucugcacaccacagcuccuggagaccgacagccaggucacuggugcaaaacgcgguggcagaauguuaauaaauauugauaacacauucucagagagcucccaggcaccauggcaggaggcagccacgguacuuauccuuguuaaauuuaaacugagauccagacuagcagccugugcacccacagauuucaagugcaauaguaauaagcaaugaacauacacaugaaaacuuuucaggucccgguauccuaaaacaaaucaaaaagacccuuuuauauuuggccagaccuggaacaucauagccugucuuucguuggagcccaugaguaucuaagagagugggcggcagccuucuuggcuccgugggcccaagagcucagcaacuuacuacuaaccuccaagccccucccccagcaagcaacuagcaaggcaauaaaugaaauguguuaauuuaaaacccacaaguacauagugugaccaagacucccgcugcuccaaucugccagagaguuuauaaacagcaggagccagacaacuggagcucaggggauaugcucucuucuuaccugggcucuggcagcaagcacuaugcuggcuuagucucuaguuugggccaaacagaaacaguacagcacacguggggcugggccacgcuuacgccacagggguuuauaccagugaggacagggaccacacgagcagcaaagggugccaucagaaaggcgcagguggcucaguucccucacggccacagaacagugaccagcugugauggaccauuaauaaaacacgccucauguuaggaaaugcguucccucugaguuagaagcagaaaagaguaagacacuaugaaugcacgcuaacgacaacuugaaacuaaugccagauacaucuggaaaugaagucuccuacagcaaucugccugaggcaguguccaucucugacaaggccucccaugcaggaacacugugcagacaaugcccuccucuguucucauacauguccacaggccgucaggaagcacaauucacguuccuggcaggggccagaaccacagcuagagagcucagaaaccuggagggcacaggggagcuucuccucuuaccagucccugcugggagggaagagugaagagcaguagguguaguaaaaccucuucugaggacucugaacaggcaacugcaccuacauggccagccagucaaggucucucaaucuguguucuucaaggcccaggcaccauccuacacuguccagagggcgcagucagcacuucugcauagugaagucaaaguaaacagcuugcgagaucaucauccaagcucaaaaagaccuacaagguggccuagucaacaagauggcuugcagacacaaacaucaacccccagaagagaaggccacuuucauuucccucuucaagcucaaaggcagaauggauuuacuaagcuccucauuauaagcucugugaagcuucagauacccacaugcauccacaugcucccaggcugaggauggugggcucaaggagggagguaggaaaaacaagaaggguuuaauguccuuuggaucuguuguguagcagacacagacuccaauucaccuacacucuaccccaguacuacuguuauuccuuauguuggcacacugcagggcuugggacacaggggccugccagccccacccugccuugccgaaggguaggcucaggcuccugggccauaaggagggaaauauggggcucuuggcacugggacuggcuccugugaggcagacggcugucccccggggaggagucagacuacuggcauuuccuaaugacccauccagggcucugauggcaccagcaagaucaaagucugcagcagagauagcagcuuuaaaaugcuacugcaacgagagcugcagaaaguagaauucccagcuguuuuuucaugagaguagaagaaaaaaaaaaaacccuccacacaagguucuuuacgcacaguggaauuauuaaugagcuaccacagccuuuuuuucucgucuuaauuguuguggcucauugcauuaaauacauuaauuaaaaaaaaaaaaaaacagagcucaugcucuuauuacuguaaccccccccaccuggagccaaauccugugccuaugacauaacaagcaacacaaaacagcugaccaugaugucagaaaugcagggucaacaucaggugggggggaagguggcaggagucacagaucaugaaacaaagauucuguuucuauggagaugucccaguaauaaaagucuucccugagacaucaacagcucuuuaaagaucuggguggguugacagcaaggcagagaugaaaauguuaaacugcucuuuacuccauaagggagguuagggauucucaaaccaaggacuuauuuuuguuaugauuagaaagaaaaguccaucaauaaacuuguuuccuggauacaaaguuacaucauacacagagagcaauuuccaagaagacuguguggaauaauacaagcguccauccccacagagcagugcaggccucugggucacugugacuugggucaucaaaaagaccgcaaugaccaagacauggucaucuugugaaacugccucugggucccaggucuccacaugaaggagcaaagugcacagcagcagaggcagcaaagccagaggccgacagcccuacccucacuccucccaacccagaccccucugucuugcuggacacgcggccaccaacuucuguuaaauagagaugcuaccagcuuaacuaggcaggcuaccaagaugggccccaaaacagaaaaugacagacaccauuuacucacaaguccucagcuaauaaugaggguccugcgcuucucugcuggugggcuggggugacaaccugggcacaagcuuccacuagaggagaggauguuccagugcucuauggccccuuccaaaaaaucccaaccauauugccugaacuuggguugaggaggguagcucuaagccugugcuguucagccacuagccauacauggccacuuaaguuuacauuaaaaaaaaaaauucauuuccucagucccacuagcacucaaugaucacaucugguuugugguuaccacauuggagagugcugagcuagagcguuuccaucauugcaguauguuaggcugagcuuugcugcuugacaucuuagaagcuggaccagaaggcaggcuaucagcagaacgggggcagccuccaggggggcccuugcugaagugugcucgggugggauguggcaccggccugucagcacacccuaaugugucccugaacacagccucagugggggaccacuucuuacccagcugcgaacugggagagccaaaacucacaguauucccaauauaaaacuaacaaucaaccauaaaaaaacuuaauacuuaaaaauccucauauauagcugggcauaaugguacaugccuguauucccagcuaguugggaggaucgcuugagccuaagaguuugaguccagccugggcaacacagugagacccugucucaaaaaaaauuuuuuuuuuuuucacuuaaaagccauuuucuuggccaggcgcgguggcucacgccuguaaucccagcacuuuggggggccaaggugggcagaucacaaggucaggagaucgagaccaucccggcuaacacggugaaaccccgucucuacuaaaaacagaaaaaauuagccgggcguggcggcgggcgccuguagucccagcugcuggggcggcugaggcaggagaauggcgugaacccgggaggcggagcuugcagugagccgagaucgcgccacugcacuccagucggggcaacacagcgagacucugucucaaaaaacaaaaaaaaaaagccauuuuuuucaacuagaaacaaaacuuuauauuacugcucccccucuuuccuggccacuagacuacagggaagaaaacacaauauuacgauguaacuagagguaaugaaaaugagaaaaggcaacugguuggcucuuuuaaaaacuuauuuuuauuugaacagaccuguucuugcuauguuauccaggcugaacuugaacuccuggccucaagugauccucuagccucagccucccgaguaccugagauuacaggugugaaccaccauaccuaguuaacugguuagcucucuuucuuuuucuuuugagacagagucucgcucuguugccaggcuggagugcaguggcgugaucucagcucacugcaaccuccaccucccggguucaagcgauuccccuaccucagccucccaaguagcugggacuacaggcacgcgccaccacaccuggcuaauuuuucauauuuuaguagugacaggguuucaccauguuggccaggcuggucucaaucuccugaccuugugauccgcccacuucggccucccaaagugaugggauuacaggugugagccaccgugccuggcccaacugguuagcucuugaaagagaaggauuuaacagcuguacuacagaauauggcagaccaugacccaggguaaauuacaccuuagacucaacaugaaaacauuuggaggaaaaaagagaacagaagggauggacuaaaacccaaacucccugaacugacauuucaaggcuacuucauuuuuguuuugagauagggucucacucuguugcccaggcuggagugcaguggcccaacugagggucaugcagccccuccuggguccuuccaucucagccucccuggguagcugggacuacagacaagggccaccacgccuggcuaauuuuuuguauuuuuuguagagacaggguuucaccauguuggccaggcuggucucgaacuccugggcucaagcaauccucccaccucagccuccgaaagugcugggauuacaggugugagccaccacaccuggcacucuguuucugauucccuaucuuuccguugaucaaauagugccuuggccaucaagcugccuuucaguccacauguacgugugaauacacacacuuuuguaauagucuaacuggcaucagcauuaucuucucuaccucucuuguucuuuuuaacuguuucuccuacagaagcuuggagagaaaagagggaagggggagguaagggcaagaaggaugugaaaggaauggagacauaugcuuaaacaaaagucaggagcugcaagcaacugcugcgcuggaaggaaggggggggcaggaugaauucugagaccugauccaagucuguuggcccugcucuguguauguuaugccucacgccuguucccaucaugcagucagccacgcccucuuccccuucccaucaaauucaaaucaaaccccgccuccuauggacagcguggcugccuccguggacagcccugcuucucuccuggggaagcacagagagggggcaugcacaugacaagcaccaugcuacuugcugccuucucucaccacuuuuccucaaacgugaccacaggcauuaugggggcugccugggugauggucuuagauacaucuaaugcucaaguaacuagaggacauuaugucaagugaaauaagccaggcacggaaaguuaaaagcugcauguucucgcucauguggaaauuuaaaaagcugaucuuacggaaguauuaaaaaguagaacagaggauacuagaggccaggaaggggaaaggaaaggaagagauaaguagagauuuguuaaagaauacaaaauuacaucuagaugggagaaauaaguucuaguauucuguaucacuguaggauaaccacaguuaacaacauuauauuguauaguuucaaaugacuagaagauaccaaauguucccaacacagacauguuguuugagacgauggauuugcuaauuaccuaggucugaucauuuuauauauauauugaaacauuacugagcaccccauaucuacaauuacuguccauuaaaaaaaguaaaaaacgcugggcgcgguggcucacgucuguaaucccagcacuuugggaggcugagguggguggaucaccugaggucgggaguuugaaaccagccuggccaacauggcaaaaccccgucucuacuaaaaauacaaaaauuagccgggcaugguggugggcgccuguagucccagcuacucgggaggcuguggcaggagaaucacuugaaucugggaggcagagguugcagugggcugagaucaugccauuguacuuuagccugggcgauaagagcgaaacuucgucucaaaaagaaaaguaaaaaacuuaauaaacuugaaauuaacacccaccuugccgccaaaaaaguaacuggggaaaacacccacugaagggacuaaaagucuagaguaagaaaggugauuuucccagguuaucgaagcucugagucaaaacucaagucuucugcgucacucauuggauggcacuucuuuaacaaaauguuucccuucuuucaacaguuaacacacugcaaaacaucccccuaucaucucagcaaagaaaauacaacacucuauuguauguauacaacguacugugauuuagaguaagaaauacauauuuuagucuucaucccugauuccuggcacagaccuccuaaaacccguguaaauuccugagcaauuaggggugcuaggagcaucuuuucuucuaauauuugguuuuugauccugguuccugacauggagcuccuaaacccuuggaauuuccuggauaggagcacuuuuuguucuaaggcuacucuuggugguuccuggaugggggcugggcaccagagagacgaagcugugauuagcagcuuggaacuguuagcucuacccaccccacuccaggaaggacagagggggugaagauugaguuaauaauugauuaugccuacaugaugaagccuccaaaaaauccgugaacuacuggauucagagggcuucuggacugcugaguagaugaaggugccucagggguggugccccuggagagagcauggacgcuccaugccccugcccacacaucuggcccuauguuucuuucauguggcuguucaucugcauccuuuauaauggguaaacacaagugaaguguuuccgugaauucugugagccauguuaaacauuaaucaaacccaaggaagcggucuugggaaccccaguuuauaguugaucacucagaaacacaggucauaacacagggcuugagauugguauaugaaguggggagcggucuugugggacugagcccuuaaccuguaggggcugcacuaacucugcuuaguaucagaaccaagcuaaacuauaggacacccaguugguguccaauggugaauuaccugugugaugcuaucaagaaaagaaaguaaaaagacaacucagagaauggaagaaaacauuugcaaaccacauauccagaauuacaaauaauucuuuuuuuuuuuuuuuuuuuuuuugagacagagucucacucuguugcccaggcuggagugcaguggcgugaucucgcaaccucugccucccggguucaagugauucuccugccucagacucccgaguagcugggacuauaggugcgcgucacaucuggcuaauuuuuguaguuuuaguagagacgggguuucacuauuuuagccaggcuggucuugaacuccugaccccaugauccacccgcccggccuacaaauaauucuuaaaacuugacauuaaaaagauaaacaacccaauuuuacaaugggcaaaggaugugaauagcuauuucuccaaagaagauguacaaauggccaauaggcacaagaaaaaaaugcucgacauuagccaucagggaaauacaaauaaaaaccacaaugaaauaacauuucauacccacugggcuggcuacaauuaaaaaaaaaaaaaaaaagaaacacauaugacagcaagugucagggaggaccuggggaaaggagaacacucaugcacugccacugagaacguaaaauggggcagccauuuuggaaaacagucugacaguuccuuaaaagguuaaacagaguuaccauaugauccagcaauucuacucccagguacacauccaagagaacugaaaacauguucacacaaaugcuugcaugugaauguucuauagcagcauuauucauaacagucaaaaaguggaaguaacccaaauguacagcaaagcccacagagauagaaaggauugaguccaacagagcuuaaagggaaaaaaaaaucauaaaaauuuaaaaaagaaaacagaauagugguugccagggacuggagggaagggaagggagaugagugcugcuaaugggugggaaguuuuuuuaugaagugacaaaaaaaaaaaaaaaaaaaaagaaaagaaaagaaaaaaaacaacgacaacagagagaaucaaacuguauguccuaauccuuuggaugcucuggacaagggucuguggucuccucuuaccugcaucaauggcacacggguaaugguaucggaaggagcagccuuuguuguagcagcccaagguggcgccugccuccuggcagugggaacauuucugaaaggaagggaaaagucaggcaugucaguaucccagauuuggcccucuccuccaggccuucccugguccccaucuguuagaccucagcacgugucucugugguuagaggaguccgugguggcaggaugagcuggucaauuucuaaaugccauucacugaccacaccaugggaagggauccagcaauaauguuuuagaccaagccucacaaauguucucaaaucaacaauacagcagggugagaugagcaauccaugucauaaaggacaugccagagugggguccccagcccugccucugguacccccgccauccacccacccacacacuaugccaggcauuuccuugcugcuaucgugagcggccugcagaucuucccuguuuacuucugcugugaaaaucugggguaagagaggguaagguaguagaguuauauauaaaccuuuuagaauuagaaguggaauuugguuucuaguucuuguauuuguaagaagauuuuauuuuuauuuuugaucuacuuaccccaaaugcccaauacauuucccuuuucagaaaauaugggcuccugugugcaaaugguauuuuuauacaugaaucuuauuuuaaaugcaccagaaaaccugccaugaauuucuggcuaagugagacauuauuuuguaauugagacacuccuccuuauauggucagguuuucuuaaaguggggcacaucucugucagcccugugauguggcugcugugagugcucauccugucagguaagaaauguguccuaucagcaacaaacacauucauaaaacucaaccacaugugacccuacuaaggaugcuggcucuucagauagcagaggcacacaaccagcaagacuagcuggaagagacagaaacuuguuccugcuucuaugaaaaauaaaaguguucccuaagcaauuacacugagcuggcucaggcccccgacacagauacugauggaaaacuacacuaacgccagcaacagcaaagcccaagcgcucgccacgcucagacugaaugaucucauccagcccucugcacuauuccaccuggcaggcacuccuaaugcuucacgugaaacucuugagacaccaaagggaaaauaacuuguuccaggucagagcugagauucuggaugaucaucucuggcauccuccagagacaaaagagguaggaacaagggcuggaagagauuaguccuucaaaagcuuugcccugcucucagaagaucaagguccuucugggugcccauaaucaguaaauguuuaucaugugcccucgcacccuuguuaagagagaaaagaucauuuggucuggaguaaaccaaggacaaguucacagcauuucuaguagcccuagacucugucgaccuuugucagugccacagagcaucucagaaucaaaaggacuaucaacuucagagaagggaguguggguaguccaucgguggccaaccugcagccaugucugcugccacuuucuuuuuuugagauggagucuugcuuugucgcccaggcuggagugcaguagcgcaaucuuggcucacugcaaccucugccucccaguuucaagccauucuccugccucagccuccugaguagcugggauuacaggcguaugccaccacgccaggcuaauuuuuguauuuuuaguagagaugggguuuugcauauuggccaagcuggucucaaacuccugaccucaucgcaucuggccuccugcugccacuuucuuacucaagaggcccgaagauauggcccucccuacccugggggaugaaucacagugagugguggccauuuaggaauggguauggucaagcauuucugguaggaaagucugcaggaaaaagggcuucugaaaacauuuugcacuccccccaaccuuuuuuuuuuuuuuuuuaauauauuuugagacgaugucuugcucugucacccaggauggagugcaguggcacaaucauggcucacugcagucucuaccucccaggcucaggugauucuccugaccucagccucccgaguagcugagacuacagggugugugcuaccacauccagcuuuuucaaaaaauguuuuuguagagacagggucucacuauguugcccaggcuguccuugaacuccugggcucaagcaauucucccaucucagccuccaaaagugcuaagauuacaagcaugaaaguuucacccucucaaaaagagacaagagggaggaacagguaauuuuucuugcgcagccucugugaggauuagacagugggaucuguggcagccacaguaucaccaugaggggacagcccugaagacaaagccagccugcugaggacagaagaguggcaagauggagagaccugggccuaccaugacacugucaagcacuaaaucacccaaacccaggaccaggccaccucuagccuuguuacaggaaacuugggugcugcuguagaaggguuaaguaugcaugcucuggaaccuaaauaacugccugguaaguggcuccacuuucuagcucugccuucuuggccaaacuccuaaccucuguuccucaaccuacagacgugggacuaauaauagcacucaccucauagaaaugucauaaggguuaaaugaauuaauucaggcuuaaaacaguggcugggucaaaagugcuaaguaaaugugacccaagaugaccaugugucagacauaugcuagauaaucuacaaagaccaucucaugaaaagcaaccacacagcaggccucaucaccaucccgguuuacaagaggaaagagaagacguggagcuuagaucugaacaauguccauuugcuuccuaccucaacuccacaaccuggcaagcagugugcaaacuccacuaugauuaauuuauaacauugcauccaaaggggaaagacucucaggcuguauuagggacuuagagaaagauccuuaaagacaguuuaguucagugguuuuugaagugugguccccuggaacagcagcaucagcaacacucagggacuugucagaaaugcaguuuuguuuuuuggguuauuuuugagacagagucucguucugucacccaggcuagagugcaguggcacagucuuggcucacugcaaccuccgacucccauguucaagugauucucgugccucagcuucccaaguagcuaggauuacaggcaugaaccaccacaccuggcaacuuuuuguuuuuuuacuagagacgggguuucaacauguuggccaggcuggucuugaacuucugaccucaagugauccaccugccuuggcuucccaaagugcugggauuacaggcgugagccacugugcuuggcagaaaugcacgcuuuugagccccaccuaaaucuguguugugagaaguccuccaggcuauucugauguacaaugcaguuugaggaccacuggucuaauucaacuccccaacuuuucagaugcggaaaaaagaaacccagagagacacaaugacugggugagcuaggauuacuggauuacugguuuccugagagccauucaguguucugucuccuacagagcaaucagaucuugggauaugguaggcagaaucccaagaaccugugaucuuauauauacaaaaucaacuuuguggaugagauuaagucaaggaccuugagaugggaagaauaugcuagguuauccaggugggcccaaucuaaucacacaggcccauaaaagcaaacgauucccccccagagggaguuacaguugucagcuucagggagaccugaugauuugccagcagggucauaggugcaaugcugcuggccuggaagaugggagaagggacagggcggcagcugcagaauuuuuaaaaggcaaggaagcauguucuccccuaagacucuggacuuuuccaaagcccagcccacaccucaauuccagcccaguaagacaccuguguuggacuuugaaccuacagaacuguaagcagaacuguauuaacaaguuugugguaagguguuaugacaaugauagaaaacuaauacacggggauuucccaagacucucaagugauuguucauuuuccuuuuagguucuuuuuuuuuuuuuuugauggaguuucgcucuugucgcucuggagugcaauggcaugaucucggcucaccgcaaccuccaccucccggguucaagcgauuccccugccucagccucccgaguagaugggauuacaggcaccugccaccacgcccagcuaaucuuuguauuuuuaguagagaugagguuucaccauguuggccaggcuagucuugaacuccugaucucaggugaucugcccaccucagccucucaaagugcugggauuacaggcaucagccaccgcaccuggccuuagguucuuuaaugcaacagauuucucccucaauuugccuagugaaaccuacaauuucacuaggcaaauugugacaucaggagaucaauaaagaaggaacucugggucugucuucgacaucuguuuuucuuguagaagaaacaagaggcuaaagcaaagugaccugcuaaagaucacauagcuaguaagagaacuuagaacuuuaccucuuuuucuucugaaccccaaguucaacuuucuucauaccauaccaugacgccuguuagcccccuucauucacucaacuauccaacauuugaaaaguacuuucuaggugccaggugccaaagauagaauauaaauacuuaucuauaguaucuuccauguguaagguuuucccuucuacccaaaaaucaauacccaggccaguacaauuucuaauuaaauuuuuauucuauacuuuuuaccuggaguagcuauuugcauuaucauccuccuaugcuacaaauaauauauuaaagucacugcacagcuaaauguccuuuguuuuugaccacaguguuacuacauucacuccaagcagagguaaguccauacaauacugcuccccaggaagaaugagacacauugggggcuccaagcaugauuucuaaauuaagacacauuuuaaaaauaaggaauggcccaaacuucaaaaucuuuuaauaguaaauuuuuuauuauggaagggaauaaaaacuauuuuuaaagaacucuaauaagaaccucacauuuuuugauacucuaaacuugggaaauaaauuauaaaagguauuauuaguuuugggacauguuuuaacggaaaguggcccagauacagagcuugaaccuuucaccagacuuugucacugucucagaggcagggcucgcugacuugagguagcaaacugcaaggacugagucaacuagcguuguuuaauccuuaucugagggaagcuuuaagggagccuucuccaagccugaugccugcucauucacagaaaggcucuuucuuaugagauauaacagcaaccugaaucaucauccuguuuaauuagcaucucagagcagccucagaacaccaaagcaacugggucacaguaguauuauagcacacugaugacaacugguuuuguucaagccuugcagauuacccuccacuacugugccuaagacggcucuuauccagcauggcacacacuucugcucaugcucacaauauuuacuuacucauguuuguccaucuccccuaaacugugagacuuguucuugcaccccccaaggacuggcacaccauaggcacuguaaaugugggcugauggaaugaaugcaaugucugacaaacuugagagccugaagacaacuaaugaggauacucuucaaugaguuacaaaacugaugcugguggagcuuggagaauguggaacaagguauguguucauuuuuggccaccagcaaaaaguuuuuuguccuuuuaauuaugccuccuacaucuaggauggaagccgcuguccucccagcuaucaaugccaacuacguggcagcuagaugggcuacauacaaggagcuacccuucaaggcccugugagcauuucuuugaugcaacucugcauccuaucaagcuucuuaaagacuacuucaaaguguuagccaaagcaauacauacauagcccuagguguuuugguccuuacuuccuuagagcuagacgaucuccuuacguuucuucaugaaaagcucaugagacuggcuggagaaccuuuaacuugccauuaacacaaagacugagggaaugggcucuggcaccagccucugggaccugcaccacggcccaguaccaccaaggcuucccagucaaccucagagggacagagacuuguccaguucuucucagguccauuuacucagugcuacucaaguuaugguacauggauuuagaaucugcacuuauguccuacagcugcuccggcaaaagugccaguuucagaaacugaauccauuaaauacacacuuaaucaauuaugaugucaguaugaaacaucagccagccacucacuggcuaagggcuaauuguguguacuuaagacaaaaguuccaggcuugacuagcuuuuuagaauaaaugugguuggucuaaugugcauacuguccagguaugaugcagcacagggcuacuggagaaaaaaacugagggugucagcacacgugugaaagccaaaagucaccaggucaauuuuaucaucuguaaaauggggauaacaguauuugcuuugccuucugccuaaagcugcuguguaaaauaaccauaaaaguguuuuacaaacuagaaaguuauguaauuauuagaacuuuuaaauaaaaauuacauaaaacauacauucaucucugucauacuuuggcaauuacugauaucaaaaucagauauaauacaaaguacagucuauuaaauuaagacaaacaguuuaaaguuaauuuuuuguuaaguaauuucucuccuacaaucugccuuaaacaagcagacccugcaugggucuggacaccugcugcuggucguuuuuuugguaagucuagcugcuguauguuucaguaauguuucaucuccgacgguguggaaggucaguucuuggccaagucucuggacacuucacuucuuagcuacuauuuacuauuacuuucauuguaucuccccucucaauucuccuaucugggaccaauacaaacuaaaacuauuuuuaaagcuuucuaaagcauuuugcauuacaagaaaagauguuaaauaaauggggacuaauaaugacacacaacugcauacaaauuaaauucuagcaggauuucgaaagcauugaaaacugccccaaaauggcauauugagcacaacuagaaugagaaaaaccgccucacaggcuugccuguuguacucuacagacagugcccucuguuauguggagagcagaccuggaaaccaaugacuccuuugcugccugcaucagagucaccugccaggugcuccuagccauacuucuccaaaccugucccuacucacauuaaucuagaauaaucugcuguggcugauucuggacccucugcugccauguggaucuuagguccaacagaugguacuauuccuuacaacacacuuagggcccaauaguucaucuucucugccuccugggacccagucaucugcuucccuccaauacaagcccaugaaaacacucacacaaacuuucuuuaaucugaucaucuuucaagcauaauuugaaauaaaauuauauauuuagaucaccauucuccucccauaaaagccccaaucaaaacauggcucugcuacagauccugacaaguauuuguuucuuugggaaaaccuuucaagucaaauuauaaaccuguaauaagugucucuguggcugaguggugguugggugguagcuggccccagaagugguacaaaacgcacagaaagccugacccagguccaaaucucuugaguguggccguuuuggcggcaucuaacagcuacauccuuggauucuguuuugauccacaaagaaagcccguucccuuauuucccuuccgaugucuuugugcccauaaggugggaccagccugucugcaguuuauaguaaaguuaugauguuuuccaucagguuagaaagguugggauuaaaggacuuuucuccuucauuaagaauguccuucuuugucuuucuguacuucaucuaccaaacagaggaugucagaaauuagccacaaucuugagcagauaaagaacauauucagaauacacacagcuuuauacaauggacuuacucauuuuaacacugagcaaacaaauaaugagaaguuaguaggucuaagacgcagcuggggaaggaggucuuuucuccagaagauucugucacauaccucuuuuuaugccauuguugcuuuaaaaaauccagauucucaggccgggcaugguggcucacgccuguaauuccagcacuuugugaggccgaggcaggcggaucaccugaggucacgaguuugagaccaggcuggccaacacagugaaacccugucucuacuaaaaauacaaaaauuagcugggugugguggugcauggcuguaaucccagcuacucgggaggcugaggcaggagaaucguuugaaccugggagguggagguugcagugagcgagaucaugccauuguacuccagccugggcaacaagagugaaacuccgucucaaaaaaaaaaaaaaaaaaaaaaaaaaauccagauucucacccgugagcuguguuaugaggaagggaccucugcaauaaugugaagguaacccuuggcuaacgaaaguaaaaacaccagacccaugcuucuucagaaucauaaaguguaaguuauucuacugaaugugaagaaggcaguuugacuuccuaacgagcuguucucugggacuuuuaauuugccuuauuaaugugucaauccugauuccacagcauaaaacugcauguccagaaaguagaaacauggguuggaugaaaauuaauaagaacuugaucaggcuggucuuuccccuugacaugcagguuucucuaaagguuguaagacacugugugaucaaggugccuuuuauucucagggcucuuuucuuugauauuuaaguucccuuaggaguugaugguaucgacuucagaaguauaauaaucuuuucuuuuuauucauucuacaaauuuuuauugcaugccugugugcaggggcugaaauggggagccaaaaguucaccuagugucuacccuccaggagcucacagaaugaucuggggguaaagcaaaauuuaaacagugauguaaacaguacuucagagcgcagacuuaaugccaccaaccuaguuaaggaagucaggaaagcauucuugagggaguguagcuugaccugagucauaaagagugaguaagagcuaccuggggggaaggggaacaaacugcuuuguggagggacaagcaggcaggguguagggaaccaacacaguggagcacaacucugagagggugggaagcugauaugcaggaacccagggccaacaauggcuguugcuggguuagggaugauauggaagaguuuggguacuggugguggaaaugcauacaagaggcagcauagacuucgaagguaaaaccgacaggacuugaugcugacacauggccagggggucugugagauguguugcagugagccugaguguguggcaguguaaaucagcacaguggacagggagcccucuggaugccagcacagcaggauucugaugaggugagcacacacguggcaccugcucuaaaugcuacuuucuccuagaaagauuccauuuacagaagagaauguuuuggacugagagcaaaaucucaacuggucaggaauggguuuaauuccaaaugacauuuuauggguaacuacgagaaaccuuuuauagaacacaggcuaucuuccugcuuuaguaaauagcucaggguuuugaguaaacugauuguuuuccguugucuuagaguuaugauucuguauuaagaguauucuuguaagacacgaggaagagacuaggcuuuaucaaagugaucccaggacauagccuaaaacuugcuuuuuaaaauaaaucccugcuagcaagcuuuuuuuccguaucauuuuacuucuccuaaaguagaggacaacaacgacaaaucuagucaaagaaacuguuccaguuaguuuaacugacaauuccucuguguaccuuccuuauauucagauauuccuuaucagaaaucuuuuuugauuuuuaccucaaauuuaggcagucuaaaaacaaagacaagaaauaaggaaaagagagaaagcuggggcggagaggaaguucucggaguuuuucacuggagcggagcuguccacugaagcugcugaucuggaauagcagcagggcuaaaagaaacuuauacuuggcccugucucucacugguacaggagccuaggcaaguuaauuuaagucuugauuuucucaacaauacauuggggauaauacccaguugggaaaaaagggcacgguggggguaucuucugcuacuuaaagacacugaucagggcaaaauaaccugaacagggccaaguaagguggcccaugucuguuaucccagcacuuugggagguugaggugggaggacugccugaggccaggaguucaagauuagccugggcaacaaagaaaggcccugucucuacaaaaaauaaaauuaaauuugcuggguguguuggcacucccuguagucccagcuauucaggaggcugaggcaggaggacugcucaagcccaugaggucaaggcugcagccaacuaugaucacaccacugcauuccagccuggaugacagggcaagaccuugacugacacacacacacacacacacccugcacauacuucccaggaaguaccagcacugaucccuagucauuuuguuacucucuagucccauguggaauggauggucccuugaaacuacaaaggccgucugugcuugucugcaaggcuaugggcagcagcacagacauccaggaggaguuaaagcuaacaaucuacuauugcuacuaaaccaaacccagcuaugcugccacacaaagggguuccuuuugucuauuuagagcguauuuuacaggucagacacaguauuuaaccacuuauuccccacccucagcuaucugcuuuacuauguacacuuuauugauguuuaaguaacaugugaaaauauggcaggugauacuaauaauuucuaccaaggugcccacaaaaaagaaaguucguaauuaucacacaugguaugaacuucaacugcagauaugguaggcagauaucagccacuugcuguggguuuuuaauguucuguaacacuguaacucuaauuauccuggguuuacagccuucagguucugcauuaauaaauuuauggaggcaaaacaaaggaggaacaaaaaacaauuucccaaauaaaauacauccauuugccucaauuuaaguuaaauccaaucuaugucccccuucuggaaaauuaaagcauuacucaagaaggccugguuuaguaauuuuucucuugcacaaaauguauacguaguuuguuauaauguuaauaugaagucucauaacucagaaggccaacacaggugucacuaaugauguuucuuugugcuaaccaaacuugccuuuuuuucugaaacacaguuugcauuuuauuauuauuuuuuagauggagucucacucuguugcccaggcuggaguacagugacgagaucuuggcucacugaaaccucuaccucccggguucaagugaugcuccugccuuagccucuaaaguagcuggauuacaggcacccaccaucacguccagcuaacuuuuguauuuuuaguagagacgggguuucaccauauuggccaggcuggucucgaacuccugaccuaaggugauccacccuccucggccucccaaagugcggggauuacaggcaugagccacugcacccagccugcauuuuaucuuaucuacaguuauauauacuccauuaaaauaauccuaaucagaggguuucuuuuauagccccaaaagaaaauugccacugugcugaaaaccuuauauauuuugucuaacggaguuuuuccuauguuaaaaggagcuugugcccuuuaagaaauuagaaaggaagggcacagagugcuagaguccaggacuagguauaagccauugauuagcacuuuuccucugaauaaaagcagagaaccugagaaaaggcugaacccagcaggaguaggagaccugcggcagcccugugaugaagaaagagaagagcuuuuucucaaguacagggagagaaauacuuacauaguuugaaacacugaaauugaaguugcacaaggucuugcacuagcuuauuuuuauuuuacccuuugcucaaacaguggauuagcuuauaaagagaaaugauuacauuuugugcuuucugaaucuaaaaaggcaucuuuuuaaagaaauuacacuccagggaagugacucuugguguaagcugcuucucuccauggcucauccuacccaggaguugggucugugcuuccagaaagccaauuacuggaagcugcuuauucacaaggcacccauacugaaauguuuacaguuucagugcagaaacgacaaaccugcugccacaauaggacucccuuaacaagauuucaaaucugugaagaucauacugaagcggaaaucuccaaagcuguuccaaacacuuggcucuggaggucuuucucauuuuuacuccuuucuuccuacuugcauucauauuaccuuccucuuucgcacccggagccacugccaucucaccaacgcucucgccuguccaucuucucaaacagguugagguauugucaggcaaagccacccuauuccuggaaguggcaaguuuuucaaaggcaggggcagccugacaggacagacacuggaggcucaggaaauagcagagucccagcagaaaggaacuuucaaaaacgaggauaucuugauauacugaagcuaaugccaaugaaacuaccacaggaucacugguccucaaauccuaagccagccccugccaccucucagccaagcuucaguggggucauuuaauuuggcaacaacaugagacauagucucacaucucauuucaggucacucccacaggucaugcucaaaccggggccuuuucuuccuggaaaccuacuggaaggaaaaacuacguccacacuagaauggaaacuuuggcacccaaaucugugacuagcuuaugaaccuucaguuuucagaauugauuuuugcauuucucaaaggguaacucugccaccugcaccagcaugguccuaagcuugaguuaaaaaacacagacugaggacacugucccagaagagacugaaugggaagcaucccagguucuuauccucaagaaaguuuuagaacuauugguucaauucaucuucauagauauggaaauuuucuucuacauuucuguuucagaagauuccuaccagauuaggaagauacucagcaagaguacaauccucauuucaacagaaaaggaaaaaggaaaaaaagaaaaggaaacuccaagagucuccaugaagaaaauagagaucuggaaguaauauaaccaaguuuagaaauccugcauaauuccucaauacaucuccuccuccuccaccuacacuuuuuuuuuuuuuugagauagggucucgcucugucacucauucaucaagccaaagaguuugagguugcagugagcuuugauugugccacuguacucauaguggaacaaucagagcucacugcaaccucaaauuccugggcuagaggaauccucuugccucuacuuccuuaguagcugggaccacaggugcauaccacugcacuuggcugauuuauuuuuuguagagauggcaucucacuuuguugcccaagcuggucucaaacuccugggcuuaggcaauccuccuaccucagccuccugaagugaugggauuacagaugugagccaccaugcccaggcccaagauuuaagugucuauuguuaggacagauuucauuuauccaacaccuugacaaggcaguccaguuauuaacuccauuuuacagguuaagaaauucagcuuaggggcuaagugauguuauaguuucccaagaagccaacuccuacagaugucuggaugaaggauaaaauaugaccuaaaagauucuauaauuaugacucuuugccaacaaagaccguccaguaaauucaagagccucugugcucuccuuugggccuugucucugggcagugugguggucguauaauaaaaggugguucuaucacaugacuuuucuuucaagagugagauuagaaaaaagcaacaaguagaggaugggacuggucagauuauugaaauugucugaaaauacaccaaugacuaagggauuucagaguucccaagucaaauuaaggagcuaaaggcaacaacuggguguuugcuggugguuucagagcuccuuggggguccgugggaaaagugagucuuuauguggcuggaucauuuccugggguucucuacagcuaauuuggaagaucuuaaacagagaaucuucuggagcugagcaacaagauuuuuuguuggcauauucaccuuaaauggagcuuuuuuccaaaggugggaagggaugagguaggucugagagaacagaaugcugggucagcaaguuagugagauuccauuauugggagaugauuugcuucaaugaagaacgguuucuguggcacugcuaaaacccucgcccugccaggaggcgaaacuaaaacauuaguaguugauacagauacuaucaacaaccccggccgccuugcacaauguuccucaggucucuaccagggaugcuuaacgcuuaucccuguccugauguacccuagugaaggaacaaguugucacuuggcccacagugagagggcuaaauacuaaugacucugcuucugccugggagaguguggggugggggcggggguagcgguagaugguguuacugagaaagccaggcaaagugguuguucagagcagagaacuaagagagugcucuugguggacugugaguuucacagggcaugguggaggagacuggcaaagcagcagagugugguucuugacaugugccuauuuccccugccacucacgcuucaaaccccccaagucacucuaguaguggcagguccaagugccacauggggagggcaggccucugaggccuuacugacucagcccucccuuuggccgaguuagguguagcuucuccacacuuacacagaccucacaguauccauagaccaugccucccagcacuuacacaagugcucacugaacauaagguggggcugcuuuuaccugcuaaaaacuauccacuggaaauuccuucauucugaaauggucauugugcauuucaaugucuaggaggcaucucagacuuaacaugaacaaaauacaacuccugaauccccaccaaaccuguucucuugggagacccuggaggaagaacagguuugguggugauucaggaguuguguuuuucaacauucagguggcacuacauucacccaguggcaacucacauuuuuguccccagagacauacacugaaacucaugaacaacaaagccucauacagaugcccucuauaaugaaggcaaaaccuguuccucugccuuacaaagaaccacaaggacaagaaauuaagaaugcugcuggucauccaucucucaucauuuuuuuccccaaaacuauaacaggaaaacaaaaaucagucucacuaccaaaacacauuuuaacaucuccuuaaauuuuuauacguagauuaaaauucugaccagcauauucacaaauuauuuccaauauuacauacuuuuuuuuuuuuuuuuugagauggaguuucgcucuugucacccaggcuggagugcaauggcgcgaucucagcucacugcaaccuccaccucccgguucaagcgauucucccgccucagccuccccagcaguugggauuacaggugcccaccaccaugcccagcuaacuucuguauuuuuaguagagaugggguuuccccacguuggccaggcuagucucaaacuccugaccucaggugguccgccugccucggccucccacagugccaggauuacaggugugagccaccaugcccagcucaauauuacauacuuuuaaacauacauauuuaaauggcauccaaaggcccaccucuucccacuggagguuacauugcuucuacgugucucuuaaagaaccugucagucacaaauuuacccugcacugaucaccccccaugccaggcauuagggugggcucuggggccaacucagcccuuggggagccuaucuggugaggacgacaaucagauaagcugguagucaccccaagagcagcuccagcuuagcugggcauuugcauaagugcugggaggcauaggcucugaauacuguugggucuguguaaccugcaaagggaaggcugagucaguaaggucucagaggucuguccuacccucagugaggaggcacucagaccugccacuauuggagugacuugggggauuugacccaugggugcuaagugguguaacagguaaaaugggagugcagcugggcagcacuugcugccuggggaaugaggugacaggugagcugguuuuaaaucgaugugcuuuucacaaauaauaguggauuaaaaugcccaggccugcucucugaagaggagggagacacaaagucuuauaucagcaaacaaauacauuucauuuuugagggguugcccuuucaaagcauuaguauauuuuuauuacuucaauaaagaacccuaccuagaaacaagcaaacagaauaauuugggaacuguccuaucacuuauccuaaugaauuacacuauuauccuagcaaccagcuuuguaugaaaaaacaaaaauaacuuucaagcaaaccagaggccuucaccugacaugugucugaacuaagauuuaagguucacaaucacagcuuucaaagucuggaaccacauggcaccccuagggagccagccacaaugaauaggccugagacuuguuagaugaauauacauuuuacuagaaacuuccacuagcugcuccgugagaaacacauaacagagaugaaaugccuccaccgcugaacaaugucagggcacccaggucccacugguggugcuaguccaucagaagggacuagcaccacuucagauuugaguucggcuggaaauuuguuauucuguugacccugguauugucuaucugccuguguagcaguucuucaauucuauuuucauaaggcacguuaacugacagcaguaugcugccaacaucuucaaauuaagugucagcucuuaagugcauacaaccaaaaucacuccacuauuaccagguuuacguggacagcaucagauagggcugaauuuucucuucaguuuaauuuccaccaauaaguuuagagacaggaggguuaucuuuacuaaaccaacacaugaggacacaauucuaaggcugaugcuagguagcucauaauauuugcuuccuuuaaaaccacaucaacucaaaagcuuccaggaauaguuuagccuccaccaaggaggcuacuugauuuccagcaaaguuaguuuuauccuuuacaguccucuaucaucaucuaauuuacagaugagaaacuuuuuuuuuuuuuuuuuugagauggagucucgcugugucgcccaggcuggagggcaguggcgcgaucucggcucacugcaagcuccgccucccggguucaugccauucuccugccucagccuccagaguagcugggacuacaggugcccgccaccacgcccggcuaauuuuuuguauuuuuaguagagacaggguuucaccguguuagccaggauggucucgaucuccugaccuugugauccgcccgucucggccugccaaagugcugggauuacaggcgugagccaccgugcccggcugggaugagaaacuuuuuaagagcucuacuaaugccuaauuuaggggcaccccugaagaaaggaguuccauacaucucaauuuuccagagaagugauucaggcuaugagaaauagguacagaaaaacaaauugagaauaauaaaauuccaaauuaacaauuaauggacauuaaacacaaaauuaacagggaacaacauuaauaucacuaauaaaauaaaugaaaaggaacuaaaaguuuaaaaagaagguccaaugccacugagguagcaguaaacaggcucaccuguccucauggaugcucaugccuuguuaugacccuuuguugauuaaaccacaagacaaugccuaucaaaaaccauaacaauguuggcccuucuugaccuagcaguucaacagccauaaauuuuucuuuaaaucgaaaaauaaaaaugcuuauugcuccauagaaaguaguaaauuaacuggaaaccaccucaauaaaagugcgguacuugaauaaauuacauuauacucacgcuaaacuaagaaaaaagaaaucacagauuagaaugaaaauuaaaauuacaaaauaaaguaaaaaaagcaacacagacuuguaucuacacugugaugauggagacucacaagguuugaauccugggcaagcuccucucuggaccucaaaucucaccuggagugugaugagacccaccagaaaggguugguuugaggucuaaaugugguaauucacguauagugcuuagaaagcauucaguacauguuagcagucauuacagucauuccuggcauccauggaggacugguuccaggaccucugccaauaccaaacuccacggaugcccaagucgcuuauauaaaauagcacaguauuuguauauaagcuaagcacauccuccuguauacuuuaagccaucucuagauuauguaugauaccuaauaugauguagcuaaugcuaugcaaaguuguuauacuuucucauuuagagaauaaugacaagaagaaaaaagucuguauauauucagaacagauggaauuuuuccaaguuuuuuuuuuuuuuuugagacagucucgcugugucgcccaggcuggagugcaguggcgugaucuuggcucacugcaagcuccgccuccuggguucacgccauucuccugccucagccucccgaguagcugggacuacaggcgcccgccaccacguccagcuaauuuuuuuuguauuuuuaguagagacaggguuucacuguguuggccaggcuggucuugaacuccugaccucaggugaucugcccaccuuggccucccaagguucugggauuacaggcgugagccacugcgcccugcccccuccaaauauuuccaaucugcuguugauugaaucuaagaaugcagaacccaugaauaugggaagcuaacuguauuauacuauuauaucuagugaaauaaucagcacauggacaaaaucuagaagagucagauauguuggguuaucaggauugcggcauucuucuacgaacaguuccauuaguuuuacaauaagaauaauacuguuaucuuuauguaaauaauauguaaaucuuuuucaugacucaggaguucaaaugggaacccugaccagcacagauggugccagcaccucaucuaaacccuguggccaauuuuucuuuucuucugccuuuucccauguuucuugcuccuuccuaugggcagagcgacgauucccacuucagagcccauuucaccauagagucaugugguagcacuuugccuagccucaauucagugcauaaaggcacgaggcugcauucugaaacugaggaaauaggguacaacugugcacaacagagagguuuucuucaggcccauaaaaauguuugacaugugcucuuucucaguguaauuaaauacagucuugguuuuucaccacauugucaguaucuugggaaaauuauuuuaaaagucuaaacaggccaggugugguggcucaggccuguaaucccgacacuuugggaggccaaggcaaguggaucaccugaggucagcaguucgagaccagacuggcuaacauggcaaaaccccaucucuacaaaaaaaaaaaaaaaaaaaaaaaaaaaaaaauuagccagauguggugacaggagaaucgcuugaaccugggaggcagagguugcagugagcugggaucgcaccacugcacuccagacugggcaagagugacucuguccaaaaaaaaaaaaaagcccaaacagcaaguuauccuuucuguuuccccuuccaauuacauuuuaggaauaauuaugaugauagcuuaaauuuuuuugguaucuuuuugggauucucuggguuuuuuuuuauaaacaugacacagaccucaugauuuccuauuuuucucuccacuuucuuucaauuuggauuuaaaaauuuaucaguuuacaucuauuugaaaggcuaaauaaaaagcaagcaguuauuuaaaaugcuguauuagaaucuaguguugacuuaucuaaacauguauauuaggcugaacugccuucauaucuaauauuuucuugucuaauacauauuaaacgcaaaccuaaauuucuuuucuucaacccuucuuucuguuauugguauguugaugaccccucaccucgcccacugacuugcuggagcuagaaaccucaacuucauccuugaccucugccuccucacuuucccaaaccugcugcaucuagucaguguuuaaaaucuaucaacuuuagccggguguggugacucacgccuauaaucccagcacuuugggaggcagguggaucgccugaggucaggaguucgaggccagccuggccaacauggucaaaccccaucucuacuaaaaaauacaaaaauuagucggcaugguggcacaugcuuguaaucccagcuacuugggaggcugaggccugggaggauguuugaaacugggggguggagguugcagugagccgagaacgugccacugcacuccagcaugggugacagagcaggacuucgucucaaaaaaaaaaaaaaaaaaaagucuaucaacuuugaaucccuaaaacguuucucagauccauccaauccuucugacucccguuucuaccacauacucgguccuuaccagcucuugcacaaauuaaucccacagccucucgaaugaccugucugcuucugaugucucccuacuuauuuccugaguuuccuuuauaaaacacaaaccuguacaugugacuuacacgcuuagaaaucacuaaugguuuugcacugcccguaaauuaaaggcuaaauccuucaaauacaauagaucccugauaugguuuggaucugugacuucaccaaaucucagguugaacuguagcacccaaugcuggaggcagggccuggugggagguggcuggaucaugugggugcuauuccugugauacugaguucucacaagaccugguuguuugaaagugugcaacaccucgcaccucacucugucuugcuccugccaugcaagaagccuuccugcucccccucuaccucccuccaugacuguaaguuuccugaggccuccccagaagcugagcagaugcaggcaucaugcuuccuauacagcuuccagaacugugagccaauucaaccucuuuucuucauacaucacccagccucagguauuucuuuacggacuaauacaagcccucuggaguucacauauucucaguauauucacuguuuuaggggaggagguggaaugcuauagggaaguauuuguccugaaucauucuguggauacaccacacaaacucagaauucuuaauuauuuugggccuuuuagugcugacauguuaaaaaguuuacuuaaaaaaacaacuuuagaccaggcgcgguggcucaugccuguaaucccaacacuucgggaggcugaggcagacggaucaguugaggucaggaguucgagaucagccucgccaacauggugaaaccccgucucuacuaaaaauacaaaaauuagccaggcaugguggcaggugccugcaacuucagcuacucaggaggcugaggcaggagaauugcuugaaccugggaggcgaagguuucagugagccgaaauugugccauugcgguccagccugggggauagaggaagacucagucucaaaaaaaaaacaaaaccaaaccaaaaaaacccaacuuuacuaccaggcagauucuuuucuuucgcuuuagauaaucgcuaucaaaacuuugucaucucacuagaauguuaaugcuuuuacuuaacaugcaagguagauuuuagucccucccuuuugccuucugucuuuugagagauauaauuccugaguguguucguguuggcugaugcuauuucauaagacauaauauuaauacugcaccugaaauaccucacacccugccacccuuccccccgcagcaaacuugaguuuccaacaagaguaaaaaggagauaauguuuuuauuuccaccaaggacaacuuucaaagagauuaaguucugaacaccccuggcaagaugagcuagcugcacuaugauggaacuacaacauaagcuauagaguacugagugagcuugcuaacaggaacacaucuuuacuaagacaacaaugagggaggacaccaucugagggcggucaccagucugcagcuugcauuuccucugaaaccaccuaacuguugaaaugugccaaacacugcucuaagcacuuuccaaagagcaacacauuuaauccuccuaacauaccucuuuacuguaggugcugucaguuuucauacuuuguaugguaaggacagugaagcacagagguuaagugacuugagcuagugaccucgcaaggaaacaacaaguccuggaauucauaugaagcagugugacucuggggcucucacccaggccuccccucuacacagcuguugaggagaacggcaaaagccaggaccuuccggggcaaguguuuagcugccuugauuuucucuucucauacguuuuuccaauaaauuggacgaaucugaucugcaguagcaagccuugagggucccgcgaaauuggccuuggcuuggggugcggaggaggaaccuccauuuuccugaaacaguauuggaugaagcaagccguaucuuuuggaaaaaucgaagcccuagugcaggaccugugugcggcaaggcauugcuuucugcagaaucacacaaacuuuccugcaugaaguucagaagccuugacauagagcuucucuaaccacacaccagcuaaggggccgaggcugaggcugagucacccugcaaguucccugacaggaguuuaacuucacauuucaacugguuuuccaguagagacucaagauauuuguugaauugaaagggaugccugcuuuuacauacuauuugcuguuagcucuuuuaacagauuagcaauaacuaguuuaacaucccagggaugaguaauuaacauauaauaacuuguguguuguggcuuguuuaucaauauuuuuguuuaugguccuuugggauuuuuuugaauauuuuucucuacuuauuuauuuugagacuaggucauuaagacuggcuaauuuucguauuuuugguagagacaggguuucuccauguugcccaggcuggucucaaacuccugggcucagguaauccaaagugcuaggauuacaagcauaagccaccuugcccagccuuggccaaagaaucguguacuccuuauaaauuuuacuuuaaaaucaaguguaaugcuccccacaucaucccccuaccucuagagagaaaaaaaaagucaagaaauaaaucguaguaaaauuugaguccuucaauuugucaugauuuauucuguaagguaauauaugcaauaaaauucaaaacugaaaauuucacuugauuccuuagaauuuggacgaaauccugaaagaaaaugaaccuuuucucuggaaauuuagugucaaugucaucaugcagugauauaaaaagauauaccacacaguguuaagaaaaacagguaaauuagauacaagucucugcuauauacugaaagccaugggaacagggcgccaccgccuagagagugagaaaugaagaugggucccagcagaaguaacaaaaagcaagugcuugccagagagagggggcugggagggagaggagaauggagaaagggagugugggaaugugagaaagggcaguuguagcaagcacagaggaagaacaaucagguaggggugggggugagguacuggaguuaggagcagagaacaggaguugaagggagccuucaccaggaugggggccuugccaggcccuggaaaugaccaccuucaaggaacauauaguugagaauuuagagagcauguagacugguggcucuauuuuacaguuaaacuagagagccuaccuuucugacuuggcuguuuugauguuuuaauaugugauuucauuuucauaauguaaucaaucuauuuuauauuuuccaaaucauguuuuccaucacaauuuaaaguaaauuuaagaaagaugugagucuguuagaugggggaaguaaauaauuauccauuauuuaaacuuguauuaaaaauaagccccuaaacuggccaggugcaguggcucacaccuauaaucccaguacuuugggaggccgaggaggguggauuccuuaaggucaggaguucaaggccagcuuggccaacauccucaaaucccgucucuacuaaaaauacaaaaauuagcugggugugguggcacgcaccuguaauuccagcuacuggggaggcugagacaggagaaucacuugaauacaggaggcggagguugccgugagccgagaucaugccacugcacuccagccuggacaacagagugagacccugucucaaaaaaucaaggaaaaaaaacccuaaauauaaucuuuaauauauugauucagaaauuuaaagaaaauuggccaggcacaguggcucaggccuguaaucccagcacuuuggguggcugaggcagguggaucacuugagaucaggaguuugagaucagccuggccaacauggugaaacccugucucuauuaaaaauacaaaaauuagccaggugugguggugcaugacugcagucccaguuacuugggaggcugaggcaggagagucacuugaacccacgaggaggugguugcagugagccaagauugugccacugcacuccagccuggcaacagagcaagacucaucucaaaauaaaaauaaaaauagaaaauaaaaauuaaccuaaaaccaguuaacauauacugucagguaaaaaaaaaagauuaaaaguuucccaagggggguuggaaaaauuugggaggggcaccuucuaugagaggggaacaagcaaagacuccccgacucccccacuaguagggcuauccagccucaagggauccauggccaccagaucuaccuucugucacaucccugcacgccuuggcauuccuuaaugucucaaaggugauuuguacauaccaaguuauauccauacccauucagaggcaauuaccucuguaauaucauucaugucagaggucauugugauucucauacacaauuauaccaaggcaaacaguggucaauguuggacagaagcaaaggggacuugugcugaaaugaauagauucacaagucccacacuugugggaagggaaaaaggaagggaaaaaggaagggaaguaaacaccauuuuuaaauauagaaauguucuaguuuucggcaauuuucagaguagugugacacagggagaggagcaaugucucuugaggacuucccaauauuuuaauauaacaucgugcuugucaaaacaccugauaaauacauaggccaaaauggaucucuaaugaaauauaugugacuuuaucuuacaugauaggauuaagggcaugcucauuaagcaagaccaaaacugaaugcaucuaucugcuaaaaccuaguaagauaaaacuagacucaaaguauccuggacaauugaaacaucaucugucaaauuaaauaaaaggcaaguuaguguaauuuuaauuuguccuugagugcacugagaaaaguagaauaaaagcuagguaaauaaaagcuagaaacggaucuuauagugauagugguacaucagcucaaagagacaacaagccuaacuuuuuucuuauuuuuuuuagagauugaaucccacucagucgcccaggcuagagugcaguggcaccaucuuggcucacugcaaccuccgucuccuaggcucaagccauucuccugccucagccucccgaguagcugggauuacaggugccugucaccauguccagcuaauuuuugcauauuuuuaguagacacgggguuugaccauguuggccaggcuggucuugaacuccugaccucaggcgaucugcccaccucggccucccaaagugcugggacuacaggcgugagccaucaugcucggcccaagaccugaauugagacacaggaucuagagauuugcuggggaagauuuagccugauuacugauuaucaauuauugcuauagaacaccuaaaaguuuacacaaaaaaacugggcugagauauguuaauaauaaauguugaaauaacgaaaacacugucagauggucacauacacauaugcacaucaaaaagcaauaaacaggcugggcgcagugacccacaccuguaaucccaacacucuaggaggucaaggcagauggaugaucugaggucaggaguuccagaccagccuggccaacauggugaaaccccacaacaaagugagauucugucucaaaaaacaaacaacaaaaaacccaccaaauacugugacuuuccaaggaaaguugggaagcaagaacucaacuuugacaagaggaugauuaacggauuauuuugagcgcucaaauuugacuaaagaauuuuguacuugagggucuuaaauguuacauccuccuaggaucuuugcauuuuaaaaugucauuguguauaaacuucuuaggggaagugaaucuucuaccucaaacuuggaguuucaccgugauguuaauaauggagacagggaaggaggcacaaagaaaagaccguaauugggagauaggggacaugauaagaguaaagggcaagcuccuugcaugacugaauuaaaauguucuaauuucaaauauauauuucacauucaauauaauuuuuacuauagucuaugggcacuucuuuuugccagaagguuauaaauaauaugguagacuacuaaacauacaguuguacauccaucugaucccuucccacgaaaaaguggauaaacuugcaagauaaacucaugacaccaugagcaaugggaagcuggaaacaugagagaugaagugagugacagugauucugugcacugcaaggaagcagacaguaaugaugagugcaguggaggagcccccagaaagccagccacuuuagggcacagagcuuggggaggccucaguaagugggggugcaacauggggcugaaaaauagagcauuagcccaaaguuucuaagaggaguuagauccuuaacccaguucaaccagguaacuguucucauccacugaaaacaggcgggagauugucaaaguccgcgcacugaaucaugagcccauauccccacccacacaacccuaccauccucuucuccacuuggcuuuuaggacgcuggcagccaagcuugcaucucuagacaggaaaucucaagauuuuucucuggaacaaaaaaaaaaauguuuuuuuuuccucugggaaaacucaacucagaaaaaagacccauaugcuggcuggcugccuuauuauucuacggagaggacuacaggcuagcaagccuggcccauacuguaacagagagcuucaagucauuuuuuaaaacaucucuuucucucuuaaaaauauaaaucaaggcugggugcaguggcucaagccuguaaucccagcacuuugggaggccgaggugggcggaucaccugaggucaggagcucgagaccagacugaccaacguggagaaaccucaugucuucuaaaaauacaaaauuagcugugcaugguggcgcaugccucuaaucccagcuacucaggaggcugaggcaagagaaucgcuugaaccugggaagcggagguugcggugagcugagauugcgccauugcacuccagccugggcaacaagagcgaaaccccaucucaauaaagaaaaaaaaaucaagacaucugaagaaccucuaacaagaaagagaaaauaggaaacagacaaagauuuuuaaaaauuauaguacaggccaaguguaguggcucacgccuguaauuccagcacuuuggaaggcugacgugggaggauugcuuaagcucagguggugagaccagccugccugggcaacaaagugagaugcugucucuacaaaaaguaaaaaacuuagccagguguacuggcaugcaccugugguccagcuacuugggaggaucccuugagcccagugguuggaggcugcagugagccaucaucacaucacugcacuccagccuggguaagggcaugaaacugaaacaaaaacaaaaacaaaaaauacguuauaauguauucaaaaagcaagagaaacgauuauagccaucaacuaggcucugauuauucuuuaaaagucaguacauucagagaaaaaaaaagcucuucaaaauaucaagaaaaaaaauaaguaaauaaaaggcuagaaggcugggcacuguggcuuguggcacaugccuauaauccugguacuuuagaagaccgaaguggaaggauugcuugaguccagcaguuugagaccacucugggcaacacagugagaccuuguuucugcaaaaaauauaaauauuagcugggcaugguggcacacaccuuuagucccagguaccagggagccccagaguucgagaaugcaguaagcugugaucgcaccacugcauuccagccugagugacaacaaaacaaaacaaaacaaaacaaaaccaaaacaaaacccacauacaaaaaagauuagaugauaaagcugaagaaagcauagagaaaucagaacaaaaagauaaugagauaaaacauaaaacagaggagaaaagauaaaaacagcggaucaauccaggagguaaaaugccuuauauuaacaggaauuauaaagagagcagagaaaauagagggaaggaaauuuucaaagaacuaccacaugacaaauugccugaacugaaagacaucagcguacauaagaucucauagaguagccaacacaaccaugaaaugaccuagucaagaccuaucauuuugacaucucaagacccuagggaaaaggagaagauccucaaacuuuccagaagaaaaacagaacaugcaucaagggaugaaaaauuagaauggcagucuucucaacugcagcacuggaagcuaguggacaaaccaggaagaacgacugcaagacagugagagaaaaaucacuuccaaucuagaauuccacaccuagccaacucucaauuaagcaugaggcuaggauaaagucaugcucagauauauaggaucucaacauuuuuacacucccacacacccuuucucacaaaacuacuaaaggaugaugcacgcccuuaaaugaaggcucacuuuaagaaugaggaagaaaugggauucaggaaacagaacauucaauagaggagagaaagaaaugaagaugaugauguugaugaucugccccaggauaaguuaugaaacagauccaaagaauaaauauccuaacuggaaagugugcguuagaaaagauguggcccaagaaacuugaaauauaauaauaugcuucauaagcauuauacauuucaaaaaaugaaaaacgauuuuagaagucuauacaaaucuuccaaauuaccuauuucauuuucuguccaucacaugggcauaggcacuuuaauuuggaggaauaaucaugugacauguaagaacaaaaacaugcaagaaaaggaaccaaaugaaauaaaaaucccaagcugguaagagauuucucauacucaccaucucucuggcuauuuccagcgcuuccugcaggccauagagccugccacaaaccagguagauuccauuggcccagagaauacaacccucauggacccaaaauucauugcugucaagagguaguucagggauuuguaacuccagcucagggccaccuucugaaguggugggcacggagggcuucgaguccaaaacagucuuuucacugcugcccucaguggcugcuuuuuuacaagggagcccccuggacagggaccgagggccuccaccacagucuuccgagcgguggcgccgcuuaaaccuggggugugcggccaggcuucucugcuccuucugcugcugcugcugcucuuccuccuccucaguguccgucuuggagccauuagaagcacuuuugugccguaccuuaacuuugcucugcauuucuguggcccucuuaggagguggauucuucgggagaguggcugcauaaucuuggggauaaaaagguccaaagaggucacccauguuccgguaacuggcccacuugccacacagacagcaaaccaggugccccauaaccgaagacucugucacaacaggucccugcagcauaaaggacgaggccgggagcgccuugcuuucagugcugcuagguggaggggucagugaccucugacccuuccugccccucacuaauuuggucuguucuucuuccucagcauugaugauuguacaaacggcuccaaguucacacuuauuuacuacauggauguaaggguaaaaagacuuguucuuggcaucaguuuuauccaguggcuggguggcauauuuuaguuugaucucagguucuugggguuccacaaugggaacugcuuguuugguuuuucgcuuccucggcugggccccaggcuuccuucucucccuccuuugccucuguuuuuuuggcuuuggcucuccaucugcagaaccuucugguaucugugggggcugaggggguggaggcgguggcugcugcuguuucuuuugcuuauucacacuaccaaugggucuccccuucuucuuuccugaugggaaauaucccuuuggagggaaacccucuugcuucggugaaaucgucacuguaucguucuccuucucuucagccuugggguuugccucaggggccaauaugcccacuggagguacauucuuugagucuggaaagauuaaaggugcuguuccacccagggaaccaucuggucucccuugguuacuaccaggcuucugugagguuguggaugucauggcaccaggggguuccuuuccggcaguaacuguuucugcaugugucucugucuucacuuugucauccacgcugccacgccacucuucugaagaccuuggaagagguuucucuacgugcaacuccugguuugcuggacugacuagguccgaagccaccucaccuuuucucuucucuaugucagcauccugaacagcaacacucccaccuucaggaggaccacucuucaaagacaguauaucaucaagcguaaccgugucucccccagccuccgcacuguucgaagaugcgcuccuccuaauauuuggggauguaaucuucugaacuauagcuuccaauuucaauccccguccuuuccgugggggcaguauuuuggucuuagcagggcuugugaggguaacagcagggcaguuucuacuaucuggacuuggaagguccuuggaggaaucucucuuagggauagacuugauauccugacugugagaaagaugggcauaggaauugaaugcuuuaucagcgccuucuuuugaugagugaaggaggcgaccuuuaucuucagugcuacuguucuuuacaucuugugacugucucuuacugggaaugggagagauaaaagaacgaacacgccuccucaugauuaagggguuuugagaagaaugauccuccuggccuggaagucucagcauaacacuaccagguuuggaugacuguguagccucagcuaguccauguccaucagucucauggggcggcccauaccuuuuuugacuggacauuccuggaggaccgcugcuuuuggcuggagaaguuugccgagaaagaucccaacaggauucuuguaacuucugggagccaugcuuuaauuccaugcccuuguuaggcagaccaucacuagacauuaggcagcgcccagccuccugggcacuggggucaugguaaguccccacuggugggccauacaucauaccaucuuugucauuuuucagagggcuccguacucugucaagaaacugcugcugccuuggacucuuccguggccccuccugccugugcugugcugcagcaauuacucccugagcagaaccgcugcuccagucuuuauacuccucugguugcuguugguacaucugucucuuauaaugcagcugagaauucaaaccugcguuaggguccccauaagcaugagcccgaguauuugcaugauaagcagaggccaggguuucugaguugggagaaaagggaguguguaaagaacuccgguuagcccucucugaaaaggucauguguggauucaugugaugagggucucccccugggccucugcuccgcccaggagacauuuucaauuuuucugcaaagucaugauauugagaaggggaccgaccccucaugcccucccgaccaccaacucugccagggacccgccgcauuggcgugggucugcugucuugcgggccauagucugaaagggaaucauggguugcugcuccagggcuggcauugccgcgguaagacucaugcuugaugcuaggaggauggcaguggucuccagauuucuuguuguugaaacuagcuugagauuuagacuguucaaagucuuccucuuuuaucugcccgcucugggauuucagcuugguuuccauggacaccaaaccaccaggaagaaugaccgacugacuuaaaguuggauugagacggucauuccucccaauucuggugucggcacucaugugucccagugagugagccccugggucccugacaaucugucuuaguggagaaauaucacagaucacugaucuucuuucagagagggaacccccaggcucaugugcugaugacugaggcucuauuucaaacuuucugggaauuggauagucagucaaauugaucuguuucauuucaggagcugugcugcuugauuuccuuucccaggggccccaguggggauuuucuaauagagacccaaugcuuuuguucagaaggccccugcuagcuaauucauugguuugacuaaccaagacauugggccuugugguuccuucuaggcuaccagccauccccugaugcucuugaguacuccuagaauaucuccugucagggugguggugguaacccugaagcacuuccugcaggaggcuugggaauuuuucauuucuacccuuucguuccccauggccagugaaaucucccuuuucuugcccuguaggauacugaggaaagccacugacauuucguggcacggcugacccgaaacuaucuuuguaacuauagcgcagacuuccaggagauuugcuaggcucaguucugcucguaaaaccagggcccgcugcagaguggccacucuggccauuuccuucuccauuaugguuggaguuguuaucgccauucuuguuuccuuugcucccuccuccuccuggaggcucuggcuggggaagugaugcaugacugguuuccuuugccccaccauugcuagguggccuuugaguggcugcaggaucauccucuugggagccuuuaucuuguccaccaggcuuuucuacccgaccugucauggcuucccgggagacaaucaccccaacagucuucucauuaaccuuuggguucccgucggaugacaauggcauguccuuagcgccuggugagguggccucuucucuugcggcaggacuagcauugagucugggggguucauucugagcaccuugugccggugaggagccagcuuucucagaggcuccacccuuguagguggugucagagcuggugcucuggccacuuaguugccgcacucucucgccuugauccucugaacugcuggagcagccuccaucuaaugacucugccauaggggacuucagcuguucuucagguugugaggagccuucagaauuugugcagcuaucugcuuucuuggaagaugagggccucuuggaggucuucuucugaggagucagggcaucagaaaguaacaugugcuggacaguguuaggaagauuggccacuugaguacucagagcacucaaacuacucaacccaggaucugucagucgcuuuucugguaccccuucuaguccaaacccuuugaagccugcagcaugagaauuaggacugggcaucauugaugggguuggacugaguugaggcauuaacuguaaaauucuguuucuggaacccauaggcacacugccuugcccacacuggagauucuccccagucugcaugagaggagaugggguagaacuacagcuuggagacugaaccacagaggcagcuggagaaggguuagaaauggggcugaaguucuggugaaacugcaugggggaccucacaggaaccucaggcugguuguacugccccacuuggcuuugcaggggcagcuugguggcagcguuaguauacugcaucacaugcugagaaggguguuguuguugcugcgguugcugcugcugcugccccuguugggucccuuguggaaucuuugccuguucaaaauucuucauagauugaggcugauagcuguaauuggauuguguuccauaagccugugcauuagaacccacauuguguccuucauacugagauccagcauucacauuguaacugccaucauagcucuguccagacuggcuaaaacgcuguggugaagggaaggaggaggaggaggaggaggaagcagaagacugauaguguuggccaaacugacccacucuuaacugguaaccagcagcagaggauggcagaguugagggccgcugcauuggcuguagaugggaugagcuggaugcugguuggccaguggccuguggcaggggcugaugggacugguaaagcuguugucucaacugcuggacuugcugcugcugcugcuggcuggaagccugcuguugguacugagcacucccuggagagaaaggcccaguguaauccugcugauaaugugacacaccgccaaggccagagugcugugcuugaaacuggcccacaugacccucacucccauacugauugccaaagcugcuccccuggggggguccauagcucugcacaggcccagaaggccuucgcugaggaggcugugggguuccuguagucacggggucuuuguugccugccauguaguaaaaaucuccagccucuuuccugaaacccugguaaccuugauggccagaggucucgcuagccaucgcugccgcagcagcugcugcuccucgucguccaccaccacugccacugccacugcugccacuacugccaccuguaccuccaaaauucuggaacaucugggccugacgagggcugaacucuucuagccgggaugagccguguaccuccuguggguagcuuugcugguuuccgugguaacugcuuugcucccgaaaggacugcauacuguucagcagcacagcagcaggccaacagcccuccuagaaauagaagaaagaaaaacauuagacacgcaucuccuugguacaaauaaaaucaagucuagaugauggagggaauaaagaugaaucagaggccc

SEQ ID NO: 192566 - RNA, 28750 nt, Homo sapiens
acugcccuccggccgccgcgccgcccgcccgccggggccccgcuguccgccgcccgccgccgcuggagcuagagguacgaggggccgcgccgauguugcgggggacgggggcuccagggggauccugcggcucgcaguggggaggaggcgccucgggaaggcaggggcaggggcggaggggcugggccgccgcccuagcccgggccaccuguucuggaggcgacauuugugcgcgcacgaaccccgcgcggcggucccggccaccgccuccaccccaacugcgccccgaaguggagcgcggcggcgggacccggagccccggcccucgcgggcaggacgcgccuggcuccggagcccucgagggcagccccacccgguugggucccggggcuggagagagggcgucggggagaagccggguucgaggcaggcucugcccggccaccgugggugagucgcgcuccuccguccgggggaagccugggcgucgggcggugcucgccccggagcggaugcgaccggggacggggauggagagcggccggcaggagggggcucugccgggcuggcagcgucggcgccggccuuagggagggugaggauuuggaccugcccagaagcgggaagggcccuccccgugcgggaaacggccuggguacgagcugggcacggggcgagccgguuggagucgcccggccuccgcgcucgccucggauccgcaggcgccccucccuccucuccagcuggggaagguugaggacugagcgggagcggaacugggcuugggagaggaucugccggggcaccuggucccagcgcccaucccguuucacugccagggcgaguccccuucccucaguuucaucaccugucauccggagggacaaguucccaccuggauagucucggcugagccucuggcccugaguggguuaaagcgccauuuccccugcacccaccuuucccucacgacacccucucugcggcuuccuccccuccgccaacgucgagugauuguuccgcgaaggccccuuggggucacguacccugcacucagcaaauaaccccgagcaccuggugggucucaggccaggucuggccuucccguucccgccaccagcugcccaaagacuuccccuuugucaccuccucccaaagaaugagggagccacccugcccagggucccauagcagagugcggauggagccaggccucccucaagauuucccacagcccucuuccagccucaaaccuucuccaggacccgaaacccugcuacacuguguuuccauagcugcaaccccccaaaagaggguccccaaaucaaaggaauacaaaggaaaacaaaauagaaaggaaaagaaaggaagaggagagauggaauccucucugucauuaguuuucuguuuguuuguuuuuuagggucucccucugucacccaggcuggaaugcuguggcagcucacuguagucucaaacugcuaggcucaagcgauccucccaccccagcuucccuaguggcugagacugcaggcacacaccacuacacccaauguugucauuaguuuuucucucaaacauuuuucuaaugccuugggugccugucguuucuugucugcuaggacagcucaguauuagaggauaaacuccaaaauggacagccaucuacaaaauauguuuuguuuccuuguacuaauugaagcccucuagcugcuagguuaauggguccauuaauuuccaguucgugugaugggcccugggaccccaguguggagcaggauuggcagaaucuccaggugguuuguguggaacaccaggagguugugaacuaccacaucagccccagcuagcaacucccaagcccaccuggccacggggccacuggguucagaccuccaaggaugcaguucagcuggggaugcaggucccggaaggugguggcagguggacggccuccaccaccaagccagccaucugaguucugaagugcaccuccucucacucuccccagcugccuccuucuuuggggaccugcuaggcgugcucacaaacuccuguugaucacccugcauuuucauuggcucaccgcaugcuucccuccagauuggaagcuccuggagggaaggacccuuguccagaucccagagccuagugccaggccuggcaccuagcaggugcuuccugaauauuguuugaaugaauuaaccgaaagaaguaggaaaaacaauuccuguuugcauacuugaagacaacuauuguuaacauuugccuuuuuuuuugccagaccuuuaaaaacacguuuuuccagccgggcgagguggcucacgccuguaaucccagcacuuugggaggcugaggcggguggaucacuugaagucaggaguucgagaccagccuggccaacuuggugaaaccccccaucuccacuaaaaauacaauaaauuaacugggcgugguggcacgugccugcaaucccagcuacucaggaggcugaggcaggagaaucauuugaaccugggaggcagagagugcagugagccgagauggcgccacugcacuccagccugagcaacagagcgagacuccgucuccaaaaauaaauaaauaaauaauaaaauaacacguuuuucuguauuugcauaucuugucuauauaaaauauuuuuccauuaguauaauuucacgagcauuccucaucgcagacauuuuuuauauuuuucaaugcuugcauuuugcuaugucauguugaguuauuggaucucuugacuuuuuaaaaauauauuuggcucuuuuugauaauguuacauugaauuucugcauacauuuauacauggccacaucuuuccugggaaggaauuaaccugguaaucagugcguaugaacuucuagaauggcuguaucuggacccagcuagauauuucuucguauuuccuagaaaugaaacuccugggucagaguacgagaagccagguucuuuguguguugcuuauugauugguuugagcucaucaguaagguuuuaccccuugucuggucuuugugugccaaggaucuuuccccaguuuaucauuuggcucuuauuuguggguguguuugugcgugcguggguguguguguggguguaugucugugagacagagagauagagaggagcagcaaguuuuuuguuuuacuuuaucugugugugugcuuucugaugagggagacuuggcugcauuuaugagcugaugggaaagcuagaagagagagcucagcucccucaggcccaggagaaggagggacagguugauaggcugaggucuccgaggacugaggaggugggaggaugcagugcugcucccaaggauccucccgggcuggugaggacaggaggcaagagggaggggcuugggggacacuugaugaauuggcuuugaucuuccccagagggaguuggaagucagcggaggggagggccccagucuuuggugcuuccucccugggagggagcaggugugaacacucccauugaugacuacgcagggaggagagagccuaguucagggugaguccaugcagggccagguucaaagcaggcuguccacauaccaaccacaagcccuugggaauugcucuucucuccgaggcucuguuucuuguagcuaucaggaaguggcagcucuuugaauaagugccuuuuccucucccaucugccaccuuugucuucccucuggacauauccuggggguucaggagcuuccagcugugcaguuggccacaggacuaggggagcccccuucccuuccagaccaguguccacauacccuccccugugcccacacaccuuccccugugcccgcacugucacccaccacaagccuacuccagcaggagcaccacagccuucugcggucacgcugugcagucagcuggcagacagggagccagguggaccagcacaugagagcgaaacaggaagagugucugucuucaccuguuugaaagucauugucccagauauaguuacgggacccagagagcccugaucaucugugaccaucauuugcuccuuccccuucagguggggguaggccucuacccauuaagccagacacuguuaccugaccuuaccagacccucucagccaccaugcucuguuauucccauuuuacagacaaggagacugagucucagagucaagcaccuccucuuggccacagugagauugagccccuagcccuggugcagccccaggcaaaugaggcugggccacagguagacagaccccuuucccccagcaaaggguguuugaaccccgcucugccgcugcccagcaggccuugguuuccucuacacuuacacuguaguuaaucauaagaggaccugccacacaggauggugagggauugaacaagucaaagcaggaaaccacuuugaccaacggcugcacauggucagugcucagaaaauacacgccauuguuacuauuaaaccacacagcuccaggccugacagugagcuuuuaauaaauguuaacucaacacuggagaagccuucucaccccgucagcagugcaaacagaaacaacagugagaucacauuugccacucaccccagugguggagaggauggucaugcaccccacucgcccuccuaugcccugggagagccuguggugaggcaagugugcccugagccuggaguaggagugggagagagcagguuagggcuccauaucugaagauuuaaauuauauuucugaggccgggcgcagugguucaugccuguaaucccagcacuuugggaggccgaagcgggcggaucaccugaggucgggaguucgagaccagccugaccaacauggagaaacccuaucucuacuaaaaauacaaaauuagcugggugugcuggugcauuccuguaaucccaccuacucaggaggcugaggcagaagaaucgcuugaacgcaggaggcggaguuugcagugagcugagauugcaccauugcacuccagccugggcaaaaagagcgaaacuccaucucaaaaaaaacaaaaaaaaagauuguaucuuuccggccaggugugguggcucacaccuguaaucccagcacuuuaggaggcugaaggggguggauugcuugauuccaggaguuaccuuuuuuuuuaaauauaauuuuugagauagguucuugcucuguugucuaggcuggagugcacuggugcaaucauggcucacuacagccucaaccuccugggcucaagcgauccucccaccucagccuccugaguagcugggaccacaggcacccuccaccauucccugcuaauuuuuugcaaagaaggaguccacuuauguugcccaggcuggucuggagcuccugggcucaagugauccucacaccuccaccucccaaagugcugggauuacaggcaugagccaccuugcccagcccugaauuacauuuccuuugacccagagggcucacuucuaggaaccaauccuauagaaguaauuaaggacaugcucaaagauguaagugaugguuaccaugguguuguuuauaaaagccaaaaagaucaaaacauuuccuaucuugaccacauuucugguggucaagauaggaaauguaugaaaugaaggcaggaacuaccuuaaggugggagacaauguugccuuggaauuuaugguaugaagcuguauugcucucuuagaucucuaagacguaagucacacuguagcacucccaaaaucaucccaaucaaaaggcaaguccuucagcagcucucaaggcccccuguggcccacccuccccuuaucuuucugaccuccuguccuggaacccccccaccccacauacucugcuguuugcucagaacucagccacacucgccccuggaucuuugcaaucccugaucuuccuccucccugagucacuuacuccagggccccacaguguguucccuggcuuccuucaggccucagcgcaaauguccccuuuucagagcagcacccccuaacccaacuguauguaguagccccugccccgcagcccaucucccugagugcauuuuucucuuggcacauuuuacccccugauguauuucuuuauuucuuuucuuuuucucuuuccuuuucuuucuuuuuuccagccuguagugcaauggcaccaucucggcucacugcaaccuccgccuccuggguucaagcgauucucagccucccgaguggcuaggauuacaggugccagccaccaugccuggcuaauuuuuguauuuuugguagagacaguguuucaccauguuggcuagguugaucuuuuuuuuuuuugagacaggaccuugcucuguugcccaaccuggugugcaguuaugaaacccuggcucagucuucugggcgcaaaccauccuccuaccucagccucccaaguagcugggacuacaggcacaugcuaauuuuuguauuuuuugaagaaacgggguuucacuauguugcccaggcuggucccggacuccugggcucaagugaugcucccgccuuggccuuccaaaauucuggaauuacaggagggagccaccauuccugccuuuuuuuuuuuuuuuuuuuuuuuuuuuuuuuugagacagagucuugcucuguugcccaggcuggagugcggugguaugagcauagcucacugcagccucagccuucugggcucacgcaguccucccaccucaguuuccugaauagcuaggacuaccaccccuggcuaauuguuuuauuuuuauuuuuuguagugauguggucucccuauguuucccacgcaacucuuggccucaagauucuccugccucagccucccaaagugcugggauuacaggcaugcgccacugugccuggccucuggcuaauuuuuuuauuuuuauuuuuuguagagaugaggucuuccugcguugcccaggcugguauugaacucuuggccucaagauccucccaccucagccucccaaagugcugggauuacaggugugagccaccucgcccagucagcaccugaugucugucugucugucugucugucuuuuuuuuuuuuuuuuuuuugacagaguuucgcucuuguugcccaggcuggagugcaauggcacggucuuggcucacugcaaccgccaccuccuggguccaagcaauucuccugccucagccuuacaaguagcugggauuacaggugcccaccaccaugccuggcuaauuuuuguauuuuuaguugaggugggguuuugccagauuggccaggcuggucucgaacuccuaaccucaggugauccacccgccucggccucccaaagugcugugauuacaggugugagccacugugcccggccagcaccuaauguguuucuucacuaauuuuccccuacuagaaugucagcuccaugaagccaaagacaauccuucucuucccuguuguacauauucccugaccuuggagaggggccgccacaacauuggcgcccaggcacuuguuggaugaacagucaaggugcgaagggcagugcuggggacuugucugguuucuuuccaggaugacuucuugcacgagguugagcagaaacucucaccugugaauugucaccuccugacuuggucuucugcacccuuggccuugacccaagggggcggguggcauggagccgcucuaagaggucagugauguuggcuucugauggaauggacagagguggugccaggagaccagauuaggaaggccuuucuagaaggguccuaagagauugucuuuucucagcucuuuauuuuacagaugaagaaacugaggcuuagaauugagggggaggcuacagagcaggguguagaagauagacaggccccuucucaggcaguauccaguuagcaaaggugguuaaugacaagaacacgcaguaggugaugcugggggagcggggggagaaugagcacucucuuuugcuacuauuuuuguuguaguuguuguuuuauugagacggagucacacucugucgcccaggcuggagugcaguggcucacugcaaccucugccuccuggguucaagcaauucuccugccucagccuaccaaguagcugggauuacaggcuuccgccaccacgcccagccaauuuuuguauuuuuaguagagacaggguuucacccuguuggccagccuggucuugaacuucuggccucaagugauccacucaccucggccucucaaagugcugggauuacaggugugagucaccacacucggccuugcuacugguuauuuuuaaucuuuaagacaguaaaacaggugaaagugaagcaauauggaaacuuucuuucaaauagaacgaacucaggacucuucuaacucagaccaagauuucuagaugcccuuuccaugggcauugcauuugccaggcaagauuucccugugaagagcuuucccugcgauuugcaucucugggaucucugcgcauagcaagugaccaagucagaaaacuuauccacauccaggcagccuggcacaacaggauauccccacgugugcaugugcguguguccagagcgaagguguaagagcccagauucaaggucacucagugcuuucggaacugagauaaaacccgguggagggguugcggggaauuucacucugccccugagaagccagccccacccagccagauccagcuuccuguggggagcuagagugacccugggagggaaggguggccucagggaaggaagaaaggcgcucuugggacuggcaaguagucagguacuuuaccaugaagagcuaaaggcaugugacuugauuuguaccuucaaauaaugaggcagcuguaauuugcaucugcguagaguuuauaguuugcaaagggcauuucccaggauuaguuaucacauuugaucccggcuuugugggcaggacugguaucauuuacucauccuuucaaaaaaauacguacugagaccagucacgguggcucacgccugugauccuagcacuuuggaaggccgagguggguggaucacuugaggucaggaguucgagaccagcccggccaacaugguaaaacuaaaaauacaaaaauuagccaggcgugguggcacgcaucuguagucccagcuacccgggaggcugaggcaggagaaucucuucaacccaggaaguggagguuguagugagccaagaucaugccacugcacugcagccugggcaacagagcgagacucggggguggaaaaaaaaacaaaaaacaaaauacagaaaauauguauugagcacuuacuaugugguaggaucugugcuggccccaggggagaugacugaguaaaaacagcauuggucucugcccauuuccaugcuaucauuauaucauuguuuauuuaaucagccucuucaagaaagaccuuggguuguuucuaaucuuuugcaacugcaaaccugugaccuugugcaaaugucauucaucuguaggauaaagccccagagugagauagauguuguuaaauugcggcugagcacugucugcaugcccacuggcuguguaugagcaugccuguuugcucacagccuugccaaaauaauguguuaaguguuuuggauuuuugcugaucugauaugugagagaugcuaucugaguauguccauuugcauuucuauuacuuauaaaaagauccuugcucuagcuuacuuguuuagaggucauauuuuguaugugugugaauugucuuuggcccauuuuguuuugggguguuagucuucuuauugauuucugggagcucuuuauauauuagaaaaauucgacuuaugugauaugagcugcauuuaaguugucccagguugucacuucuuuuuuuuuuuuugagacagaguccugcugugucaucuacgcuggagugcaguggugugaucuuggcucacugcaaccuccaucccucagguucaagcaauucucucgccucagccuccugaguagcuaggguuacaggugugcaccaccacaccuggcuaauuuuuuuuguauuuuuaguagagauaggguuuugccauguugccugggcuggucucaaacuccugagcucaagccauucaccagccuuggccucccaaagugcuaggauuauaggcgucagccacaaggcugcauuguucuuauuuauuuauuuauuuauuuauuuauuuauuuauuucgagcuggagucuugcucuguugcccaggcuggagugagauggcaccaucuuggcuugcugcagccucccccuccugggcucaaacuauccucccaccucagccucucaaguaucugggaccacaggugcauaccaccaugcuccacuaauuuuuguaauuuuuuguggagaugagguuucaccauguuguccagacuggucuugaacuccugggcucaagcaaucuggcugccucagccuccuaaagugcugggauuacaggugugggccacugcacccagccucacauagauguuuaauaucuuuuguuaaguuuaacccugaguaucgcgacuguuguuguaagcggggucuucucuuuucccauaccuucuagugacuuguuauuuauauuuaaguguguguguuuauacuaccaucuuuaguuuuuacuuuuucaauuauuuaucuugacuuuuccagguauacaauaauaucauaugaaaauagcaauaguuuuaacuauuucuauugcguuuucuuucuuuugucaaauuccucugauaaauacacccaguauagugauggugguggcagcaucugugucuucccugagcuuaguauuagugcccagguaugaaacuguguauucguacucucuggaguaugaagcugguuccuggcuucuguguuaaucuauauaauuuuguuaaggaaguguccauugauucauaauuuacuaaguguuggcuacuuuguuaaauguuuuuuggugucacuggggaugaugauuuuucugcuuagaucuauuuaauaugaugaauuauauucaugauuuccuaauuauguugaaccauccuugcauucuuugaauaaaccccacuugcauuccugaaucacccccauuuuuuuauuuuuuuuauuuuuugagacagagucucacugugccacccaggcuggaaugcaguggugcagucuuggcucacugcaaccugucccucgcaagcucaagcgauucucguaucucagccuccuaaguagcugggauuacaguugugccccaccacacugggcuaauuuuuguauuuuuaguagagauggguuuuugccauguuggccaggcuggucucaaacuccuguccucaagugauccaccugccuuagccucccaaacugcugggauuacaggcacgagccaccguacuuggccuccauuuaauuuuaaugugcugcugaauucuauuugcuuauauuuuauuuuggauuuuuacaauaauauucauaagugaaauuggucagaaggauauucugugaagccguugucagguuuugguuuaaguauuugcuuuacuuaaauuuuuuuuuuuuuuuuuggccuggcacaguggcucgugccuguaguuccagcauuuugggaggccaaggcaggugggagccuaggaauucaagaccagccuggguaacacggugaaaccccaucucuacuaaaaaugaaccugguaugguggcaugugccuguagucccagcuacucaggaggcugaggugggaggaucauguacuugagccuggaaaguagaggcuguaagugagccaugaucgugccacugcauuccagccugggugacagcagacccugucuuaaaaaaaauauauauauauauauauauuuaaauuuuccuuucuauauguuccuguuuaacaguuuaaacauuaucuguuauuucugaguuuuccaggauucccucccaaaauguuuugcccuggugcuuuuguuuuguaaugguaguccuuuuauaauucuguuucuaauguggaaguuguccuguguagauuagcuaugucuucugggauccauuugauuuauuauuuuuguccagaaauuauuuuauucagguuuuaaauuuuauuugcuaaguacuaucuuauuuuuuaaaacaauuaucugcuuauuugguuauuuucccauuuagcguuuccuaguuuguaugggaagcuuucuccccacccuccuaucuugauuagguuaguuggugguuguauauuuuauuggcuuuuuuccaacaagccagcuuuuuaccuuauuuauuaguucuaccgcuuauuucuucccuaauugauuucuuuuccuuccuuccuuccuuccuuccuuccuuccuuccuuccuuccuucucucuuuccucuucucaaaacagggucuugccgugucauacaggcugaagugcaguggcaccaucauggcucagugcagucuuaacuucccaggcucaggugauccuccugaguagcuggcacugcagguacacaccaccacaccuggcuaaauuuuuuuauuuuuugagagggaguuucgcuuuuguugcccaggcuagaaugcaauggcgcgaucucggcucacugcaaccuccuucuccuggguucuccugccucagccucccaaguagcugggauuacagguaggcgccaccacacccggcuaauuuuguauuuuuaguagagaugggguuucuccauguuagucaggcuggucuugaacucccaaccucaggugaucugccuggcucagccucccaaagugcugggauuacagguaggugccaccacacccggcuaauuuuguauuuuuaguagagaugggguuucuccauguuagucaggcuggucuugaacucccaaccucaggugaucugccuggcucagccucccaaagugcugggauuacaggcgugagccaccgcacccagccuuuuuuuuuuuuuuuuguagugacagucucacuguggugcccaggcuggucucaaacgauccucccaccccagccucccaaaaugcucugagauuacagacaggagccaccaugaccagccauguuucuguguuuuauuuugugguucuuuuucuaacauuuuuaaacuggugcuuuauuuauuuuuauccuuucuguuuuaauuguuacauacacugguggcuaaaaauauccugaucauugcuguagcuguauccuguagauauggauacuugguguuuugguauuuguuggugguggugguguuauauuuugagaaagagucucucacucagucauucaggguagaaaaugaugaugcaguuucagcucacugcaaccucugccucccauucaagcaauucucgugccucagccucccgagguagcugggacuacaugcaugugccaccaugccuggcuaauuuguuguauuuuuaguagagacuggguuucaccauguuggccaggcuggucucaaacuccuguccuuaacugauccgacugccucggccucucaaagugaugggauuacaggcaugagccaccaugcccagccugguguuuuuauuauuuuuauuugcuaggaaucccauagauaaaauuuuuuaaaaaauucccgauuuuuaaauuaauuucuagucauauugcuucauaaucauaaauuuuuaaaauauuuuuuggauguuauugacauuuucuuuggacugaauauggucagauuucaugacuguuccaucagcucagcucuugaaaagaaagcacaguaucuaucacuaggguagagaguuugaaauauuauaguaccuuacugauuaucuuauuugggucuucugaauucuuauuucuguucaugcuacuuaauguuucuugaacugaaagugguaaauuaaaaucucuuauuaguguuuugauauauuuauccuaguaucuguaauuuuucuauucugaaaauugcuacaguauuauuugaugcauuaugaauuauaccguuagcauaauaaauugcccuucuuuggcuaauuuagugagguuuguugugauuuugcaucauuuuauauuaagauuuuugccccagcauuuuguuugcauuugcuuuuauaucuuugcuuguucuuuuuuuaauuuuuuuuuuuuugagauggagucucacuccaucacccaggcuggagugcaguggcguaaucuuggcucacugcaaccuccgccucccaguuucaaguaauccuccugucucagccucccaaguagcugggacuacaggcaccugccaccaugcccagcuaguuuuuguauuuuuaguggagaacggguuucaccuuguuggucaggcuggucucgaacuccugaccucaggugauccacccgucuuggccucccaaagugcugagauuacaggcguaagcgaccgcacccggcuguucuuauauuuuuaaccauucuaaguuacuucguuuaagguaugucucuugaauagagaauagagauagguuacagguuaugcuugaaaucuaaucuaaaaaucuuuuucuccuucaagauuagugggugaaacuuuuuuuuuuuuuuuuuuuuuuugggauggagucucgcucugucacccaggcuggagugcaguggugugaucucagcucacuacaagcucugccucccggguucacaccauucuccugccucagccucccgaguaacugggacuauaggugcccgccaccacgccuggcuaauuuuuuguauuuuuaguagagacgggguuucaccguguuagccaggauggucucgaucuccugaccucgugauccgcccgccuuggccucccaaagugcugagauuacaggcgugagccaccgcacccggccaacuuuuuuuuuuuuuuuuuuuuugagauguagucugugucacccaggcuggagugcaguggugcgaucuugacucauugcaaccuccacuucccagguucaagcgauucuccugccucagccucccgaguagcugggaugacaggcacacauuaccacgccuggcuaauuuucguauuuuuaguagauacaggguuucaccauauuggucgggcuguaauuuuuguauuuuuaauggagaugggguuucaccuuguugggcaggcuggucuccaacuccagaccucaaacgaucugccagccucggccuauuaaagugcugggauuacaggugugagccaccgcaccuggccuggaauuacuuuuuaaaguguuuuuauuuuuaaauucaugcuguaauuuuggauucgaauuuguauuugucuugugccaguauuuucuucuuuuucuuuuucuuuuucuuuuuuuuuuuuuugagacagaaucucugucgcccaggcuggagugcagugguacgaucucagcucaccacagccucuaccuccuggguucaaaugauucuccugccuuggccucccaaguagcugggacuacaggcacgcgccaccaugcccagcuaauuuuuuguauuuucaguagagagaggguuucgcccuuauuggccaggcuggucucgaacucccgaccucaagugauccacccaccucgggcccccaaagugcugagauuacaggcaugagccauugcgcccggcuguggcaauauuuucauagugaauuuucuuuauauauaagcgaguauuugugcuccucacccccguuuccauuuuguuuuaugccuuuaaauuuuuuuccauauuugaauuaguugaauuuuccuggaguggcaauuaacaggagguuuugguggaaauugggagagaagccaggacaguucucuggguuucucuggugaaaggcucccuccucuguugccaugguaauggguugugcuuuuuaaaguauggccuuucucugcauccacuccucuuucaccuccagaaccuaaccugucucaagaggucacuugccuccagcccugaguacucccaguucauucuggccguagcucaugccuucugccaucucccuuuuagaaguggccuuuucuggggucuuccacucuugagcucccccgccuccgccgcccccccccgcccccccccauugccaugucugcugcccgcaggugcuuugggccacacucaacugugguugggaguuugcggguuuucccugccucuuaguuucucucauuugucuuuacccauguugcuuuguauaauuugguagaagagggaaaauucagaacuaagcugcugccuuauuccuccuggaaugaaguccaccucccugaguuuucuguuuguaacguccacccagacagcaagaccgccugcuugauuccuggcuucugagguguuaaaggccugggaggaagaauauuuuguaaccucugcuccgaaaagagcccuucugcccuucuuacaaacagcccuucagcccuucuuuuuuuuuuaauuuuuuuuauuauuuuuuuuauuuuuugaguccagagucucacuuuguugcccaggcuggagugcaguagugcaaccucagcucacugcaaucuccgccuaccagguuuaagcaauucuccugccucagccuccugagcaguuggcauuacaggcaugugccaccaugcccaguuaauuuaauuuuuguauuuuuuaguagagaugggguuucaccauauugggcaggcuagucuugaacuccugaccucaugauuugcccaccuuggccucccaaagugcugggauuacaagcaugagccacugcgccugggcacaaacaguccuucuuauaccaauuacuuccuccuaaaaacugucauucuuacuucuuggguagaaauauuauauuuauuugugccuugaaagauuguggggcuagggauggggaacaggacacuugguccuccaagcaggguuuggaagcucugggcauugaguuuucacaucaaggggggucugaguuccaagaccaaggagcccacccccuccuuugauggacaaagcagugaaggcccagggaggggcagagguggguccaaggucacguugccaaaucuuagcaggugcggaagcugucaggcagggccuggauuugaauucuguacucggugcuguuucuuggcucuguggccuucugccccagaucccucagaguucuuggcgccucaggucugugcuaagguguuacuuaucccaugcaguuagcagcaggugcccaugugucccgccaagguuagagcauuugguuagccugcacccucccuuccccgcacugugcagaagggaaucugaggcccaaaaaggaaagugaccugucuaaggucacacugcaagucaucuucccgacaucacugcugagugggccaaggacagcuuccuaguucugcacuuucagaguuugcaaaacacuccuuauugcaggccgggcacaguggcucacaccuguaaucccagcacuuugggaggccgaggccaguagaucacgaggucaggaguucaagaccagccuggccaagauggugaaaccccgucucuacuaaaaauacaaaaauuagccaggcgcgguggcaggugccuauaaucccagcuacucgggaggcugaggcaggacaaucacuugaacccggguggcagagguugcagugagcugagaucgugccacugcacuccagucuuggcaauagagugagacucugucucaaaaaaaaaaaaaacaaaaacaaacaaacaacaaaaaaaaagcccacuacuuauuuauuuaauacaugugguugagcccuaggcugggccuagucucugcccccaaggcauucacagccugguggggacaacacacacacacacacacacacacacacacacacacaguggggcagcaugcucucucucacacacacacacacacacacacacacagcagggcagcaugugccagccaaggcugcaguguggagggcagaggugcugcggccagcggaccacacugugauguaccccggccugagugccacuguggccccuuuacuuuucugaaaguuaaacaggggagcagggaccgggauuggcuggaguaauccccgcaucccucacugggggucaggcugagcuaagacaaccugccaaccccauuauuugggccaggaccgccugacuccaccaggugcguccucggcaagugaaggaacccggugggcguuccaccuuaucugcacgaaggcuccggacccuuugucucccacuacguccccuccccaaaaccacccaguuccagugaguccagguguccucuuccuggcaagggggcucccaugccaguuggggguaaagaguguguuucagccggacacggcggcucacgccuguaaucccagcacuuugggaggccgaggugggcggaucacccgaggucaggaguuccagaacauccuggccaacauggcgaaaccccgucucuacuaaaaauacaaaaaaauuagccagacaugguggcgcacuccuguaguacuugggaggcugaggcaagagaaucgcuugaacccgggcggcggaaguuggcagugagccgagaucgcaccacugcacuccagccugggcgacagagcaagacuccaucugugaaaaaaaaaaaaaaaaaagaguguguuccucuggugggggagccccuuuuuccggggggggacacaaguccucaacagcggcugcacaucuaggugccuucaguccugugagcccggcccuggcccucucugucuccugccauugcagccccaccccugauaugauguuguggggucagggaccaagaaaggcaucccggugucugcugagggggaugaggagagagaaaggagagagagagaaagagagagagagacaccaaccuggaguggcaggagggagagaaagaggggagggacaaggagucccagggagaaaaagcaggaagaagacacugaucagggggaugagacauucauuggucgauugaggaggucaucagaagguuccgucauugacuucugggcuauccuuuccucuuguguggacuacguagggugggauccacgugucaugacagugucacgugggucucugucuccuucccuuggcucugcuugccucagggcuggcuucauuaccaggcagccucuaccuugacgguuccuggcucacaccuagugaccccaugggaagcacauaccucugcuuggaccugacuagguucugugugccucagccggaccacugcggccaggggaaugugguacuaucauuagcuggaccugagucagugcuuauggcaacagccagggagcagggcccacaggcagggguggcuccccacaggacagcagguguucucaggaggaugaaugggugcaggguagguaaaccuagaugaccccucugccuccacugcagaacagcagugcaugugacuuuucuccuuuuucuccugcugcggcgggagcauucuuuauggagcugcuauguuagugauguucaaagccacaugugaccuuagggucauggggacucuggagaagguagugggagaaguuuccuuucuaccucacccuggccagggguccaccucgggcuccugucugagucugggauccagcugagcccugaccacacuuaauccccacagcaaccuguguccugggugcugguguuaccccuguccacagacagguucagagagguggccugucuugugggcacguggcagggccaggaaggaagcucagguauguuggugcaggccguuguccuccaggccuggccacauaaaguccugcucaggaaggaagccgugaggcaacgagcugggagacccugggggugaagcccaccuuggucccugucugaccaggcaaggguggagguggguggggaggggacccgauuuggcuccacuagaggcaaguaugaccaugggacagggauggcaggcucucaccauccaguuggugacagcugugggacugggagcaugauaaagagcaugcuacguccuggcugcaugucccugcuuccugaccuuaaacacuauccugagugguccuucacuuccagccccaucagagacuucugcacacagauacccaccaguuccccugccggaggaaaggccuauaaugcgauggccguggccacaucuguugagggccuguuccgugggcugggcccuggagaugcauugccucccuccaucccuccaaaguggaguuaaucccauuuugugggcagagagacugaggcuccgaggaggagcauggccugacugcagucacauggcuggugacacagugggagcacccgugugacccuggcgcuggugucuuacaccucaggggucuggggucacaaucacaggucagcagggguggccacaccccagccuggccacgcacaggggccagcuccuuaucuggagaggcuuggaagccacagcaguauccagucguggucacugaugcgccccaccuuggccacugcugggccugcuucuccccacuucccaccuuugaaugagcugcuggccucccaccacccgaccguggcuuugcuccuggaguuccaguuccugggcccucuuguugagaccccaagaacaugagaagaguggaaauagccucuggcucuccuggagggccauuccucaucucaucaguaucuguugagcuccugcugucggcugaaccugugucagcaccaggaacagaaugagagcgaggagccccugccccuuaggacugacacaacggaaaacacauacaaucauuuccaggggacgagggcugcgcugggcgcgguggccccaucuggucccaccauugagcccuggagcccccgucuccuggguagauugcccccuaccucgggagcagcccauccccagugacccacugcgggccaguguugguguaggccccuggguuagucgggguucuccaaauuaacagaaccagucgaugagaagaugaaauaagacauccucucucagcucagcagugaggcaggagaacgggggcgaauuccuccguccucagccuuuccuucuacucaggguugggggcccacccacacugggggccaucugcuuccugagucugccauucgaaugguaaucucaucuggaaacacccccagacacacccaggaguaacguuuaauuggggcacccuguguccuggucaaguugacacaugaaauuaaccaucauagccccgacugugguuuggaacaaacaucucugauggccaccccagcugcagagcuccuaugggacuggccgaggccccuguggcaaugacagccucacagcucaacaucucccucugugcaguccugcgucccuugcccucacaggaacucagagcccuccccuugcccugcauggggcucuccaaguccucagucagcuccccgggccaggcccaugaccaagggcauugaaggaaaugucgagugaugugaccgagagugacaggagggucguggccacucacaccagggggcaagaaaauucaggaugaguccgcagugcaaagugaaagcaaguuuacuaagauuguaaaggagccgggcgcagugucacaugccuguaaucccagcacuuugggaggccgaggugggcggaucacuugaggucaggaguucaagacuagcuuggcaaacuuggugaaaccaaaucucuacuaaaaauacaaaaaaucagccgggcaugguggcacaugccuguaaucccagcuacucaggaggcugaggcaggagaauugcuugaaaccaguaggaagagguuuuagugaaccgagaucgggccauuacacuccagccugggcgacagagcaagacucauaaaaaaaaaagaagguaaaggaauaaaagaauggcuacugcauagagcagccccuagggcugcugcuuacccauuuuuaugguuauuucuugaugauaugcuaaacaagggguggauuauucaugccuccccuuuuuagaccacccaagguaacuuccugacguugcgauggcauuuguaaacucacggugcuggugggaguguagcagagaggacgaccagaggucacucuuauggccauuuugguuuugguggguuuuggccggcuucucuacugcaaccuguuuuaucagcaaggucuuuaugaccuguauuuugugcugaacuccuaucucacccugugacuuagaaugccuuacccgucugggaaugcagcccaguaggugucagccucauuuuacucagcuccuauuuaagaugguguuggucuggcucacacgccucugacaccuuugccucucggggccucuguguucccgucaggacaucggaaucuccaagggcauaacccuggugcucugggagccucucugucagcacucagccuggauggagggcucagugcggacuccguuuuguugggucaugguuggccagugcuaggcugagcugggcuggacacagggcuggagggguagcgcccuuacuguagggacaggugggggugcaauuuguguagggaugaaaagcaccagcuuggagggccuuuucuaggcccuugggccuagccccugaugcugaugccccuaguuggggucugcagagcuggugccaagaaccuggcugguaggggucugacccagccuuuggccuucugucuccauugcccugcaccucucgauuuuuuuuuuuuuuuuuugagacggagucucgcucuauugccaggcuagagugcaguggcacgaucucagcucacugcaaccucugccucccgaguucaagcgauucuucugccucagccuccugaguagcugagacuacaggcgugcaccaucaugccagcuaauuuuuguauuuucaguagagaugggguuucaccguguuggccaggauggucuuaaucuccugacuucaugauccgcccaccucagccucccaaagugccgggauuacaggcgugagccaccgcgcccggccaugcccugcaccucuccucucuccucacuuccugccuaagaugagucauggggaauccuggcgaugggagccauggaagggcuuagagcaggggaguggccacaguaacaggcuaacugggaguagcucccuggugacagggcgggaaguagugagccuggaggcaggggcaggcagcaggggugugccaagcccagcugacaagguccaggacauaggcugcaacugcgaggcccgucucgggggccaggagcaugcuuugggccugaggucaccuggauauugggcugcggccaacuuggccccauacacaguuucuauuccugggucuugggcucugacaccaaauauggcguggccugagucuggcacccccaacugugguccgacgacauauccugcuccuccaagugggcccggaccccgcccacaccauggagucagaucaugccagcacucggggcccccaagugggcagaggcuccugcugcugcuacuggcccuccaacuguccacccguccgcgugguucacaugggguuaaaaguacucaggaccaaaauagccccucucccugcagaagaaagacaggggcagggggcaccaugucuugguucacaccacagcccuguccuugcuacccgcaucccagggagcucacccggccucugccccccaccuuucgcacuggcccacuuggucacacagcgaucuacacacucauugguucacucuuacuggucacucacucguucacucauucauucauuuacugaucauucauuaauucacucauugguuaacucauggaaucacugccuauuuauugaccacauacuaagagcuggacaccguucuaccauuucagagcugaacaaaacacaaaacauaccuauccucaugggguuauguucuagacagacaaccaaagcaaauaaguaggauguaccguguguuagaauaaaugcaaggaugaggaaacgagggggcucugaggugauggggggaguuggaauuucagggggcccagggaggaccuggugggaaggggacuuuugagugggcaucugagagaagaacccuccaagcagaagaacagcaggugccaaggcccuagcagccguuugaggccugaaaaacaggcggccagguguggcuggggcacagguggcggggagagaagcagaacgugaggucagggggacacauggggcccaguggaucagggccucaugucauucagggucugagcugagaaugacguggcugauauacuuguaaagcauccugcuggcuguugagugaaugggucagagugagccauuuucccaugugccugcugcgugcugggaaccuagcugggugccggggagagaagaugcaggugaacccuagaugcuuauucccauggugcuugcagaggucuggagccaccacugucuccuccaucugaccugcucauccuuggugcuuaaccaugugucaccuccccaagggagucaccaucuuugucuguuuccuuuuuucuuuuuuuuuuuuuuuccuuuuugaaacugaguuuugcucuugauguccaggcuggagugcaguggugcaaucucggcgcacugcaaccuccgccuccuggauucaagcaauucuccugccucagccuccugaguagcugggauuacaggcaugcgccaccaugcccggcuaauuuuguauuuuuaguagagacaggguuucuccauguuggucaggcuguucucgaauucccgaccucaagugaucugcccaccuuggccucccaaagugcugggauuacaggcgugagcuaccgcgccuggcuuuuuuuuuuuuuuuuuugagauagagucuggcucugucacccacgcuggagugcaguggcacaacuuggcucacugcaaccuccgccucccugguucaagcgauucuccugccucagucaccugaguagcugggauuacaggcgcacaccaccgcgccuggcuaauuuuuguauuuuuaguagagacgagguuucaccauguuggccaggcuggucucgaacuccugaucucaagugagccaccacgccuggccucuuugucuguuucuaaaugaugcccccaccagacugagaacuccuuuagggaaaggcugugucugauucuccccuucuccuggguaccagugcagggccugccccuauucccugaguguccccugagagguggagcgagugaaugaaucagugaacacaugagccccaggccugaccugccuguguggccagggggacgaggccucugagagccagcgaccuguuucacucucuucuugccaucuuuugcagauggauuugcagccgcugcaaguguguggaagggccguguucguguuggcaaagaaggucggcugcugagccagggcgugucucccggaggccugugggcugccaggauccccaccucucugcaaugggcugcccaggcuggucaguuaccagccagugacaucagcgagguucccugcucucuacccugggaagggcccagccuaaguuaccaagccccaggcucccaguaccacccucagccuauguggauugccaccccaccuucugccuguccuugggaggggaccgacucuuagcuccccuuagcaaucagguugcacccagucccuugacuuuaugcccagguuuccuggcaccuaaaguagaaacgaugcaacugccccucgggcuugcugagggucaaagggggugugacuuugucauggagcguagaagucagagucgauggugaucccgcuggcuguuaacaucgauacaguucaggucagcaugcaccaaguuccuccaacacaccagguacauuggcuagccaccucucccaggcagggcggugcaguggugagagcagggaccccagccagguggccuggguccuaacccccugcacugucauugcuggcugugggacucugcacaagguacugcacuucugugccucaauuuccucaucuguaggguggggguggugauugccaccccauagggugguuauaaggggccacacauguuccuaugugugagaugcugagaaagucaccuggcauggacaggauggacagccaguauuuaucgaacuaugaaugaaugaauguuacccuuuaguggguuccagcguccuauccugucggugggaagacugaggcucagagagcuccguaacuugccccaggucacacagccgguucaggcagaguuggggucucaugccucccagguguucccacagucuuuuccccaggagcaggguccaagccugcugcuccuccaaccaccugcgaggcaccugggcauguuccuggccaccaggaaagagaggucuaauggcaguaguaccagucagcgucaugugccuggagcgagugcccugugagugcaccugcugggccagcccuuagcaaaccaacgccugggccugccggagccccagaccucaugcugaacauccucagggccccucaguggccuguccuuagacgaaccccaggccugguuuauggagcugaggcgggcaugagcugggccucaaaucccaggcugccaauccucacagagcccugugugucacauggcgaagccaucacuucugacaguccuuacgcagaccagacucuggccugggccugugaugguuacacaccauggguggcacuggccugguccuugggugagcucacaggugugucgcagagaguggaagggacccugcucagaccccaguccauggcccacugugcucccauuucguaggugagcagccagcaggcugggguucaagccuuggccccugugggcccaggagcccaugggcuuggaagccagccuuggcucuggcugauguucacaggaagcguuuuccuuguggaucgggaaugccaacggccucccugauggcgggugcucaucucuugcagaccagccgguuccugcuggaagcuccuggucugaucuggggauaccauguccaagccccccgaccuccugcugcggcugcuccggggcgccccaaggcagcgggucugcacccuguucaucaucggcuucaaguucacguuuuucgucuccaucaugaucuacuggcacguugugggagagcccaaggagaaagggcagcucuauaaccugccagcagagauccccugccccaccuugacaccccccaccccacccucccacggccccacuccaggcaacaucuucuuccuggagacuucagaccggaccaaccccaacuuccuguucaugugcucgguggagucggccgccagaacucaccccgaaucccacgugcugguccugaugaaagggcuuccggguggcaacgccucucugccccggcaccugggcaucucacuucugagcugcuucccgaauguccagaugcucccgcuggaccugcgggagcuguuccgggacacaccccuggccgacugguacgcggccgugcaggggcgcugggagcccuaccugcugcccgugcucuccgacgccuccaggaucgcacucauguggaaguucggcggcaucuaccuggacacggacuucauuguucucaagaaccugcggaaccugaccaacgugcugggcacccagucccgcuacguccucaacggcgcguuccuggccuucgagcgccggcacgaguucauggcgcugugcaugcgggacuucguggaccacuacaacggcuggaucuggggucaccagggcccgcagcugcucacgcgggucuucaagaagugguguuccauccgcagccuggccgagagccgcgccugccgcggcgucaccacccugcccccugaggccuucuaccccauccccuggcaggacuggaagaaguacuuugaggacaucaaccccgaggagcugccgcggcugcucagugccaccuaugcuguccacguguggaacaagaagagccagggcacgcgguucgaggccacguccagggcacugcuggcccagcugcaugcccgcuacugccccacgacgcacgaggccaugaaaauguacuugugaggggcccgccaggucaccuccccaaccugcuccugauggggcacugggccgcccuucccggggaggcaagauugagggcccgggagagggaggcccgagcugccaccgggcuuaggcaggcuguugaggagcugugggagcaggcccagugggaggcuguggacaccccgaggacaguguccugucucgaggcagggcugacacauggugccauagccagcggagggcgcucagugagugccccgggccuucuagacaacaggcaggaaggaugaaccucagggcacccccagguggugcggaaagccaggcaguugggacagaggugcccacgagggcagaggccggugcuaaggggauggggaagaagggacaagauucccagagaggagaggaggcuguugguaggaaaguggcagggcugggggagacccagccccaaggguccggggcggaggaugcuuuguucuuuucugguuuugguuccucuuucgcggggggugggggaggucaacagggacugaguggggcagaggcccagaagugccagccuggggagccguuugggggcagccccuucugcccaccccauccuucuuccucuccagagaugccaggggggcguguaugcucugccccuucccucagacaggggcuggguggggaggcucuuuaggcucaggagaagcauuuuaaagaaacccccacccugccgcccgcauuauaaacacaggagaauaaucaauagaauaaaagugaccgacuguca

SEQ ID NO: 192567 - RNA, 60877 nt, Homo sapiens
gggccagcggcgcggcugaagcgagggcggggagggaaagcgagcggcgccugcgccccggcgguggacgggcccggucgugggcggggauuggggcggagccugaccguuacgcgcagccccgcccccgcggccucgucgcuccugcugaggcgguagccgcuuuucgucgacucuuaccgguuggcugggccagcugcgccgcggcucacagcugacgaugggggaccccagcaagcaggacaucuugaccaucuucaagcgccuccgcucggugcccacuaacaagguagcggccgcgggcgagugcgggccugccuggcaucccugcgggaaccggcgggaggccccgcgggcgccagugcccguggcuugggaggcggggccggcgcggccugugacacgucgcacuguggggccgcggcagccuggccgggccggggcgggcggggccgggcagcugagaggcccgggcgggaggccgcagcgcggggguccucacgcgagccggggagcguucccgggggcggcggcgcgggcacaccccccggcgagcucuuggggcggggggcgagcaccggcggcucugagcggaggcgggggcgggggcauccucgggggcgcugcgaggagggagcucccggcucggaaaccccggcugcuggcgccggaugcggggaaagcgcggcucccccagcgccacccuggagcucgaccccgccuguuggagccggcuuggcuccucgggccuugcggugccugccucaguuucucuucugauaaaguugccgaguagucuacgcuuuggcuuccagcuuuugucgcuuuggccagggaggcucaccacagccuccucccucuccucgguucucuuuggagauggagguuuccuuuuuuuuuuugucuccagaggcuguucucucccuggaacuuuuacagcuuugcgcagcuggcuggaggcguuggggugacgcagggggcuaaggugacacgucgggucggagagggacuuggagagugcaaagggcugucgcgucagcgugggcucuccccgccccuccugugacacgaguguugucugguucccacugucacuucccgaagggaacagcuguuauugaaccucgauaugcuggcauagaaaguucccgaguguuacaaaauagguguuucuguugguuuuaagucuugaugguacaggggagcccauauuuuuuccagccuaggugaggaaggaaacaguuuauuggaggugaugucugauggaugugggaaaguuaagagaaaggcuccaggaauucuccagugcccguuucuuuacuguucucuugauuuucacauuuuuauuuauuuauuuuuuuagagacagggucucaccccgucacccaggcugaaguguagugccuugauccuagcucacugcagccuugaccuacccagcccaagccauccuuccuucccagccuccugaugaggcugacaccacagggcuguaccaccacgcccagcuaauuguuauuauuaauuaauuaauuaauuaauuuuuguagagacagggucuugcuauguugcccgugcuggugucaaauuccugggcucaagcaguccuccugccuccuccugccuuggccucccagagugcuaggauuacaggcaugagccaccaugcuggccuuaauguucuuuuuuuuuuuuuuaacguuuuaauuuuaauuuuuuugagacagagccuugcucugucgcccaggcuggagugcaguggugcgaucucagcucacugcaaccucugccuccuggguuugagcaauucugccucagccuccugagucgccaggauuacaggcauccaccacuacacucaaguaauuuuuauauuuuuaguagagacgagguuucaccaugucagucacucuggucucaaacuccuggccucaagugauccacccgccucggccuccugaagugcugggauuacaggcgugagccaccgcgcccagccuugauuuuuaaauuuagauugauguguuuauaaagaguggguccuguguaacuuagucaagauuaggaucugcgguuagcaauguguaaacuauauuuuuuugucaccuuuaucucagaaacaucaacauguauucucuuugauuuaauucaaagauaauuuuaaauuagaaaucaaugucuuuauaucaagaggcuuuugagagacaggcuuguauuguccaaacugcuacuuucuagguaugucacccuuggacagguuacuugaccacuuugucccuuuuuuccuccucugaaaauggggcaugaacuagaccugacucagaggguuauugugaagauuaaauggaauaauccaagaaaaacacuuagaguaggaacugcauauaauagucuucaauaaauggcagcuguuuuuaugaugaagaacacaccugugaaaaauuuauauucuguaauaagauuaauaaaagcaaugagcaaaaauguuuucugguaauguuuaacaguaaugugcuauauuucuugguugagaccuuuuauuugaucauugguuugaaacccuuaccuaaacgaagauaacaauagcauuuuaaaauuggggucauaaaagacagcucuaagauacaugagccaggaaagguaaucaaagaaaaacaagucggcuuacuuuuagaacaugguauccaauuucuucgucucauguaugaugauuuacucuagaucaaaggucaugagggucaauucucuuuuuucuuuuucuuucuuuuuuuuuuucuuuugagacagucuagcucuguuguccagucuggagugcaguggugcgaucuuggcacacugcgaccuccuccucccagguucaagcgauucucuugcaucagccuccugaguagcugggacuacaggcgugugccaucacgcauggcuaauuuuuguauuuuuaguaguaauggaguuucaccauauuggccaggcuggucucaaacuccugaccuaaagugauccgccugucucagccucccaaagugcugugauuacaggcgugagccaccgcaccuggccaagggugaauuuucuuguuuguggaaauccuucuuuguugcuauaccauuccuuacuuuuauauagauuggguuauucauucaacaaguauucauuaagcaccuaugcuaugcugggcacuguguagagcaugaaagguauguacacugaugguauguuccuguccucagggaacuuauagucuaguggacagaugaagggcagaugcaggacggcaggugguauguuuucugcucugaagcacagugugguggagcgggaagaguggcucugggaacagacugcaugggauccaguccccauugugggcauuuccacuaaggaauuacuaagcaguggccacuucuuaucugucauacuuaauucaguaauuccuuaguuuucuuuaaaauggagaucaagauuuaccgccaccaucccacgcccggaagggcuccucaugcucucugcagcauggugcuucugucgcuuacagaacaacuugccuuugaugauuuucaagagaguugugcugugagguggcaaaaguauccaggcagcaggaugccagugccucaaggaaaaaaugguccuuuucggcaauguguucgguacugggggcuuggcccuuguguauuaccgcauacaaaagacuuuuuccagggcuuuguauuaccaguuggcauuggagcaggugcauagccaucccaaggcacagggagcucugggcccucuucucaacauucacugucucaaacucaccaagcacaacuuuguggacauugcugaugccaaguugaagauuccuagcucuggauccaagucagagggccaucuccaugucagcucauccagaagugccccuuucagagguggcaccuugaugaggucuuccuagagcccaaggauggccagcagauucccuuguucaagcucaguggggagaauggugaagaagugaaaaaggaguagaaacgauccaaaagacccagcuuucuucuagucuggccuucccuuaucuccaccaugugcccaccaggggugauggcccaucugagugacagacacucccguaagcuaauuuuccagccaccaguggaaugauuguaugugcuggcauaugguaauuuugguauaauucuaacuugggcacaacgaaugcuauugucauuuuuaaacugaaucagaaagaaacucuuauuauaagauaauuuaugugaaaguucuuuguuuaagaaagcacaugauaaaaggaaucagaauuaagaaaacauucauugauuuaaaaaacaaauaaauaggccgggcgcgguggcucacgccuguaaccccaguaccuugggaggcugaggcggguggaucaccugaggucaggaguucaagaccagccuggccaacaugaugaagccccgucucuacaaaaauacaaaaauuagcugggcaugauggcgagugccuguaaucucagcuguucgggaggcugaggcaggagaaucgcuugaauccaggaagcagagguugcagugaaccaaggucacgccacugcacuccagccugggcaacagagagcgacuccaucucacacgcacacacaaauaaaauaaaauuaaauaaauaaaauggagaucaagacuagcuacauaauuugugaaauguacaaaaugaaaaugcagggcccuuguuugaacaguauuaagaauuucggccagacacaguggcucacaccuguaauccuagcacuuugggaggccaagguggguggaucaucugagcucaggaguucgagaccagccugggcaacauggugaaaccccaucucuacuaaaaauacaaaaaauuagccaggcguggugccaugugccuguaaucccaacuacucgggaggcugagacaggagaguugcuugaacccaggaggcggagguugcagugaaccaagaucacgccauugcacucaagagugggcgacagagcgagacccuaucucaaaaaaaaagaauuucaagaugaggcuaggcgcgguggcgccuguaaucccagcacuuugggaggccgaggcagaugaauagcuugagcucaggaguuugacaccagccugggcaacauggugaaaccucaucucuaccaaaaaaaaaaauuaaaauuagccaugcaugguggcucaugccuguggucccagcugcucgggaggcugaggugggaggauugcuugagcucgggaggcagagguugaagugagucgagaucauaucauauacuccagcaugagacccuaucucaaaaaaaaaaaaaaagaauuucaagaugagacagcagagcauuaagccaaucacacacucuuuuauucuaaguguggggcccucugcgacugcauagaucacacacaugcccaggaagcuggcccugauggggaugaucauaguaccuucuacuaguacccuacuaaugaaagcguuguuaggaagaugaaauuggcuaaagugccaacaauagugccugaauuaaacacucaauauuagcuguuauuauuauuuguauacuaauuauucucaucauuaaacaaaacaaauugucagucaaaagcuauuucuugcucaucaccauaagaacugauguucugcuuuaaaagccacaucuugacuuugguuugggauugcauaucaaaucaaagcgcagucccugcuuccaaagcauagccuccugguauagcaggaggaucaaggcagcauuuaugggagccagaccuguauuucucaccacuucugaccuccacacgucccagucuccacuuguuagcuccucuaccccuauaaacugcuccaccaugugcauucgcauuuagugagcaccuguguugugccaggcauggugccaagcucaggugaauaagguagacauggccccccccucauggggcuacauuuuagcaaucccuuagcuuaggugauggguccggaggaugccaaagcugccugccucauuaggaaccucacugcucucuucuuguagccagucuggugaccaccucagaagugauucucaaacuuggccugcucugggcuguguacccaaaaucucugccaucaccucuaccaaaaacccuuugcauccuguccuugcuuacuaggaaacaaucuuguaacuaauugucuugcccacuggacugcuagacugugggcuccaugugggcagacuuccugaaccacgcugguauguccacuugguaugugccagguacacuugaugguaagugcacagcaacugguaguugaguaacuaggugagaaauuacacacagccugacggggaagaacagcaccuuuuggcagagucugucguuuuguuugaugccccacagaagaggguucuccuaauggccaucaccacagggcguuugaauuugcgcgucugucuuccccacuucucagugagcucuuuaaagacuagcaccaauaagcguucagcuaguguuugugcugcuacuuuuucauaccucaucaccugucacaugucugacauacagcaggugaucaguaaacaccaaaguaaaucuccuggccucuuuuugugucaguugucacuccaccccgauuauucagugugcgaucagugugagcauauuguggugaggggcuuuagaaaacccacucguguuuccucucuuguauugcccuuguauugcccugaaaagaccagaagccagaucuugcuugauaaugauagguuggacaaccuucacauaagugauucugccuauaaaguauaucuuuuuuuuuuuuuuuuuuuuuuuuuugauagcagggucucacuguugcugaggcuggagugcaguggaguggucuccgcucauugcauccuccgccucccaggcucaagcgauccucucaccucaaacuccugaguagcugagacuacaggcacguuccaccacgccggcuaauuuuuuuaauuuuuugguagagauaggguuucgccauguugcccaggcuggucucaaacucuugagcucaagcgaucuaccugccuuggccucccaaagugcuaggauuacaggugugagccacugcacccagccuauauaucuaauauguauuuuuuuuuccugcaaaaagauuaaaaacaccucuauuagaggaauuuuuucccuauucggaguuuaaugaguuauaaauacuacuuuccacaacaagcacuguguauuuuaugggcccagcacacuuccgacgcgugacucugcuaguuagcacuguguauuuuaaaguacuuuuaugcuccuguugggcuucagugucaguguugaaggggcuaguaauuuuugagcuggcaauacguuuuuaaaguuauucuuuugaguaacaaauauuuacugaaugcuuaccauggguaagccuauuuuucaggcugugugugagauuuaaaaguacacaacuauucagcaaacacuuauugugcguuuaccaugugcagguucugugcuaguggacaggaaaguaaggugacaggagccggacgugguggcucacaccuguaauccuagcauuuugggaggccgagagggcccaaauugcuugagcccaggcguucaagaccagcuuaggcaacauagcaagacccccaucucuacaaaagaaaaaaaaaaaucugggcacgguggcauacacuuguccuaacugcuuaggaggcugagggggguggauggcucgagcucaagaguucgagacugcagugagcuaggaccgugccacugcacuccaaccuaggugacagagccagaccuugucucuuuaaaaaaaaaaaaaaaaaagccauaaagcagcgagcuaggaccgugccacugcacuccagccuaggugagagccagaccuugucuccuuaaaaaaaaaagaaaaaaagccauaaagauuagcaaaagggaaagauucuaccccuguaagagcucucagugcccucagugggcagggaacguaguccucgguuaugaaccugcaucuaagaguuaucaaagugaccuggacagagugaggcaguggagguagagaagggcacagcauuucauaaaggaauaucucucuguauuagucaucuauugcuguguaucagaucacccccaacuuggcaucauaaaacaacagauaguucugagggucaggaauuugggggugacuuagcuggcugcuucugacccagggucuuucaugaggcugcagucaagcuguuggcccagggcugaggucaucugggagcuuacucacauggugguuggcaggccuccucuccucgcuggcaguuggacugggggccucaacuccucagcacuucacccucuccacagggcaaccugaguguccucaagacauggcaccuggcuuccccuagagcuagugauccaagguggggagggagagagggggagagagaaaaagagagugggggagacaggaaaaggccauagugucauuuguaacccaaucucaaaaaugacauggucauuucugccauauacacauagacacacagaucaccuugguaaagugagggugguggagauuacacgggaugcaaauaccaggagguggguuucacuggggccaucuuggagucuggcugccacaaccucuuccucuggcuggggagagaagcaauaugcucaacagccugccaucugguauagccacugccaggaaggaugguagggcuggaguguuucuaggcagggcugcuucccucacuagcauuccuuuacaugacugguaggaucccugcugaugcuucaaggauaaggcauguuugagaugguacacaaaccuaaauucucuucacuauguauagugugcauuguuaaaauauauacaugauagcccgggcgcgguggcucacgccuguaaucccagcacuuugggaguccaaggcggguggaucacgaggucaggagaucgagacuauccuggcuaacacggugaaaccccaucucuacuaaauauacaaaaaauuagccgggugcgguggcgggcgccuguagucccagcuacucaggaggcugaggcaggagaauggcaugaaccugggaggcggagcuugcagugagacgaaaucgugccgcugcacuccagccugggcgacagagcgagacuccgucucaaaaauaaauagauaaauauauauauaacauaaucuguaauauacuguauaaaucauguaguaaacugggcacaguggcucgugccuguaaucccaacacuaugggaggccgaggcugccagaucaccugaggucaggaauucgagaccagccuguccaacaugguaaaaccccaucucuacuaaaaguacuaaauuaguuggguauaguggugugagccuguagucccagcuacuccggaggcugaggcaggagaaucaauggaaccuggaaagcagagguuacagugagccgagauugcaccauugcacuccagccugggugacagagcgaaacucugucucagaauaaaaaaauacauaauauaguaauuaacuauacuaauuuauaauuaauauaauuauauauaauaauaaaagagcaugaaauuugaggcuuuuaaaaaaaccuaggugagauauuuucuaauaauacaaucccaaaguuuacauuguaaagguuaaacaguuuucaagcuaagucauuuacuguaucuuacaggauaauuuauuuggcuaacauaaauuaguaacugaauuuaacauuuuuuuucagguguguuuugauuguggugccaaaaaucccagcugggcaagcauaaccuauggaguguuccuuugcauugauugcucagggucccaccggucacuugguguucacuugaguuuuauucgguaagugaaucuucucucauuggggugagauugauuacauuguuacauggguguuuuuuucccuuuuuucuuuucuuuuuuugagacagugucuugccuugucgccugucaccuuggcugcaggagugccaucauagcucacugggcucaagugaacucagccucuacaaaaaauaaaaaauguuguggugugaugauguauaacucuaguccuaguuacucaggaggcugaagugggaggaucacuuaagcccaggagucaaggcugcagugaacuaugaucuugccgcugcauuccagccugggcgacagaguaagacccugucucuuaaaaaaaaaaaaaagaaagaaagaaaugugauuuucaguguugccauacaguauuaaaaggugaggccuuuaagaauugauugagcccucauugguauggguuaauggguuaucauguaagcggcuuuauaggaaaaggaggagagaccugagcuagcacgcucagcguucucacuaggcgaugcugccucuggacucuacagaguccaaccaguaagaagguucuuaccagauguagccccuugaccuuggucuucucagccuccuuaacuguaagaaaucaacuucuuuucuuuauaaauuacccaguuucaggaauucuguuacaagcaaugaaaaaccgauuuaugucaaucaucuucuaauaauucggcaguacaaaguacagacucaugggagaaggggaaucaggugcugugggucuguccuauguccuccaaaguggagaguuuaugucaaugaugagacacucuccuuguaucagggcuucacuuccaccguaaucuuauagcucuggcuuccaaggacacuaauaucacaaagccugagugaaugauuuuuaguggcaguuucaaauguuuauaacaugaaggucuuuuuucuccuuuuaucugaagacuugggcugcauuggccccucuggugaguaaaccgucuucuacuucugauacucuauggcaauagcccauauggggccuuuugcaucagaagaagacaccaccuuuggacugacagucugaugggauaaccccacaguccagugggaggcaggacuauuugugaagugaaauaaauugaaauaauaaaagaaauaauggaaagauccccagggcuuggaagcuaagcaaggccugccugucaccugccacaggcccuugccaggacaacuugugcagagcacccucaaacagccauggcuuagucauugcugccucccccagacaauuuccagagauuucccuacuccaucuuuucuagggaaggaaccagcuaggcugcccaucuggaauuguggcaagcaaucuuauauuaugacuuaaggaauaucgaaauauugauagaacgugauuauuaaaaaggagcauuuguuucuauaagauaaaaucuauuaugauucuuugucuuuuuuuuuuuuuuuuuuuuuuugagauggaguuuugcucuugucgcccaagcuggagugcaauggcgcgaucucagcucacugcaaccuccaccuccuggguucaagcgauucuccugccucagccucccaaguagcugggauuacaagugcgcgccaccacacucagcuaauuuuuguauauuuaguagagaugggcuuucaccuuguuggccaggauggucuugaucuccugaccuugugauccaccccccucguccucccaaaguguugggauuacgggcgugagccacugugccuggccuugccuucuguuuucuucuaagaguuuuauaguuuuaggucuuaccuuuaagucuuugauucauuuugaauuaauuuuuguucacaaugucagguaagaguucaacuucauucuuuuguaugcggauaccuaguuuuuccaucaccauuuguugaaaagacugucuuuuccccauugaaucaaacuugggguuuuuuuuuguuguuguuguuuuggguuuuuuuuuuuuuuugagauggagucuugcuuugucacccaggcuggggugcaguggcacgaucuuggcucaccucaacuuccgccucccagauucaaaugauucuccugcccucagucuccuaaguagcugggauuacaggcaugugccaccacguccaucuaaguuuuguacuuuuaguagagacagaguuucgccguguuggccagguuggucuugaacuccugaccucaggugaucugcccgccucggccucccaaagugcugggauuaccccggcuaaagcuuguuuuuaauguacuuuguuuuccagauugaucauuaccaguuaacuuaugguaaccuacucugcccagagcagaugaagacuagacucaaggcaauaccuaguuacuucucuuccuucugucuuuacuguguucuuucccucuuucuuucugcuaagucucgcccauuauaaccucuccuucuuccucaucgcuaaagaauacuuccaguuuaagccauuccaggaaaucgggugguuuuaugauguguuccuccgugagggaaggagugaccuagagccugaggggcaguacagcaggaucuguuugggccauugcagguuuaaucacugaccuuuuaaaagucagauaaauagaacuguaugagucacaaugcuuguaaaugauucaaaaacagcaauuaaaauucaugauacaaccuuagggcaggagucuaggauuugggcaagaaaaagucaaggaugagaaaguacucaguauuguuuuuguuguuauuuuuaaggcagagaagagcuauucuuuaaacauuuuuauuccuuaaaaaaaacugaggggccggacauagugguucacaccuguaaucccagcacuuugggaggccaagguggaaacaucacuugagcuugggaguuuuuuggguuuuuuauuuuuuuuuuuuuuuuuuccuuugagacagagucucacucuauccccucggcuggagugcaauggcaugaucucagcucacugcaaccuccgccucccggguucaagcaauucuccugcuucagccuccgaaguagcugggauuacaggugugugccaccacacccagcuaauuuuuguauuuuuacuagagacgggguuucaccauguuggccaggcuggucuugaacuccugaccucaugugauccacccaccucagcuucccaaagugcuggguuuacaggcaugagccacagcaccuagccgagcaugggaguuugaggcugcagugagcuaugaucucaccacuucacuucagucugggugacagaacaaagacccugacucaaaaaacaacaacaaccaccaccaaaaaaagaaacaaaaaaaaccacuagcuaauugggaaaaaauccaagcagccccaaaauauauaaagucucuccucuagaauacuuuuccccucuucuuccccucccacugccagacacacacacaugcacugcuuccuguguggcauggguggugugcauauuuaacuggaguuuuuuuucuuuaacuagaauuucaagucaacaaauuuacagaggaaaaauaauuuauaaguuauggcuuuugccaagcaaaggggggaaggcagauuaagaguauauggagagggcaaacugcauugguugcugacugcucccagaguggaccagauugaacugaccucugccccuuuucaccuccauugcugggaucuccauguuucaggcugcuccuccccucuagcucuguuuuuucucaaguuugccguuacguauuucaugagcuuauuaaaggugaaugggaucccugcaucgaucuuguuggccugggguuagggacaggcuuaaauacaacguaaauaagaagauagacugcaaaguuaugcaugagagauggaaacuaaguccugugcccacuucugguuggaaaauaaggcaaaguuuaaaagagguaacauuugcaaugaacuuggaagguuuggugagguuuugauaauggagacaaggccgggcaugguggcuugcgccuguaaucccagcacuugggaggccggggugggaggauagcuugagcccaggaguuuaagaccaaccugggcaacauagugagaccucaucucuacgacaacaaaaaaagauaauggagacaagggagggaaaauugaggucagcacucggaccuucagauauaaaagcaggaaaaagcgaaaugcuuuguagcgacuuuuuguaugcauaggaaaauaaagagaaguaagggugaaaggagaggaucugugucauauuguggagcgcuuuagcugccacacugggagcuaaaaguucacuccugaggcccuggaggggugaggcauguggggaggcugacucagccugggcagagcaggagacagcaucaggaagaggugaggaccgaggcugaggaugcaggagcggggaugugguuggggggucggggggaggcaaaucugagcuguccuuuccuggccuuggguguguuccuuaccucugaaugucuugcuuuccuucucuugaaagugagggugagaauacuaggaccugccguacaggguguuggcaggagcgagcaagagagccccauacagccuggcacauagugagcccuagaacauguugaugaugaccagggcagaaucugggcuccugcucgguggacacuggggagaaccuuuuuaugauguuggcguagaaaggcaacgcuuuuuaugaccuuauagagguaaucaaacaaguuauaaacaaagggcggcugggaaauuacugagauugucuauaaguaaaacucuagauuaauaaugguaugcacuuugggaggcugagaugaggggauugcuugaggccaggaguucgagacuagccuggcgaacauggcaaaaccccgucucuacuaaaauuacgaaaauuagccaggugugguuccgcacgccucuaaucccagcuaccucuggaggcuggggcacaagaauugcuugaauccagaaggcagagauuaccaugagcugagaucgccucacugcacucuagccugggcaacagaacgaggcugugucucaaaaaaaaaaagguaugguucacugggcaugguggcucacaccuguaaucccaacacugagaggcugaggugggaggauugccugagcccaggaguucuagaccaucuugggcaacauaacaagacccuaucucuauuuaaaaaaaaaaaaaaaaaaaaaaggccaggcacgguggcucaugccuguaaucacaguacuuugggaggccaagguggguggaucaccuaaggucgggaguuugagaccaaccugaccaacaugaagaaacccugucucugcuaaaaauacaaaaauuagccgggcguagugacaccugccuguuaucccagcuacccaggaggcugaggcaggagaaucacuugaacccaggaggcagagguugcggugagucaagaucgcaccauugcacuccagccggggcaacuccgucucaaaaaaaaaaaaaaaaaaaaagcccggcaugguagcuaccaucuacuugggagguugagacaggaggauugcuugagcaauccugguugaggcugcaaugagcugugaucacaccacuccauuccugggugauggagugagacccugucucaaaaaaaaaaaaaaaagaaauuaguaaauauaagggcagcacaaaggaaaguuuugguggaccuaaagcuucuuuucuuuucuuucuuccuugcccauuuuguaaaagguauucugccuauacucauucuaaaauauccacauuccuuuacaguuaguguagggcaagcuauuacugaauaacaaccucugcuuuuugcucauuucuguggauucaguauaaagauucuaacauuguugcuuuaccgucgaccccuuggggaaugugcauuguugaggcuauacucacugccuuuacuuguuucagauuugaucuuacaguggagagaaguuaggcauaagguguggaaggggcaggaagugcuuguagcuuucacuucaggagcaugaaaucuuguguuuuuuccucucucugcuggucgugauguuggguaggucucuucuaccuugugauaagagaaugagcauccuccaagcuucugguagcgaucaaacuggacaaguagaucaccgaccugaaaacauccaaacagugcaucuguuucaaguagagacacauuaccaaauuucaaaucauauccaaccaaggaugggaggcaaagaguuggugucguuccagcagcccgcugacacuugucaugucccugugcccugcauuccaggaaggacgagaggagccagggguugcucacgccaaccaucauccacucuggaguccuagcaucccaaaaguguggguccuuguugacacaaacuuagaauucuuuaggauccuaaagccuaaggaaaccuuguucucaaaagcucacugauuuugcuccuggggauaaaaaauauuaacaguuaguaauauucuuuccauuuagaucuacagaguuggauuccaacuggucaugguuucaguugcgaugcaugcaagucggaggaaacgcuagugcaguaaguucaucucaaacucgucauuuuccuucuuguuuaaauauuuguuaugcuauaauaguaaagaagcucaggcuaggugcaguggcucaugccuguaaucucagccauuugggaggcugaaauuacaggcguuugggaggaucacuggagcccaggaguucaagaccacccugggcaacauggcaagacccucuguuuauaaaaaacaaacaagucagguguggugucucacgccuguaaucccaacacuuugggaggcugaggcgggcggaucacuugaggucaagaguucgagaccagccuggccaacaugguggaaccccaucucuacuaaaaaaaaaauaauaauaacaaaaauuagcuggguaugguggugcacaccuguaaucccagcuacucgggaggcugaggcgggagaguugcaugaaccugggaggcagagguugcagugagccgagaucacaccacugcacuccagccugggugacagagcgagacuccaucccaaaaaaacaaacaaacaaacaaaaagaguucaauacuugaaaguuugggaggcccuaugagaagaagcagagagccugauggguuuuggaguuggacagacccaguugacuuguuuauucaaaaaucuguuaaacaccuaauaaacaggaagcguuggcuagcugcuggggauauagugacagacaagacaaacaagauccccagcugggcacgguggcucaugcuuguaauccuagaacuuugggaggcugaggcaggcagaucgccuugagcccaugaauguaagacugaccuggacaacaugacaaaacuccguuucugcaaaaaaugcaaaaauuagcaaaucaugguggugcauaccuguagucccagcuacucgggaggcugaggugggaggaucucuugagccugggagguagagguugcagugagcugagaucgcaccauugugcuccagccugguugauagagugagaucagugauagauagagugaguugauagauuaucaaaauaauaaauuaaaauaaccaauauccccucuuauaggggauauuuuauuauaaauaaaaauaaucaagauccccucuuauagacaggggcagucagagaguaaucaaagaaauauguucacaggaaaauaacaggcagugauaagugcuuuaagaaaauuaaaacaggaagugaggguacagagaaacuggaggcuucuuuaugauaauaguuuuuuaauaacuggggugacuuuugugguuaggauggaaugcuuguauuuaaauuaauauuuaacuucuuaaaucuacaaauuaaaaaacccauucuuuuuuuuuuuuuuuugagacagaguuuggcucuguugcccaggcuggagugcaguggcgccaucucagcucacugcaaccuccaccucccggguucaagagauucuccugccucagccuccugaguagcugggacuacaggugcacgucaccaugccuggauuuuuugguauuuuuaguagagacgagguuucaccauguuggccgagcuggucucaaacuccugaccucaagugaucugccugccuuggccucucaaagugcuggaauuacaggcaugagccacagcacccgaccaaaaaacccauucuucaugucuuuaaauauagcaaauauuguguguuaauuucuaaacacaaacauaaauacuguguguuaaguucugugaaaaaauaaccuuaaaauauucaauuaauuuauaauuuuaaagaacugauuuccuuaaccccauuuacaaaccuaaguaaggauuuucuuuuuuuuuuuuuuucuuuuuuuuuuuuugagacggaaucuugcucugucacccaggcuggagugcaguggcccaaucucagcucucugcaaccucugccucccagguucaugccauucuucugccucagccucccgaguagcugggacuacaggcgcccgccaccacacccagcuaauuuuuuguauuuuuaguagagacgggguuucaccauguuagcuaggauggucucgaucaccugaccuugugauccgcccgccucagccucccagagugcugggauuacaggcaugagccaccgcgcccggccuaauuaaggauuuucaaacauuuuaaacuuuauuuacaaauucaguauauuugauuaucucaaacacugaacuggcagccuuacaaaucuagccagccaaaucuugcacagcacugguaaccuauuuaucaggccaaaaugguguagauggaguaaauggaauuccuuuaggcguuucuuauaugcuaaaguauaagaaaucaaauuuguaugcauuucaaauaaaaauuauggccaggcaugguggcucgugccuggaaucccaacacuucgggaggcugaggcgagaggaucacuugaguccaggaguguaagaccagccugggcaacauagugagaccucaucguacaaaagacuuaaaaauuagcaaggcauaguggaaccugccuauagccucagcuacucaggaggcugaggugggaggaucacuugagcccaggaguucaaggcugcacugagcugugaucaugccauuacacuccagccugggugacagagcaagacccugucucagaaaaaaaaaaaagaaaaaaaaaauauauauauauauauguguguguguauauauauaucaauuaaauaguuaaagucagaggucuaaaauagcaguuuccaaaaugcuaguuucucaaucuuuuuucuucguugucccuaagcauaaaaaucaauuaauuagauaauuuuccauuuaaauuggauccaauguuucccuaaugagauaaauuaaauacuaaggaauacaauuuugucagguagaggugaccuuuggaaggccauaaaccauuguaauaacuaagauuuuuuuuucacuuuucaagaaacaauuuuugccccucuuaauuaaaaauauaugccuggccaggcaugguugcuccuaccuguaaucccagaacuuugggaggccgaggcaggaggaccacuugagcccaugaguucaagaccagccuggacaacaaagucuacaaaaaaaaaauuuuaaauuagccaggcauaguggugcaugccuguaguccuagccacuugggagucugaggcagaagaaucacuugaauccaggggguuggcgcuacagugagcaguguucaccgugccacugcacuccagccuggguaaucaagcaagaccgucucaaaaaaaaaaaaaaaaaaaaaagaaguaugccuuagauguuucaaggcuuuuuuuugguuuuuuuuuuuuuuuuuuugagauagagucucacuccuauugccuaggcuggagugcaguggcaaaaucauagcucacugcagccucaacuuccugggcucaggugauucucucacucagccucccaaguagcugggacuacaggcaaguaccaccacgcacaacaaguuuuuuacauuuuuaguagagacaggguuuugccauguugccaggcuggucucgaacuccuaggcucaagugaucugccuaccucugccacccaaaaugcugggauugcaggcaugagccaccgggcccagccaguguuucuuauuaauuuuuuauugauuuucuguuuuuuuguagaggcguggucucacuuugguucccagguuggucucgaauuccuggccucaagcaauccuccugcuuuggcuucccaaagugcuaggauuacaggcaugagccacugugcccagccucaagcaucuuuuuagaaaccuuugcccauuaucaugauguucacaaacuuguuccuaaacuuagcacuguugguuugacuuaccuguucuuauuucuaagccuucccaagguugcagagucacccuccaaacuccagaaaggagcuuucucaucucaagccaucagggguugggggacauggggagggaaggcucagaugaguggucauucgguuuagccaguggagcugugaguucugugcuuggaaccauccuuuuuguauuugaauccuaacucugucccuugcuacccaugugacuuggggcauguuguugaaccucucugugcuucauuuuccccaucuguaaaguguagacagcaguagugacugucugauaguguugcuaugaggguugaaugagaugaugcccaugaagcacucacaacaggauccggaacaugugggugaccaauaucauuaucaguuaaauuagguucaucaaaggaucacucguauagguuuuuagaagaccuguuuuaauuaagauaugaauucuauaauucaugucuauacauggauccucaugaaguggguaaaagcaguuucuuuuaauuguuuaaauacuuguuuuaucaucuuaccuauauuguaguaucuguuaaugauaaaauagugcuaaacaagguaaacauuaauguagcuccucacuaauuugucaaaaauucugauuuacuggaauccauuuugagauugauuguggacgaaguguagugguucacacuucuaaucccagcacuuugggaagccacggugagaggauugcuugaauccaggaguuggaggcugcagugagccaugaucaugccacacuacccuccagccuaggugacagagucagaccaucucaaaaaacaaagaaaagggccaggagcgguggcucacgccuguaauccagcacuuugugaggccaaggcaaguggauuccuugagcucaggaguucaagacuagcaacauaacaagaccccaucucuacaaaaaauacaaaaauuagccaggcgugguggcacacaccuguagucccagcuauuugggaggcugagguggugggaucacuugagcccaggagguggaguuugcagugaaccgagauggagccacugcauugcagccuggguaauagagcaagacucucucaaaaaaaaaaaaaaaaaaaaaagaaagaaauggauugcucgugaauuaaaaguaguccugaguagaaagcuuuuccccaaauaaaguucacaaugacagagaugguuuaauggacaaaugaggacuaguuauuucauuuuguaaugcaagucucauagcuaguuuuuguuguuguuguuguuuugagauggagucuugcucuguugcccaggcuggagugcagugacacgaucucagcucacugcaagcuccgccucccagguucgccauucuccugccucagccucccaaguagcugggauuacaggcgcccgccaccacgccuggcuaauuuuuuguauuuuuaguaaaggcaagguuucaccguguuagccaggaugguacugaucucccgaccucgugaucugccugccucggccucccagagugcugggauuacaggcaugagccacugcgccuggccauacguaguuuuacgaaaauauuaaugugcaugcuuuucucuguagucuuccuuuuuucaucaacauggguguuccaccaaugacaccaaugccaaguacaacagucgugcugcucagcucuauagggagaaaaucaaaucgcucgccucucaagcaacacggaagcauggcacugauguaagucacuggaggcuggauuguuuccuuuagauacauguucacuucauagaaaaagugauuuuuauccugaauaguaaaacuuuucuaccugaguugucuuacaaggaauuaguguacaguagauucuuacuauugaaguaguuauguucuguaaauucaucaugaguacuggauuagugaauacuaaaacauugcuccuaggagaaauacaggauuagguuccuauaagcucuggucucauuuucaucaacugaucaauacauaaccuuauuuaacauguguuucuauuuaaagacaccuuuuuaaauauauauugauggcucaugaauauugaacucacagccaaggacuauaacucagcccugaaugaagcuuauuuaaugccugaauuuucuccaugaggcacaucacagccuucaugugcuucagaacauuagauagcccuucaguacugcacuugagaggcaucuuaaaaaaugacauccucaauaaaaagcaugggaauaugaagaacauagcacaaaauaaacugcagaaaggacauuuguuaugagaacugaaacaagaaggcagaguagugugucuuguucuaccucagcugagaaugugcuucuugggcaacucauuuuuugcugcacuauucuccaaaugacugaaaacaccacgaggacuaauuuuggguuaaacguaaauuuuagcaaguagguagauucauaaauauggaauccaugaauaacaaggauugauuaucauuuggaaccugcauuuagauaugaagucuuugaucuuuccuuuucagaaaugguuuauguguuugagguccuugacuuccucaagguuuggaagcaaaauuuacuggaugauagauuacuaaagugcacgcagagguccucuguagggauguuacugauuuuauaagaauggaaagcaccaaucuuuaggaaacaggucucuaagggaagugaaagguaucaaauaaaauccuuuacaggccggaugaaaugcucagcccuguguuguuuuuuuguucuagcuguggcuugauaguugugugguuccaccuuuguccccuccaccaaaggaggaagauuuuuuugccucucacguuucuccugagguauguauuaugcuucacaucauuuuaaagugugcuuacucugacaguuaacaaaaggugcauauuuaaaauguuaggauguaggcuaagcucuuguaacaagaagugcugaaacauaacuacugaagagagaaaugacauuaucaacaauuccaagguuaggauaucugcuauugacugauggacuuacuuugcuguucucaacauguggcuuccaucucagggucuaaagcagcugcuccaguuuaagacucucccagauuaagagaaaaagacaagcauccuugagagcuaaugcccuauucuucuauuuauuuauuuuuggggggacugaaucuggcucuguuucccaggcuggagugcaguggcacgaucucagcucauuacaaccucugcccccuggguucaagugauucuccagccucagccucccgaguagcugggacuacaggugcgcaccaacacacccagcuaauauuuuuuuugagauggaguuucgcucuugucaccuaggguggagugcaauggugugaucuuggcucacugcaaucuccgccuccuggguucaagcgauucucuugccucagccucccgaguagcugggacaacaggugcacgccaccacaccuggcuaauuuuuguauuuguaguagagacgagguuucaccauauuggcuaggcuggucucgaacuccugaccucaggugauacccccgccuuggccacccaaaguucugggauuauaggugugagccaccauaccccaccacagaugcccuauucuuuuacagaaaaagucuggagggagcucccaucccuucuacuuauguccuaugagcuggaauuuaguugcaugucuuaucuagcugcuagggagaacugagaauuuauuacuaguagugugccacaguucaguucagagcucugaaacugacuaaaaaugaaaacauuuuuaauagggguuucauucucagugccccaguuuugcuguuuauguaguauuaucucaaagcuauuggaugaguuaaugcagguaaaaguacuuaguaccuggcacaaaguaagccuucaguaagugcucuaaauaucacuaucuucaucuuugugaccugauagcaacagugacagcaauccauaguacuucuguggccucuccucagaucacuuagaucuagggaaaguaaagccuaaaaggcgacaauauuuacuauuuggcccuuucuuuucuuucuuccuuucuuuuuuuuuuuuuuuaaagacggaguuuucccucuuguuucccaggcuguagcgcaauggcgcgaucucggcucacugcaacauccaccucccggguucaagcgauucuccugccucagccucccaacuagcugggauuauaggcaugugccaccacaccuggcuaauuuuguauuuuuaguggagacgggguuucgccauguuggucaggcuugucucaaacuccugaccucaggugauccaccugcuucggccuccuaaagugcugggauuauaggcaugagccaccacaccgggccuacuauuuagcccuuuaagguaacgugugccuaccucugucuuggaccaucauauguucugccagcuacucuagcuccucccagucccacuggguaaggagcacgauuuguugaacucuugcucaaucuauucuuuaauuuucuuuuuuucuuucguuuuuuuuuuuuuugagauggagucuuacucuucugucacccacguuggagugcacuggcacaaucuuggcucacugcagccucugccucccagguucaggugauucuccugccucagccucccaaguaguugggauuacaggcccacaccaccacgccuggcuaauuuuuuuuguaauuuuaguagagacaggguuucaccauauuggccagucuggucucgaacuccugaccucaggugaucugccugccgcagccucccaaaaugcugggauuacagaugugagccacugugcccagcuuauuccuuaauuuucaauuuaaaacuauguaaaguuguacacagguuguuaaagcuuguuuuuuggguuuuuuuuuuuuuuuugcuauuauaauuugcacauacuuauuagcauugucacagucaauaguuaccaaaaaugguuaucaagaaagaggagaacaggccaggcauguuggcucaugccuguaaucucagcaguuugggaggccgaggugggaggauagcuugagcccaggcguuugagacgagccugggcagcauagugagacuccuucucuacaaaaaauuuaaacuuuagcugggcgugguggcacaugccugcaaucucagcuacucaggaggcugagguggaagcacugcuugagccugggaggucaaggcuccagugagcugugauugugcuucugcacucuagccugggcaacagagcaagacccuguuucuaaaaaaaaaagaaagcaagaaaaaaguagauaugccuuccuuuccauuaacagggacucagaauguggcuguuuaaauuguuagguuuuucccgugcuuugauguguuuuuuauggcuguuuucuugcuuugucugcuaaugacuuuucucgccuuguuucaggugagugacacagcgugggcaucagcaauagcagaaccaucuucuuuaacaucaaggccuguggaaaccacuuuggaaaauaaugaagguggaguccuuagaacugucauguaauacuauucuaugguucaguggcaugcuaugaaacuauuaaaaauuaagaugggccaggcacaguggcucaugccuguaaucccagcacuuugcgaggcugaggcggggggaucgccugagcccagcagucagagaccagcgugggcaacauaguccccaucucuaucaaaaaaaaaaaaaacugaaaccuaaaaauauuaaaauguagacccuucugucuuuuuuuuuuuuuuuuugagacuaagucuugcucuguagccgaggcuggagugcgauggugugaucucggcucacugcaaccuccgccuccuggguucaagcaauucuccugccucagccucccuagaagcugggauuacagacaugcaccgcacaucuggcuaauuuuugcaacaugauuucaccauguuggccaugcugaucucgaacuccugaccucaggugauccacccgccuuggccucccaaagugcugggauuacaggcgugagccaccacaccuggccgacccuucugucuuaacaggaagaaauauucauaauagacuauaaagugggggaaaaauauuacugaacauggaauauaauaaucauuuuuguaaaaaaagaaaaacauaccaaaaacguucuggaaagcacauagcaaauuguuaaauagagagugaaauuacugaggauuuuuaguucucacuugauauaguguugaagugucugaacuuuuauaaugaguauggguuacuuuuaucaucaaaaacaaaauuucaauuuaaaaacuuauaaaaauaguugauacauaaugauucacauuuggugacuuucuuacaggauuacauuuauuguaaauauaucaguugcuuacauauuaaaaaucacuugugacaugaguagucagcucuuucuguuuuaaaguugugcauccuuuguuaggccagaauguuaguguaaauuaacaacaaaaauguaacuuuggacaacuaagcagugaguucauggguuaugauaccuuaagaagugcuggcuuauauaaacugagccuugaacuacucuaaggaacauagcguaacaggaaagaugaagcagucaccaaccgcggguugggugaugguauugagaaaauuucuggcaaggauuuugcuggaggguaggagaguaagugguauuuaucaagaaaguaguccuaggagagagaggcacucagcugugucccagaguggagucauguuguaaugaaaaggagucgcauagccaggcagguugugcacgccugugaucccagcuacuagggagacugaggcaggcagaucucuuaagccuaugaguuugagacugcagugagcuaugauugcaccacugcacucuccagcgugggugacagagacccggacucuaaaaaaaauaagaagaaaaagaaaaggagucgcuuccuuuguauugaguuauagguauaagggugggaaugucugagauuuccaucaaacaguagaaugcugauuuuucauuuugcugguauaggcguagacauaucagugaaucaggauaagaacauugcauauccuagguaacaauggguuauuugaugaauggaauuuggacaagugucuggcauuuuagaaacaaauaauaaaacaaaguagaauuucuucuuuacucuuuacacaaggcuaaauucagguaguucaaagauuuacaugaaaauaugauuauccuagaagaaaacauggguaaagccuuuuuuauuauccugaauugaggaagcccuucuaggcauauucaaaucucauaaaaggaaaagguuaauaaaucugaugacauaaaaauagaacauuucuguuuugaaaaaauacuuuaaagugaagacaaaugauaaacuuauauuugcaauucauauguagacaaaaacggcuuguuuccuuacuaugcaaagaacucugaugugguuguuuuguggaugauuugcacccugugauuuuuuuuuuccacauucuuuuuuuaggcauaugaccguagaugccugcaaagaagacauuuauacaccucuaacuggaguuuaguuuuuugauuucuuagccuuacacuauacugcagccacauuugcccuuggguguuuuucugccuguguuugcuuuuuguuuugcuuggaguguggcucugccuugauuggcauggguugccucuuuguugggguucagcuuuaagaccagccaacgagcacucccagucacaacugcauuuguacauuuuuucuuccucauagcauagcaaacaccaguucuggaaauuacugcguuucuuaguuugcauguccacuguguguccccucugcugagcugugagcucuuccagagagagauuguuuuuuaagaugagaaaucuaccugagccauugauugauuuaccguuaucaaucagagagaagagaagaaagaauucccacaaucuccuaacaaacaggaacagugcguuauauaucuuuugugaaaguacagaugauaauuuaacuauuuucacuauuauaauuuauuagcauaaaagggcuuugaggccaggcacaguggcucacgccuauaaucccaacacuuuggauggcugaggcggguggaucacuagaggccagggguucaaggccagccuggccaacauugcaggacccuaucucuacuaaaaauacaaaaauuagccaggcaugguggugcaugccuguaaucccagcugcucagaaggcugaggcaggagaaucccuugaaccugggaggcggagguugcagugagccgaguucgcaccacuacacuccgccugggcaacagaacaggacucugucucagaaaaaaaaaaaaaaaaaaaaggccgggggcuuugagauugaggguuagccacaggagauauguguaaccucugaaguccggaugucacaguuuguuuuaacagaaaccccaguaacuaacacagaacaagaauuuuuuuuuuuuugagacagaguuucacucuuguugcccaggcuggagugcaauggugugaucucaggucaccacaaccucugcaucccggguucaagcgauucuccugucucagccucccaaguagcugggauuacaggcaugugccaccacuccuggcuaauuuuuauauuuuuaguagagacggguuucaccauguuggccaggcuggucuugaacucuugaccucaugaugcgucccccuuggccucccaaagugccgggauuacaggugugagcuaccgcgccuggcccucaucuuuguauuuuuuaguagauacaggguuucaccauguuggccaggcugaucuugaacucuugaccucaugaugcgucccccuuggccucccgaagugcugggauuacaggcgugagccaccacaccuggcccucaucuuuguauuuuuuaguagauaugggguuucaccauguuggucaggcuggucucaaacuccugaccucaagugaucugcccgccucgaccucccaaagugcugggauuacaggcauaagccaccacaagcccagccuacacuuuaucuauuuuuaaaguaauaaauaaaauaaaauuaaaauaacaaaguaugguugggcgcgguagcucacgccuguaauaccaacacuuugggaggccaaggugggaggucucgaacuccugagcucacgcagugugcccaacuuggccuccgaaaguucugggauuacaggugugagccacugugccaggcuuuuaaugaaggcuucauagaguugcuaaccaggaucacuuuuuagguaaaauagaauaaacaaggcagauuucuuggcaacugaaaauuuagauuucuaucacugauguaauugguauuagaauuuccacauauuaggccggguucaguggcucacgccuguaauccuggcacuucgggaggccaaggcggguggaccaccugaggucaggaauuugagaccagccugaccaacauggagaaaccccaucucuacuaaaaauacaaaauuagccgggcaugguggcgcaugccuguaaucccagcuacucggguggccgaggcaggauaauggcuugaacccgggaggcgaagguugcagugagccgagaucgugccauugcacuccagcuuggguaagaagagugaaauucugucuccaaaagaaaaaaaaacaaaacaaaacaaggauuuccacauauuaacauacauuggguauguauaguccacagagguaguaaguaucuuuugacaggucacauuaaaucaccagaucauaagguagaauuuugaaucguauuaguugaagagaccacuaacauuuuuauuugauaaagccauuggauuaaaaauaaacuucuacuuuaauggacuuuuaagucaaaauucuuauaacguuaaaauagaauauacagcuaaaaagguaggugaucauugacaaaauuggauaagauguagcacugagcaaguugaauuauuauauauucaaaagcaaguuagcugaguauauuuucugcgcuaauaucaauguuuugaauuuucagguggacaagagcaaggaccaaguguggaaggucuuaauguaccaacaaaggcuacuuuagguaauaugcuuaaaauccuacauucugauuuaaaguguaugacucauuaagaaaaaaauaaauccucuugcauuuggccugggcaucucaccugacggaguaauauaaucaugaccgaaucuguuaauaagauuuuauuaaacaaaagauacuauauauauauguuuuuuauucaucucucaagcuuccaacaaagaugcuacauuuuaaccagcuugauaauauaaaaugcagcauuguggcugggggcaguggcucacaccuguaauccuaacgcuuuaugaagccgagguggucagaucgcuugagcccaggaguucgagaccagcuugggcaacacagcgaaaccuuagcucuacaaaacaacaacaacaacaacaacaacaacaaaaauuaccugagugugguggcacacaucuguagucccagcuacuugggagacugaggcaggaggaucacuugagccugggagguugaggcugcagugagccaugaucacaccacugcacucugcccugggugacagagugauaccuugucucaaaaaaaaaaaaaagcagcaaugugcacauuuagccaauauggcugcugaugguuuugauucguggguuuauguugggcuggcucaccuuacggaaauaagcaguggucagaacaucuacaccauuccuuuuuacucaagaacucauuuucuucucuuucugauuuuauuauaggugaacuuaaucuuaaauuuuucauuaucaaggaauuauaauuuguaauuguuauauauuccauugcauuaguuggaaagcagcugcuuuggugaaaaauaacuaaacuguuagaaaugcuccugacauuuucaucauguuuuagacucgucagaguuugggagcagguuaugugacuacuacaauacaaaucugaaagaaaguaaugaaaaggaaaacucccacaagcaucuuuuucacacuugaaauguaaugacguuauucucuacucacggcuaaagauuguuaucuuuugcuguuucuggcuuuaugcuaucuuuuccuaucaaagcacauucuuaucuuuauaugaaaaaauuaagacuuuaauuuugcuggguuucuuagacauaauucuaaagacaauauauaaccuauaaguaaaauguacucagaaaaugauuuuuaagaaacuuucucuaaaaguauuuuugugcaauuuagaaaguauuguuauuaaaauaagagaaugcuuuauguuucuuuuuuuuuuuuuuuuggagacagagucucacucugucacccaggcuggaguacacuggcacgaucucagcucacugcaaccucugccucccggugccuccuggguucaagcgauucucgugccucagccucccaaguagcugggauuacaggugugugccaccaugcccagcaaacuuuuuguauuuuuaguggagacgggguuucaccauauuguccaggcuguucucaaacuccugaccucaggugaucugcccgccuuggccucccaaagugcugggauuacaggcaugagccaccaugccuggccgaggaugcuuuauauuuauuuuggcuaauaugauaaaaucuauauauaagccaaggugaaaaagcacgucacuggcugcuuuaguuguauacauaaugccuagcuaacuuuauuuuuauuauuguuauuacuuuuuugagcuagagucucgcuuuauugcccaugcuggagugcagugggugcaaucacaguucacugcagccuggcccaagagauucuccuaccucagccucccaaguagcugggaccacaggcgcacgccaucacacuggacuaauguuuuuuguuuguuuguuuguggagauggagucucccuauguuguccaggcugcgaacuuuauauuuucaaauaaguuuuaugcagccguaaaaaagaacagucauguccuuugcagcaacauggcuggaggccauuaucguaaacaaacuaaugcagaaacaaaaccaaauaucacauguuuucacuuauaagugggggcuaaaucuuggguucauacgaacauaaagaugggaagaguagacacugaggacuccaaaaggagggagggagagaggggaacaagagcugaaacacuuccuguuggauacugugcucacugucugggugaugggaucaagagaagcccaaaccucagcaccacgcaauauacccuuguaacaaaacugcacguguacucccugaaucuaaaauaaaaauggaaaauuauaaugauuuuuaaaguuuuugggcugggcaugauaguucauaccuguaaucccagcacuuuagaaagccaaggcaggaggaucacuugaggccaggaguucaagaccagacugggcaacauagugagcuccccugaugucuacaaaaaaaaaaaaaagaaagaaaaccaggcaugguggcauaugccuguagucccagcuacuagggaggcugagacgagaggaucacuugaauacaggaguucaaugcugcagugagcucugaucacacuacuacacuccagccuagguaauggagugagaccaucucuaaaaaauuguuagauuuuuaaguguuuuaaaguuuuugaagaguagcacuugauaaaagaguuguggcaugguggcucauacucauaauuucagcacuuugagaggcugaggcaggagcaucacuugagcccaggaguccaagaccagucugggcaacauagcaagacacccaucucuaaaaaaaaaaaaaaaaaaaaaaaaaaauagccagaugugguggugcgcaccugugaucccaacuacucaggaggcugaaguggaaggcucccuugaucugggagguaaugccacugcacucagcuaaggugacagagcgagacccugucucaaaaaaaaaaaaaaaguuguuguaauauauuuuuuaaaugcuccugaagaaaguacugagaggggcaagcucaggcucuauuucucuucagugugcuguuaaaaaaaaaaauacauuuucucugaguuuggagacugcguggaaauacugaggacaccauuuugacaaaguucuguuaauccaaaauaugcuuaucaacuugagucuucuggaugagaaacuaaaguggaaaauguuaucaucucuuaaauaauaaagugcaguaucuuagaauuuuaaaagacacacuaaaaaagaaaaauuauuucuauuggucuuacuuuuuaauuuuuauuuuuuggcagagguauccucuaucauaaaaaagaaaccaaaucaagcuaaaaaaggcgugaguauuauguacuuuauauauaaaaaucugguaguuaagcuuuaaaacuaaaaagccgcuucgucauuuuaguuuuauucuuuugaaccaucuuguaauaaauguagcuuugauauaaggagucuauguuuuguucaaagagauuaaugucaaagagauuaauguuauacuuauugaauuuuuucuagaaugauuauuuaacauuuuuucugucuaugacaaaauucugaaaaaaauuaacaaagguccccugggaauuugucuccugcuuguguagaucaauaagcaaugacaucuugugaggcuuagagggugguugucuggugaguuuucagauacagcgaagcauugcggagcaccagcucuggaggcaggugcaggguuugaauccuggccuugccauguauuggcugugugaccuuggccacauuccuuaacuuauaugagcuuuacuuuccucagcccucuguauccagggguucugcauccauggauucaaccaauugcagaucaaaauuauuugggggggaaaaaaaaacaauaggccaggcguagugacucacgccuguaaucccagcacuuugggaggccgaggcagguggaucacuugagccccggaguucaagaccagccugggcaaaauggugaaaucccaucucuucaaaaaauacaaaaaguagccggauuugguggcccgugccuguagucccagcuacucgggauacuaaggugggaggaucgcuuuaccccaggaggcagagguugcagugagcugagauugugccacuguacuccagcuuggucaacagcaugagagccugucucaaaaaaaguaaaaaaaaauaaaaaguaagaauacaacaguaaaaacaauacaaauaaaaacacagaauuaguaacuauuuucauagcauuuacauuauuuaggcauaauaaguaaucuagagaugauugaaaguauacuggaggcuacacguggguuaaaugcagauacuacgcccuuuuacguaagggacuugaucaucgcagauuuuguuauccacagggucgugaaaccaauucccccaugcugagggacuccuggaauaauacuaacuucacagaguucugaggacuaagccacagaacaaauguagagugcuugucacagugccuggcagguccuaacccuuaggaaauguuagcuguagucacagaagcuuucaaacagcucguguagacuauagucuuauauauguucuagcuuggggccaaaaaaggaaguuugggagcucagaaacuggcaaacacaugcuuuaaugaaauugaaaaacaagcucaagcugcggauaaaaugaaggagcaggaagaccuggccaaggugguaucuaaagaagaaucaauguaaguuuaauuucauuauauuaauacauuuucagggaauaaaacuauuaacucaagauuuugcuuuccaaaugccauguauuuuuguguggggggggaagggaggguacugcaaaauucaguuuuaugaaaacugauauugcauuggcauguggauuggaagggaaagagacgaugggggcagcaacacucugcugaggcuguaagggcaagacuggagugacaucagugagaagggaaagacagagaugcauggagguguuuacacaugaaacaugcuucacauuauuagaguuggggaaaugcaaaucaaggccacaauaagauaccacuguguacucucuagggaagcuauaauaaaaaaaucaguaacagguguuggcuaggauguggagaaauuugaacccuuguacauugcugauggcaaugugaaauggugccacuguugugaaaaacaguuuggcaguccuucagaaaguuaaauguaaaguuuccaugugacccagcaaaucuacuccuaaguauauacucaagagaaauuaaaacuuacaucugugcaaccacacacaaacucgugcaugaauguucauaguggcguuaauccuaauagccaaaaaguagaaauaagcuaaaugucuaccaacugauaaaugagaaagaaaaugugguauguccauacaauggacuauuacucagccacaaaaaggaauguaguccugauauuggccacaacauggauaaaccuugaaaaguuuaugcuaagaaagaagccagucauaaaagaucacaugauaugauucugucuauaugcaauguccagaauaggcaaauccguagagacagaaagcaacuuacugguugccagggccuggggugaggagagaauggagaguggcugcuaaugguccaggccugcuuuuuggacugcugaaaguguucuggaguuaguggugaugauggcacagcuuugugaaugugcugaaaccacugaaucaugcacuuuaacagggugaguuuuacgguaugugaauuauaucugcauaaugaaaaaaguauuuauaaucugaagcccuguuggacucugugacuaaauucuaaauacaugauggaagacuauggcucuggucgugucuccagagguucugagccuggaucuuggagagggagaaggaagaguuucagagaaugaagaagguggaaugaucgugugugucgggggccugccugaaguggaggaguuggaacgauaauguggagcaccuuaaagucaggcugugguuguccacuuacccaagagaaacagcuccuucagcagugcugucaugaaggggcgucucgggagaaugaguucgguagugauacccaggccaggaagaggggaggagacuggaagccaggaggccagugaagagaucgguuuuccguagacuuuuguaaggcucuugagagguuuucauuuguguugaaaucagaagagaaagauggccuucuggaaaccgugacuguaccaaagaucaggagagaagggcggagggugcaugcuacacagaaaggaaaaguaaccuggaucccuauuuuuuauguguguguuuuuuaaugguguuuucucuuacuuucauguguauuuuaucuguuuuagcuugaguuacuauagacuguaugaugaagaaaauaacaccuauuuuaugaggugguuuuaaggauuaguuuaauagcuuaaaugcucauugaagugcaucaaacaguaccuggcacauaguaggugcucaguaaaugcaacuacuuuucguacugucuuacuguucauacugacgguucgcuaagauggaguuuauaagguaaacccaaauaauuugaaguugauaguuguuucuccuugucauuuaauucacagaacauagggggcagcacugaacuguauuuaggucgaauaugguuugaaaugcuuuguguacaaaaauuuacguugacuugucacagacuuuaauuucucuuacuaagcuaaguuuuugacccuggcaaagggaaagguuagauuugaguguuucgauggcuucucuugguauuugggaguaggcucuguccagauuacucaugcuugagguuuucccagagcguguguaaaaucgggcccugaucagcuuccuuccugcaaguaagcuggauggagaagcugcagguaagcuggauggagugaagucugguuguuacuucuaauauuaacaugcuaaucuuccugaaaacaggaagcaacaaccagacuucacuuguaucuuucauuaggaguguuuaauacaucacaaaaacaaagaugcagaucggaagauuuaugaauuugauuugagaagccaguuuggcaacuuucauggccuuguucagaacaaccacaccacugugccuuaaugaccaccacugccacucaaacccguagaaaguacagguguuuuauccuuaauacaugaguguuauguugcaaguuaguuuguuuaauggcuguaaauaaaguuauuucggcucaguaaacugucagaacaguguuguucuuguacugucagagugugaaacuaaacagcccaugcagcauccuggucuccuucuagcaguuucccagcccguccucagaggcucucugugugcccacuugguaggaaggaaggaagaggcagagcugccuugagcugcuccgcuuguuugaucuguguccugcaguccucccuugagccaguacccguaagcacuccugaaguucugagaaacgcgguguucugacuucuuaacuguuggugcuuccagagagauguucucguaagcaucaaagugcaugcuuuuagugagugacccaguccaugucagauuaccuaggaaggaaaacuuuuccaucucuuaucuuucuaauagaaccuuuucauccccaugcaucuucuccagaagaaucuguugcuguaauuauauguauucaugauuuuaaacagagcuauuguuuuccuccaaaagaaaaaguaguauuuauuuguuaaggaauaaaauagccauaaccuguucuguaggaagaguaaggaaaacaaacugccaugugaaaaccaaagaaaucuugcuugacucauuaaagaaaagaaacagcaaaagcaagauuacuuuuuccuaauaagaaauucugcaccgggcgcgguggcucaugccuguaaucccaggacucuuugaggcagaggcaggcagaucgccugaggucaggaguucgagaccagccuggccaacauggugaaaccucgucucuacuaaaaauagaaaaauuagcuggauaugguggcaggugccuguaaucccagcuacucgggaggcugaggcaggagaauugcuugaaccucguggguggagguugcagugagccaagauugcaccacugcacuccagccugggcgacagagcaagacuccauuucaaaaaacagaaagaaauucuguugucuuucccuauuacuaugcagaaauuuauuuauauuacuaggaauuuauacaaugccucuuuugccaggaauucaugguauuuuacauguuuuuauaaaguggaugauaacuuagaaauccuuguaaguuagauagaucauuuuucagggcccugaaauguugugcugucucacuaaaauaugaugcaaacugcuauucuugcuauauaggcauaguuuucuuuaugaaaaauuaagucauuauugcauuuuuagaaaucugagagcaaggacaauguuuuguacaccuuuuuaccccuuugguguccugcuuguagcagauauuugauuuuaaauagaagagugguauuugacugacuaguagugcuaaagagucuauuagcugaugagucacuaucccauuuuaaaugcucucagaagccugauugcauagagauguaucuacaagaaauuauuuuguaaauggaaggauccuuuuacaauuaaguaauagccccuuaguugaucuauuuguaaagucaaauuuauauauuuauuuauuuaucuuaaaucaagauagacuagugagacuaaccucaugcuuuguuauguaauguggaaguguaauaaaauauuaauccaaguaagaaaucuugcuuuucacuaucccauauggaagugauuuggguauacauuauguuauuauacaauaauagguaacaugaacuaaacuugaacagugguauagguugagcagcaaugagaaaguggcuguaagcucauucaaauuuucuuaaacgucuguucaaaaaaggcagguagaaaaaacaccaacuugccuucauaauuguuaauuauggaaagaaucaugaagcuaaaaguauaaauuacauguuuaauuuugcuugcuauuuuaauauaagaacaaaggauuaaagcuaaauuaaggaguauuugguuuuucuggcaguguuucaucauuacgauuagccuauaaggaucuugaaauucaaaugaagaaagacgaaaagaugaacauuaguggcaaaaaaaauguugacucagacagacucggcaugggauuuggaaauugcagaagguaugugagacugcuuucuuggaguuagaauuuaaaacagugugucaaucaucaguggauuuuucuuggacuguguuaguuucaacuuuagagauuuuuuuuuguuauucauuaacuucucuaauuauuuuugcuuugcucugguauucaguauaacaugaaaaauuucaaauuuggcucuuuaaaagaaggaaaaaggucuggcucuuuacaugaagcaccuaccagagaggaaaccauggacauaaccaauauuugugacugcauuugguguagacacaguccucacaaaauuuuaacauuuuugaaagcuugcaccagaaaaaaaaauuguuuuauugcuuauguuuuuaaccccucgaauacauuugucuuuguucaaaacauaaauuaaagcuuuguuuauuuuggugaaacaaaaguuugugaacuuacugauauauauauuuuucuguuuucucaaguguuauuucacauucagugacuucagauaugcagaccauagagcaggaaucacccauuauggcaaaaccaagaaaaaaguauaaugaugacagugacgauucauauuuuacuuccagcucaagguacuguauuacaaaucaucguugaagugucauuuugaaaagcagugacuaguauggauuuauuaguuuauuugcauuaggagaaauuacaaaucaauuuacuucacuguuuuuaaaagcucuggcuggagccagagcuguucuuuggaguaaaaauuagagaaacguuuguaaaagaacaacguuggcuaauauuaaaauguuuggcaauaaaaucagcaacugugaguuaaaauuagagguaggagagaugugcuuauuuaaauuaugaaauuggagaaaacugcaaaauccugaagguauguguuguuuaguccagcagugggaauauuucacagcucuuucucagggcuucagcagauuucugugcuucagaaugccagcuucagaaaacuccaguugguacaauagugcauuaaauaaacucuauggguguguguauuuauuaaugaggaagaugauuguacuuugaggggaccccagaguaaagccuagguuucucuccuucagcacucacuaucuuauugagacaaaaugcauaacucuagugugaagcugacuguggagagcagugcacggucaaguggccugccagagcaaagagaacaaguuuaaacuugagucaguucacuucguaaggaccugcucggcccagugagaggucugcuaaaaaggcacaaaaugaaccugugauuucacuggagagggcacagcucaggaacagagggguaagaauaugggcccaggggccagauggcauggauuugaauccuggcuuucacuuacuugucaccuaggccaaguuauuuaacuucuuugugcuauagcuuccucaucuguaaauuagggacccuaguaauaccuacccaauaggguugugugaggaucgaaugagauacugcgaaugcuauagcacguuuagaauggugcuuggcucuuacuauguuuagcugcuauaugauaauauagaaacucaguuuaagagaugugauucagucuaaauguuuuuuguuuguuuguuuguuuaugagauagagucucacucugucacccaggcuggaguacaguagcaugaucucggcucacugcaaccuccaccucccagguucaagcaauucuuaugccucagccuccugaguagcugggacuacaggcgugugccaccauacccggcuaauuuuuuguauuuuuaauagagauggaguuucgccauguuggccaggcuggucucaaaccccugacuucaagugaucugcuggccucagccucccaaagugcugagauuacaggcaugagccuccacgcccagccuaaauguuugauuacuauuguuagguaguuaaacuaaccacauugaggaccaccuuuggguuagcaguucaugaaaacugaagguguuccugucggaaaugggcggugcuuacuggaaggcuccaucacuuaugucucugagggcauuagaguugucuggcaauuuauagguuugaagcguuuucauauguauaaaagauauauauguguguguguauauauacacacccacacacaugcacuucauauauagaacagauauaaauauauuaccuaggaucuaauugugaaauuguauauuuuccuaucaauguuuauagacaaggaauuguauaaagaauacuauccuuaaaaaugucucuaaguauagcucuaaauuauuucaaguccagggauuuuaccaaaaaaaaaaaaaaaaguaguaguuuagugguguuccauggugguauuuucagagacuugggugguuuuauauuuuugccuauccuuugcagccuguauaaugcaccaaguuucacuuuacucagaagugauacccaaaucaugccuuuuaaagguauguaaauagauuuuacacagaguaaaauuaaauguguaauuugauuuggaaacuacauacgugucagaucauuucagaugugaauauuaaaugguggacuaagucugggucagaggaaacucuuggcaguacgggucuguauuagccuguguggcuucucacaacaucuuugauuauuucacugcuuauuagcaacuucugcagaugauaguguaggaagguaaagaaaguuuaggcugggcaugguggcucacacuuauaaucccagcacuuugggaagccaaggcaggaggaucacucgagcccaggaauucaggaccagacugggaaauauagugagaccucaucuuuacaaaaaauuucaaaaauauuagccuagcaugguggacaugccuguagucccagcugcuugggaggcugagguggaggaucacuugagccugggaggcagagguuacagugagauuagauugcaccacugcacuccagccugggcaacagagcaagacccucucucaaaaaaaagagaaaguuucaguuaaaucaguacuguugcuugguagccggguugguaagaaagcucuaagugagguugccuaaugggaacuucagagacccucacuggcuccaggucacugacaggccccuguggggccuuucugccuuguaaaggcuucagggaucuuucagacuuccccuucuucaaaggcuuaaucaaaagaguuagacccagaagccacuguugcuaugaaacuguuacuuaugguuugaaaccugggagcagauggcauauuuauauagaccacaccuccuggacucuuuccagagagaccuugguguauuguuuaucacgaccugcagauugucuaauaggaacauaaaugccuucucuaguccuccuuggcauggugaccaccacuaguagaaugaggauacuauuagguacuuuggcaacugagguaaaauaaacauggacucugaaagcaaauauauuaguucgaugaagagcucuuauugcuuucaaauuauucauuagcccauuagaacuugaacauuaugaauuaugaaagaguucuguuucuguuaaaaauaagauaaaaccuguccuuguuuuuuuuuauuauugaguuccauuauuucuaggauauaaacaguauaauuauauauugaguacaagauaaugaaacuagaacaauuugcucagccuuauaaagccagcauggccuuaauuagaauagacaacugucuauagcucuaaaucagagcaaaugugauauuagggugcucuuaucaagggauuuuaaggaauguuuucaagauuggguaaagacagagugggaggggaaaaauaaaaguaaaaaagcauugagagcuauacaaucaaaacauuagaaagccaauaaagguuuggagaugaggaaggaaagucuguguguuucugagcagggacuaguggccguuagucgucccacucaccccauccuuccaaaggucagcuggaguccuggcugguggucugucgguccucuuagugaguugccaguccuccuacugaguugcuccugcuuagcaugagcacagagagccucucguggaugacuggaagacagagaagccgccagccagcccacgcauggacugcugccucacaggcucaugcuggucagggggacccaagccgauggcugucucucuucuuugacuucugaauaguucagucacuuaaaaguaaucugauuccucuacauuucaggauaaguacauuggcuuauaagaaugaagaauguuauuuccuuagaguguugcuaaaucuacaaaauuuaguaucacagagucaugaagaaccuggaaguuccaccccacccucacccugcaccaguccagugcugaccccccucuucccacuccagggcaguccagccucuacuacacccuuccuucuccucaaggcagccauuuggucccaggucagcuccgugagaaacucugccuuucauuaaugcagcuucugaggcuucugcauucaagucagccucccuuccauaagucaguucccaagccucaugagggcaggagcugaaugugucuucuugcccuuugucuuccccuagcagagugccugacuccucguaggugcuuauuaaguaguuuuaaaauuccucacugaauugaucuuaguucuuucauggugccuuaaaauaagucccucaaacaugugaauaucaccuugcaggccagcacacaucccacaucuuuugaaccuuccuccgauguaacuuccgguuccuucaguguccugaucucucuucucugaaaggggaucggucaucucucuuccuccaggcagagccugggugcaguacagauccacucauccgccauagggagagccuggucgguuucuagcugaaauccagauacacuuugaacaccacguuuuccuuccuaaggaguagaugcuagugucaugagauuuguucuuaaugaccuucuugccagagaaggcagaagccacauuuagaaauucuacuuucugucuauuaaggauguaauaucauaccaucugcuccaacagcaguuuauccucugucccuuuuuuguuucguuuuguuuucugccaagaaagaguaaauguguucuuagcauuucccccacccagaucuuagcucaccgaggucccuggccucuuugcucuuauggguucuugcuucccucuuauauuggccuuugguuacuggccccucugaccuccuaugaucugcaucuucugugcaacuccuuauagcacggagcuuggugcucaucuuauuuccagugugcuuccuguccuuacucucuggagaaaaccuggaugaugucuguuaaggccucugcauucucuucugucacccuuccuuuccuaagaccucccugggaucugccucucuccucugaacuucuuggacugccuuaaugagguguguauaucuggccagacugcuuuuccauccuaagcuaucgugaauucuggcauggcacagucccuuuuuuuuuuuuuuuuuuuuuuugagacaguaucccacucugucacccaggcuggaguguaguggcaugaucauggcucacugcagucucggccucccaggcuuaggugagccucccaaguagcugggacuauaggcgugccaccaugccccauuaauuuuuucuuuuaauccccggagauggucaggaaacgguuauuuuauuuguuuauuuauuuuuuauuuugcauuuuuuguagagauggggcuuugccauguugcccaggcuggucuggaacucccaggcucaagcaauccaccugccuuggccucccaaagugcugggauuacaggugugagccaccgugccuggcugguugauggucacuuuuucucaagguuuuggcacauccaccucgccugucagucucuccuguuccaggcagaccuugcugcucuuggucaaagauuuuucucuaaucacacaggaccaaaagccaacacugagugcugcucucugagcaaugcccugcucagugacaauuggcuaauuaaaguguaaacugaucugaaggccaggcucuccugggaugcuugcaaaucagaucaaguuuacugcaggcuccaggcugaaagacuauccccagaaugguccagugaucaugauccauagcuuuguauccaacuccaggaggagguuaaugagcaucauuuacaucauuuucauugaaugugcuuaacacggaagggauugccaacaagaagcuccuuguauggagucaguucucuaggcccagcaguguuauuugugauugccuaaccaggcggaaugagaccuaaagacagugaaauguguaaccugugguagauaacauuuaaagaugcccuguguugucuggauaggccaaguuauacuaagguuauaaacaucccccagaucucaagggcugaacacaaugacaauugauuucuuuuucacauaaagucagcuaaggguucaggugguucucuagaguaccuguccuccaugugucaucuugauuguccagacugauggagguuucaccuaccugagacuguagcaccuggaacacaaucucuuccauguagcuugggaagagaggacugggcaagguugaacacagguacuugaaaggccuuggaaaugacacaccucgugucugcuccugucucauuggcuagaccuaguuaugugacugccauuaacuucaaggaggcaucccccacaucuguggaagugagagagcccaggacgagugucaacaaggaccuccaaagucacuguuguacucuugcuccuacaguuacuuugacgagccaguggaguuaaggagcaguucuuucucuagcugggaugacaguucagauuccuauuggaaaaaagagaccagcaaagauacugaaacaguucugaaaaccacaggcuauucagacagguaugaaugcaaaacugugggguuguaguagugaauccaugcauuucugggaaaaaauugcugauaacaugaugacaugaaaacccuuguaaggggcugggcacggcggcucauucccauaaucccagcacuuuaagaggccgaggucaaaggaucacuugagcccaggaguacaaggcugcagugagcuaugaucacgccaguguacucuagccuggucaacagaguaagucccccucaaaaaggaaaaccuuuugaaaccuuuuguaagacuaguaaaugauuuuguucuacuauuucaggaauauuguuuugauuuuguuuuuuuguuuuguuuuguuuuauuuuugagacagagucucacucuguugcccaggcuggagugcaguggugcaaucucagcuuacugcagccuccgucucccagguucaagcgauucuccugccucagccucccgaguagcugagacuaccggugcacaccaucaugccaggcuaauuuuuguacuuuuaguagagacgguugccucaccagccaggcuggucucaaacuccugaccucaaaugauccgccugccucggccucccaaacugcugggauuacaggugugagccaccgugcccagccuguuuugauuuuaaauuacugauucuaaauaggaagugcacaucagaauccucuguggaccuugaaagaaauguguguguggaguccucuucccugaagauucugauccaugggucagggguggccuaggucaggaagguuucaccuuuuuccccaauuuuuuuuuuuuuuuuuuuuuuuuuaagauggagucuugcucugucacccaggcuggagugcaguggugcaaucucagcucacugcaagcuccgccuccuggguucacaccauucuccugccucagccucccgaguagcugggacuacaggcgcccgccaccacgccuggcuaauucuuuuguauuuuuaauagagacgggguuucaccauguuagcaaggauggucucgaucuccugaccucaugauccacccgucuuggccucccacagugcugggauuacaggcgugagccaccgcacccggccuuuuuucccccaauuuuaagguauuauuuacauauaguaaaauucaucuuuuuaaacuuacaguucugacaagcacauacauucauguaauuaccaccaaaaccaagaaacagaacaguucccaucacccccaaauuuuccccaugcccuuuguaguccccccuccccugccccuggccccuggucaccccaggucuguuuucuggccuuacaauuuugccuuucccagauaucauauaaauggagucauguagcaauuggccuuccuacucugguuuaacuugucuuaguacacuuggggaagacucauucauucuuguauucauuccucuuacuugccaaguuuauccauucaccugcugaagggcugucuccaguuuuuggugauuaugaaugaauuuauuuuccaaccagaggacuucugagagugcaaggggguacuacuaauauguugggacaacaggugugacuugaaauugucccagguaacugggacauuuuauaaccuauacaauguagagagagcaguguccuauggacauuccaaacaauguauucaguguuuacccaguugaucugaaaugugauauaacauauuugaacugaaaugugaaauaacagaccccguuuuaaacagaaauuccuucaaauuuuguaucguuuggguauuuauucuuuuuuuuuuaauuagaauuuucaggcuuuuaaaaacagccuaaaauccuuuuacaaaauuuacugcuguuggcauuuuaaaaaauaaaaugaguaugaaacacauuugcuucaccucaaauuaguuuaaccuaauuuggcuguuuuuaauugcagaccuacugcucgccgcaagccagauuaugagccaguugaaaauacagaugaggcccagaagaaguuuggcaaugucaaggccauuucaucagauauguauuuuggaagacaaucccaggcugauguaaggguccagagaguuucuuugggugccccauaaugcaggaaggaagugugggugugggcauugucggggaggagauccugagugagcugggcucaggcugccagaugcccucuggccugaaagugcuggagucaggacuugaacccaggucuguauaacugaucaugugcuugcuaccucagcaagaggaauguuuacaagacaaggacuuaucucacaguugucuuauuccucucuugguguuuugaauagccauuauccaguaucuuuugaauauauuucaauuguuggugcagcuguaauuuacuuaauaacuuuuaaacauagugaaaugaagcacauagauauguuucuuuuuuuuuuuuugagacggagccuccuucugucacccaggcuggagugcaguggcaugauuucagcuuacugcaaccuccgccucccaaguuuaagcgauuuuccugccucagccucccaaguagcugggaauacggccgugcaccacuacaccuggcuaauuuuuguauuuuuaguagagaugagguuucaccauauuggcuaggcuggucuugaacuccugaccucaggugaucuggcugccucggccucccaaagugcugguauuacaggcgugagccaccacgcccagccagauauguuucugaggagugcauauauuuauuuucagguuguuggcuuuucucagaaauguuaaugaacuuggccaggcacuguggcucacaccuauaauccuagcacuuugggaggcugaggcagguggaucacuugaggccaggaguucgagaccagccuggccaacaugaugaaacuccgucucuacaaaaaauacaaaaauuagcucgguauggugguacgcgcuucuaguccagcuacuugggaggcugaggcagagaaucgcucgaacccagaagcagagugagacucugucucaaaaaaaaaaaaaagaaagaaauguuaaugaacucaucauagugaagucuugcuaagcuguaagacucaaguggaaguggggagguuuacgucuuuccucucauccugaauugcuagugugccucugacuauuuggaugaugguuuccuaaaaugugcugaauguauuuugcagaaauuuaaacuucugcaaguguaacauuucgccaucauuucgaaaguagaauugccccuugcuguucccacaguccauaaaaucugccuugcuucaaaguugacauucaaguucaguuuuaaaauagugucauggggcuuggaaaagagacucuuagaguggccuuugcugacagcuggcuagaagcagcaccaggagagagaugccgcucucccucccucacuccgacggccuccgcacuggccaucguggcugagguguuguauguugaucagucugccugugaccugccucccaugcagaacaugagcuuugugcugucccgcaggaccuggccuuggcaguggcauucaguaacuguuggaaagaaagagccugggggucaaacacuuucaaaugacagcucuucagugauucuuuuugcaaaacugcccacaaucuuuggagccuaacauuuccuuuuccuugucuucucuaguaugagaccagggcccgccuagagaggcugucggcaaguuccuccauaagcucggcugaucuguucgaggagccgaggaagcagccagcagguagggggcacugaacaagagcuggucucugucaugucuacgguaugaacacauuucaucuggauaggacuguuuccuuuuccaagauauuuuagcaaccauuauucgaugcucugaucucugcuauaagucagguagagcagaaguuacuauuccaggcuucacacguaaggagaccaagucaugaaauuaaagcaacaucccaucauugccuggcaagucauccuucugaacacugucauagaggaguguuuucuagcugagugcggcugugcuaugaaauaccaugugcuaucuuagccuuagagguggacagcgccgggcucccgugugauccucaccacccucuagcugugagcccuugaggaugucauggugucuuuagccucagucuccuccucuguaacggggguggauaaaaccaccucacaagguugucaugcggcuuaaaugagcaaugugaagugccaccaagugucuggcacacagcaggccccaggggugggcagaggcagauagaaacauguggcucuaacagcaucugucuucuggggaagacagaacacagcuuugggagugagcagguggagaggaauugccugucucccauaucccucuucaggguucagaccccagcgaggaggugucugguccucccagggcugggauggccuaggauggggcggccugugagcccaguggugggccucagagcgccggccccucugcuucgacuuccccucccccugacugagggaugccuugugagaguacccuacaaaggccucugccaggccacaguggggaggaggggcccugugguuaacgugaaaggggcagcguccucugaggucauuucaggaagccauuuaucagcaggagagccaaggggagggaugacucucaggagccaggcauuccaagccuggcacccucagcaucccuaggccuagaggagcuggcuguggcucuaagugaccaaccuaggcuaucacuuggccuuacagccacagagaacagcuguuuucagaguccaaagagaaacagcucgagagaggucugagugucggacauucuggguugugguuuggggauguuauagagacacacuguggcccucggggugcagugggcacugccaaguugcugugcugcaguggagggagaguccuagccagguggcagcaagugagacaaggguuguguuggcagagcagcuggcagagagccaggcagcccaaggagccagaggccagggccagaguggacaagccccggcacauccgcugccagugagagugugagggugccugggggugcgcagccagggccacggcuccccugagccacucuuuggucaggagcacacccugugccucaccccagacuugagcagaggggccucguuucccuugggcagucaguuacuugcugacugggcauuuccuggcagugagucuuggugggggcaggugaggcucauuggcuuguuccaucuccaaacuuucaguguccuggccuguugucagggcaacuuccuuuugugaccaccccuggcagagaggcacuccggccaccuuuggagaccuccagcagccccacaggucagugcugggucgccuuguaggggcccuggcacagccagcagccgguccagagaccugcauuguucaguccccugacucccugcaauggaugccuuuguaauuuaaaucaauagaaguuuuacucugaagcacuguuuguuuuuuuaaaaaaauauuuggagaucaaaugagagcagccuuuccaguuacugaacaaaaauaguggcagccuguguuuaccuuccuguucccuuucagagaacaaagauccauuaaauuuuuuugacccuguguggaugccaaaccaacccugguuccuggcaccucguggucauuguaaggugcacccuggggugagaggccacccagaaacucacuccccugcccccgccggggucuaacuguguugcccaggcuggucucaaacuccgggccuugagcaaaccucccuccucagccucccaagaagcuggaauuacaggcaccagcaacuuuuauuaaauauuuacuuuuuauuauucagagcauauuucaacaaagagcuuuguguguucugccuccauaaagcuuguuuuauuuuauaaauuuuuuuuucuuuuauuuugucuuuaauacuuuccuauugaaguaaaagcuuguuuuaagaaaacaaguucuuaaaacuuguucugggcaaggcacggugacucacaccuguaaucccaacacuuugggaggccgagguaggcggaucaccugaggucgagaguucaagagcagccuggcuaacauggugaaaccccaucccuucuaaaaauacaaaaauuaggccagucacaguggcucacgccuguaaucccaguacuuugggaggccgaggcggguggaucacgaggucaagagaucgagaccagccuggccaacauggugaagccccaucucuacuaaaaauacaaaaacuagcuuggcgugguggcaugugccuguagucccagcuacuccggaggcugaggcaggaguaucgcuugaaccugggaggugggaguugcagugugccgagaucacaccgcugcacuccagccuggagacagagcgagacuccaucucaaaaaaaaaaaaaaaaaaaaaaaauuagcugggugugguggugggcgccuguaaucccaaccacucaggcggcugaggcacaagaauugcuugaaccugggacggggauguugcaguggccgagaucgcaccauuacacuccagccugggcaauagaaugagauucuguuucaaaaaaaagaaaaggaaaaaagaaacuauucugcuugguggcucaccccuauaauccagcacuuugggaggcugaggaagacguaucgcuugagcucaggaguuccagaccagccugggcaacauggcaaaaccgugucucuacaaaaaauacaaaaauuagccaggcaugguggugcacaccuguagucccagcuacucuggaggcuaaggugggaggaugaccugagcccaggaggcagagguuacagugaucugagaucgugccacugcacuccagccugggugauagagccaggccuuguaucaaaaaaaaaaaaaaaaaaaaagaggaaggagggagggaaggaaggaaggaaggaaacaaucaguucuguguuccuuaucuuaauuuccaaaugugaaacgcuucuggugagguaagcugcuuucuggggguguuucuagcccaggagaccugcggccguucuuacgggcacucucuuucacuguagcugaaggauugagugggaagcgcauguaagugccugcagccaaccugaccuggcacagcaacagucccuguggucacacccaugggacagggucauuagagcugggggacugccaucagcugggcacugccucaggcaggcgugaggcacucagacaccagaugacagaguggaggcagcugugugagagccaggauacaacaaaaagcuuaaaacccagcugcccccucagcauguuuccucccagaaagccaauucugauuguuugaaugagagcacgucugcaugggagugcagacaccugcaccccuuccuugugugcaucguggggucaagugguagguuguuugugaggucccuuaaccacugucuccuuuucucuuugcuccagcccagggucuaggagugugaccucgaaagcacugcccucagucugcaucaggcagucugguuugguuauugccaugugugcuugucagacaguauagcugugcaguggccccaggaguuccagaccagccuggacaacauagugggacccccaucucuacaaaaaauuuaaaaaauaaaaaaauuagcuaggugcgauggcuaaugccuauaguuccaauuacucggaggcuaaggcaggaggaucacuugaacccaaaagauugaggcugcagucagcugugaucacaccacuguacuccagcccgggcaacagagggagucccugucucaaacaaacaaugcccaaacuuguucuuauaaucuuggaaauacuuuuucucuucauuugucugcaugaagcagagaaauuaauacgugguauucuauuaaaaauucuuauuuugggccaggugugguggcucacgccuguaaucccagcacuuugggaggccgaggcgggcagaucacgggucaggagaucgagaccauccuggcuaacauggugaaaccacaucucuacuaaaaauacaaaaaauuagccaggcaugguggugggcgccuguagucccagcaacucgggaggcugaggcaggagaauggcgugaaccugggagguggagcuugcagugagccgagaucgcaccacugcacuccagccugggcaacagagcaagacuccaucucaaaaaaaaaaaaaaaauucuuauuuugggccaggcgcgguggcucucgccuguaaucccagcacuuugggaggcugaggcggguggaucacaaggucaggagauugagaccauccuggcuaacacggugaaaccccaucucuacuaaaaaauacaaaaaaaaaaaaauuaucugggcgugguggcgggcaccuguagucccagcuacuccagaggcugaggcaggagaauggcgugaaccugggaggcggagcuugcagugagcuaagaucgcgccacuacacuccagucugggugacacagcgagacucugucucaaaaaaaaaaaaaaauuguuauuuugaggagccugggaguuguccuggaaacuuccaccucccacgucacaccauagacccauaugaucagaaucucuccugggugacuccagaccugaaacguggccacaacccgcugcuugguccuccugccuccagucuuggcugcugcucaccccucuccucacucuucccacagggaucuuucagaacacagucaucugugcugaaaauccugcccucagcuugaagcacagcuccccacccaaugcccaccuccaggaccaugguucccacuggccuuuccagccucauuucucgugauucacuguuguggcucacuccagcuguguugagccuguggagcccccagcccagaaugcucuucuuccccauucccccagacagccccgcaacccguauuuacccugggggccugguuaggcccccuugcaccacucuugugccuuacacugagggcaagaccaugcgaagaccgucucccccaguggacugucaguucucauuucugugcccuuggcgccugacagccuggcagaggaagcccucugcagguguuugaggaugaauggguggaggggugaugaaugaccccaaggagcuugcugagucugagcaccugcccaccggccaacauaggcuggaacacgccucccccuaccucccaugucccauggccagugccaggcugcaggggcgauguguuccgccuccagcacaagccuuaagagcugugcgcauguugccauguuucuuucccugucauaguaggcaaggaagcuggaauuaagagguggccccaugggcuuggaccgcaagugacugugaugcacagaacccccugcccaccugcacugggcacagcaaacaucaguugugggugguuguuagcucagagucaccuggccuguccugacccauccagggcauuugccccaaccacagaccacuguguagcucaguguccccucugucucagagaggggagcagcugucuucuuccuggcugcccaagcagaaaccugggaaacauccuuaauccgccugccucucagccugccuaggccagucagucagugugccucuugacaccugccuccugaggacgcucagcccguucccuccugauccccacugccgccuccucaugcucaggcaccgccccaugcaccuggaccccugcagccaccucccagcugucuaccugaguuugcucuguguccccuccagaugacacaggucacacuuuagugauguuaucaguuaauugucugcuuuccccaguagguggugagcuguggaaaagcaggucuguagcuguguccucaguacacacuguggguguucugggaaaagauagggaggagagauucccugggucaaggacgcucuuccugagcagguggcuggaacugucauuuccuggagcucauuguguaaccugagcacacuagggcugucuuugaccauggccacccggccccuccagccugcccaggcagcccucagaggagacacagcaccccagucccaucacuguguuggaauuacacucugucauuggugaaggccuacaagauuuuagacagucagcuggagguggagaugggaggaccugcaucuguggugggcaugggaacagugcugggggcaaaugcagugucucuuccaagggacacguugcaggguaacuugucaguucuguuuuauucucagagagggacuugaccaaggcuuucuguuuuuguuuuugagauggggucucgcucugucacccaggcuggagugggguggcacagucuuggcucacugcaaccuccaccucccagguucaagugauucuccugccucagccucccaaguagcuaggguuacaggugugugccaccaugcccagcuaauuuuuuguauuuuuaguagagaugggguuucaccauguuggccaggcuggucuugaacuccugaccucaagugauccucccaccucagccucccagagugcugggauuacaggcgugagccacugcgucugguggguuucuguuuuguaaggagcagguggugucauguggggcuuagggaguagcugggcguggcuacuccugaggaccugcaggguuuguguugagcucacugagccccuccagcgucuuauuacaauugugacacagaaguuuaugaaccccugauugucagcucuaggaguguggucagaccuccuugaugugugauaacccugaugaacuucacccagauugguagcaauuauggugauguuuacaucagggcaaccaaaacuuaagcaacuaacacuuaacaaaacuaacaacuaacaaaacuuagggccacuaacaccggcccuagcaaagaggguggaagugugaacuucuguaccugggaagacuggcaguggagcuuggcuucuaagucacagucagacagcaucagugaugcaucuauuuggcucaccuccuugggggagguaacaagcuuccuccauaccccaagcgagugggaggggcagucguagucacagauggcugcugcuuugcuuugucccugccaauaaccccagagcaagcaaauggcucuucucauuugaggauacaugaaucccugggaaggcucugauuggucaggccugggucaugugcccaugccuguggacaggguagaagggagaggugguuccuggaggaagggaggaguacuguuaccaaaagagggaggaggugaugagaaacaggccauccguguuggcccaucugccuuuugcuggguacuuaccugccagggcuauguuaagcaccuugaggaaaugggcccagagagagcaaggaacuucucuagaggcacacagccuagaagugacagugccaggauuugaacucauagugguguuaagucccccauacuacauuuucugucguguggauucucucauguggaucauggcagggcugccacuucagcccgagucuccaucccacuguugggccccuugugaggcagcaggaggggagagauccggguucucuggagccguugagcacucuggguacuggguuugccgcagcuguggccagggcagugaugagacagugucugcugugugugugcagggaacuacagccuguccagugugcugcccaacgcccccgacauggcgcaguucaagcagggagugagaucgguugcuggaaaacucuccgucuuugcuaauggagucgugacuucaauucaggucaguggaauggggcagugcucacuggcuaugacgguagguucagcaguuugaaaaugagaccugcuucaaucuucaacugcuggaaaauucaauuauauauuauuggaucgauauguuugcuacacuauaacccagaacauuaugaaaaccagaaauuauaauuuuauauuuaauauuuucuaacggaugacucuaggggaauuguuagaggaauugucaugaccauuguccaguuuuuuuccuagauuggaacagagaaguauuaagaagaaaacugaaauuaucuguaaugccacaucacagggauaaccucuguuaauauuuugguauauuuuuagcucuagauuucuaaggauauuuuucuauacguagauuaaaaagauauacauaucuaucuuuuuaaaguuaaaaagggauuauauuguauagaggguuuuauaucuugcuuuuucucugugaugcugggagcauuuccuuguaaugaaaaguuuuccuaaaaccacauucuauugagugaaaacauaagccaaggauggcgcauacuugcgcaugagagucgaggccaucugugacgauaugaguggcucguuucuuugcaccuucuuguuuacgucaggcuauugaagaaggauuguauuaauguaaaacgcugcuaaaggaaguaggacugaaaccguguggacucuggugccuccaaaggagauuccugguccccaggcagaugcugcucuagcugcaguucaaggagggcguggaggugcacccauuccggagaguucccucagccccaggacucuggauguagccguuuucaugcugugaauagcacagucuucccuuucauguggcacugaaguuaaaaugcauagagcucuuucaugucccuuaggucagcuaagcccacaucaguguccaaauagguaacaucccuauuuuauagauggucauccccauuuuagagauggcucccuuuuauauccccauuuuacaggugaaggaauugaggcacagaagguuaggucacuucugcaagaugaccagcugaaccaaaauuucagggcuucaaacaccaaauguguuccuuugucuuccguuucccacuugcuucccagagggcucagcaaguugccucuggcccacugagcauccucccgcccacuuugcucccugccuccugaucccaggacuguggccguggaugccagaggcaggaugugaauccuguuggguucugaagcccacaccuacccucagccuugaagcugcagcaauggcugcuuccagaugagcacacccucggggugcagcguccaugucacaugccugacaugggcugcagugucaauuugggugaugcugaauauucagggcgugggagucagggaucgcugcugaauggucgugaacuuccauuuugguucucucuucaggaucgcuacgguucuuaauacugaagucaugauguguauuuccuggagaaauuccucuuuaaaugaacaaguaaccacaucucaggcggcagugaaguccagauaguuuugcagauuguuuugcuacuuuuucauaugguauauguuucugauuuuuaauauuucuuuugagaaauucugaguucugauguaggagcuuuccugugauuucuguuucacguuccuuccugucacacccuccuuuggcgucucuguguauauccuugcuuuauuuucuuggaaccuuugauuucaacacugagggccuggagaccucggcuccuccugcuccugaaccaggaggcuucaugugggggaggaggagaggucuccaugugacacaugggcucagggcugccagaaucagcggaugcuggaugggccugcagaaacaacacucaccacacacacuuccuucaaaagaccaaaagugacuggugucucgugugacagauugcuucauuuauguuucuacauaguaaggugacugccaaauaauauuugaagucaucugucucuuuguaaauuauuuuauaugaccuauaaauuuaaaaauguuuuucagugagugcuuuuaacaaacuuaagcuucugcccugccaagggaauuaauguuaucuugugaaagguguugcuguuugaauugaugagaaauggaagaugagaacucccuaagaguucucauaauaaaucaucucaucacaaaucaauacgguauacagaguuaaaguggaaugagguaagaagauacagcuacagaaaauaguugcguguaugggagaacagucauuguaauuggguaguuuuguuaauaaauauuuuuaaaucuugcuuuucagaaauuaccgaauguguauaaacaaauaaagaaaaauaauuuagcuguguuuuagacagcauuagaauauauuguucagcacaguaaaauauauuugaaauuugauaagccaaaaaugugguuuugaaugaauauuuugugaaucuuucuuaaaagcucaaauuuguagacuucuaaauagaauaaacacuugcagcagaugg

SEQ ID NO: 192568 - RNA, 23830 nt, Homo sapiens
augguccgaggggggcggggcugacgucgcgcugggaaugcccuggccgagacacugaggcaggguagagagcgcuugcgggcgccgggcggagcugcugcggaucaggacccgagccgauucccgaucccgacccagauccuaacccgcgcccccgccccgccgccgccgccauguacgacgcagagcgcggcuggagcuuguccuucgcgggcugcggcuuccugggcuucuaccacgucggggcgacccgcugccugagcgagcacgccccgcaccuccuccgcgacgcgcgcauguuguucggcgcuucggccggggcguugcacugcgucggcguccucuccgguaucccgcugggugcgucuggggacgcugcccgggcuccacgugcggagugggugcccccuaggccggggagcgggggauccccaggggucgcggggcccuggaggagcgggcaucggacgcggacacggcggggugcaucccgagggcccccuccgaggcagaugcuuccugcgggggcgcuguuccugggcccgggaagggggcguuggaaccccgagcgguccgggccgaagccugggacucucgugcguccccaccccuacccccaucaggcgcccgugcaugaagggagacccucaccuccggacugagagucggagcgucucggagcgacggggaguagggagcgggacccggggcggaggguagugcuggccccugcggacuccggguccccuguguccucucgggaggggcuggacgggcugagcugccgaggggccgauuugcccugggccggacaaagaguggggcuuuggccggucccccacggugggcuccuucccucuggggauugagggacucaagacaccccgcgccugcgcuuuucuuuucuuuuuuucuuuuuuuuuuuuugagacggaguuucgcucagucgcccaggcuggagugcaguggcgugaucucaacucacugcaagcuccaccucccagguucacgccauucuccugccucagccucccgaguagcugggacuacaggcgccagccaccaagcccggcuaauuuuuuguauuuuuuaguagagacgggguuucaccguguuagccaggauggucucgaucuccugaccucgugaucugcccaccucggccucccagaaugcugggguuacaggcgugagccacugcucccugcugccuacgcucucugggucgcagcccagccuucugggggcuggguagccucccagaagggcaacccugggcauccuccagggcaggcuaacuggagucuaguggggagggguaccuugaaagaggaaaguuguuuccuccuccuccuccuccuccaguguuugggacccuuccugggggcuggagugcaucccuggacaccccccaaucccauccucuucucuaguuuccacugaccuaggcccacccuccccucuccggcucaguacuccuggaaaugagauuccguacauuugaaucuuguccuaaugaaauauuuguccauguggguaccuguguguguguggugggggugcagacggaggguuuguuucucacuagcuggaacuacuggggugugguaugcuuccugggaauuugugugccacaguccuggaggcgaggaggggguugugagccaguaggcaggggcuggggcaaguagcauugugaagcuauugacacccagacguccccaggcaggagauuaugcccccauuagcccccuuuuaucugggcuuccuuaacaauggacucuuugcccugccugccagagccagcagggagugacuguucaguggugaggaagcgggcagaggaagcccugccauuggguaggagcagugggcagccccugggcugacugggagguggggauuagggauuagacaguccuggcugucugccuuccccuaagccagggggagaggagcaaagggcacgaaauguggccuccaggaggauuagaccgccacaugaucauuugcacacccugggguuuagcaacaauaaaagucagcuuuuuuguaucccaagguggccuguggacacccacauggacaaauguuuacacugggacagaauucaaaugcagaggucccaggagccuaaaguacacucacucugguauagaaaggauuccuuacugggcagaggacaggugcagccuggggcuuucccaggcaggacacagggaggcucaggaaccaccaagucccuggaagguggaucuggaggcguuggcaggagccacucccuggguuccagggcuccagguuccugcuuuaacccccugucucacagagggcugugcacuugggggcugcugagcaugucccagaggcugcauccuggacacagcaccucagugcaucugagcugaggcuaacuuggcaggagggacaggcagaaccugccagccacgugcaauuccaccccucuggccacucagggaaggagagcugugagucaagaucagauuugggucaggacaggcuggggccugccugucccugugcaucccaagauuuauggcuggccagggguugggcugggagggguggucuugcaugccaggagagugcagaucagccugagaggccaggccaguaagugaggucagaucuccugcaccugauagcauuaaggccaucuacaccaaagcucuaaugcugauauguuccuggccucuauguggggcauggagguggggcauggaggugaggccugcucgccugggcuucuggaagugggagacucauuccuguggcugaggccuacagcagugcugugugguaggaauacacuggaagccaugaugucauugugcauuuucuagaagccacauugaauaaaguaaaagacacagguagaauuaauuucauugagcccaauauauccaaaauaauaucauuuucacaucuauucaauauaaaaauuuacuaaugagauauuucauacuaagccacugaaauccaguuuguaucuuacacaucucaguuuugacgagccacauuucaagggcgugauagccacauguggcucccauaguagacaguacuggucuagagaaauguugguggcauccuugcugucugguuucuggccuugccaaaaguauuaccaucccagugugguacauucuuucauguauuugucuccuguccccagagcagacucugcagguccucucagaucuugugcggaaggccaggagucggaacauuggcaucuuccauccauccuucaacuuaagcaaguuccuccgacagggucucugcaaaugccucccggccaauguccaccagcucaucuccggcaaaauaggcaucucucuuaccagagugucugauggggaaaacguucuggugucugacuuucgguccaaagacgaagucguggauguaagcaguuugcuuaucuggacguugucaaguuagaaaagcuguuuugggaugggugugguggcucaugccugucaucccggcacuuugggaggccgaagcggguggguugcuugagcccaggagcucgagaccaacaugaugaaacccagucucuacaaaaauuacagaaaaauuagcuaggcaugguguugugggcccauagucccagcuacuagggaggcugaggcaggagaauugcuugagccugggagguggagguugcaguaagucaugaucaugccacuguacuccagcccgggugacagugagaugcugucuggaaaaaaaaaaaaaagaaagacuguuuuguuuuggaagcaacacaggcaguuguaggcccccugugccagagugacauaaacucuguacaccuccagugauuugguccauguuuguaaacccugaauguuccagggcaguuucuuuucuucacuuuuuaucucuuuuuuuugggugggggggcgggguacagagucuugcucugucucccaggcuggagugcaguggcgcaaucucaaccucccgaggagcugggacuacaggcacaggccaucacaccuugcuaauguuuguacuuuuuguagagacgggguuuugcccuguugcccaggcuggucccaaacuccugcacccaaguaaucugcccaccucugccuggcaguuacaauuucaaauaauuccucccuuuccuucaacacuuggcucaugaccguccaguccaaggaaccuguccugcaggugugccucucccgagcuuccucuaugcaucuuccauaaugaagaugccuucucacuggaaacccuacaagggugggaacgugccuuauuugccuguauccucagggucuagcagagagaagauaauuuguaauaccaaaacaccauuaaauucagcugaugcuuucauaagcgcuccuuggaggaaggacuccauuuacuugacagaucugugcaagacagcagccuggcgcgucuaaccugcagccaguugcauccucuguuuaaccuuguuugcggaagcuuucucuaaacagccagcacuugucuguucccacauggguccguucucccagugaaucaccguggugccugcugacugcucuguagcacagugcuucgcaaagugugauccugggaccagcagagcagcagcuccuuugagcuuauuggaauggcagacccucaggucccaccucugaccugcugcaugggaauucuggggagggacgcagaaucucugguuccacaggcucuccggugaugcuaaugaauaccggcauuugaacagcaccgaucuagccccuuucaguccaugagccaacaacccuugguccugucuguggugacccagugugacucucauggggagcaaggagaggaaguugaaguucacugacaggguuguuaaggggauuaugcaauagaugagacccaugggccugaaguccgaggguguauguuaguuccccguucuuuugacccauggauuaaccuacucugugcaaagggcauuuucaaguuuguugcccugcucacuuggagaaagcuuaugaaggaucaggaaaauuaaaagggugcucucgccuauaacuucucucuccuuugcuuucacaggccuugguauguuccugcuucauccccuucuacaguggccuuaucccuccuuccuucagaggcgugguaagucggcuuucucugcuagcgcugaguccugggggccucugaagugugcucacacaucuccugccugcagggcacuggugucgggcaccucagggucugucccaugguggagccccaugccucacugccuuucagacagaguagccacagcuggcccuauuuccaggcuacccgggcagcaaaacuuacugcauguguaauuaauuauuuggcuaucuguaagguaaacuggcugguucacuuaaucugcaccuuaagcaucagauagcuucucagugaucuaguuaaacuauaugauguuggccaggcgcgguggcucaugucuguaaucccagcacuuugggagccugaagcaggcagaucacuugaggucaggaguucgagaccagccuggccaacagugugaaacucugucucuccuaaaaauacaaaaauuagcugggcaugguggugugcaccuguaaucccagcugcucgggaggcugaggcaggagaauugcuugaacuugggaggcggaaguugcagugagccaagaucgcaccacugcacuccauccugggugacagagcgagacucuaucucaaaaagaaaaaaaaaaaaaagguaaauaaaguauaugacacugaagaaucuguuaccccuggaagguggagcuuuacucuuagggggaacuauaacagucauauauauauauuuuuuucuuuucuuuuuuuuuuuuuuugagauggagucuggcucugucgcccaggcuggagugcaguggugcaaucucggcucacugcaaccuccaccucacagguucaggcaauucuccugccucaaccucccgaguagcugggauuacaggugccugccgucacgccaagcuaauuuuuguauuuuuaguagagacaggguuucaucauauuggccaggcuggucuccaacuccugaccucaggugauccgcccgccuuggccucccaaagugcugagauuacaggcgugagccauggugcccggccaacaaucacauguguuguaaacaacaacaaaaaucugucagccuggucuaaccuagauuugugcuuuguuuuguuuugccacuuugugaugcacaggaggaaguuuaggcuguaaaauacuagccuuuuaggguaauuuuugaacucacaagagcagcagcggaaccuuugaugcaauccuguauguagcaccagcagagccacguggcagagggacucgcauuaggagccucccauuacagacuacgugcuccugugcguuaucuuauaggguccccacaaccaaggggagaugugauuauucauccuguguggcuguggggaacuugagagucauacuugcccaaagagcacggccagcgagcuugcacccaggucacucucugcuccucugucagaacagggcaugucuugguucacugcagggcggcucuucucauucucuguaguuugggguccaggauagugguccacggagccacuggagugcccagcuacugagugaccaaagcauauuuuggauuuccgacauugccacagcaugguugggcaucagcaggaccccaaccccuuguuaugcugguggcuuuaugugguuauuugaucuuccccagaacucagcaggagugcacccagcagcaccguagugaugcucucuggcuccccagugcacgguucuggcuuuccuuccuggucgagaguuucaagcccucuggguccuacucuguccuuuucagcccauagcuuuguucaaaagcugcuggcaguguucagauuuggcugaguucagugaauaugugcauuggcugauuucugagccaugccagggggauggagaagccgaagcaggaguguuuguucugcaggcucuggaguaggcauugggucugugccggcucacuugcuagucuugcauccuuccccaacccccucuggggaugucuggccacaucagaagacaguuuggguugucagaacugggggaguaccaggccgagguggguggaucaugaggucaggagaucgagaccauccuggcuaacacagugaaaccucaucucuacuaaacauacgaaaaaaauuagcugggcgugguggcgggcgccuguagucccagcuacucgggaggcugaggcaggagaauggugugaacccggggggcggagcuugcagugagcugagauccugccacugcacuccagccugggcaacaaagcgagacuccgucucacaaacaaaacaaaacaaaacaaaacaaaaucugggggagugccacuggcaucugauguauagaggcccgagaugcugugucaucacccguugagugcgcucauaggcaucuuccugacaauuagaacccauuauucuucaaauucaaugcaagcaaauucaaagcauuacuguguacauaccgcaugcuaaucaauugcaccacuggagcuccuaaauucaaaacauuacuauaaaaaaguucaaaaugcauggaaaaguuguacauggcaggagaauauuugggcuucugacuaccccuugaaugaagaugauccaccagccgccuuccuccuuggucuucacuccagauuccuagcauuucauucugugucucuuuaugcagugagguuuuuguuuguuuuuugagacagagucucacuguaucaccuaggccuggagugcaguggcgcgaucucagcucacugcaacccucggcuccuggguuuaagcgauucuccugccucagccucccgagcagcugagauuacaagcacacauccccaugcccagcuaauuuuuguauuuuuagcagagacaggguuucaccauguugcccaggcuggucucgaacuccuggccucaagugauccaugugccucagccuuccaaagugcugggauuacaggcgugagccaccaugcccagcuccuagugagguuuuugaugccuugcuacaucugcccuagaaauugugugacuacgauuuuggaaauguugcuguguaaacuugugaucauuucuggacuccaggcaagaaucuugauggcuaagguguggcugaacaugucugauucucuccuggaccuguuuuaggccaaacucugcucugaaauuccuccguguggaagggcgggcuggggagagccucccagcuggaaucuuuuggaugccuuucucuguggguaucugauggcuggcucugauggcuggcugugauggcuguggcuggaaaucauuguugacaugaguuucacagaugcaggcucuguccaaauuguagcaaaagcugccugccccagccgagcuaugggcaauaaggugguuuaaggauauagaugaaggaaaacucacccuuagaauaauuuauccaaaaugcugcuguguuguggguuagaggacauuuucugaggucccagguucauuguuucauuuaagucucaaaagucccuccagguguugguucuaauugucaaagcauggggggagaugggcucauggguuaaaggucuuaucccagauuucuguauccuccuugcaagcagcaaaggggucuggauuugaauccaugaccauguuucuccuuuggguuuccaucacacucuguccccgugcacugagcacccuuuaguucauaugacccccuuaggcauguuacaugggcacuccuauaggugcccaucuggcccuaggacuuggccaacacaacauggacuccaguuuccaucugccucuuugccaggcacuuuugugcagugcacacacuguacaacaguagacggcaacccugagagccagaguagagccuguccuagcaccggaaugcucgguaaggauuugucgcaggagugauuccaaagccaauguccucccuccauaucagccuguuuguggcucugagaagcucugcccacaugugaaagcuuguuaagcacuuaagcacuaacccagagcuucagacagugccaguccuuuuuccccuucuuuaaaagcgauauguggauggaggagugagugacaacguacccuucauugaugccaaaacaaccaucaccgugucccccuucuauggggaguacgacaucugcccuaaagucaaguccacgaacuuucuucauguggacaucaccaagcucagucuacgccucugcacagggaaccucuaccuucucucgagagcuuuuguccccccggaucucaaggugaguugguggugagggggcagguguucuggggugcagcucuucuuugccucccugauugccaggagcuaccaguuacugucugcacaaucaaacagaaauagaccuguccuugaugguuaacggaaauaaaaggcgcuugucccagaagcucaggugaggcaccacccugauuaugggaaucaccugggaacauauacccagaccuaaaacucagauccacuucccaggcugugguuauauagucaggggggugcaguauggguauuaggauuuuuuauuuuuuaguuauaaagauuuuuuuuugguuuguuuuugagacagggucuugcucugccgcuuaggcuggagugcaguggugcaaucauagcucacugaagccucagacuccuggguucaagcaguccucccaccucagccuccuaaggagcugggacccacaggcaugcagcaccacaccuggcuaauuuuuaaaaauuuuguggaguguugcccaggcuggucucacacuccuggccucaagcgauccucccaccccagccucccaauguguugggauuacaggcaugagccauuguacccagccacuaagaugauucuuauuuggaaacacggucaagaacaacugcguucgguaguuuaaccuuuuuugauuguggugguuuuaguaugccuuaccacucuaccauaguaagaaauuugcagaccauguacaccaaccuuuggugcuccuggggagaaagaaagaaggcuaugcaaugcaaugcaugcucacaguccaagggagagggaaagcugucuaacaggauugguuuucccgugugcuuuauaagcagaugaguagaggagacagcucuuauuguccuaguggcaauugggauaggcugcaaaguuuguuaggguggaggcuuauuccgggaccaagggagcccaaagaaacaagcuccugccaggcgcgguggcucacgccuguaaucccagcacuuugggaggcugaggcagguggaucaccugaggucaggaguuugagaccagccuggccaacauggugaaaccccgucuccaugaaaaauacaaaaauuacccgggcaugguggcgggcaccuguaaucccagcuacuagggaggcugaggcaggaaaauggcuugaaccucggaaguggagguggccguuagccgagaucacgccacugcacuccagccugggcaacagagcaagacucugccuuaaaaaaaaaaaaaaaaaaaagaaaaguaaaaggaaaaaaaagaggcucuggccugcuggggugccugcaaagucuccguggaagggugacauucaagccgagaccuccagggaacugucuccugggagcacagagcccuuugcucagcccccagguggcucagugcccccagccagcagacucagagcuugcaugauucuuuggugcucucugcggucuuccaaugaugcugaaauaaauggugcuuggugucucccugcuguaguccccuugcuugcuuugcucacaggugcugggagagauaugccuucgaggauauuuggaugcauucagguucuuggaagagaaggguauguaugggcugggaggaucagccaugcccuuuugacaagcauuuacuagcggucuugguaaagacuugagauuugccuuaguucuaacacuuagugcccaacgccuuccuuguguugcucaaccuacucaugagcccaggagauaggaaaucuccgucccauuguacagauggggaaacagaauuuuggaaaggagagccaagcagcacacaccccucccugaggggcagagccgagauuugaacugggaugucaugacuccagggcccucucccuccccaggguccccuuaucugaaggcgguuuuucuuuccagcucgaccucuugugacccuuaguuuaacaagggccgaaguuaaagaguuucugcgccuggaccccaaaugaagcaaucagauuucucaucuccagucagguguggguccaagcccacuagacaaguuugcucuucccagagcacauuucugccuucaagucauccuggcuugucagggcugggggaguucugcuguagaaauauuagaguggaaggaaaaagauguguugggagcuauuuuucuuuaauacuaaaaguugguugaugaauuugucguuggccaagaccaaggagacugcauuuuuaaggacauauguguauuuaucugcucagaaaauguucauugcugugugcuagggauacugcagugaacacagaggugugacccuugccagccuugugagagaagugagcagauaaguaagcagaagggugaugcugugucgaugggaaaguacaggugccaaugagaaggcacaggugucaaggagaagacacaggaugcuggaggcucaugcaggauggaucuccaaggcccaggggaagaagggccucucggaggacgugaauccacauuaagacuuuggggauaaguaggagcgccuuaggcauggggacccauggaugcgaggccuguaggacacagacaggauggcaugaaggccugugcaacuggagggguggggauggggacacuaagagauggcuggaaguguggggguggggacacuaagagaugacuggagaagagggggucaggaguggugaaaaaugggagaggagggcaggcugggccuuuuggauacagggggauugcauccugcagugguagggagccacugagggcugcugcaguaggagugaggggaucagaggagagcuuuggaagcccccuggaugcgggacaggaagcgagauaccagugucuaggaggccagugaggcagccacaggcuccaccaggaucagggcugcgagggucaugaggaggaaaccaauuugaaggaguccaggggaauaggacuuggaaaugaccgaugggacauuugggaagaggaagacagaagagcgcagucccggcuucuggcuuuagcaguugggcaaggggagauggggagaugugcccauggguugaggguugaggacauuaggagggagccgguauggcaggaagagcuggugugccagagaugcuggaagcagcaucugccugagaacagauaccuggcaauauuccuaagggaaagugacaucucggagggugaggagggcaucugauagggccuggaaagagccggggcaagcaugaaugugagguuaucuuggggggcaaggcucaggcguugaggagcagccccuggucucuucagccugaaguuggaagccagaguugggccaggugcagcugugguugucugaagucccccucccccagcccagugugccaaugcuguaagagcaagggccgcucacuggugcugguggcugagucccagcacccaggacagggccuggcacauacuggugcccaauccucccuucugggugcuucuuccaaggccuugugauggaagugaguacccucuucgacaucagacccagcuucaaauccuggcucugcuauguauuggcugcguggcuuuagacaagucuuuuaaccuugcugugcuucugauuucucagcugaaaaauggagaugaugauagugguuucuguaaggccuuauggugaagcaccuagcucagggccuggaaggcagguguaaccagugguucaguuguuauaaaccaacacuaacccucgccuuugcaccucaugaaaccagauauguagauggagcccacaaagcuagcaggagccaagcucacguguguccugcuuuaaagccccauaccccuuucuccgggugacaaacaccugugcucguucucuucccuuccccucuuccccuugcauuuggcuaauaacaggccagcugccugccucccugcaguuugguagauggguggguaacgaccaccacucccacguucgccugaugggcuuguuuuccgugcccuucacaggcaucugcaacaggccccagccaggccugaagucauccucagaagggauggauccugaggucgccaugcccagcugggcaaacaugagucuggauucuuccccggagucggcugccuuggcugugaggcuggagggagaugagcugcuagaccaccugcgucucagcauccugcccugggaugagagcauccuggacacccucucgcccaggcucgcuacagguacccacuccucggggugagcacgggcagcaccuuguuuucuuucuugugcauuauggaggaagaugguacugccacaugggagcgauagggugaggcaaccaugacaggugguugggaacaucuccuuccauguguacagccugggcugcugccaucacucccagcacagcccccaacccccccaauccuggaaccuugccaagucucccuucccauggggucaugaccaggaggaaaacaaacuccagcugagccccuugggguuccccauauaggcuccugccuguggcagcugggcccucuguaccccuuuccaacucugucucccuaacauggcaccugagcuccugccauccuggauuucauggaccccaaggauggggguccugcaucugggacuuggccuauuacucggagcuccuuuucagccgccucccuccaccuguccacccaccucaaggcuccuuucuugagaccucuccuaauuucucccuuccccuaaacccacaauuuugaaccuccaucgaauggugcuguauuuuauaaugucaucaaauaucaaauggagacagugcuaugguccaaaugauuguguaccccccagaauuugucuuuugaaauccuaacccccaacaugauggucuuaggagguggggccuuugggaggagauuaggucaugaggaaagggcugucaugaaugggauuggugcccuuauuaaacagacccaagagaggucccuugucccuucuacugugugaggacucagaagguggugucuaugaagaagcaggcccucaccagacaccaacaugucugcugccccuugaucugggaccuugcagccucuagaacucugaaaaaucgauguuuguuguuuuauaagccacucaguugguggcauuuuguuagaguagccugaacacggacuaagucaaacagaagaacccacaaaccagcuacagaguugggcauuuggagaaauucaaaaaugagucagacauaacuccuuauucuugaggugcccuaagagaugggacacagcagcugcccaggugcauuaguuuguucucacauugcuauaaagaaauaccugagacuggguaacucauaaagaaagagguugaauuggcucacaguugcacaggcuggacaggaagcauggugcuggcaucugcucagcuucuggggaggccucaggaaacuuacaaucauggcagaaggugaacgggaagcaugcacaucccaugacuggagcaggagugagagagagagggaaauagagggaaggugccauacacuuuuaaacaaccagaucucaugagaacacauucacuaucaagagaacagcaccaguggggaaauccgcccccaugauccaaucaccucccaucaggcuccgccuccaacacugggaauuacaauuugacaugagaugugggcagggacacagauccaaaccauaugaccagauuaauacgauuugaggcaucacgaggucauuaaagagagggaauaaaagacuggggcuccaggaagaaggcucuggaauccagcagagggucaaggaccagcuuguaaagcugguggugccugagaaguaccuaggagaacauagaugcugugacguuugauguagcuguuuuuuguuuuguguuuugguuuuugagacagagucucacucuguugcccaggcuggagugugcaguggcgugaucuuggcucacuggagccuccaucucccagguucaaaugauccucaugccucagccuccugaguugcugggauuacaggugcacaccaccacgccuggcuaauuuuuguguuuucaguagagacaggguuucaccauguuggccaggcuggucuugaacuccugaccucaagugauccaacaacuucagccucccaaagugcugggaugacaggcaugagccaccaugcccagccugauguagcuguuucugugcacauuauuugcugugggguauauucagauuucuuaauacaagaugauucuuugccucaugacuuacacaccauuuucuauuuaauuucagcuaugauauuggaaauggacaugucuuuucaaggaaaauaaaagcaggcuuucuggaauggcgacuuccaaacauauuugucaauuuaaaggagcugggaguggggacccuaugcuccguaagcacucucuuagcuguucuuggcugugcuccccgcuucagcuucacacugcccuugcugugaagggagcagccugggccgggcgcgguggcuuacaccuguaauccuagcacuuugggaggccgagguggguggaucaccugaggucaggaguucaagaccagccuggccaacauggugaaacuccaucucuacuaaaaauacaaaaaauuagcugggcaugguggcaggugccuguaaucccagcuacuugggaggcugaggcagaagaaucgcuugaacccaggaggcggagguugcagugagccgagauugcgccauugcacuccagccugggggcaacaagagcaaaacucugucuggaaaaaaaagaaaggagcagcuuggcaaaccccaccuugucgcuuuugugagugccucugacccuuuggcugccaggacgggcguauuuuauggaaaugcuaagcaccaacagaguaaagugguuugguuuuucacaguggugggagauaauagcuccaaauugucuuuuucagcacugagugaagaaaugaaagacaaagguggauacaugagcaagauuugcaacuugcuacccauuaggauaaugucuuauguaaugcugcccuguacccugccuguggaaucugccauugcgauuguccagaggugagcauuuuagguggcuccgugucuuccucacaggguugauaugaggaugaaacaagaugauagaucaugguggcauguagucugggaccuggauugucgugccacagaucacagcucacagucuaugugcaaugccccugaauguugcccaccuguccucaagccacacaugcaccuguaacucagugcaagcccagaaacuccccguggggacuccuagagcugucaguggccucacauagcagcugguccagucucuugugauugcccaaggaaacugaggccuggagagcuuggggucacugcucugaggccauagagaugccuaguagaagggccaggccuagaagcaggauccuugcugccccucugagcuguuuccauuuaaaaucacaugaaggccggcgccguggcucacggcuguaaucccagcauuuugggaggccaagguggguggaucaugugaggucaggaguuugagaccagcuuggccaacauggugaaaugccaucuguacuaaaaauacaaaaauuaguggagcaugguggcacgugccuguacucccagcuacuuggaaggcuggggcagaagaaucgcuugagccugggaggcagagguuguagugagccaagauuguaccacugcacuccagccugggugacaggagagaaacccuaucucaaaauaaaaugaaagguaaugaaaugaauaaaauaauaaaucaagucacggccgggcacgguggcucacaccuguaaucccagcgcuuugggaggccgagguggguggauaaugaggucaggaguucaagaccagccuggccaacauggugaaaccaugucucuacuaaaaauacaaaaauuagcugggcaugguggugcaugccuguaaucccagcuacuccggaggcuaaggcaggagaauugcuugaagcaggaccuaggaggcggagguugguugcagugagccgagaucaugccacugcacucuagccugggcuacagagcgaaacuccgacucaaaaaaaaaaaaaaaaaaaaaucaaaucacaugaaaguagaacauagggaauuccaucuuucguucuaggcauaguuuguuaauaugauucagagccagcaguuaggagaacacagugugacucuccuagaacuucuugauugggcuuccucugauuggguuuccucugauugggcuuccucugaaagugggggggaugggggguggggagcagaauggucagagcuuggcucagcagucagacugcucuucuucaaauccuggcugcauugcuuacuacagcugugugacuccagaugacugaauccaccucucugugcugcagcuucccgucuagagagaucaccuggagcagaggguggucaggagacucaaucugguuacugacucacagugcaggaguacucaucccauaguaagcauccagcuagagauguugauuucuauuuucagguaauaaugaugaucguaaaauuagagacagauaaaagguaugggcauuaggccagggcacugcaauuucuaagcugugugaccucaggcaaguuacucgacuucucugagccucagcgguuucauccgcaauauauggauaggaaaaccgaccucaguggguugucugacaguggagggcacuugauuaaaaaaaaaaaaauuacccuggucugaauauuacccuggacugaaagaaaaauauugagcuaauacaggcaucaggaauggggcugcagggaguccagggaagggagaacgaagagccugaaggugugaggaggugcgagugcugaucugucugcuacaaagaggcugcugagccuccuguggauguggcccuggacuuggcaguuuaauaccugagcuguuaaaauaaccucagaugcuguguucuuuaagggguaggauucagauuccugcugaaaugcuucugaaagggagggaaugagccagcccauccccaguugcuuuuuaagaucauugggaaguucuggucuugccauuugucccuggaccacucuuagguccuccugccccacuuccaucugggugugugcccugggcuguccaccacacagcuacauccugccaucuucccuccuggagccacugugccaugcauggaucuguagcuucauuuuucuuggcuuuucccugguuuuucuggagcagagucucuaguaaacucccaaggaagaaaacguuugacuuuauguguguugggaaacgugcuuuuuuucuauuacaucucagugauagguuggccaugucuagaauugcagguugaaaaucauuuccucucaguauauugguuagugagaagccugggacugagacagucacauucucacuucuuugcaggugagugcucuuaggacugucuuuuuaucccuuauacucugaaaugucauaugucuugguguaaguccuuauuucaguuauugagcuggacaaguacuggagaccccuucagucaaagccuucugucauucuccagcucuaggaaauuaucuucuauuguuauuucuguuauuccuucccuuccauuuucuuuuuucuuuuuuuuuuuuuuuuuuugagacagggucuuacucuggugcccaggcuggaaugcagugaccugaucaugguacacugcagccugaaccucccagacucaagugauccucccaccucaaccuccuaaguagcugggacugcaagcacacaucaccacacccaacaaauauuuuuuaaaaauuuuguaagaugggaucuuacuauguugcccagacuuuuucuuccucuuccuggggcucuuauuaggaagauguuugacuuccuggguuggauuccugucuccgugucugacuuucucucuuugucauauuuuucaucacucguugucuuuuugcgucugcucugacagauuuccucaaauuuugucuucuaguccuauccuacaguuuuuacuuucagcaaauauaauuuaaucuccaagaguacucucuuguucuuuuuucuuagcauucuguucuuguuuuauggauguaacauucucuuggaauauuugcuguccucuagaucaucccuucuccauuucuucuugggcuaguuuuucuguuucuucaucuuucucuuuuaugcuacuuauucugggcguguucuugguggguuuuuucccauauagcaacagaggacuuggagcucagggagaaaaggguaggugcaucaccuggcagagcucccagacagugacaggcaggcugcgggaaggaugucuacuuggcggugcuaccgcuuuccuagaaacccuuucccuggagcugguugaacuguuggguuuugcccugguggugaacgcuggcuccccgugcucugccuguuucaucaccagcccccuccccuucugccugggguccaguaaucuguugaaauauauaucuugcucauuggugagcuccugcuccuuccucguugcucuugcagauuuaucacuucucguaaggcugcgcuuguacuucgggauuuucucugugccacacugggaaacauagggugguugcaugcugcaguccugagcacuuauuucacucacaucuuuacacgaagauuugguggguguuuacuuuguuuuuaguaaguuagucugucauguccuuugauccuuuuuuuuuguuuuuugagauggagucucucuguguccuccaggcuggagugcaaugucgcgaucucagcucacugcaaccuccaccuccugggcucaagagauucuccugcuucagucuccugaguagcugggauuacaggcaugugccaccacaccuggcuaauuuuuguauuuuuaguagaggugggguuuggcauguuggccagccuggucucaaacuccugaccuccugaccugccugccuuggccucccaaagugcugggauuacaggugugagccaccacaccuggcccugauuaaucuuuuaaugcccagucucuccuucaaaagccggcuccuuucucucccucgccuuccuagauuccuucuccacuccccaggaucagccuccuccuccccaccccaccacugccggggggaugucuguggucaggcauuuaucagagacccugagguggggguccuuuaugugucugggggauggagagucuagaggagguagcguucagaccucuccauggugccucugcugggcucacaugugaccaagcacagcaaaccaugaggcaggggauggucuugaccaugagagcccuugcagcagcugccaugggccucagcuccucuccaagcugggaagagcccugaaaagccaagguguuuuuuuuucccucuuuauuucaguguaagucccuugagcuuucuugaaccagaagugggcucauuuugcuuuagagauuucaggugggcuuguccuuguccuagcaucccagauccaccuucugggaagucaucagauuggaggugauguuggcagcuuuuguaaacaaaggguaguguuguaagcuguugugucugccuauguguguguuuguguacuuggucucaucucugcagacuggugacauggcuuccagauaugcccgacgauguccugugguugcagugggugaccucacagguguucacucgagugcugaugugucugcuccccgccuccagguaaauacuuuggcugugggugugugggccggacgggcaccucucucaucugaugaggccucacacgacauucuagaaacagcuggcugaacaccaagcaaggagcuugcccuuggguguggggacccugucucaugggaggcagcugagucagucagagguccuggcacaccugcugagagcugccacccaggccaaccugaaccggagccugggaagacuucccgucggaugagucucuuugagugcagcauugaugguggaagagcagagaggccccagauaagcagggaaaggugcuucagacagaguggcugggaugaggacuggggagugucagauagcgcuggcgugucugagcgaaggagcucuggcacccauggcacaggaaggaggugggacccuggaggggcagggcuagcagagcuccucggagcguguggcuaggugccugguaaugcaagcccccuguccuccacccucuguuguacugagucacagucuccggggugaagccuagcagucugcguugacaggccccaggggaugccgcuacuuccugaauucugaauucuggaaacugagccggaguucagggccuggcucccauuaccaggguugggcguuauccugaaaaucauaggccuugguuuccucacuuggcuaacaggggugauccccauccccucaauggguuuccgugagcuccugagagcccguagcaugguacuuggcacaugcugggcaucaggagguauggccucucuugcuauuguuguuauugguagacacagaaggauuuaaaaguaggggaaugcaaagauccgauuugcuagggaagagggcaguaguggccaaguagaggguggauccugggcccuggcuggcagcaggcagcaaggggggcugccagggcccaggcagggacgaucuguagaccgagaggcuuccuaaggcucuuggacaggaggaggugucgguuccaagccuaaggaguggggcagcccuggugacugguggucaguggugccaggcggugggugguaggacacccuggcaggcaaguagguuugugugggggaaacugauaggccccuccagggauucguugguggacaacaccugugauguccagugggagguguccagguagcugggagggccacaggcuuggaagaccuagguggugacaucagcccagcacugagggcuagaagaagcugugucucuggcugugacggcacccuagaguguguguggugcccucuacuggccggcaauguggguccaccguagcucagacugcacacugcagcagcgggaacggccucuaagccaacuuccuccauguguuucaggucccaaaugccagugagcagccaacaggccuccccaugcacaccugagcaggacuggcccugcuggacucccugcucccccaagggcuguccagcagagaccaaagcagaggccaccccgcgguccauccucagguccagccugaacuucuucuugggcaauaaaguaccugcuggugcugaggggcucuccaccuuucccaguuuuucacuagagaagagucugugagucacuugaggaggcgagucuagcagauucuuucagaggugcuaaaguuucccaucuuugugcagcuaccuccgcauugcuguguagugaccccugccugugacguggaggaucccagccucugagcugaguugguuuuaugaaaagcuaggaagcaaccuuucgccugugcagcgguccagcacuuaacucuaauacaucagcaugcguuaauucagcugguugggaaaugacaccaggaagcccagugcagagggucccuuacugacuguuucguggcccuauuaauggucagacuguuccagcaugagguucuuagaaugacagguguuuggaugggugggggccuugugaugggggguaggcuggcccaugugugaucuugugggguggagggaagagaauagcaugaucccacuuccccaugcugugggaaggggugcaguucguccccaagaacgacacugccugucagguggucugcaaagaugauaaccuugacuacuaaaaacgucuccauggcggggguaacaagaugauaaucuacuuaauuuuagaacaccuuuuucaccuaacuaaaauaauguuuaaagaguuuuguauaaaaauguaaggaagcguuguuaccuguugaauuuuguauuaugugaaucagugagauguuaguagaauaagccuuaaaaaaaaaaaaaucgguugggugcaguggcacacggcuguaaucccagcacuuugggaggccaagguuggcagaucaccugaggucaggaguucaagaccagucuggccaacauagcaaaacccugucucuacuaaaaauacaaaaauuaucugggcaugguggugcaugccuguaaucccagcuauucggaaggcugaggcaggagaaucacuugaacccaggaggcggagguugcggugagcugagauugcaccauuucauuccagccugggcaacaugagugaaagucugacucaaaaaaaaaaaauuuaaaaaacaaaauaaucuagugugcagggcauucaccucagccccccaggcaggagccaagcacagcaggagcuuccgccuccucuccacuggagcacacaacuugaaccuggcuuauuuucugcagggaccagccccacauggucagugaguuucuccccauguguggcgaugagagaguguagaaauaaagac

SEQ ID NO: 192569 - RNA, 170022 nt, Homo sapiens
caaaggcccuacacuuugacguccuccccaucuccggcagcuccuuaaacuaagaacucauuuuaauuucugaauucucccuuuuuaaagaccagauaaauuuaccuuugggacaguuagaugugcacaaaugcaccauguguuuaaagaucaccaaagaggagagaaaaggggauuccuuaguccagagaacaaaaacuggugagcugugauuuaaacaaaacgaauguuguuaaaaucagguuguacucagaaguccaaauuucuagcuucucuugagaaacuggauccgacaaacaaaaaauguucauuccuaccugcagcaggaggcuggagcugagacguggguguuccugcagcuggggccugugcucccaggcacucauggcuucucuggcugguucacuucucccuggcucagacagaucaggaguggaaacaucugaauaugcucaaggaggagguaaguuuugggggaaaaacugucagaaaguggaugagggcugggugcaguggcucaugccuguaacccuagcacuuugggaggcugaggagggaggauuguugcuugagcccaggaauuugagacuacucugcacaacauagugaaaacccaucuauaugaaaaaaaaaaaaaaaaaaaaaaaacagcugggugugguggcaugcaucuguggucucaucuacuugggagacuuaggugggaggaucacuugagcccaggagguuaaggcugcagugagccgugauugcaccacugcacuccagcuggggugacagagcgagacccugucacaaaaaaaaagaaagaaaguggacuagcagugagcccagggucaggggcccuggcucuugcccuguuggggcuguuuaccaaauccacucacugcuuuccucagguuuuucuucuaccaaaggagaagaucuugguguauucagcaauagauuccacucuuaguggaugccacucaugagcuuucuagggcuuucuacccccaagguaaaggcuagaugauuuuuaacaccagagauugauuguuuugccugucugaggacauuauguacaaggaguugaacaguggcucuuugauugugauucagacuggaggugaaucccagcucugugguugaccagccguaugaccuugagcauguucucauguggguucaaauacugggccacugugaauaugaggcacaguccccuguuucccagugaagaaaagccagguggaggagaguggccaaccugaguaaauaacuuuuagaaauacagaugaaauaggccgggcgugguggcucacgccuguaaaauuuugcagaucuuuuaauaucugucuucaaaaccagagggauucuugcaucugguucugcauucaguuuguugcauuugaaguuguucgauugacgcauaugaagaaaauguguuuucacauagauacguauuuggaaaagagaguauuuuaguagccuuuucagauaacugugaacauucuuugauacuucaccaaaacucaacuaaugaacgguuuugaaagguuaguugcaguguggaaucugaaaccccgucuaugucuuuuucacacucuguuccauuaagauccccuggucuaccuggcacugugauuggauuguuuacccaggcaugcuuuuguaacaucauaugcuagucauuugcaaaauacugguucccugaauuaggcacaucuuccaaaugucaacaugucuucauuaugcaaaacagaagaucacauuuggccaggugcgguggcccaugccuguaaucccagcacuuugggaggcccaggugggcggaucaccugaggucaggaguucgagacaagccuggcuaacacagugaaacccugucucuacugaaaauacaaaaaauuagcugggcgugguggugggcgccuguagucccagcuacucaggaggcugaggcaggagaauggcgugaacccgggaggcggagcuugcagugagccgagaucacgccacugcacuccagccugggugacagagcgagacuccaucucagaaaaaucaaucaaucaaucaauaaaagaucacauucauuaauaucagcacccguuggaucaggaaaaucuaaguacagaugcucguugacuuacauuugauaaacccguuguaauucaaaaauauuguaaauugaaaaugcauuaaguacaccuaaccuacuggacaucguggcuuagcccagccucccuggaacaugcucagaacacuuauauuagccuacaguugggaaaaaucuaaaacaaagcuuauuuuauaagaaaguauugaagaucuugugcaguuuguugaauaccguacaugacauagaaauugcaaccauuucacgcuguuguaaaagucaguacaucggaagugggaccauuagaaguuagggagguauugggaagcugccaagcucauggugcuggauccaaguuuccaaaaauuccaguuuucacuugaagcccgcauuuuaccauuggcagcaaacacuugaagcucacuuuguccauuuccaaggaaaugucugccagauacccacgucugaaucaccauaguuuguuagucgcucuuccagggaaaaacaauguuccaugaacacagcggcaauucaggccuggacccaaucacccagggcuuuccuugagacauaugagccccugugagcagcagaaguguucucugcuuaggauguuugaacacaggguaaaagcgcugagauguaaugacagggagcauuuugcugcuucauucaugagcgaaacuggcauuuguguuucccuccccaagcacaguggcgaagaauacaauggccauagggguguguugccucugccauucucugccagggugcaggcacuuucacccacagcugcuuuugcaucgugagugcaaaugucaacccagugaaccaaguaacuaaguaaugucuuugcauuauuauaaauauaguuuuaacccaauggacucccuggaggagucucaggaucuccagggggccguggaccacgcuucgggaaccacugaucuaucguuguccaaagcuaauuuuuucagcuuucgggguccuccccaggugacuugcaauagaguaauugugagaaugcccauaagggcuaagcugggacuuaagcacccuccuuuuauuuucagauguaaaucauauucaccucccugccgcagauccuuugugaaaugggguagucgagccuaucaguaucgagagaaacaaaagcgaagugccuggcacgugguaggaacucagaaguggcaggagggggcaguggguguugguggaggggcagaggcgggugcguggucucugcgcuccgugggguggguaagaaccugccaaucccaguggguucuaguaggagggaugucuuuccugcguggcuguacacaggagaacacuguaaagagcaaggacuggcauuaaauucugcauuaaacgugaggccuguuuuuacauuuacacauacagauuucaguuugcguagugaaccgugggaggcugucucagucgugccuuccuggggucaaaccaguuggccuguuuucaagaaugaaaaaugcuuugcccgaaaguggggcgaaugguaaucacagacacacacgucucggugccagaguuguagcuuuauacauagugccuuccugacaaguaaauuacuggauuccuuugccaaaucauuagauaacuuuuaagagcaacaaacauucaugcaaaaggagauucagcauuaucuuguuagaaaaauagucaugauuuuugaaaagcaaggacauucugugaaguuugaccaacugugaaaauuacagccuuucuuccccguacuucccccgugcuuuucaaucaaucaguuucuaauggaugaagcauucccuacauuugucacuagauggaugugccggucaauuaaaauauucugacuucgcaggguugagauaauagccagccuggauccauccguuacugugaaauagaaggugaccuuccuguauugagucagagacccaaauacaauugcuuugaucuuauuaucauagccagaaauuaccguucaucuaaacguaauuucccugaaauacugagcgggcagagcuacugcuggaaauaccagaacaucauaaagagacugugauguggccuuggggaugaaaggugacaucuugacuugacauccauuccaccugacugcagaaaucaaguggaauggaauuuccugggauguucuguaucuaguaaaggcuaaguaggauucaucaccaaaccuuaacccagagagauuaagcccuguuauaaugugcugcggcagccacgccaggacuggacucccuggaaucugacccuuucuuuccauucccacacucccaggccaggguccuagccuuuccugucugucugaaaacugcucuuccagggguggggagcaggaaaccuuguguugggguggaaagagccuguguuuaggaguuggagcuggcuuuggauucucacuuccuuuguucgcuuauucguuccuccaacauggacauugggccaggugcaggguguuguacagguggcucuucuggcaacugccgucagguuuacccuccucuuuagccccagaggucccacagccuccugugucugcccaucccuuaccuccgauguccccuucccugaaguuguuccaaaugaccuguaguugccgcugcugggccuggcuucugcagggcuggccacuccccuucuccagggagccccuaguucuguuuggagaacuuugccaggugcuggcccuuccccacucuugggauggaagccucuagaacaggauggagagggguguauccaucugcaugucauucucuggucagagaaaauaaguuccaccuuuucugagcuugagugagaaaaaaacaaucaaacuagauguuugccaaagacaucacagcagacacgaaguagcagagccaugggcacagaaaagggagccuggguacccccugcuggcagaggugcuggggcaggagcaggcgcuccaggucgcgcgcgaagucagugaggacccuuuugagcuccccgcaacugaagaaggaauuaauaaaaucaacuauaaccuaacaguaguaguaauagaaauuuuaaaauccucucaaaguugcugcaaagugugaccccccccuuacucucaaguuaaaagagaauauuaacagucugucuucucucuguggacaguggaccuuaucuauacuccccaacuccacauuccucaaaguuuguuacaggcccagcgaguuccugcuuaccucccuagcauggcugcagggucacaagaccaauaaguuuagguggcaagacauguuucucucaagauauaagaaauguaaugcugucuuuguuucuugcuucuguaacuugcuucccgccucacguaguuccugccuuaagauguuuacaaguagaaaaagcccuuuguucggggcucaaacuuucuggaccuauguccggcugagcuggugaucaccuuaauuuaauaaacucuccugaaccuuuuccgucucuccagucuuugauuguccugcaacacaacguccgguuugugagcaugcacugcuuuugucuucugggcuaagccagaacaggcaauaggguuaagcaccugaaguacauuuuaaggagaauuaggagccauuguuccaaaaagauucuaaaaauggaugauugauuuaaaagguucucagggacagugcuguguacucaacagacuccugaccgaccugcuuaugagccuugaaaacagaaaaucuuuauuuugcaauaaaggugggaaaaauacaacagcucuuuaaaaaucaaugauuaaaaaaauuuuauaguuuuauuuauuuauuuuugagagaggguuucacucugucacccaggcuggagugcaguggcacaaucacggcucacugcagcuucaaccucuuggacuuaagcaaucauccugcuucagccucccaaguaacugagacuauaggcgugugccaccgugcccagcuaauuuuuucuauuuuuuuuuuuuuuuucuguagagacaggguguugcuauauugccuaggcuggugucaaacuccugggcucaagcaguccuccugccuugaacucccaaagugcugagauuacauguaugagguaccacgccuggccguuuuuuuuuuuuucuuuuuacacaaauaauagcauacuguaguuccuguuacaugcuuuucucuuucuuuucuuuaauuuuuucagagacaaggucuugcucugucaccuaggcuggagugcaguggugcugaggcaggagaauggguucuggaggcaggguaccuaaggcugauuugcacugauuuccuagagcugaaucaaaaggaaaaccccaccucuccacacccaaguaacgaaaggaucagaggcuacucaacccucccaccuuuccacugcauggcagaugaaaaaugggaaguuccucugauugguccccucccacaaccaaucagacuggucgcaggccacuucuucauuuacaucgguuguaaucaaguaacaaccuagaggguauuuaaaccccagacaauucuguaaccagggcucucagccacugcuagagccugcucccacuuugaggaguguacuucuguuucaauauaucugugcuuccguugcuucauucuauuguuucuuuguuugugcguuuugcccaauucuuuguucaaaacgccaagacucauaaucaagacccuccacugguaacagcgcuaucauagcucacugcagucucaacucccuggcucaagggauccucccaccucagucucuggaauagcugggaccacaggcgcaugccaccaugcccagcuauuuuaaaaguauuuuuuauagaggcagggucuugcuauguuucccaggauggucuugaacuucugggcucaagugaugcuccugccucagccucagccucccaacccucugggauuacaggcacaaggcaccacaccaggcccauggaaugcuuucaauaguguauauccuagcaucuuacgccacuccaaguguagugcaggaaucugacgauacauuagaaaugcagaguccuggccagaugccgugucucaugccuguaaucccagcacuuugggaggccaaggugggcagaucacggggucaggagauugagaccauccuaaccaaaauagugaaacgcugucucuaacuaaaauacagaaaaucagucgggcgugguggcaugcgccuguagucccagcuacuugggaggcugaggcaggggaaucacuugagcccagaaggcagagguugcagugagccgagaucgugccacugcacuacagccuggugacagagcgagacuacaucucggaaaagaaaaaaagaaaaagaaaugcagaguuccaggcccugcccagcccacccugugguuuugcaagauucccagguggccugugugugcagucaggauugaggagcacccucuagguuugaacucagcacacuuccauaccuucagcccucuccucucauagguaacucagcucccaccugccacguggcaggaucuccuggacaggcagccagaaagcuaguaacagcaaagcuuuguuaccuaacauuuccuucuauuugugugcaguaccucccccugucaugccccgugugagggcaaaucaccuucaucgcugaaucuuucaccugggcaagugcaggaggggagccccagaucagcugcucccauccaugugaguucugcugcgcggaugcaaaaggcacaaagaucccagggacccauaggaagcuucacaaugguuaccauccaccuacugucaguggccacuaccuuccguucauucaaccguuugggggacagcgaucaagcucuuagugugugcgaggcugcguuugcggguacagcgggcggagaugacacuucaggucuaguggggaagaacaggucagcaggggguacccaggaaagauggggagggggugcccagcuccgccuaugggaggaaggugggcuggggggaguggagucuccuccgagaagcccauccuuucccgugcugcuuugcaguuuagcauggggccugcaucaggcucugcacucccacgcuggaggccagagauucaugugaauuuccagucgugggucauggccagagcauccuuuauucucuuucccaaggucgggcucucuguucacccucuucugccucugggagccucuggacucauuucuucccuccugcgcuccucagcgggaagucuccaucuccuuccuuccuguagauuccucuucuccacgagaaaguuuuagaggcuuuuccaaucccccaaggcaagacuuugaauuaccuuuaguuuuaggcccugauuuauguggguuugacaacaggcuuuaaaaaaguuuuuuuuugguaaaaugcacauaaaauguaccauuugaggucuacaguuccguggcuuaaauccauuuacacuguugagcaaccaucaccaccacccaucuccagaacucuuucauuccgaagcugaaccugcacccauuaggcacucacucccaauucgguccuucccagccccugcagccacuguucuacuuccugucgcuauuaauuugacuccucuaggugccucaucuaagcaggaucauacaguauguguccuuuugugacuggcauaucacacuagcaucauguccucaaaguucaucugcguuguaggcugagucagaauuucauguauauacgcaugcauacaccacauuuucuuuaucccuucaugugucaguggacguuuggguuguuucuaccuuuagagacagguuuuuuuuguuguuguuguuguuuuguuuuugagacagagucuugcucugucacccaggcuggagcacaguugcaugaucucggcucacugcaaccuccgccucccagguucaagcaauucuccugccuuagcacccccgcccgccuccgaguagcugggauuacaggcgcgcaucaccacgcccaacugauuuuuguauuuuaguagagaugggguuucacauguuggccagguuggucucaaacucuugaccucaagugauccacccaccucaaccucccagcaugcugggauuucaggcgugagccaccacgcgcggucuagagacaggauuuuaugauugagugaauauaccuggaugccuacuaugugcaaggaaagcaugcuucugagaaaaaaagauucauuuugcauuuuucuuuuagauuuugagaaaaccauaccauuuaguuauagaaaaguauuuaucuuuugcagcauacuuuggcugacuuugauaacacucagacuguauuagagauagaugcuugggucugccacucugaggacacggauccaagagugcugccacaaccugccugucuuucuugcuugcuuauaaaaauagagaugacaggcugggcaugguggcuuaugccuguaaucccagcgcuuugagaggccgaggcaggcggaucacgaggucaggaaaucgagaucaucauggcuaacacgaggaaaccccaucucuacuaaaaguacaaaaaaaaaauuagcugggugugggggugggugccuguagucccagcuacucgggaggcugaggcaggagaauggcgugaacccgggaggcagagcuugcagugagccgagaucgcaccacugugcuccagccugggcgacagaacgagacuccaucuuaaaaauaaauaaguaaauaaauaaauaaagcuccauauuuuaaaagcucauuauaguauuuaaguagcagugauguuugaauagucuuuucaugccuucccuuuuacugauuuccuugcgaauuugaaauuuugacugucuuaagauaauuuagcacacagaauugagcuuuacauuuuaauauuuuccugauuuaagaggauaauuugcuuacagcuguucagaccucugaucucaauugguaaugagcuacaguagguaugcuauguggaugagcaugggacagauuuuaacauacaaguugcaaacccaaacccaugaaaguuucuaucacuuuuaugucagacugaguuuuuaacugaugauaaugccugucugaguauucauuuucucaaucaaaauguauucuaaucaguuuugaaaucaguuuugaaaucaguucuauuugcucuaaauaacaucaacuuguuauuuuuuuguacggacagauacaaaggcagaguucaaaucagcaauuccccauugacaaaguauuaagguaaaguggcauucugccauaaagguuuauauauauauguaaaaaccuauauauauacacacauauguauguaauauauaauauaugugauauauguaauauguuuauuacauauauauaaaauagguuuuaaaaccuauuauauaaacucucuuguuaauauauaaaccauuauuuaacccuuuaaaaacccucuuuuauauaauaaacauuauauauguaaaaaccuauauauacacauauauaugcucauauaugcauacacaugugugcauaugaaucuuuuuuuuuuuuuuuuugagacggaguuuuucucugucacugaggcuggagugcggcggcgugaucucagcucacugcaaccucugccuccuggguucaagcaauucucugccucagccucucgaguagcugggauuacaggugcccaccuccacgcccagcuaauuuuuuguauuuuuaguagagacaggguuucaccaucuuggccaggcugaucuugaacuucugaccucgugauccacccuccucggccucccaaugugcuggaauuacaggcaugagccacugcgcccguccccauaugaaucuuuaaaauugcaaauguaauucccauuagaauguaagcuccgcagaggaggucuuguucauuuuguucacgagugcaccccacggccuggaaucacacauaaacuggcacucaguauuuguggaaugaaugaauccaugagugugcaaaggagaaagcacaaguugcuuuucugcuuaaccccaugugaugaauggcaccacgucccacuaagaucacucugcccuuuccccugccagggugucucauaauguucccuggggcggcugcacuguccuauaauuuguguaaucaaacaggcacauuuaggugauccccauuccccuauaugacaagcaguccugcagugugcucauaccuuuguauaauugugcagaaacuuucauggaauaaaugaugagaaguggaguuguuacugacgcacuuuuggaaguacugugcugaugcauuccuaaugaagcucccuuagaguucagaacaacagaaucugaaucacuguuguuuucaaacaucgguuuuuggugguaccaucagcaucaccacuauuaggacuuucagguaaaaugugcaguaaaugaauugaauuuugguugcucucugcucccgaaucugcauaguaucugauuuuguauggccugcgagugaaggaugaguuuacguuuuaaauguuugggaccaaaaaaaucaaaaauuuuacgacauaugaaaauuaugugaaauucacauuucuguguucuuaaaaaaaaguuuuauuggaauuaggcaccaugccuauuuuuuuuuuuuuuuuuuuugagauggagucucgcucugucgcccaggcuagagugcaguggcgcaaucucagcucacugucaucucugccuccuggguucacgucauucuccugccucagagacaggguuucacuguguuagccaggauggucucgaucuccugaccucgugauccucccgccucggccucccaaagugcugcgauuacaggcgugagccacugcgcccggccaugccugacuaauuuuuuaaaaauauuuuucauagagauggacucuugcuguguugcccagguuguucucgaacuccagggcucaagugauccuccugccucagccucccaaagcccugggaugaaggugggagcugcacgcaccuggccugcuuacacaucaucuguggcugcuuucaagcuacaauagcaaaauuggguccuuguagccaggcacggcggcucacgccuauaaucccagcacuuugggaggcugaggcagguggaucacuugaggucaggcguuugagaccagccuggccaacaugaugaaacccugucucuacuuuauacaaaaguuagccaggcgugguggugcaugccuguaaucccagcugcucgggaggcugaggcaagaacauuguaagccugcuggugcuugaaccugggaggcagagguugcagugagccaagaucacaccacugcccuccagccugggugacagagugagaugcugucucaguaaauaaauaaauaaauaaaauuuaaaaaauugaguccuugcaucagagucugucuggccccuuacacaccccugccguagaccacugugucuucccuggccacagcaauguucucaugaugugcuauggccgccacauccuuagcuccagcaucguagagcaaguucccucccacaaagcccuacacuucaguucuccccuacccccgucaucauucucuccuucauccaaaacaccacucucauccccucacugcucucaaauugggugggaggagaaaauaaaaaccuuucauuuugcaagcaggugauaccuggauggcaaaugaauggcaaaagaaauucagacuaaggugugaaugucuaauagacuuggccuuuguucucccacccaccuaagagguccuggcauguuucaaggagcuugcucaucccccauuuucucauagcuggucagaggggagucuuuuuuuaaagggggcauaaucuuugggggacuuucccaguuuucccccauggaagacuaggaaccaauaacuugguaccauguuauuuauuccuucuucaucuauaaaauauuuaagggaacaaaacgcauaugugguuuacucugccugguaugcaaaaagagaacucggaggaauugcuaauaaaugaaaauccaacuucccuugucucagaguuugcugaugcuuccaaaaucauuugagugaaagacgguugaucaguguaguuggugauucauguucugcucacacguggcaugggcagaaguguuuccaucacaguuuuaaaauucuaggcaagucuggucaucuccuccugcucuuaguauuuacugugaacaucgcagguuacucucuugccagaucacuaaauuagcagacugauuaaauaacaccauuucaaaaugcuaguuuagauauuaugguuacagcgugcuugaaaacccuaccccaaagugcaguaagauugccucaaaaguauaaccugggggaaauaaggcauuuucuccaucgcacaucaauuaaauauuuccaucacuucucuacacacuucuaacucgccuaaaauugcuuggaggucugaaaaugaacaacacaagaagacauuucacagucuuaaguauucccuggaaugaguucccuuuucucucccaaagagcuacaggcgguuuuuauuuauuuauuuauuuugagaaauaucagcuucuuuuuaguucuauuaaagagaagugaaagaaagcugacaagcuuuauuuauuuaacuuuuuuuuuuuuuaacuuuuuugagacagucucgcucugucacccaggcuggagugcaguugcgcgaugucagcuuacugcaaccuccaccucccggguucaggcgauucucgugccucagccucccaaguagcuaagacuacaggcacgcaccaccacgcccgguuaauuuuuuuguaguuuuaguagauaaagguuucaccacguuggccaggcugaucucaaacucuugacuucaggugauccgucugccucggccucccaaagugcugggauuacaggcgugagucaccgugccugaccgcuugcagcuuuuaagacccucuuuaagcacuuagagugcugccauguuauccagaaggaaacucacacauguaaagaauccaaauuaucccauccagggguaucacguauugacuuucuuuuccccaagaauuuauuguggucuaauuuauauagagggaaaugcacacguuucaguggaacgucuguugacuuuucacguuuguguacacugugugacuaccaccagaucaggcugcacaucacccagccagccugcuggugcccauaugcaggggagauccucagugccccucaccacgccggcgaagccacuaucaacacagaacagaggucgccugcucuugaacuucaaauaaguggauucacgcagucugugcucuuuugcaucugucuggccucuuucauucaacauaauguuuuggagauacacuacauuguucuuuuuuuuucuggauggagucucacucugucucccaggcuggagugcaguggugcgaucucggcucacugcaaccuccaccuccuggguucaagcgauucuccugccucagccuccugaguagcugggauuacaggugcccgccaccaugcucagcuaauuuuuguauuuuugguagagacaggguuucgccauguuggccaggcugcucucgaacuccugaccucaagugaucugcccaccucggccucccaacgugcugggauuacagguguaagccaccaugccuggcucgguguaacuucuauugaaaaagauuuuucucagcacucugggaggcuaauguggguggauagcuugaggccagcaguuuaagaccaaccugggcaacauagcaagaccuccaucucuguuugaaaaagaaaagaagagaaaaagauccacauguaaguggaccugcacaguuccagcauguauuguucaaggguccuguguuuggguacuauacacagaggaacaauguuuccguuuguucaaacacacuggacucaggucccucuuucugcaggcccagauucuccaaggcaagaguguggguaagggagguugacugagaucacacagugcagcccccagcauggggcacagagugcaugcagcaccagcucaggaaauguuuccuccuuguccuuaauuaagauuauauggaacuggccucuucagaagccacaguucaaaagcaaaccaaaugguuuucuuuaauaggggcagcugcauguaaucugauuuucauaaucauucuccaaguguacaauguaugcauagcccuggcacgaggcauauguggggagcauauuaagaagcaaagacggcauugauggagaaggagcuaaguucauauuucugcaucucauuaaauucucucuuuuuauuagaaaguggcacuuuccaaucuugaaguuaauauuuauguuugcugcucugcaaagcaauuuggaaaguaguuuuagugagauuaccccagagagaaagcuaguuauguaaacuccacaggagccaggccaggaaggaggaaaguuuuuccgguuugaucauuguccuuccuuccucucaccuugaaaagaaauacaacuuaguccacagccaucaagccaguucuugauugucaucuguagcacauacaagacaaaaaaaucauuacaacagacacaacaauuuuuuuuuuuuuugagacggaaucucacucuguugcacaggcuggagugaaguggugcaaucucagcucacugcaaccuccgcacccuggguucaagcaacucuccucccucagcauucugaguagcugggauuguaggugcccgccaccaugccuggcuaauuuuuguauuuuuaguagagaugggguuucaccauguuggccaggcuggucugaaacuccuggccucaaaugauuggccugccuuggccucccaaacugcugggauuacaggcgcgagccacugcgccuggcccagacacagcaauuaaaaaaaaaaaaaaguucuaaccugcauuuaauaaugauacaggagauagaaagaaauuauuuagacagauagugagggugaaagaguccuugacaagaucucucuucuaauaaaaagcagcccccaaaauuauuuuuuuucuaacaaagagcagccugaaaaaucaagcugcaaacauagauaaacaugcuaaaaacuuacaugggugaaugcagacagcugugccaauagaaaagggcuaccuggggccaggcguacccaacaugaagacuccaucuuuccuuuucuguuguuaccacguauacaauaaagaaacgaacaacaugacacuggccagacagagaauccaucuacauaauacauaggauuggggcugggcgcggugacucaugccuguaaucccagcacuuugggaggcuggggcgggcagaucaccugaggucaggaguuugagaccagccuggccaacauggugaaaccccaucucuacuaaaaauacagaaauuagcugugggugaugaugcacaccuguagucccagcuacuugggagguugaagcaggauaaucauuugaacccaggagacggagguuucagugagccaagauugugccacugcacucuagucugggcaacaagagcaaaacucugucucacaaaaacaaacaaacaaaaaaagauuagggugcagacagccaacuuuuaacaccuuauacaaaugauacaccuagcucuaaccaguuuuucacgccuuauacaaauggcacaccuggcccaaccaaucguuugugcccuaugcaaaucagacaccaccuucucaaacuaaucuguaaaauccccugacauuucaccauggaaccaacaacgcauuuuuuugggauuucucucugggcagagagcucuucucugucuuuuucuuuuucuuucuuucuuucuuuuuuuuuuuuuuugagauggagucucgcucugucgcccaggcuggagugcaguggcgugaucucggcucacugcaagcuccaccucccagguuuacgcaauucuccugccucagccucccgaguagcugggacuacaggcaccugccaccaggcccagcuaauuuuuuguauuuuuaguagagacgggguuucaccguguuagccaggauggucucgaucuccugacuucgugauccgcccgccucagccucccaaagugcugggauuacaggcaugagccacugugccuggccuagcucuucucuuucaccuauuaacuuccacucuaaaccucacucucuguguguccaugucuuaguuuucuguggcugugagacaaugaaucucggguaucaccccagacaaaugaggccacuucaauaacacaucauccuauccaaguguaaacaugaaauucgcuuauguuucauauacaccuuguacacagagucugaagguaauuuuauacaauauuuuaaauaauuuugugcgugaaacaaaguuuauguacaagagauauuacagcugaagggggcuggaagggucuuuuuuccccuggggcugcugaauaaacuguguguuaugugccuggugcuucaacuguaaccugucaugugaggucagguguggaauuuuccacuuuuggcaucacgucagugcucagaaauguucagauuuugaaccauuucauuagggauguucgaccuguggcuguuuuuacuuccccauuuuauuuuauuuuauuuuuuuugagauggaguuucacucuuguugcccaggcuggaguacaauggcaugaucuuagcucacugcaaccucugccuccuggguucaagugauucuucugccucagccucccgaguagcugggauuacaggugugcacugccauguccagcuaauuuuguauuuuuaguagagaugggguuucgcccuguuggccaggcuggucucgaacuccugaccucuggugaucugccugccucagccucccaaagugcugggauuacaagugugagccaccgugccuggccaccuuccccauuugagaugugagagguaauccacccuaaccauaaauuaguuuuucauaguguuaaauaagaaauaaaucaucuuagucucuagacaaagaggugcaaggaaaauugagugaaugaaugcagugcuuugggucugagaauacaaaaggugaacgaugauaaacuuuaccaagaaggcccuauuuacaugggauuucuuaguagcgaguaccacgcuugcauuuaacauaggauuccaucuguauacaaauuaggucuauaaaaugccaggaacccuccaguaacgcaaagcccaagacaguuccucuuacaauuaagcaccacuugguugucacuaguucugcuugaaauguggggccacuguucuuucacacuguaauggcauauucaaacugucucugccauguucaaauuagcaauaaccaaaugaaaauuguaaauucuguguguucacuggcaagccggaaccacugacgaaagcuucaaaaauccauuauuuccugggcacucaccagaccccccacagaugcaucucugugucuucagccucuggaccucggcuuuugcccauucacaucccccaugaggauggcucuuguccauuuucucucccaguugguguuucuucuccccuugcucucuccugguuagaggcucuucacuggggguccguggggugccaagggcaguaggggugucaggggggccuuccaaagcaggcuauuguuugagaaugauguugcaugucacgugucacacaugugacauugugugugcuucuccagacuagagggucugucccaugcaccagauucucaaagaggccagagaccccugcccuagaugacagucucaccccaggauacagagaguacccggaucucuguucagcccugcuaugucacaaucccacugagaugucaauaaccacaucucggccaggcacaguggcucacaccuauacucccagcauuuugggaggcugaggcggguggaucaccugaggucaggaguuugagaccagccuggccaacauggugaaacccugucucuacuaaaauuacaaaaauuagcuggguuugguggugggcaucuguaaucccagcuacuugggaggcugaggcaggagaaucaccugaacccaggaggcggagguugcagugagcugaggucuugccauugcacuccagccugggcgacaagaaugaaacuccaucucaaacaaacaaacaaaaaacuaaccacaugcucgauguuucugugucuucccugcugguuagugacauccaaggcaggccacaugaguaagaacccucugagaucuuccacccuucacuucccuaaccuggaauccagucauucuccagguuuuggggcucccaacuccaaauguucauuccucuuugucccccacuuccaugugacacugccuggguguguagccucagcaccccuuuugucgaauuggucucuggcucugggguuuccucgcuugguccuccacacugggucaguucucucaauggccaccuccuuccuugcacaagaucaagugcagacuccugaccugggugcuggagggcaguccuuuccaucgcccccguucuccucacccagauucucaggccacaugggcgggcuugccaugguuaugguugacucgugcgcugcccccaucuugguccauuugcauugcuauaaaggaacgccuggagcugguuaauuuuuuauuuuuauuauuuauuuauuuagagacaaagucucgcucuugucccccaggcuggagugcaauggcaugaucuuggcucacugcaaccuccaccuccagguucaagcgauucuccugccucagccuccccaguagcugggauuauaggcgccugccaccauaccuggcuaauuuuuguauuuuuaguagagacaggguuccaccauguuggccaggcuggucucgaacuugugaccucaggugaucugcccgccucggccucccaaagugcugggauuacaggcgugagccaccacgccuggccuauuuuuauuuuuuuauuuuugagauggagucuuucucuguugcccaggcuggagugcaauggcaugaucuuggcuaacugcaaccuccgccugccggguucaggugauucuccugccucagccucccgaguagcugggauuacaggcaugcaucaugacacccagauaauuuuuguauuuuuaguagagacaggguuucaccauguuggccagucuagccucaaacugcugacaucagguggacugcuggccucggccucucaaagugcugggauugcaggcaugagccaccgugcccggcugaagcugguaauuaauaaagaaaagagguuuugucgcucacggcucugcaggcugcacaagcagcauggcacagcaucugcacgggugagggccgcaggcugcuucuccuggcaaaaggagcaauggagccacaugcacagagauuacagggcaagagaggaagcaagaaagugcgggggacggccagcucucaagggagcuaacagagugcaaacucacucauuacuaugaggauggcacaaaaccaugagggauccuccccaggacccacacaccccccaucaggcccgacucccaacacgggauugaauuucaauaugggguuuagauauuuggagucaaauauccaauacauagcacucccaaaagaugcugaaauccuaauccccaguacugugacugggacauuauuuggagguaggguuguauggaaaaaucaaacugccuuuccucuucucucacaccacaagugucaacacuccugugacuccugugaugaacgggcugaggauuucuccccgccagcaagucggcacucaguucugcagcggcgccagcugggugucccccaguccaguucaauuccagcaugguccaucugcagacagcacaagaucccacagggugagggcucagucccacaagacagucaccacuuuuuuuuuuuuuuuuuugaggcagggucuggcucuguugcccaggcuggaguacaguggcaugaucauggcucacugcaaccucgaccuccugggcucaagugauccuccuagcucagccuccugaguagcugggaccccaggcauaugccauuacacccagcuaauuuuuuauuuuguacagagggggucuugccauauugcccaggcuggucucgaauucuuagccucaagugauucucuggccucagucucccauaguguugggcucucaggcaugagccauugcauccagccaccugccaccacuucugaugccagucacaagccccagcuaguucugccugugcuucugacuggcuauaaauugagauucuuaccccccucagguuugauuagcuggaguggcucacaaaacucagggcaacacugacauuuucuggaugauuacaaaggguguuacaaaggcuucugaugaacaccagaggaagagacugguagggcaaggauggaggaggggcauuaagcuuccuugcccuccccaggugcaccacccucaggaaccuccauguguuuagcuauuuggaagcuucuccaacucuguccuuucuuuuuuuuuuuugagacugagucucacucugucgaccaggcuggagugcaguggcgugaucucggcucacugcaaccuccaccuccuggguucaagcgauucuccugccucagccucccaaguagcugggauuacagacaugcaccaccauaccuggcuaauuuuuguauuuuuaguagugacgggguuucaccauguuggccaggcugacuccuccaacuccugaccucaagcgauccacccaccuuggccucccaaacugcugggauuauagacgugagccaccacgccuggccccccuuuuggguuuuuauggagccuucauuggcuaagcacaauugaagcuggacaaccaugucgaagugugauuggacaaaaacaguaugacucaacaccaucagucagaguggugaagccccgcaaggccugucuguauagcauuucuuccuccugggcgggaggcuggacuccuccugaaaugggggucccgugacccucagucagacaaggcaggucagagaauuucuccacggccagcuccaagauggaaaggugggggaagauucaaguauauuuucauuuucuauggccugacuuggggagaaaaaggagcaggugaaaggagggaaggagaaagaaggucagaaagagagagaaacuacaccugaagccugcuuccaaagauccaacaugauaacacaggacuaucguuccccuuuauugcucugaagcuguuuccacacugcuucaggaaccaaggaaaaaagaacaaauauuguaacaaaagaucugcuuauugcuauagucacugaggaaauaacaagggugaugggaauuaugagccaggcaugguggaggaaaaccaaugcauaaauaucaucaucucacagggucuuugcagaugaugaggugaagaugaaucaccaggaugggcucuaauccaacaugacugugucccuguaaagucuagacucacacacacacacacacacacacacacacacacacacacacacacacacacacacacagggccuaguagagacggaggcagagacggggcaaugcuucuacaggccgaggaacauggaagauuugcuggcaaaccccaggagccuggagagaugcagggaacagauuugcccgugcagccuccaaauggaaaugaaccuagccuacaccuugauuuggauuucuggccuccugcugaaauccuaauccccaguacacagggguauuacaaggacacggucaucuuggauuacagcccacucuggugacuucaucuucacuugaucaucugcaaagacccuugugagaugaugauauuuaucaauugguuuuccuccaccgugccugccucauaauucccguagaccuuguuauuucucuccaaacugugagagaagacguuucuguuguucugagcccuccagcucauggaacuuugugcuggcagccccaagacaccccaguguccucucccugucucuucugccuggugggucuucuccuccuuuacugaaaggaaaagggcauuugauccuuguuccaggucaaaugucccuucccugcaagccuccucugcccacagcacuucucccccaccccauccacauggucccugucccuccuccaugcuggccacgcuacacggccacuguguccugugcccacguucuccuugaccacaaacuccuggaggacaaagcucugugcccuuggucuucacgccccuggcugaggacugggccuggcaccaacuugaccaacagaaacauguacugcacuggggggacuggggggcagccagcacaaagggagacagaaaaaccaucucaacccacacacccagagcugaacccacuucuccccaggugccguccucugcugagugauccaccauggccuggcaggacacccagccuucacuccuccuacuucuuuuuuuuuauuuuuuauuuuuuuuuuauuuuuggagacagagucucgcucugucacccaggcuggagugcaguagcaugaucucugcccacugcaacuuccaccucccgaguucaagcgauccuugugccucagccucccaaguagcagggauuacaggcauccaccaccaugccccgauaauuuuuguauuuuuaguagagaugggguuucaccauguuggccaggcuggucuugaacucuugaccucaggugaucugccugcuuuggccucccaaaguguugggauuacaggugcgagccacugcaccuggccuacuccuccuacuucuucaaggcuggggcuucuggcugugagcaucucagaaaucuguuugcuuuucuccuaagucaccguccgccugccugugccuucucugucuccagcaccugcugagcagccaucagccagaggcaacaucugugacaucacagcucaaagcccugccuggguaucuaggcugggcaugguggcucacaccuauaaucccagcacuuugggaggccgaggcaggcggaucaccugaggucagggguucgagaccagccuggccaacauggcaaaaccgcaucucuacuaaaaauacaaaaauuacccggucgugguggcgugcaccuguaaucccagcuacucaggaggcugagacaggagaaucgcuuuaacucaggagguggagguugcagugagccgagauugugccacugcacuccagccugggcaacaaagcaagacuacgucuaaaaaaauaaaauaaaauaaaacaaaacaaaauaaaauaaaauaaaauaaaauaaaauaaaauaaaauaaaauaaaauaaaauaaaauaaaauaaaaauagcccugucuggcaguccucgggaugaagccguuuccucugcuuccaacacaugcgaggccugucuccccuccucuccccucccuggcaccccacacuguccccagggccugcucuucugcucaccucaugguaccggccugcaagccauuuccuggggccuccccgucgccucuuccagaaacaacuccuggaacuccccuuggaggucaggccaaugaccugugccccgcauugcccuccauccucuaagcuucccguggguagggacaauucccaguucugaagggcucccccugccccgggccuggcucuuggcagaagcuuaacaacagaccggccacguucgugugaccugauucucuccggcuuucaggacguccugaggcugcacccacguggcaauggugucugucgcgcugucgccuggauccggcaccacuagcggagccgagcagagcccagggcuccaacgcguagggaaaaggcugcgccgcucccgggguggccccacgccccuucucugagcuugagcggcggcgcgggacggggacggcucuggccgggaccagcaggccucgggcauccgggacgccggggccgcgcuccaggccaggggcgggggcgggaccggggcgggggccggcggcggggccgcgcccucggccucuccccggggcgaccgggcggcuccacacgcgcugcgcccgccgccggccccacgcgcggcccauguccuccgcgccgcgcucgcccaccccgcggccccgcaggaugaagaaggacgagucguuccugggcaagcugggcggcacccuggccaggaagcggagggcgcgcgagggugagugcgcgcccgcgcccgccgacccccggggaccugcccggcggugcccgcccucggcccuagagccccacgaggccgcccccgcccucccccacgcaccccgcccggcccacgcggcugcgcgaccuucgggacaggccaggccuuugacccaggacccguaaacaacggccgggaccuggcgcguggggccgcgguggccuccggagucugccaaacgcgcgugcgggcgccugcgcggcggggaccucgggccaccgugcggggcccgcgccugcucugccugccggguguucagcucuucccugggccagcggcauagccagccgcgcggggugaccguucauuccaugagcagugacgcucacgugugcagggcacucugggcagacacggccugggggacccacuacuggguguugcgcgggcgcccugcagggugcggggcucagggcgugcagggcugaggccugggaggccugcgagcaagaauugcagagaucccauuaaaaauuuuuuuuuuuaaauuuuuuacugcgugugcucacgaaacacuaccaaccucguacguuuuaaagauuguuagaguugcaagggauagucuggugucuuuaaguguaccgcuugcccagggccuccugggagauacauucuggaauuuucugcuuggguggggagguucugccccgggaccaugcccuauagugagauuucggauuggugagaggugaggggagcugcuguggaaaggcagauggagaaaggccggccucagguggguccccgggaaggagcccucccauagcggguaugcaguacgguuuccuuaaaccaccugggccugacauauccccugggaacucuuccugugccuccagggauuaguguaccccgggaugcaggucccccauucauuucuucccugggacucuuguauuccuagggaugugugugccccgggaagacauaugacagauuugccucuaggcaugugugugcccccaugcaccugcuccccaggauuuuuguacagugcagggaacgcuugguuccccagacauuuucucccagggaugccugugcccccagggaugcgugucuucccacccgugauccuguuccaagagggcagggucuuguccccuucaguaggucuccuggcggauaggucacucuucucucaagccuuacacuggaggacccacuguagcuuguauuggucgguguuggucacgucuccuaaaugacaugauuaguggcugucacccuucuaucauccccacuguucuuccaugcagucaucagcacccucaccagaaaucauuucgguuccucuuuauggcuugcaacgauuauagacgcaagugacgcuccccucccaauucagcccacagccuguggagcgcccgccaugggccaggugcugcuuagaccccaggaagaaaagagcgggggcggggugcuugcuuucguggaacggggaaugaauacauagacaacuggcgcugugaugacgugccccggagcacauagaacagggcgaucagagccaggggaggccucugaggaggggacacuugaguggaggccagaaggaaccagaggaaaaagucuuucauagaauggcaaggaaccggaauguucugggcuauugcagcuuuuucuaggugccguuuacgcucucggaauaggaagaacacacacccaaaguaauggacugggcccaaauuccaaaguacgcagugcuucuccuccuugccuguaugaauugaugugugucuagaaaauucaggcccagccugguuuaauucaaaugcaccaagaauuccgguagcaggaagcauccugugcugaauagaacgggcguggaggcaggaggaggagcaggacgccgggcacugcugaugcugcuuucgcugggggugagcugggcgcccugccucgguucucaggguuggggugccuggcaaacagagggccacaaacccuccuuggaucuaggcacaggaauugagggacaggcuggauugggaaggguuuagcggcuucuguguggucuccugggaaguggaagagucaggaagacuggauaaugagggcuugaauaauugagagucgcugguauuuccgcaagcccauuugccuuggcaacaugcgcuucugccacuccaggguggagcagccccuggcccugacuuugggccgucagagcuaugcucgguugccuaccagggagugacagggcgcuugggagguuuccacgacccugccugcugcaccgucggcuucauuuccuccuuuguuagaaaguugaggguggauuugggagaacggauguggcuccgacauguuccugaguugaggacucuaagggaggagggggaagcugggggaaggggcgggcucaucggugagguuccagauucaggcaggggugugacaaggcacggagggacuuuugggagggaugguugggaugagugacguggccuguuccagaggagagggguuaggaaauguggggcccugggguuuggaggaagcagugcaggaagugucugagaaugagcuucacggugggcgugauuaaggcugaugugcuacgggaggcgugucacgugguggccugggucagaaaagggaacugugaccaacugugggcauucagaaaauggaaaggaacgccggaaacccccagggcuccccacagaagcucuggggacgugaaaggacagcguguuucaaacuuggguucagcuuuacuggggcuuggaggagcccgugugcagagaagaccaacaacacacaggguuccccacugugaccaugugaugagaggcccuguagguccagugggccaggauggaggucggggacagcccagcugcugcuggaaguccucagaggcggauggccggcccuggccaguguggaagaggucggguggagugcuccacacauuugccacaagaggccuguucugugcugcaccaggcacuggaccucaggcgccacugcccaguggccagggucagguuucucagagacagcugaaggcagcggggcgagagcagccagucuggagguucugucccucuuuucugagcaacacauucaggaaguuucuauccccugauuaccuuaaaaaauauguaugugugggccaggugagguggcucacgccuguaaucccagcacucugggaggccgagguggguggaucaccugaggucgggaauucgagaccagccuggucaacauggugaaaccccaucuccaguaaaaacgcaaaaauuagccgggcaugguggcgugugccuguaaucccagcuacuugggaagcugaggcaggagaaucgcuugaaccugggagguggagguugcagugagcugagauugccucacugcgcugcaggcuggucaacagagugagacuccauaucaaauagaaaaaaaaaccauauauauauauauauauauauauauucauguguguguauauauauucacauauauauauugacguauauuuuuaaagcaguuuuagguuuacagcgaaaucuagcaaagaauacaaaguguccccaccuaucccuucucaccuccaucagugccccccggcugugugguagagucgugagccaacgcugagacaucauuaucuccgcaagcucauaguuuacauuagggguugcucuugccguuggacauucuguggcucuggauggauguagagugacauggacccaccauuacagucaccucuggagcagcgucacugaccccagaauccucuuucugcugccuaugcaucccuccguuuccccaaaucccuggcaaccacggaucauuuuuuuguuuuguuuuuuugguuuuuguuuuuguuuuuuuuacuguaucuguguuuuugccuuuuccagacuaucaucuaguugugaucauaaaguguacaguagcguuuucagauuggcuucuuccacucaaugauauacauugaaggcccuuccaugucuucucagggcuugguagcucauuccuuuuuugacugaauaauauuccguugucuggaugugccaguuuguugauccauucaccugcugaaggacaucuugguugcuuccaaguuuuggcaguuaugaauaaagcugcuguguacaucuacguguagguuuuuguguggagauaagguuuuaauucauuugagcucaauugcuggaucguaugguaagagugugucucguuuuggaagaaacugccaaacucucuuccaaaguggcugugccacauuuauucaccgguggcgaacgagaguccuggcugcucugcauccucaccaguauuugguggugucaguguucuggauuuuggaauucuguuagguguauuguggugucuuguugcuguuucaauucgcauuucccugaugagguaugaaguggagcaucucuucagaugcuuauuugccaucuguguaucuucuucagugaagugucuauuaaggucauuggcucauuuguauuuuauuuauuuuuauuuuuauuuuauuuuugagauagggucucacuguagcccaggcuggagugcaguggcacgauccuggcucacugcagccucaaucuccuggggcucaagugauccucaugccucagcuucuggaguaguugggacuacaggcacauaccaccaugcccagcuaauuuuucuauuuuuuguagagauggggucucgcuauguuacccaggcugcucucaaacuccuggacucaggagauccaccugccuuggccucccaaagugcuaggauuacaugcgugagccacagugcccggccuuggccuauuuuuaaaucugcuuguuuguuuccuuacuguugaguuggaaguguucuucauauauuuuggauacaagucauguguuuugcaaauauuuucucccagccagcggcuugucuucccugucucuugauccugauaucuccuaagcauuugauguagaguuaaugauuaaugagcaagauauugagaccucaucaacuagaucuaaagaaaucacuaggccagacacauaaucccagcacuuugggaggcugaggcagguggaucaccuaaggccaggaguuugagaccagccuggccaacguggggaaacccggucucuacuaaaaauagaaaaauuagccaggcgugguggcucacgccuguaaucccagcacuuugggaggcugaagcggcagaucaccugaggucaggaguuugagaccagccuggccaacguggugaaaccccaucucuacuaaaaauacaaaaauuagccgggcgugguggcacacaccuguaaucccagcuacucaggaggcugaggcaggagaaucacucgaacccgggaagcagagguugcagugagcugagaucgcgccacugcacuccagccugggagacaaagcgagacucugccucaaaaaaaaaaaagaaaagaaaagaaaucacuagguagcugcgacauugaacugaagguugaaaguauuaaguuucuuuguggacuuuaaauaaccuucaggagagaaaucucaaagcucuaaaccagcaaccgagaauuuccuucagggcauccaucuuuuacacggagccaucaguuguguagaugauggguugccccaaaacacuaagacgcaccagugaagggaggggagcuguggcaggggggccugcacugcccccgccuuuccccccagcaacgccugggcugggagcugggggugggugagacccuggcucaggccccacucaggacaguuugagggacaggcagauggggggacugagccaugggggucucaccacccagacuugggguuuugggccucccuggaggaagugguccuggcugaaugucuaggauggauguaaauuagcccagggagggggagggggcuccugaggagacccccaggcaggcucccaguggcugagcaacggugcagccugugggcuguggccagcccuggucgggggcuggagaggugagcagcccuggcgucccacaaacacaggagcuuggaacccuugcuggggcuuggcagggguggccgauuucaguggugcuuuggggaguggggaauggacggaaugggggaacggcggggaggcaggcuggcaggaauguggcacggggcacaggcagugccccgaggagguggcgugggugggcgcaggcguggcugugauuuccacgcuguuuucuagcgggcugcagccccucugaugcugaaaugaaaaaggacccagauccuuguuugugggaggggugggaaaggauuugcaaggaguguggucucuuuuggacgauuuuucagacuucuucucguuuccaggcccucugugcucacgugaccccucugauagcgucagggcccguagaaaaguggcuguggcauguugggaaggccagcgggccuccuagccaacgaaaagggggaguggcugguccgaaguugggggauauagacaggugagggaccagggccauagucacugugguuucuauggggaagaggggaugguggagguccuauuuggagcuguuguguugugaggcucuuuacagacccugccaacaaagagaaagacaauuccacacuguuaucucuaaacccaaaccuccuucgagcagaggccgucuccguuuggggauggacagcuguugguccaagaaggaaaggcacagugaggucacugcgacgcugcccagcaccuucaugggaaacgcuccucaggguggugaguggaacucccuggagaccauuuuccagugagggccuaucucuuuccucuugggcugagaggaaguggguggcucagcuacauuuccuuugauuauuauucugacuauaaucuucaaacccuacauuucucauuguguguuccgcccaugcguucuguuguccggggcagcaaagucgaccugcaccacguggguguuuuuguuuucuuuuguuuuguuuuguuuucuugaaggccuacuaagagcugucggaaacucugcuucuguagaaaagguaaaggcacugcuuggccacaagugaugacucuucccugccuuucggggcuuggggaggaagggcagguucucggugguucuccuagcaccuugguuacaaaccucccagcagagucagaucaccuuggcaaccccacacucaucaaagggacucugccuugauucccuccccaccgcuguggaauuaauaucgauugcacauccugaaauugcuuacccucgcgcucccuguccagucgucagaauaauuaagggguguuuauuggauguaaguggguucaucccugcugcgaguauggauuuuaagugcuccguuggauugauuccucccugcugugguuggcacagggcagguaccuuuaccgagcuguuuucuucuuuucgaacaugcgguuccaucacauaaaagacauacccuaugaaaaugucucugccuuagcuguacauguuacacuuuagguuucaggugaaaaauugguuuaucuccuaauaugucugcuauuuguuacaucacauagaggcugcaaaacagauuaauaagcuuuggaggauauuauaagcauacguuggcccaaugguauuaauuugcuuauccauacuaauugcugucuugguaaaagaaggcggacacaaugcaaucaauccuagaaguguucuguggcuuugcaacuuugagauaccucaggcugacauauucaaaugagagccuucucucugguuacaagaaaaaaauggaaugagcagcaguuuuggccucguccagucucuagggcucccagcaucuggguaguaacaugaucagcccugggaaaccagcggagucuuuuaccuccucugauguucugacuaagagugucugggccguggggacugaacgcacccuuugaggcuauguguguuaaaguuugggggcccauuucuucauuucuaauauggggcagugugggcagaucccagcucugcguuucugagcugcugaguuugcccugguucugagaaugcccgucgcgguggugcaguccgccuccuugcacuggaucuguugcuucuucucucuaagccucuguuccugauggucccuuguggagcaaagcagcacuugugguguaaggaaggaaagccucaucagcaauugagugagcgcucaaucagaauucguuauggaugaauguggaugacuggaggcauugacgcagacaccagaguccagagcugguacgugguacagcagaaguggcaagucagcucaguuuaggacaaguaccuaacccuguguugagaaggauucuguggcugagucugggcuuagggaaaaagaaugcugggaccagucagccacacuaccaguguguauggaggguuaguugcugaguggcugucacccccagaacaggagccuuuuccagcucuagugcugugucauuucagcagcacuggcugcuuuauucccauugagugccgugcaacagcuaguuggcuguugguaacaaaaguugugugaaucguuuaagauauugcagugagaauguugguaucuuaacucuuccccuagcugucuguggcuaggaagcaucuccagugcuauuguuuuuuucuugagacagaguccugcucuguugccuaggcuggacugcaguggcaugaucucggcucacugcagccucugccuccuggguucaagcgagcacauccagcuaauuuuuuauauuuuuaguaaagacaggauuucaucauguuggccaggcugaucucaaacuccugaccucaacugauccgcccaccucggccucccaaagugcugggauuacaggagugagccaccacucccggcccccaauacuuuuuugagguauacuuggcugaguaacuguuuagcgugugcagagaagcagguguuucugagcuggaauuccuuguacccagaaaugugagggcaacucacaugggcaccaggaggcauuuuugccuuccucaccagccuacggcaucagagaacauuuggcagucucugagugggaguucuuuacgcuugccugauaguaguuggaggccugcuccuuuaagcuuugccacuugaagugaugagcuugguuuuggccuuugaaccuuuaccugccagccacccacaaucagucgguaauguugguuuccccaagcaacgccaucuuaggaauuucuuugcuuguucucuuacaaagucaugcauuauuauacguguuuucauuugaaaaauuacaguuccacaggaucuagacuugaauguuaagcuauuaaaaaguuaaagagggagugaaaauguuagcacuccuagggccugcguacguugcuugcucaaauccagacgcuccuggaagcagcugucucagcggagcccugucugcccuuguuguuuucugcuucucaaguuacuccagacuccagggaacuagaacugaccaggccccacuuuaaacauguggauggagugccccugacaaggcuggagaaagggggagguccggggcggggccucaugcgcauaugguauucagaguuuauuuuugcuauaaauggaauuugaagaauauauauauauauaugaacauacaaauaaaaauauauaaagaauauauguauaaagaauauaaagaauaauuuuggaauucauugcauugugucugcauucuuuuacugcaacagcaauuauaauuauaauuauauuauaaagaauauauauucuuuauacauauauauuugagaugggugucuuuauacauauauauguuugagaugggugucuuuauacauauauauguuugagaugggugucuuuauacauauauauguuugagaugggggucuuuauacauauauauuugagaugggggucuuuauacauauauauauguuugagaugggggucuugcuguguugcccaggcuggagugcaguggcuguucacaggccagaucaucagacacuguagccuugaacuccuggccucaagggauccuccugccuuagccuccugaguagcugaaacaauaggugcacaccaccaugcccagcucuugagaagcaucuggcccauagcuuaauuugaagugucuucaucccugucuuuuuucuuuuuguuuuaaaauuaauagaauugacccuugaacagcacagggggaaagaggcacugacccccaugcagucagaaauccacguguaacuuuuuuuuuuuuuuuuuuuuuugagacggaguuucgcucuugucacuaggcuggagugcaguggugcaaucuuggcucacugcaaccccugccucccagguucaagugauucuccugccucagcuucccgaguagcugggauuacaggcgugcaccaccacacccagcuaauuuuuguauuauuaguagagacagaguuucaccauguuggccaggcuggucucaaacuccuggccucaguugauccgcucaccucagccuuccaaaguacugguauuacaggcaugaacaacugcacccggccaccauguguaacuuuugacucccacaaaacuuaacuagugauagccugcuguugacuggaagccucacugauaacauaaacaauuaacaauauuuuguauguucuaugcauuaugugcuguauucuuacuacaaagugagccugaggaaagaaaauguuauuaggaaaaucauaaggaagagaauaugcauuuauaguacugugcuguguuuauugaugcugcacguuuacaacaugcguuuacaagaugaaugcucugaaguggccggcaacugcagcugcagaccucacccuaccauacaacaucucaagcuauucagcuucuuggaaugucacgcuuuucuucuuuucuuuuuccuuuuuuuuuuuuuuuuuuuugagacggagucucgcucuguugcccaggcuggagugcaauggugcgaucucggcucacugcagccuccgccuccuggguucaagcgauucuccugccucagccucccaaguagcugggauuacaggcaugugccaccgugcccggcugauuuuuuuguauuuuuaguagaaaugggguuucaccgugguggccaggauggucucgaucuccugaccuugugauccgccugccucagccucccaaagugcugggauuacgggugugagccaccgcgcccguccgucaaggcuucuugggagcacuuacagcaacacaaguggugcuuuguaugagucccauaguguuauucaggguuuacgguauugcacuaaacaugaugaaaaauacgugggaacccaaacagaucacuuuuuuuuuuuuuuacuaugauauggaauuuacuggagcggugaacugcucaaguggagauaauuaacaucaaauaauguucuaagcaaugcaauagcaacaggaggcggcuacuauuacaguggugcaguauggacugcaguuaauuuuaugcaguuauuauugaauacugcaucuuggcugggugcaguggcucacgccuguaaucccagcacuuugggaggccgaggcgggcggaucacuuaaggucaggaguucgacaccagccuggccaaauggugaaaccuugucucuacuaaaaagauaaaaauuaaccaggcgugguggugggcaccuguaaucccagcuacucaggaagcugaggcaggagaaucacuugaacccaggaggcagacauugcagugagccaaaaucaugccacugcacuccagccugggugacagaaugagacugucucaaaaaaauaaaauaaauacaauaaaauaaauaaauacauaaguacugcaucuuuacauuuguuuacauuucucucaacugugaacacagucuguguguguguguaaguuuugauacauuuuaacuuuuuauaguagauuuguauguauuuuauggugguaaaugauaaaacagaugaguaucuacauauauuuuaugcauuugucgcauaucuaacuuuuucuuaauuuuuaaaaauauuucugggcuacgugguuugcaguuuuuucaaauugucacaaaucuccaaaaaauuuuccaauauguuuauuggaaaaaaucugcauguaaguggacucauauaauucaaaccuguguuuuucaagagucaacuguaaugucuuucaaaguaaaaucuaaaugaguuuauacuugauauauauaaguuuaauagaaggagugcguuggcucaugccuguaaucccauuucucugcgaggcugagaugggcggaucacuugagcucaggaguucaagaccagccugggcaacauagagagaaccccuuuuuauuaaaaauuaaaaaaaaaaucaaucaggcgugguggugcacgucuguggucccagcuacuugggaggcucaggugggaggcucaggugggaggcuggcuugagcccaggagaucagggcugcagugaaccaugauugcgccacugcacugcagcugugugacagagugaggcccugcaucaaaauaauaaucauaauaaagauaaucugagaagugaggguaaaaguuaaaggaagauuaaaaacaaaaaaaaaaugcuuauaaucccaguacuuugggaggccaaggcaggaggaucgcuugagcccaggaguuugagacuagccugggcaauauagugagaccucgucucugcaaaagaaaacaaaacaacaacaaaaaaagaaaaaacagcugagcaugguggcacaugccuguagucccagccuggccaacauggugaaaccuugucucuaccaaaaauacaaaaauuagccaggcaugguggcuuuugcuuguagucccagcuacucgggaggcugaggugggaggaucgcuugagccugggagguggagguugcggugagcugagaucgugccacuuugcuccagccuggaugacagacugagacccugucucaaaaaaacaaaaacaaaaacaaaucagaauggagcuuauaauaaucacaccguagcuaagacuugggcacugcugaugucccaggugcugugcuagaugcuuccugcauuauuaccuuguuuacuccucacaccaagcugggaagucgguguuaugugguuauucccauuuugcagaugggcaaacacaggcuuagagaggaucgaggucauccugccagcaggugagauuuaacuccaggcaguguggcucuucauugccgcugacccugcuuaaacuggaagaaugauucagaugggagucaucuucccagcuggcuccuaguaagcugaugucauuccuggcauuuaagcugcacccagccccaguguuaggaagacgcgcuagaggagacacauuagauccuuuuugugcugaaugaacuuguugguguuuauaagaagaagacagaacccuaguggcuucaugcuacuccaggaccaaguccagauucucgccagccacccagcgccuguccagcccagcccagcccagcuccagcuccagcucccaggucuucucccuuggccuggccauggggucuucguuugcuuucugugggucccaugaucuuccuuggcugaaagcccucacguccccuguucucucugaucugacaacucucugcccuguugacuuaaauguugcaccuccagcagggugggggccccucuuugcccauuggcaccaucaugucccugcauuccuguuucagguuguuggcacaguuccugucuuccugggguguggugcauucccauuucacugggagauaaugaugaccauuuacagugaucuuuguguauuugcccagcaagcaagaggcagucuaguguagugguuagggugacugcucuugaggccagacugcaugggcuugaacugaucuuucugggcccuggagcugugacccuggggaagguacuuccccacgcugugccucaguuucuucuucuguaaagccuacuuaacucauagggucauuagagaauugagugaguuauuaaaugaaaugauguacuuaaaacuggaccuggggccgggcgugguggcucacaccuguaaucccagcacuuuggaaggcugaggugggcggaucacuugaagucaggaguucaagaccagcuuggccaacauggcaaaaccccaucucuacuaaaaaauacaaaaauuagcugggcgugaugguguacgccuguaaucccagcuacucgggaggcugaggcaggagaauagcuugaacccaggagguggacguugcagugagcugagaucacgccacugcacuccagccugggcgacagagugagacuccaucucaaaaaccaaaaaccaaaaaacaaaaaagcuggaccuggucaagccaucgagugggagaaaauguuugcaaaacacauguuugauaaaagacugggguccaggagauggagagaacuuccgcaacucaagaauaaaaacacagucaacgcaguaaaagaauagauagauaaaggguuugaacagacacgucaccaaagaagauugacagauagccaauaugcaucuggaaaagugcuccccgucaccagccaccugggaaaugcacaugagaagaacagggaaugccccgcagacccaugggaaaggcuggaagauguggugagaauaggacagcugcuacucacucaggcuggagggaugugcagugguguggccccucaggaaaucagcuugguaguuucuuuuaaaaucaaguaaccauccuuccuaugacccagcaauuccaguaaaucuuagauagauuugcucaacagaaguaggaaucuguggcugagcacgguggcucauuccuguaaucccagcacucugggaggcugaggcggacagaucaccugagcucaggaguucaagaccagucuggccaacaugacgaaaccuaaaaauauaaaaauuagcugggcgugguggugcaugccuguaaucccagcuacuugggaggcugaggcaggagaaucacuugaacccgggagguggagguugcaguggcagucaauaucgugccacugcacuccagccuaagcaacagagugauacucugucaaaaagaaagaaaaaaaaaaaguaggaaucuguaagaagacucuuguacaggaauguucauagcagcuucauucauaagagcugguacuuggaaacagcuuggggaccaucaguaggugaauggauacacggacagcaguaauugacaggacggaaugauccugggcagugucaaggaacaaggugccgguacaggaaaucacccgagacucucaaaaccacuaugcugagcaaaccaagacagaccaaaagaguacacacugugugauuucauuucauuucauuuuuuucaaagaugagaucucacucugaugcccaggcugaagugcaguggugcagucauagcucacugcagccucgaacuccuggccuccagugauccuucugccucagccucccaaggagcgaggaccacagguguguaccacuacaccccgcuaauuucacuuuuacaauguucuacagcagacagagcuaaucuguggugguugccucuggggcugugggcaggaguugcuuggggaggagcaggagggauuuucuguuguuaugaaaauauucuuuacagugagagugguuugagauacgcaggugcagcauuugucaaaacucugcauguguacuuuaaauuugugcauuucauggcauguaccuuuuaacuccaaggaaauaaaagaacuauaaauaaauacugaacucuaauuagugaugugugugauuagagggaaaaguacugaugucugcaacuuacuuugaaauguguuaaaaaaagaugauaugguagacugaauaguaguaccaaaaaugucuauauuccaauaccuggaaacugagaauauguucucuuauguggucaaagggaauuugcaggugugauuaaguuaagaaccuugagauggaauuagccuggguuauuugggugggcccagcgugauuaccaggguccuuaugagaaggaggcaggagggucagagucagagagaagugaccauggagguggaaguugcaaugauguggggccaggagccaaggaaugugagcagccucugaaagcugcaaaagccaggaaauugauuuccuccuggagcuucuagagggaaugcagcccugcugacaccuugauuuuagccagugagacccauuuuggaguccuggcauccggaaccacaagauagaaauuugugucguauggaggccgggcgcgguggcucacgccuguaaucccagcacuuugggaggccgagguggacggaucaugaggucaggagaucgagaccacggugaaaccccgucucuacuaaaaauacaaaaaauuagccgggcgugguggcaggcgccuguagucccagcuacucgagaggcugaggcaggagaauggugugaacccggaaggcagagcuugcagugagccgagaucacgccacugcacuccagccugggcgacagagcaagacucugucucaaaaaauaaaaaaaaaaagaaagaaauuugugucguaugaagucccacaguuugugggaauuauuuccagcugcaauuggaaaugaaugcugauggauugcuggauagauagagggauggacggauguggaauaaaacaaguauagacaaaggugggugguggacuguaggcuguggguauacaaguguucacuucaaacuuuacuuggcugggagugggggcccaugccuguaaucucagcacuuugggaggccgaggcggguggaucacuugaggucaggaguucgagaccagucuugccaacauggugaaacuccaucucuacaaaaauacaaaaaauuagcugagcacagugacauaugccuguggucucagccacuugggaggcugaggcaggagaaucgcuugaacccgggagguggagguugcagugaacugaaauugugccacugcacuccggccagggugacagagcaagacucccucucaaaaaauaaaauaaaauaaaguucuuuagauguuucuauguguuugaaacuuuuaauaaugaaauacuggggggaaaugacugggccugauacauaauaaaagcccuacaggccaggcacagugguucacgccuguaaucucagcacuuuaggaggcuaaggcaggaggauugcuugagcccaggaguuugagaccagccuaggcuacauagugagacccccucucuaccaaaaaauagaaaaaaauagccaggcgugguggcccaugccuguggucccagcuaccccggaggcugagggggagaauggcuugagcauggaaggcugaggcugcagugagucgagauugcaccacuacauuccagccugggugacagagcgagacccugccucaaaaauaaauaaauaaauaaauacauacauacauucauacauacccuacauaggugucagccuuuguucucauuggcaucucaucuccauucuuauugccaccacggccacucccccacuuuauccaucagguggagaagaggccugggaagagaagagaccaggggcuggguugguggugagcagacgaaauaauaaacauacaaugaggccauaugacauauugggagaauugcuuucacuuaagaaaaucuaggcugggcgcgguggcucaugccuguaaucccagcacuuuuggaggccgaggcagguggauugccugaggucaggaguuugagaccagccuggccaacaagugaaacccugucucuacuaaaaauacaaaaauuagccaggccugguggugggugccuguaaucccagcugcucaggaggcugaggugggagaaucgcuugaacccggguggcggagguugcggugagccgagauugugccacuucacuccagccugggugacagagcgagacuccgaagugaaggggcuggggcuuuggaacuguagaggcucaucuccccaguaagcugucacuugugaugugguuacagcuguaggcauuugcagagaugggacgagaagacacgccacccugggaacuggcccgugucuucacacguccugcacugcugcugcugagaacgucugcacuuuguuaggggaagagaguguuuuaguuaaauuuaucuggaaaacauauuauuaguauaaugagauuuuaaugauuugaaauuuuguuggagcagcgcagggagaauuucaaucuuaacugugugugcagcugggcauuguuucuauuuuauuuuguuucuuugcuugggccucauugcaaggacauguuucuacaauuauuauuuaguuuuucuuuccuagagcccugcuuuguuacagcucuuaauuuucuuguguagaagaucugcuggagaaaaaagaauauccuuuuuguaaauacuuagcuggcuugaucagaaccagagaaugagcguuguuaccgaaggagacuuguguuuguuuaagguuuacuggcgcacucugugguugccguggaguggacccaacccagauguccguuaacugaugaguggauaagcaaacuaugcuccauccauacgauagaauacuauucagcaacgaaaaggaaugacauauggauccaugcuacaacaugggugaaucuggaaaacaggcucagugagggaagccauuugcaaaaggauaaauacugugugauuccauuuauuugaauaucuagaauaggcaaauugauagagacagaaaguaagauuagugguucccaaagccuggggaagguacagugaccccucauggguacagggauuauuuugggggugacgaaaauguucuuacauugacaauggugaugguuacacagcucugugaauuuacuaaaaaucauugaauuguacacuuauuuauuuauuuauuuauuuauuuugagacggagucuugcucugucgcccaugcuggagugcaguggugcgaucucagcucacugcaagcuccgccucccgggaucacgccauucuccuccuuggccacccgaguagcugggacuacaggugcccgccaccacgccuggcuaauuuuuuguauuuuucguagagacaggguuucaccauguuggccaggauggucucaaucuccugaccccgugauccgucugccucagccucccaaagugcugggauuacaggcguaagccacugcgcccagccgaauuguacacuuuaaaacggcaaauuguauggaaugugaauucugucucaauaaagcugguaaaaaaaauagcgugguacugagaggcagcgcucagagcuugugagauguuuuucuccaguugguauucguugcauguuuccaaggugagaucuuucaccuuggggugagggcggguggauccgggacagacauggaauuuucagucuuccuccuccuccucaucuuccuguucauugccccugcagugguggcagcugucccauaucaaggucucacacuggccaggggcugggcuuggugcuguacgcagauugucuuauuaggacuaugaggcuuuugagauagguaugauaauauguccucauugagcaagugacaauaggaaacccccagaaauugugugcacuguuuugccugaucucacacacuuuggacagagacuuugaucacauucuuaggggcccacaaauggucaaaaaccucugaacugagacagcagcauuuuuugugguuuuuuuuuuuuuuuuugagauggagucucgcucuguugucaaggcuggagugcaauggcccgaucucggcucacuguaagcucugccuccuggguucacgccauucuucugccucagccucccgaguagcugggacuacaggcacccgccacagugccuggcuaauuuuuuguguuuuuaguagagacaggguuucaccguguuagccaggauggucucgaucuccugaccucgugauccgcccgccuaggccucccaaagugcugggauuacaggcgugagccaccacgcccggccuguuuuguauuuuugagauggaaucucgcucugucgcccaggcuggagugcaguggcaugaucuuggcucacugcaaccucugccucccggguucaagugauuuucaugccucagccucuagaguagcuuggacuacaggcaugcaccaccacacccagcugauuuuuguauuuuuaguagagacgggguuuuaccauguuggccaggugggucucaaacuccugaccucaagugauccaccugccuuggccucccaaugugcugggauuacaggcaugagccacugugcuuggcuugggagagcaacuuuuaaacucucuuuuuauuuuggauccaugguaagaaauauauuuccauaaaaaccccaguucaagcauacauuuaccuauauccaugaauaaaaguuucaugaaaugauaucuuccuauaagcacacugacguuugcuacucuacuguucuuucauuucauuaaagaaacgugcuguccaggcaaucucaguacuuugggaggccgaggcaggaggauugcuugagcccggugguuugagaccagccuggucaacauagcaagaccccaucucuacaaaaaauaaaauuagucuggcguuguguugugugccuguggucccagccacaggugccccugcaggggcagggggcuuucaggugggaggaucgcuugagcccaggaguuugaggcugcagugaguuaugauugcaccacugcacuccagccugggugacaaagagagagucucugucuaaauaaauaaauaaauacauacauacauaaaauaugcuagucacaguuuccuaaauggauuuuaugacucauugagucaaaaugauaguuuuaaaauguugcuaagagagauguaaggaggaaaauguguuggugaguguugaggagcccaacuucuuuugagaaaucauuguuggaucuggugucucauguguuacccugggguuucaacuccuguuugcucauucaguuauucauugaucacccugucuuccaggcaugcagucauucauucaaggugauuauugagcuccccuugagagcagguauggggcuggggguuggagauccagugagugguccugcuugagagacuggcccugcccacauggcacuagugggcugggacucucccaucacucuugucuccaucuuguugugcacuguugaugcuccauugaaugaucuuggcaucuuugcugaaaaucaguugaucaucaauguauggauuuauuucugagcuuucaauucuauuauguugaucaacaggucugucuuuauguuaguacuacacugucucuaucacuguagcuuugcaguacguuuugaaauuggcaaauaugacacuucccacuuuguucuucaaccuuguguuggcuauuugggaucccucgagauuccguaugaguuuuagggcgugauuuucuauuucugcaacgagccaccauuggaauuuugggaggaauuguacugaauuugagaauugcuuuggguaguaucuuuaacaacacgaagucugccaguccaugaacauaggaugucuuuccacuuccuuaagucuucuuuaauuucccuucgcaauguuuugugguuuucaggguacgagucucuugccucuccaggcagauuuaucccuggguggcuuaugcuuucggaugcuguugucagugggauuguuguccuugccaguggucgcugagcccagcugcagccuugucuugcacugcagggugucugugucaccuacuugccuaguucuggccacuuuucuugcaggaagucagaaguguacugaucuggaguaggacccuuagcacaacagagcugcuccuuggugcuaggagaugcguccugaggcuggccauccaugucagaggaccuggcgccucacccucaucaugggauaucacugaccaccagugggggaugcaucucugcugggcuuggccugcaagguaggagcugacugcaggagugggaaagagcccauggccccugagggggccuacaguuggcucuccugugguuacuuggcauguuugauagacgccugggucuggcacagagaacacugcccgcugacaaucauugagccucggcaggcuggccccgaugacauguuaucuccccacacagucccuggacacacuugauuaaaggugcuuauuacuuucauaguguuggcuggagugaugugauaacuccacaaaagguucuggcagaaucccagaccuugggguguucccaccagugucucuguguucaaaguucagcacagugugggguggcaggagaugggaacuuggagacugaggccagagucugcugacuugagccucugcugagguccuuaucagugccgggagagcagcagccuaaucucaagaugguuuagaggauuuagcgggggcgugcaugcagaguugagaacuggcuccugggucggugugcgggggguggggauggcccgggggccguagcuacaguuugucuuccuucccccaccggcagaggugaagagagguguuuuguccuggagccaccaggccuauccauggaggagcagagcuucacauggagccugugccccgucuuagucuauuucguguugcuauaaaggaacacuaaggcuggcuaaugcauaaagaaaagagguuuacuuggcuccuguuucugcaggcuguacguggcacuggcaucugguucuggggaggccucaggggcuucuccucauaguggaaggugaagagggagcaagaaagggagaggaaggaggugccaugcucuuuucuaagaaaacagaaacacagcugcauuauuuuaagcaaaacacauauuggcuuaggucgcuguauucaucucccagggcuguggcaccaaggcaccagacacuggguggcucuuugggaggccaaggcaggcagaucacuugaggucaggaguuggaggccaggcuggucaacauggcgaaaccccaucucuacugaaaauaccaaaauuagccgggcaugguggcaugaaccuguaaucccagcuauuugggaggcugaggcaggagaaucacuugaacccaggaggcggaguuugcagugagcugaaauuguacuauugcacuccagcuugggcaacugagccagacuccaucuaaaaaaaauaaaaaauaaaaaacccagcagaaguggauucucucacaguuauggaagccacaagcuucuagggguuagaauuccaacauaucuuuuuuuggggaaagaggggcauaauuccccauagaagagccuguaaucucagggagccuugacccagguauuugacguugguguaaucuacuuguguauguguauugguggacaaaggggauggccucacaucccuucagcaucuugggggugggcggugccuccccuccggcuccccugagucagccccggggaagaccaauuguggggcuggauggugugggaacccccagcuccguccugucuccagccaucagugaggugugcuuggccauuccccacaggaccagugggcgggauggggcagcuuugcaguuggagaggauggggguucaggcaggcagaacagaugcgcggacacagaagagcugugcagaauguggaguugagcuuccuggaaggcccauaggagaggcgagacugaaaucuucuugauacuuuuucacuggggccugaaagccuggugcagaaugaaacugaaagcacuugucucguugagcaaaucauucaacuuuguuauuucuguaauugaaauaauuccuggcauuaauuauguggagagcacucaugaccauguggacauaucuuuugggggcacaugaacugaggguaauaauuucgcucgaauuuuuuuuuugagauggaguccugcugugucgcccaggcuggagugcaguggcgugaucucggcucacugcaaccuccaccuccuggguuccagcaauuuuccugcucuagcuuccccaguagcugggauuacaggugcccaccaccaugcccggauaauuuuuauauuuuuuaauuuuauuuuuauuuauuuauuuuuugagacggagucuugcucugucacucaggcuggagugcaguggcacaaucucagcucacuguaaccuccgccuccaggcuucaagcgauucuccugccucagccucccaaguagcugggaugacaggaguccgccaccaugccuggcuaaucuuuguauuuuuaguagagacaggguuucaccauguuggucaggcuggucucaaacuccugaccucaugauccgccugccucggccucucaaagugcugggauuacaggcaugagccacugugccuggccuaauuuuuguacuuuaggugggauuucaucauguuggccaggcuagucucgagcuacugaucucaggugaucuguccacuuuggccuccuaaaaugcugggauuacaggugugaaccacugcgccuggccuauuucacuccauuuugccgaggagggaacagaaguguggaguccucccagccacauggccucggauccgggcugcagguccaggcuuuccggcuccagggcuggugcccucuguccugugccacuuccccugcaaaaugagaugaaaaugagucucauuuuacgaugaggaaacugaggcccugagagagggugagaaaccaggucucuggcugaaugcaccucucacugaagacaucuccggguggaaauguucugagagcugcugugugugcuggugucagaaugaacaauacccauagugcuuggcguagacaaucagcaaagcuagggacccguuuucuccucccagcccccuuucucacuucaggcccuagacaagaaucggagguccguuucucaaguuuagcuccugucugauuaaauuugagguucguuucucaaguuuagcucuugucugauuaaauuuggauuugcuccacucuuuuucacgggcauaaaaauaucugcggagugaaaaugugugcagaggaugcacugcgugcaggcugcggcucgaggucaaucagauuccuccagcgauaaaaggccugcugaggaagcggccccacucccagcacagccccauugauuggcuuuuauuuuccucuguugcuggagugauccaauuugaagcccuguuucugagcauguugcaaggaacccuaggggcugccauagcccuggagauacuggcuggaaaucaaauucaaauuggugcuuucuuccuauuaaagcaggagaccucugcccgggaacgggccauuugggggcucagccaucuggcacauggagugaguagguuuuauugccaaagccgucccggccuuggccucagccucuguguggcucugguggggagugugucucgauguuguacugugaauaagccccaugccuacuugaguuugggguuucuguuuuaccuacacuuccauauugugggcauguggcugcggaaaugugccugcaccuggacucgcugucacucacuggcuucucgugguacagccuagggaggguugccccagccguauuuaguucuuccugccucagaugaacgggccuccucucccagcuccuaaucaggagggcagagucucguuggcggcucuccuguccugcugccacugccuuuacacuucuucagauaugcggccgucuuaagguguaaaugccuuccucuguuucccagugguuaucuaaagcaaggauuggcaaacagaauccacaccauagauuugagguauguuuguuguccucuuuccuucuuaaacuguuaguaaacaagacauuccuacaggugaccccuuucggccuuuuuuuuuuuuuaagacugaguuucgcucuuguugcccaggcuggagugcaauggcgccaucucagcucacugcaaccuccgccucccggguucaagugauucuccugccucagcuucccaaguagcugggauuacaggugccugccaccaugcuaauuuuguauuuuuaguagagaugggguuucuccauguuggucaggcuggucucgaacuccugaccccaggugauccucccaccucagccuccuaaagugcugggacuacaggugugagccacugcgccuggccaguccugcacucuucaaguuucuauguguugcagacuggugggguagcaauaucaguuagagagacaggacuggggucacuuguccccuguuagcucagugaccuugagcucagcuuagacacauugucucugaacacugugcugauggcaacaccucucucaccugucuugcagucuuauuugaggaauuaaaugcaauaaccugggagaaagugcagguaugaagucagggcacacagcccgucaccaggagcuugaaggaggagaagaguggguggggaugugagcacagaagcugaggcgggggcugagccggguguguauuucugccugugccacagggacaccccuuucaggcacugggcgccuagcuccuguugucucaucuccuaagagagucucgggaggccugagacucccucacugcugcgggcuucaagagcagcaucugugcugaguaacagccaugggggcagaagcagagaucucccgugacagaguaguuaggcagccguaaaaauccuaccaccagcucguggaaaaggucucauuugacaggugccaugccgucaaagacuugugcucugcagcugcaaauucccaacugaaaaauaucaacaauucuuacgaagagagaaggggagcccugcaaagcuguugugucaccccgucuguuuguaggcgcuggggggauugaugaugagguggggacuguucggcuggccacacugccauuguagauagccugugacucuguggcuggcgccuggcuggccucagugaagcccuucagucccagcucugaccaugucucuguggagagacaagcaggugauaguguugggugggcaaggcugugcugguggccugcuuagcaacagcaggaaaaggaaggagauaaccaccccaaccuuucuugcuggaaggagcccuuccuguugucggcgcuguguguaaccaaugaggcgaaugccgggaagcgcuugguuugugucaaugaggggagaggauugugcagaagugcaggaagggaccaugggaggaaauugagugaaggucucuguuagggguuuguguuccccuaaaagguauguccagguccuagucuccagcccuugggacugucaccuuauuuggaaauagggucuuugcagaugugcuuaagacgaggccugucugaaguagggugggccccuaauucaaugugacuggggccuuuauggggagaggaggcaggacacagacagacacgggacacagaggcuggacagagauuggagagaugcugccacaagccaagaugcaccgaggacugauggccaccaccagaaacugggaagaggccaggacggauccucgccuggagcccucagugagagcacggcucugccgacaccuugaucucagacuucuggccuccagaacugggagagaaucgacgucuguuguuuuaagcugccaguuugagguacuuuguuaagguggccacaggaugcgaauacagucaccaucuggccuuugaucuucuaauugccucggcgguucuccugccaguaaggguugugagugaaacuugaaggucacaguuggaaaucaaguuaaaagaauuaagcuggaagugcaacaugagaguccgucacccugagaggcggugugaaugccaaacacaggcaggcagggcuggaccugcauaaauugugguucgacagcaccgggagaaagaaggcccgggccugcucuccucaccugauucugggaaugccgaaccuaccuguguuccugauaucaccccagugcuaacuucccaccccuugaaaaugucaaaacauuguguuaugaauguucuucauugagcaacugcgaucucuuucuguaaagauccagagaauauuucagccucugugagccauccugccucuguaggaaugaaucaacucugccuuggaagcaugaaagccccuauagacaguucauaagcauagccguggcugcgucccccugaagcuacaaaaguagguggggggcugggugugguggcucaugccuguaaucccagcacuuugggaggcugaggcaggcggauugcuugagcccaggaguucaagaccagccugagcaacauagcaagacccugucucuacaacaaauacaaaaauuaguuggguguguuggugcucaccuguagucucagcuacuugggaggcugaggugggaagaucccuugagcucaggagguugaggccacagugaacugugauugugccacugcaccccagccugggagacagagcaaagcccuaucucaaaaaacaaaacaaaacaaaacaaaacacccaaaaagacagguggugggccagauuugcucacuggcugcaguuugccaaucuaugguuuaaaccaacaauuuaaauaacacacacacaucuuuguaugauguuacacaucuuuuuuuuuuuuuuuuuugagauggagucuugcucugucucccaggcuggagugcauuagugugaucucggcucacugcaaccucugccuccuggguucaagcaauuccccuuccucagccucccgaguagcugggauuagaggcauacaccaccucgcccagcuaauuuuuguauuuuuaguagagacaggguuucaccauguuggccaggauggucucgaacuccugcccucaugauccgcccuccuuggcuucccaaagugcugggauuacaggcaugagccaccgcgcccagccugauguuacauuuucuagaaguucucagugaugggcauuuaaaggauucggcugcugcucccuguggcuuucacagcgcugcccugaauggguguuagggcaccguacagguagcggggaugccugggaaagcccagacucacagcaacacaacaacaguuaacagacuccagugaccaaauguguggguuuuuccugcaccaacuggcggauaccagcuggauguccccuaguucaauucaauucaguucugacuccaccuaccuggagauggcaucagaucccacagggugagggcucagucucccaagacucugaacaguggcuguaagucaggguucccacagccccaucuuuggguucaauuaauuugcuagggugacucacagaacucggggaaacauuuacuuauauuuccugguuuauuauaaaggauauuacaaaggauacagaugaggagauacauagggugagguguagggaaaggggugcagagcuuccaugcccucucugggcgugccacuuugccaaaaccaagcauccagucucuggaagcucccugaauccugccuuccugggccuuuuauggagccucauuggauaugcacgauugacagccauguagaaauaggauuggacagcaagggugugaucuaacacuaacagauggacuggggaggcccugcaagaccuaucugugcagccuuccuuccuccaaggugugggggccccucucuggagugagggucucauuacuuacaaucugaugagaguccugccuugggcaggugaaaggagggcagaagguuagagagauucuguuuucugaggcuaaagugccccaacaucuuuuauuauuauuauuauuuuugagacagggcuggaguacagugaugcaaucuuggcucacugcaaccucaccucucgggcucaagugauccucccaccucagccucccuaguagcaggcacuacagccgcgcacuacaacgcuuggcuaacuuuuaaauucuuuuguaaacacaaggucuugcuauguugcccaggcuggucucgaacuccugggcucaagcaauccucccgccuuggccucccaaagugcucagauuacagcaugagcuccucagcuagaagaguuaaacucauagagagaggaaguggaauggcaguugccaggggcagggguugggggcugggcagggaggggacagggaguuaguguuucugccuugcaagaagaaaagaguuuggcggauaacagcgaugguggcacagcagugaauguccuuagugccacugaaccguacacuuaaaaaugguuaaaguagccgggugcgguggcucacaccuguaaucccagcacuuugggaagucgaggugggcaggucaccugaggucaggagucuugagaccagccuggccaacauggugaaacucccucucuacuaaaacuacaaaaauuagccgggugugguggugggcgccuguaaucccagcugcucgggaggcugaggcaggagaaucacuugaacccaggaggcagagguugccgugagccgagauugcgccauugcacuccagccugggcgacaagagugaaacuccaucucaaaaaaaaaaaaaaaaaaaaaagguuaaagugagaaauuuuauguauuuuauguuaaauguaccuuacuacaauugaaagaaugaaaaaaaaauacugggaaauacauuacacauacaaaagaguguacauauguauaguuuacugacuaauauuaaggaaguacccacguuccugcuauccagcuuaagaaauaacauuaccuguuccccgagccauaugccccguaccuccugugcgccucccuccccaccagaggugaccagugccgccuugaacguugcauuuagcauguuguauuaguuagaguucucuggagaaacagaaccaaugggagauauguagcucucucugucucuuuuuuuuuuugagacagagucucacucugucgccaggcuggaauggugugaucucggcucagugcaaccucugacucccugguucaagcaguucuccugccucagccuccccaguagcugagauuacaggcacuggccaccacacccggcuaauuuuuguauuuuuaguagacacgggguuucaccauguuggccaggaugaucucgaucuccugaccucgugauccgcccgccucggccucccaaagugcugggauuacaggcgugagccaccgcgcccagccugucucucugucugucucuauccaucucucucucucucucucucucuauauauauauauauuugaagagauugauuauaaguuauuggcucaugugguuacgagacugagaaaucccaggaucuucaagcuggagacccaggagggccaauggcgucagcccaagugcgggaggagacccacgucccagcugagugaauccccuuacccugccuuucggucuauucaggugucaaauggauuggccgaggccuauccgcacuggggagggccaucuguuguacccagucuaccgauucgaaugcuaaccucaucuagaaacaccuucacaggcacgcccagaauaaugguuagccaagcaccaggccgcuccccacccaguccaggcagcuagucagcaggcccugccccacuugcuugucuuuccuugcguuuugcacacgcaugcaucucugucccucacuuucuuuaguuuugcccgacuuugaccccaauaugacgggagccccaccgugcgugcuguccuaugacucgaguuuacgcaguagccuagcuuuggggcacagccccauuuacuuggggcaccgcugccucugcuguguggccgugugggaucccacaccaggagcaccgucccuuugucaccugggaggggugauucugugccugaguugcauguggauuuccuccugcugaguuuuaauuaagaggcagggagcaggugggugaagggcacacacacggaugcagcguugcccggguucgaauucugccugcgccauuuccugccugcugaaccagaucggacaaauuacucuaccucucugugccacagauuuuuuguuguuguuguuguuuuguuuucauuuugucucguuuuguuuuuguuuuugagacagguucucccucugucacccaggcugguguacaguggugcaaucacggcucacuauagccucgacccugugggcuuaagcaauccucccaccucagccuccugaguagcugggacgacaggcgugcacagccacaccuggcuaauuuuuuaauuauuuguugagaugggguuucacuauguugcccaggguggccucgaaccccugggcucaagugauccuccugccucagcuucccaaagugcugggauuaagugugagccaccucaucuggccuuugugccccaguuuucucaaucagguaaugaugauagcucucagguggugagggugacuguauaaaaugucuggaaauggcaccugcucugugcccagggguuagaggcuugggaccgagcugggggcugagcuggggguggagcugggggcugagcuggggguggagcugggggcugagcuggggguggagcugggggcugagcuggggguggagcugggggcugagcugggggcguuuuuguuccaaggcuuucuugcugauaaguuucucuuucucucucucucuuuuuuuuuuguccugcgugucucaaccugacaaaaaugcucaguuuagaagcgugucguuccauuugugggaaaauuaaacacauuuaagaguaaauuaaauuaggggacuugugaucauuagcuaaguaaauuauuuuuuaaaaaugugauguaccaagcauagcacauguggcacgcucaauaaauauuuguuagaaugaaugauaauuuuaugagccagucgagucauauauaaugggauuauuugguucuagaacuaaugaagugacuguagagcaauaaagcuucuaaaaagaaucuccgugcucgcaaaaaauccaaaagugggggaagaggcucaugcuggauuucacccaagagcgaggcccgaggagagcugggacgcuguguccugagagcuguccaaggggggcccuugugacuuggcaggggugguuuuggagccugaguuuauccgcacucuggguggacugggucucgggggaggccugccuuaggucagcucaggagaccaguggauauagcaggaggcccacuugcaguucacgguuugucuugccagaugugcagggggcccggugucucagcacuuggcaccugugggacugagagaggagucagucuagcaccagacacccgcuuggugggggaggggaguggaagaggagggagaggagagagagggggcuggagccccagucccacagcuuagguccugggaagcccuguggguucaugcuugccuugaggggagguuggacggcucaagcagggaccaggagccucccaguguggcaugagcuuugcuggaagccugggcucuuugagagggguggggcugagagccgcuagaccuggcuucauccuccugccugcuuuccugucugggguguacccugggaagggacauaacuucccugaaccucgguugccuccccuguccaguggaggaaaggaaggcaccugccuaacugggcucuugaaaauaauaaauugagauaauacaaaaucugcauuaauuuccuaggccugacauaaaagaguaccccacacuggcuggcuuacagagcagaaguuuauucucucccagcucugaagaccagaaguccaagaucaaggugucagcagggccuugcuccaucuaaagucuccagggagggauccuuccugacucucuuggcuucuggggacggugggcaguccuggcauaucuugauuuguggccaugucacuccagucagccuccauugucacaggugucccccuucaugccccucugugucuuccuauggucuucucucugcaugucagcauccaaauuucucucucccauguggacaccagcugggcccaccgcaguccaguaugaccucauccgaacuugauuacaucugcaaagacccuguuuccaaauaaggcacauucuccaguuguccaauuccagguggacguggauuuuuuuuuuuuuuuuuuuuuuugagauggagucucacucuguagcccaggcuggagugcaauggcacgaucuuggcucccugcaaccuccuccucccgaguucaagcgacucuccugccucagccuccugaguagcugggauuacaggcaccugccaccacaccuggcuaauuuuuguauuuuuaguaaaaaugggguuucacucuguugcgcaggguggucuugaaccccugagcucaggcaauccaccugccucagccucccaaagugcugggauuacaggcaugagccucugcgcccaucggacguggauuuuggaugagacaccauucaacccacaguaccuggugcucaguuagugacuaaaacccacuaguuauggucacucagucacccuucuuguuauuacuuucauagaugagggugugaugggggggggaaacagaagcagaguugauuguaucuucuuaguucugcacacccuguggcuuuuuuuuuuuuuuuuuuuuuucugagagggagucuugcuguguugcccaggcuggagugcaguggcacgaucucaggucacuacaaccucugcuucucacauuuaagcgauucuucugccucagccuccugaauagcgggcauuacagacauccgccaccacacccagcuaauuuuuguauguuuaguagagacgggguuucacaauguuggccaggcuggucacgaacuccuggcaucaagugauccacccaccucagccucccaaagugcugggauuacagacaugagccucugugcccagccccguggcuaguuauuagacuguucuaggucuugaugggaaaggggaggaggacuuguucuucucuuuggauuaauaaaacaccgugaggcuuguguuugcacagugcccacagcuugcacacugacaagcccuuuuagguugacuucugcugagucauuucauccuguuccauuugucagccauaagguaaggagcaguuuuucugauguacuccuuuugcauaaaugcuacucuccaucagccucgagaaguagaaggcaccgguaugguaucccaagcucauucacaggggagaagagaugccuguugccacaaaaugugaauguuggguguacauucaggugucacguacgugguguugauugucucagcuuaauaaagaaagaugccguacacauuuuccuuuaaaaagucucacuuggcuuguuugacaggcacagaagauguguuauuaaacacuugcaaagccugcugucauuugguuuuaaacagcacucgucgucuuuggcggggcguguuugcucagcaucauggaagggggaugugagguacccagguggcaguuucucuaccacgaugcuuucucugcuugcuaucgggagaaauguucuuuccuauguugugggaaggcggaaagggcacucugaaauguaagguggccuuuuguauuagaauuucauggcugagaccaggcgugggggcucaugucugucauccuagcacuuuggaaggccaaggcagguggaucaccugaggucaggaguuugagaccagccuggccaacaugguaaaaugccaucucuacuaaaaauacaaaaaauuagcugggugugguggcagccaccuguaaucccagcuacuugggaggcugaggcaggagaaucacuugaacccaggagguggagguugcagugagcugagauucugccacugcacuccagccugggcaacagagagagacucuuucuaaaaaaaagaaaagaaaagaauuucaugguugauugucacaggaccaucuuuagucccaagaucugaggcaagggaaucguuuucaauaggaaacuuuuaaauguuugagcagcagaaagggagauugagccagaagaacuugcugguggaaagaugguggaagcugggagcuuugagguucuaaaaauccuggugugucaggucagguaguggggcaaccggagcuuagggugaguuauaccugaugggacuuaacuggguaaaugucaucuaguaacccaacuacauucggcauuaauaucuggacaaaagguggaauacacccggguucuuugggcacaggcgaaggagaggucucauaguuugauguugcucaagaagggaaaacaagcaggaugggaagaggucuaaucagccggcuggaguggggugcuggguuuaguucauuccuucuuaaacucagccaguucucauuauucauggugguuuugaucuauaaaguugccacaaaccccaaguuagccaauacugagccaucacuccuagggcaguacagcgcucgguuccugcgagccucuggucacaacauuuucagcaacagauccauacauaacuuuuucuuauauauguuucuuuuuaaagauacguuauuuaaaauguauuguugauugauuaacauugagcucacggccaacagcaguauaagugcugccugaaugaagcuucucugaccugugcguucucugcaaggcauaccucagccuucuugcacuugggaacacuaggaguaccccucgccacgcguggggacccauuuuaaacagcaaaguuggcugggcacggugacucaugccuguaaucccagcacuuugggaggccgaggcaggcagaucaccugaggucaggaguucgagaccagccuagcuaacauggggaagcccagucucuacuaaaaguacaaaaaaauuagcugggcaugguggugugcuucuguaaucccaccuauucaggaggcugaggcuggagaauugcuugaacccaggaggcagagguugcagugagccgaagucacgucacuguacuccagccugggcaucagagcaagacuucaucucaaaaacaaaacaaaacaaaacaaaacaaaacaaaccaaaacagugaagucaccaacaaauagcagaaaaaugugaaaaacauggcauuaaauagaccaugaaauggacacuuguuuaugaugugagaccucagacaagaaggcagagcgccccguguuugaccucagguggggacacauccggcaacucagauucuuuuuuuuuugaguggagucucacugcgucacccaggcuggagugcaguggugcaaucucggcucacugcaaccucugccuccuggguucaagcaauucuccagccucagccucccgaguagcugagacuauaggugcgcacuaccacacccagcuaauuuuuguaucuuuaguagagacgggguuucaccauauuggucaggcuggucucgaacuccugaccucaggcgauccacccgcuuuggccucccgaagugcugggauuacaggugugagccaccacacccagucagauucuuugcuucugugugcaggucugugaaugaauguaggccaagaguauugauucugagcuuacaaauuuuagccaguagacacauuuacacauacagaauccaugaaucaaggcgauugacuguacuuugacaauuauuuguuuagcacuguaggaggaaccugcaaacuguuccuucccucugcucacauacugcccaggguaagacuucugacaccagaggugcagggaugcuuccugccgcaccuggcaguucuccagcagacaccagcuggguguccugcaguucaguucaauucugacaccaucgaccuggagagagccucagaccccacaggugagggcucagccccacgagacugcaccccaaaucaggguccccacgacugcuuccucgguuuugauuaauuugcugggacucagaacuuggaaaugggccaggcacgguggcucaagccuguaaccccagcacuuugggaggccaaggcagguggauugcuugaggucaggaguucgagaccaaccgggccaacauagugaaaccccaucucuacuaaaaauacaaaaauugguugggcaugguggugggcacuguaaucccagcuacucgggagacugaggcaggagaauugcuugaaccugggagguggugauugcagugagcugagaucgcaccacugcacuccagccugagcaacaagagcaaaacccugucuggaaaaaaaaaaaaaagaacucagggaaacacugcauuugugcucccuggucuauuauaaaggagaugauaaagggugcaggugagcagaacaggaggaggcacacagggugaggccugggagggcccccagcacaggagcuucuguugcccuggaguuggggugugccacccuccuggcaccuggauguguuuacccacccggaagcucucugcacccuguaguucagggauuuuuacggaggcuucaucauguaggcaugucugguuauuaguucaaucuccagccccucuccccuuucuggagggugggguugggggguguggagcugaaagcuccaggcuucuaauugugucugggucuuucuggugcucagcccccacccaggagccaccaagagucaccucauuagaauaaaacauccuuuuaucucccuggaaauuccaagggauuaggaacuuugugucaggaaccagggucaaagacuaaauauuagaacaaaagauuguccuggcaccuggaaauuacaagguucuuaggaucugugugccagggacugguggcagagaccaauaugaauauuucuuuucuuuucuuuuuuuuuuuuugagauggagucucggucugucacccaggcuggagugcaguggugugaucucagcuuacugcaaccuccgccucccggguucaagugauucuccugccucagccuccugaguagcugggacuacaggugugcaccaucaugcugggcuaauuuuuguauuuuuauuagagacgggguuucacuauguuggccaggcuggucucaaacuccugaccucaggugauccaccugucuuggccucccaaaguacugggauuacaggcgugagccaccgcgccuggcccaauaugaauauuucuuauuauuuuacaagcacuugcgguguguccuguggucuccguccucagcgucgugguuuagagggugccugacaggcagggugugggguuagugggguuggggagugauuuccggggcacagugauccccagaguaugugugguuguccaguucacucacuccucguggccugcucggugcuggggguccacacucacagagggcauggucugugccccuugggaucaggcagcugcuccugguacagaugaguugggagaugacuuccuccagggcaugugagaagcucucaaugaccaggccagcucggauucccaguucuggccgagccgaugugcucucuguugccacauuccgugucacuucccaggccuccccggcuucccauucucggggccagguguuccguggauggggugcggugcggccuuugauaccagaggccugggaucgcuuuccuccucgguuucuguguggucaguggcgccuucaccugucucaugcccugccaugcugccaugcaagggcagagggcugguguugggguggugcuggggccuggggaguggaauauccugcucuguuaagaugcuggggaucgcaugugugaugcuggccacgucagccagucuuccuuccugccgagaccaccagcccucggugcagccagccguaucaccugguuauagucacgccgaaacccagcuguuuggaagcguggccguggggccuuggaucccuuuuccuuuccacguguuuuguggagacgaauaacacaggcaugcgccgugcccagguggaggcaauguuaggaaagcaggaaggagcucagagcaggaaauguguguggacucgcguuuguugaagggccuggccgaguuccccagaggcuggggucaguguucaaguucugaugcuucacguccuuggaggccaaaggacgugaccuugaagaaggggcaguucucaccugugggccuaggagaggucguuggccuuaagacauuacuccagguaauuauaugugguuccuaccuauaaucccagcacuuugggaggcagaggcuggaggaucgcuugagcccaggauuuggagaccacccugggcaacaaagugagacuccugucucuacaaacaaaaacaaaaacaaaaacaaacaguuggcuggauaugauggcaugcaccuguagucucagcuacucaggaggcugaggugggaggaucacuugagcccgggagguggaggccacagcaagcugugauggcacuaaugcacuucagccugggugacagagugagacccugucuaacagcaacaacagcagcagaacauuaauccggauaguucuaggaugaggguucucagagcuagaugggccuuugcaaguucuuuccacugauccccagguuugguugauuguaugaaaccaagaggaaauguacaggguuuuugugaagaaaggaaagugucauuucuuuggguuuuacuuugaauggcauuggaugagguccucagagcuuauguggggccagcccagccugccccaugugccccacugagacccuggaaacuuggcuuucucccacugcucccccagugcucacugacuaguuuugggguuuuguggggacccuuugucuaucugcuucgucuuccccagaugaaucaggggacguggugguaccauaguggugcugagggcagcuucuggguggggguucucagaaggagaagucuguccaggaagauuauauuuuauuaccuucucccucaucuuauuuauuuucuguuuuuuuagaggcugggucucuauguugcccaagcuggucucgaacuccugggcucaagcgauccuccugccucggccucccaaagugcugggaugcaggugugagccacuacgcccagccucccaccucuuucuuauuucuuuauuguuuauuucaacagguuuuuggggaacagguguguuuggugacaugaauaagcucuuuaguggugauuugugagauuuuggugcacccaucacccgagcaguguacacugcacccaauauguagucuuuuuaucccucaccuaccucccacccuuuccccaaguccccaaaguccauuguaucauucuuaugccuuuacauccucauagcuuagcuccugcuucugagugagaacauacgauguuugguuuucuauuccugaguuacuucacuuagaauaauggucuccaguuccauuuccauccagguuacugcgaauaucauuauuuuguuccuuuuuauggcugauuaguauuccauggugugugugugugugcauguguguguguguguguguguauacacugaaauuucuuuauccacucauugauugaugggcauuugauugguuccauauauuugcaauugugaauuguggugcuauaaacgugugugaaguauguuuuuugucugaugacuucuuuucccuuggguagauacccaguagucuccuacuucuuuuuaaaggaagccuugcucuuucuuaaaagcugcuaaaaaggaaugagaguggcgcuacagcaaacaucuauugagcgccuacuguguaccagguggguggcuaugguggaaucuaccacuucuuaaaagucaccauccaaguuaccguuuuucugaaauacuuugucuuucaacugagugcuuuguuuuuagugauggccagugaagggcccaauucaaacagaagcagagccgggggauacugaagggccuuucucccugugagccccuuagaacucaggcagaaauauuuuagcaaaaagucgaaucuguacuucucuggcuuuuaauggguuauauugaaaaggauaugaccugccucuaagguuguaacuuacguuuggcucagucuuaauuaucuuaacaaggggugccuccccacccaucauccccauaccuuguauuuaugcauguauugacuuuucucccacuuugauagcuugaaggcagggcugcaguguuucucaccuuggcaccccaggcuugagugaugccuggcacacaguaggugcacggcacacaucugaguugagauccugauacgcacccuguauaagaccuucaacagccugucgaccacucacugccuccguuuccucaucuguuagauagggaugaucauaaggguucuuucuugcuugccuuauggggccuugaugagaaucaaaugaaaugaugacaucagucccuuaauuauuucuccuccuccuccuccuccuccuccuccuccuccuccuccucuuccuccuccaucuccuccucucuucuucuuccuuuuuuuucuucuuucuucuuucuuuuucuucuucuuaggcagggucucacucuguugcccaggcuagagugcagugggauggucauaggcucaagugauccuccugccucagccuccugaauaacuggaacuacagguaugugccauuguaucuggcuaaguuuuuguagagacagggucucacuauguugcuuaggcuggucuccaacuccugggcucgagcgguccuccugccuuggccucccaaugugcugggaguacaggugugaaccacugugccaggccccuuuaauuuauucugaaaauggcgugucaggagcugggucuuggcugccuugcuugcauugugaaauccccuugccuggcagguaggaggcagucgaugcauacagggugagugaaugaaauguuaguuaguugcauuacauugaaguggucuaaaccugacucuaagaugugacuacuaggcugcugauccuuuuaugauuuuucaagugcguaguuauuuuccuuuuaaaagcuaaucacauuuccuuuccugacugauccucuguuauuucugccuccucccccaaggggcugaccaccagccccaggcaucuccuuggccagcucaguggauacacacacgucaggaagacccucccuugccccagccuuccuucguggguggcacuggacacugggcagauggaaaggcccucuccauggagcacugggcuggcgagggccuuccugucugugcccucaugauguccucacuuggcugucgaggcaucuccugggccaugaagugcuguuugcuguccuggccuuggauuccugcaucaagucucccagcaggaaaacuguuaaaccaaaaccaguguugggaacugcaucagagcuggggaccacaucagugcuggggaccuggaucagcauuggggaccuggauuagcccuggggaccugcauuagugcuggggacucgcaucggcauugggugucuuuuuguugcuuccucaaguccuaguuuugacucuggaugaagcuugguuugugccgugggaguggaguguugggggacaggggugaccggcgggugagcccucacuguugauccuggccucgaaugggagaggggcacuagugccccugggagugggccaggcaugucccaguccacugccugccccagagccccgccuggagcaccugcugggucgggacaugggccucccgugggccucaccgcuuccugcuucagcagaacugggauugucaguuaaucgagcaacaccuccaggaagccagccucaggaaagagcuuccacagggaguugggggacugguaauuggaauaaauaaaagcuaaucgugcuuccuggaugccaggaaccacugaaauuuguggauucccacagcagcacaugaggcuggucauuguuaauaaccccuuuuuaccgacgaggaacccagaccagacagagagcccgccugugucaccugguagggaggggcugggccugguguuauaaaccaggagaggguucaggccgaggaaagggggagcaaguugccggccaagguagguaucaugcgaguccuacuucuccccucauucaaggaccuuccuuuggggaagugagugcucccgagagcagccugccgccuccgugucggggcagccucagcuucuucuuucuguguccgauauuugauuucuguugucguggaaacgggguggcaaguguuccauguguuagcauuugguccuccugacguagucggcacacgggagaugcagcugggguggcacgugcccacaguggugccaccucuugccgggggucaggcagaggagacccagcuccgugccagcuugcagacccccaaucacuucuccugucucagggcccagagagcaaaggcagugggaggccaaugucuguuguucaguuuagcucugagccacgugcaucuucagucagcccaggggccugggcgcgcccuuccuuccuucuuugugcauggggguuuuccuggggagcaguugcccuggcccaugaggcugaugggagucaagacagaaauaguggucuguggucagcaaggagcuaucgcuggaaacaccccgguccuuccacagccugacccucugugaccuuccucaaaggcuccccaaagaggcuuucccuugaagugcaagucauaguggcgccccugccacgucccuauaugaacggggugugugcccgccugcccuccgacguccgccggcugugcuggucugcagagcugccgccagcugcacccuccucgccagugaguucuguugcuuucguaucauuuucagcaggagcuaaacccaggccagcccuucuuuucuuuucugcuuuauggcagaauuuuguuuugcaagaauggacccuggguggcugcuugacuuuucccaggaaggugauggggacguugguguuaggacgaugggcaaggggguccagguugucucacugcggccccagagggaugagggucugacuuguggagugaaauuuccagcacucugcugggggcgaguagaucauugggcccagaagaaugggauuuggaacauucucaggcacaugcugcaauuaagauuuucuuuuucauagggguaccugauacuguggguuucucucucucugucuuuuuuuuuucucucugagauggagucuugcucuugucacccaggcuggagugcaauggcgcgaucuuggcucacugcaaccucugccucccagguucaagugauccuccugccucagccucccaaguagcugggauuacaggcucccgccaccgcgccuggcuaauuuuuguauuuuuaguagagacgggguuucaucauguuggccaggcuggucuugaacuccugaccucaggugauccacccaccucggccucccaaaaugcugggauuacaggcaugagccaccgcgcccggccauggguuucucguuaguggucuucgguucuguguuuccccucuaaguagcugaucguggccggugccuggcuuuccccuggucaccacuagauauucugucuugucuuugggaggcagagucaguagaaggugcuuugcacugggcaugccugggagugagcccagccuugcuguuauuagcgcccaucgugacggucggccaggcugcccuauguucgauuuuuccuccugugaaaugggaacaacaguagagcugauguguccugggcuuucugcaucccagggacuaucccagcuccuuaacgugcuuugcucagugcuauccuccuaaaaaguuuucuuuuacaguugaguaagcugaagcccagagagguuaaguaaccugcccaaggucacaccgcagaucggaaugggagucaggaguguacccaacagccuggcucccuagucagugcucucaaccucagcuugaaggccgccucccugggcccugcuaggggacccaguaagaugacaguuauucacauucuccuuuguuucugauaccaagcaaacuccugguaaaugcuccuuccccacuuuuguggaauaaagaaugcacauuuuuuucugagcucugccuggguauccuuaaggagagggacgcugugccugggacgcagaugaacaagauaggagcuguuuccuggaggagcucccaggcugauuuuugccuuugauguucugcaucuuuuucacaggcuuuuuguagauguguggggauauuucuagaggagaaaccagagguggaaggaggggcauaaugaaauugaaugcugggcaucucuuagcucacauuauaugaggcucuucagggacaauagaccuugcaauaaaaggcaaaaaggugauugcgcacagagugcuuuuccugcacagugcugggcgggaugggguggauggggcuuggcggcuggaggaggguagacccugcccgcaccuccugggaccugugcgggacuuugcucaccuugcuguuucuaaccaagguaccagauucucuucacucaggugugucagauuuuaacccuugaggcuagaaccuugccaggcuuauucgaagucagugguuccuaguagucacagggccccugcccuagaccccagaccaggaccccccggccccugcccgcccgccuuggccuggugggguaggagucacugugaaagggguccuggagcccaguaucacuccagcgacauuucccagagagcauccuggggccaguguggggugugggggaacagauacugagcgcucuguccccuccccuuggagaaucucacaguacauuagcagagucaagacucugagaaguccgguaggaaaagacaccugcuuagcuucccuuaacuucacgacuccuccaccuccuugaccuuugcuugauucaugugugaccugugaacgucuaaacugcaggacucacuuugggagauacugauggagaccaaauagguguccugcucauauauccuccacuucuucaguuuugcucaggauccacugggcuuccuaaaaugcaaacgaauugaaaagcugugcugaauguguuuuucucugucugaaaguacagccacccacgaaaggaggaggucugcuaaguuuucuuuuagaaaagggguccccaggcucugaaugcuugaggaccucauugggaucacccccuccauugugggcuacccauccuccacccgcuguggccuauugauaaccucccagccaccaccuaugcuccuagaggcccugacuggaaucccuguccucacccugaguuugucaccuccuuccaaacuucguguccucuguugcaguugaggaccuggaagucaugauugggcugauuagugauggguguuuauuuugaauucuuaacuaaacaaggaggaaucacauccuagcuccguauuuuacuaguuaugggaccuugacuuucccaagaucuacuuuccuugucaguaaaauggcaauaaucgggguaacccauacccugauugcugagaaccccuguaggcguccaugccuggcccaaagccaggacccaggaagggaggcgcagcugggcggccucuucugcgucucugccaguugcuggcuuggauucuaacacccuccuucccucccucccucgcucucuaccagugggaucugagaccaugaaaacguuugaagguuucucaagcgucugugacugccccacgucugucguuggguggaaaggacuuuguaauugaacggagucaguuguaaugugaaugucauguggagcugcuuuuccuuggcaaguccuugcugugugagccauuguuuccagaucuguagaacccucccuacccugucccccuuuccgggcuauugggaggcugagcgagcucaucaugaggccccugaaagauaguuucugugcccuguggagcugaguccccgagucucuguccccaccucacaggcccccucucaccacccuauuggguugguaaauuucaaguugggcaucagauaggacaagggaaggggacuggagaaggaagagccgacaguuugcccucaggacuucagagucacucuuuuuuguuugguugguuuuuugagauggagucuugcccuguugcccaggcuggagugcaguggcgugaucucaucucaccgcaaccuccaucucccggguucaagcgauucuccugccuuagccucccgaguagcugggauuacaagugcaugccaucaugccuagcuaauuuuuguauuuuuaauggagacgggggcuucaccauguuggccagacuugucucgaacuccugaccucaagucauccacccaccuuggccucccaaaguugcugggauuacaggugugaaccaucgcgccuggcccagagucacccuuucuuuuugugccuuauuagacaucuuccugcuacaggauagcccagaagaaaggaacaaguuuccgucaugaauaaguccccuaccuacuagggauguagggauaaaggacuggaacucucuuucuucacccugcagggcaaacuccuucaagacucagcuccaggaagccucucuggacuacuacacucccuccugagcccccagccuucucacauaccucccuuaugugucuccugggugcuggagcccucagagcagggccuguaucuaagucccccuguggcccacccagugccccgugccaggccugaccauaguggaugucacuaagcaguuguucaaugagugaaugaacaaaugcaaacuaggcccaaucuuaucaaauuauacuagaauaauuguauaaaaaaccagacuucuuuaaguggaggaaauuuaaagucagaagugggcugggcacaauggcucacaccuauaaugcuagcacuuugggaggcugaggcgggcggaucaccggaggucagggguucgagaccagccagccuggccaacauagcgaaacccgucucuauuaaaaauaacaaaauuuagcugggcguggcggugcaugcuuguaaucccagcuacucuggaagcugaggcaggagaaucacuugaacccaggaggcagagguugcggugagcggaggucgcgccauuacacucuagccugggcgacagagugagagucagucucaaaaaaaagaagugaaugaauacgaccauaccugcuuuuccagcuccugacucuuaaacgucucgaauaccaaugccaaauaaagggaaccgagagaugaaaggugucacuguccugaucuucagaugcagaaauuucuguguagcugaggagguggggcccgcuugccccccuuugaauuuuggguugugcuugagcagaagcauucauugcuuggagaaagcagaggagaccccagaagcacuucccucugaaagggagaagcagguaggccaaggcagcgguucugggaccagcucuggggccaccugcuuuucccacacugggucuguggugggcucggcagcuggccugcacacaggagauccucaaaacagaugagcgagcaugauugccauuuuuacacucccucauuuaauccgcagcacuggaggaggugugauuaugguguguauuuugugcagccauuugguggacaccuaccgaggacccgccguggggcaggcugcuggcugggcucugaggaugcugacgaggacccuucuuugggauccucuguucggguugaagacaguuuaugaaaacauaagauaacagaauggccgacucugaggcaggagccaggggugugugaguggggguccuggaaggggucucuggaaaccagaggaggagugguccucugaggcuggccaaggcucccagcagagagacgggggcaugggcagaagccugucgugccagugagcccuggcauuucugagccccugaucgguucuguugccugcacgacggccugggugagcaacacugacaggagaccccugccuuaguaccaugucuccugggcucuggcuaguggcgccuccuggcagcagcugcccaggccacacaggaugcuggcuacaugcuuggcuggucuggccaucccugcauggccccgcugucacugguaucuggagaucacacccagccagagccuagugccacccucggaugcuuccuuggggagggaggaugcccuguuuccauggcaacccuaggugggaggccagggcuucaggcaagcugcugagcuuuucacagcccugggagugaggagcagggcaggcugacccuggccuguggggcagaauuaguagaggaggagccccaccaucccugagaagaggaggggagugggguggggaacauuagacaauguucacugccccucccucagcuucccagcugcccacggcagucccaggccaggccagugugggcguggggggcaguuagagcguggccguguggugugccagcacgcagugcaacagccaagacaauggagucauccccugccccugggcccuucccuccaccccaccucaugucugcacuaggugaggaagcagaggacggaggagcccagugggcucugggagcuccugggacuccugagucgguggggacggggcuucccagccucaacacugaggauucuugguuguggagcucuccugagcauugcgggguguugagcggcaucccuggccucuacacacgaggugucaguugugacaacccaaagugucuccagaugccacuacguacccucccaguguggggguggaggaaucguccccaguugagauccgcugagcugagaggcuccccggaagcagguggugaaggaagggaaggcccugggcccuggagacauggaugccugccugggacacacacaaacacgcacgcacaugcacgcaugcauacacucacucauaugcacacauguucaugcaugcacccgcagugacccugaagggacuagacuauuuuuagagcacuuuuaaguucacagcagaauugaguggaaggugcagagauuucccgugacugcacggccccaccacgcacacuaucaacauccucccccucuaacaacguccagaccagagggugcaucugugguaccugguggacccacauggccauaucagggucacccagaguccacaguuuccaugaggggccccucuuggugcuggacauuguguaaggacagggacccccaugguagcagugacacugcccugagauccccgugccccaccugcucaucccugucucccucucacuccuggcaaccucugcuccuuucacugucuccguaguuuugccugccccacagggucgugcaguugggaucacacugucugcagccuuuucagacugguuuuucacucagugagaugcauuuaaguuuccuccacgccuuuucacagcugacggcgcguuucuucuugguuccaaguggcucuuucugcauugucuggacggauccauuuguucccuguuugccucccagaggauccgcugcucuugcugcagauguauagcccaggugcuguggaguugggauggagcagucgagcugggaucagagcccaggccccugcccugagguuggagcucucugacugcaccuggccuaggccugugcauugucuaaacugauggccguggggcaggggaccuggagcgcaaagcaggagaggaugcugaagggggcagguggggccgggacuugggagugucuggaaggaggaccgccugccucaacccagggcuggucuguggaggccagagcgcucagccccucaaugcuaggccuguugugaguuucuccaugagguggcccucucagaaagaguggcuccacagcagcugaguugggggccccauggcagcugagucguggacuccauggccgcugauuugggggaugccuguccuuguagagacugucaccucuaggaauggugaaagggcggccacccgcagcccuguguccucuuucuaguccucugucuuguaagcccgguccccacaguggccccaguccuccccugccagaaauucguucuccucagaaauccguucuccucucugaucuuucaggccuagagacaggcucuucccuccggagggugcagcccagggguucugguaagauacagagcccagccucaacauagcaggaaguuuuuccacaaauacacaguucuucaagaccacaugcagcugugcgugggguguguuuugaagggcaauggcaggagcaguguaugccucguggugcagggagcacgaguuguuuauaggcgugccuggguccugggucucugugcacccuccucuagauucauggggcaucugcccaccgugagauagauaagccagggugccugccccuuucucaggugagaugcugagggccagaaacaugcugcugugucccauggaggagguggccugccccaacuccccugcacccuagggagagugcccacaggcugggggcuggggcuggguccugugcccccuccccagcccucgguauguggcucgcugaggugugcgccggaauguugggcacauccugucugauaccagcuuggcuggaagucgaauuaugaucagaauaucacaugauguguggccugggucccccuuugguugacacucuugaguauggguccugugccugcccggggccaagcagcaggugcaaccgggccugcccuggggcagcauggggugugcuaguguccuggggccacuguaacaaagcaccacaaccugaguggcuuaaacaacagaaacauagucugucacaguuuuggaggcuggaaguccaagaucaaggugucagcugggcugugcucccuccagggcuccgagaggaucccccuuggccucuuccaggcugugguggcucugguguucccugccgugggccacaucacuccagccucugucucccucuucacgugggccuccuucuccgucugugucucuguccucuccucuucuuguaaggacgccugucauuggauuagggcccacccuaaugaccgaaucugcaacuugauuacaucugcaaagacccugcuuccaaauaaggccacagucacagguguugggggccagacuccagugugccuuuuaggggagauacagugcaauacacagcacacagugaggucuuccagauccccagaccuaucuucuuccagaccgccagacaacaccgauaagggugaaguuggcuuacgaguccuggccaggaugugacggggagucgccaggugggugccggggaggugggaagcucugcaggggauuggagaaccacacgucauugcccacaugugacuuuaaaccuuagcaaugauauuggagggggauaguuacucuuuuuuuuucuucugagacagugucucauucugucauccaggcuggugugcaaugguucuagcgauucuccugccucagccucccgaguagcugguauuacaggcaccuaccaugacacucggcuaauuuuuguguuuuuaguugagacggguuuucaccauguuggccaggcugguuucgaacuccugaccucaagugauccgcccaccucagccucccgaagugcugggauuguaggcaggggauauuacucuuuacagcuagggaaacaguugggcuuggugacaugauagagacaccaggucccuugaggacagggggccauuugcagagccgugugguggaaggagccugaauuuggagccccaagcucacagcguggguccuugucacauguccugugagcucuguuugcauccuuagcucaggcaagcuacuguguugaacuggcuggacacagugugucugucucucccucuuccagagaaguccucacuuaagguugugucacuguuuuuacugauguuggaauuggcacuuggagaugugaacuuucccaaggccacacacccagaugagugguuagacccggaccugccuaacuccagcauaucuuuuucagggggacacaauuaaauccacagcauggacugaguuccccucuucucugccaccauccugaccuuuuccuggccaggguuaccaugucggggcaggcaugggggaagugguaagggagguaucuggaccuaguaaaaggcucugguccuccugcuuccucuuguaaggacccugucaaucacaucgggcccccugaauaaccaggcuaaucucccaccccaagguccuuaccuaaucacaucuacaaagucccccucuugccaugugaagucacagguuccugggacuugaugugaacaucuuugcagggaccaugauccagccuuccauagaggcagugacagauggaguagaauauagguccuuugaguauuuauuuauuuaagauggagucucacucugucgcccaggcuggagugcaauggcgagaucucagcucacugcagccucugacuccuggguucaagcgauucuccugccucagccucccaaguaacuaggauuacaggcgcagaccaccaagugcagcuaauuuuuuuguauuuuuaauagagaugagguuuuaccauguuggccaggcuggucucaaacucuugaccuaaggugauccacccgccucggccucccaaagugcugggauaacaggcgugagccaccgcgcccggccccugugaguuuuuacaagagacacugcaguagagagaaugguagaguccucaaacccugauucagucguucaugaauucacugagcacucaacguuucccgcaauguguguccucuucuuugccagccugcuggugugcuccuggugcuugguccaccauagaugggugugcuugguccaggaggcugauggugcugacaucugggcugauauucaccguuuuuagugacuugaaugacguccaugcagaagagcuagugcaccauccuuguguuugaaaaugcccgggcuccagccugagaaccugguaggccaguaauuggagggacaguagcaggaucgagaagccaucugugucacguguucuuggggacaaagaggagacacaggcucaaggaacagcaagguuugugggacacagcugugucugaaaacgucaagcaguuagcucaucccuggcuacuuccugugaacccauuaaauccccaggcugaggaggacagagggugagggaaucugaccccuuacucagcccuuuagccagcggcugcugugcuaagccauucugagaagccaccgguggagaacugacuucaggucgugcugacugugaggccauccaguuguuuuugcacauugaaaacaauacauuacacuuugggaggccgagguggguggaucacuugaggucaggaguucgagaccagccuggccaacauggugaaaccccgucucuacuaaacauacaaaaauuagccgggcaugguggugggcgccuguaaucccagcuacuugggaggcugaggcaggaggaucgcuugaacccaggauguggugguugaagugagccgagauugugccacugcacuccagccugggggacagagcaagacuccuucucaaaaaaaacauuguuccggauuugcuaauaaggaggcaaccuccucagaccuuggugucacaggagaauggcccgcggcagccuuagggccaguugugauuuuauccacaguguuggucagaugcguccucugugcuuguuuaauauucauucugcuugcgugaacaaagccaugucaguuucaguaacgcuugugccagggggcacccgguguggagcagggcucaguaaaacugcugcaaagaauguuccaggcuuuuugaaauuacguggaguugcuggggcucucuugaggcuguuaauuuacuuagggcugcugugacaaaauaccacaaacccagugguuuaaaccaacacaaaucuauuauuuuacaguucuggaggucaggagucccaacaucaagguggcagcagggccgguuccuuccggaggcuccaggggagaaucccauuccuugccuuuuccaacuugcagaggcaccugcguuccuuagugccuggccucuuccucugucuucaaagccaucucccgaucuuucucugucuccuucgccacaccuccucuggcucuggcccuccugcuuccucuuguaaggacccugucaaucacauugggcccccugcauaauccaggcuaaucucccaccccaagguccuuaccuaaucacaucugcaaacucccucuugccaugcaaagucacaguuuccugggacuugauguggacaucuuugcagggaccaagauccagccuuccauagagacagugacagauggaguagaaaguacauccuuugaguuuuuacaggagacacugcaguagagagaaugguagagucccgaaacccugauucauucauucaugaauucaccgaguguucacggagcaccugccucaguccaggcgucauguugggagcaggggagacagagcaggccaugcaucuguccuuucagagcacuguagacgcaaauccuguagcacagaugugccuuagacuaauagugccucgaaaggagaggaaggggaauggaugcggggaguggggaaccugaccugcuuuguggggucauggagugacucuccaccugccgucaucccuccaucccuuguuuggggcuguuccuccaaaggugcagucuccagcagggguguggggaccccugugggccgugaaggccuuucuccuuuucugcugugggcauugcaucuguuccugauggguagaguugucugugcccgguggggcccaaggcagugccauggugguucuuugaguaucucaggugggaacugagcugccagcaccagaggccaauggcuuccagcacuccccaaauccaccugcuuuuggaaggggccugucuccgaagcaggccggguccuccuguugggggaagcuuucauggaggcaucugugucacuucugcaggggagacagccgcuagagggcacuguccuucuggccuuucccacauccccguuuccauggcaggugcauaguaaagccuuucuuuuucuaacgacuuaaugauuuaaucuucuuauuuucucagcagacaacgcuuuggacuucccuggauacauugggacguuaccagucacauuaauuaauacgaguuucacaacuugggaaccagcgaacgugcuucuccagacuuagcuucugcacggccguuucugcuuuccuuuaugaagugcguuucucuaagagccuggcagucucauggggcucgucuguugcuggaagugagcagcggguuccauugccccccgccucgguggggcucauugugcagcuugcuggcaaguggcugggcucggaggggcggugacggugacacacgccaggggaaagguuggcauccucuucugagaauuguuucuuuuggguuucacacccugcccccaccuucugcugccucgaggcucuuuucuucuuauuauuagcuaaugacagauuucaugaccagugacugaaaucauuuggaaguacccccugaaagccagcgugauggguuggagaaaugugacagacgcagccucugaaaaucacagaggcagaggcuugcgucgaaggacuugcuaaggaauuaggaugagaguggucaggaggcaguggcugcugggcacuggagcugagggugaggggccgagaaaacgggaggcaaaugggguagcucuuuuuuggggcgggggaggcuggcuuuggggauguguaucccacugugcaccgcaaggugggggcacugggcgguagguucccgugcuccggaaggguggcaauugaagggaggaauuaaagaaguuggccaggugcggugguucgugccuguaaucccagcacuuugggaggccgaggcagguggaucacuugaaaucaggaguucgagauccaccuggccaacauagugaaaccucaucuguacuaaaaauacaaaaauuagcugggugugguggugcacacuuguaaucccagcuacucaggaggcugaggcaggagaaucgcuugaaucugggagguggagguugcagugagccaagaucgagccacugcacuccagccugggcgacagagcaagaguccgucucaaaaacaaaaacaaaaacaaaaaacaaaaaacaaaaacugacucauguggcuuucagucugagaaaccaaucagaucaucauugucucuaaagaauguguccuccuuuguagacaagaagcucaccggccccuccaugccccgguuucucgcccagguggguuagacggccaaccugacauuuuaccgugcaccuggaagucuuucuuccuguucuccuucccacaaaggauucauuuuucugugguucuaacauuuuccugaucaccccagggacaaaggggaagaaaagaccguguuucugggccaagggaaucaucuguuuaacaugggcuucggagcuuuuuuuacauuucuauguaagcaacuuuucguauucagaagacccaguuucccugagccagauggacuccuuccaucucgggguggucuguauuucagauuccugcagcagguggcuggucggaaugcacaccccaggaggugaggcuggggggauguuggcuccugggcugcuuguacuagcaagucccuaauugcggagcggacuccuuccuccugagcccaucagccucuacguggccacaucaggguaauuggguuccuugugaaacacgacugccaggcuaauguaaaccuuaauggaaacccucuuuuuccacccaauuaaguggcuggaggugggaugcugugugagagccgucaguucaguucccugacuuucucuuguagaaauuaucuauguagcuccauuuggccuacauaagcuuagcauuuguguucauucauucauucauuccacagauauucagagagcaguuauccaugugcuggguuuuaugcaggaugugaggccauggucaugaaugggaccuggccccugugcacuccuugcggggucggggggugcagggagaugagcacaguccacaaucacaugaucggggaauaggguuugucauugucaugugcacggggagcuguggaaacccagaggaggggcccgaacugcacccagggauagaggaugugcagagugugcuuuccagacggugggaaauggguggagcuagcugaccugaagugaagggcauugcagguuguggggacagucgagcagaggggcagagauaugaccuacagaaguggccuggaauggccucaucagacgaugaguguggaagcaugguaacugcagcuguauugaugagaggaggggucugcucauuaacagucaucggguaccacuaugaagguuuugcguuuuacccuggagcuggugggagccauggggugcacugcagcagggagugaccaacgccagcuuuguguauuggaaggauuucuacaucagacaggacucucuugguuugcaaaggacagaaaacccaacucaaaauggcuuaaaagcaaaacagaauucacugguacauuugacagaauggucugugggguuggauggccucagguaaggcuugauccagcacauagaagguguugcuagauccuagauucuguucuccccuuccccgagcucuuucgaucuggugccuucaucuccaggcucuguauagugguaagaugaugggacggcuucaaccuccauccuuucugggucaaggccagugggaaggagugccugucucauucucuauuccugguaaagucucagugcaguucauuagcucuaacugggccaugcccaucccugacuguguuccugggaggccagugugccagcuggcuuuguccugggaugccugcuccaccccagagcugaacuacaaggcccgagcaugguggcaggagggguggcucucucugagggaggcugagucuuguuugccugaaaggaucaauggaugcuggagaagaaaagcaaugguguccauaacagucaccuccagaaggggagaggcugggcuggggugggaagaguuuagggcagggcuugcaggggccaagguggccauccuggugagaaagccccacuggccaauccaagaauagggcacgagaugugagccugccaaggguacucccaggucuggcaucuugguucuuuccgcugcguucuuggcacagacacucaugccagggccuuugcugucacccauagucucagagucauguuauuauucugcagucaucuguggggaugggaccgugcaggacuuucccuccccagcuuccucccuccuucaggguagcucacugugucccccgaggcagccagugcugccgggagaggcccgagacuccuucugggucucagagccauuucuaugguugaacccaguguguguccuucccuguagaauuggcugccacuuuguuuccuuuaggguccccacugcacccuguacauaacccugccaggacaucuguuuauuuuccauucuuguagcuuuauuuuuauuucaaaaggaguacaagaacacagucugguggcagagccucccucugucuccuccuuaccuucagccacugggccuugcaucaguaaugcugcucuugucauucuggagcaugcccuuucauuucuuuuucugugaauuuugauacguacacauagaaauacauaguggugaguuuucuaguuguauuuuuuacauaaauaucaugcuguauuuauuuuaaagugucucaccauguugcccaggcuggacuugaaccccugggcucgagugauccucccaccccagcuccaaguagcugggacaacagauguacaccaccacacccagccuuugcuguauuguucugcaacaugguuuucuuuuucuuuuucuuuuucuuuuuaauuuuuugagacaagaucuggcucugucacccaggcuggagugcaguggcgugaucuuggcucacugcaaccuccgcuucucggcuucaaacuuucuucccagccuccuggguagcugggacuacagauucacaccaccauuccuggcuaauuuuuguauuuuguguagagaugggguuuugccuuguugccccgcuggucucgaacuccugagcucaagccauccaccuaccucagccucccaaaguucugggauuauaggugugagccacugcagcuggcccaaccugcuuuugcuuuuuuaaaaaaucucaacaccaugcuauguauugcacuuaauuaauugugcaucgaauccuucacgagccuucugugccaggugcgaggucggcugcuggguggaagugaccaggauacgucuucccucggcuacacgcagacucuccacggugcaagggcagggccugcccagccccaugcccagcccuuuggcauccauccaccaguguuaguuagaucagcaggcugucaugcccaaggcuugcugccaucugaauaggacaggguuucagcagugagcucuugauguggagucugcgccaccuguugaccuucuuuggauuuaccuuauugaaauguucacacauuucuuuuagcuucucaacuuauuucaucuugagaaaugggcuggaaccucaugccccagcacaacaagccccauaaaucagauguucaagcugagcgauccuuccgguuugggccacagucacggggcuuucuuacuccucuagucaugucagcaccguucagaaacucauccuuggcuuagagaugauagugaguuacauguacauaaauacaccgagcucauuacccugggccggcauccugcaugacaagggcccacauccauuucucggcaaaaacaaacuacaucugccacuugaaacgucaagaagcgcuuucuuguauguugugcuccauggaucacuggaaguccuuucccucuuuucccauguccgggccaggaggagcagcugcucucuggcacuguuagccuuugcugccuuuuauccuaggcaagacacuuuguuauuccuccgauuuguaaucccaagaaccuuggagauuggacuuggaguucguaaccuccuggggagggccaggccucacauuucaaggccuuugcacgcgugaugugccagcaacagcucagcccuuugaauuaugauccgcgacucccuccaaucaccuuccuucuggaugucagaaaagacugcccaacagcaucuccucccagcugccgaggcugaugauguuuuuauucugauuuagaucucacuuaggucuuauuuuaacuccacugagcugcaagaucuucacugaaguacaacuggacuuauuuuuagaaaaacugcucuguuaagaagaccuucgugccugaugaaguuaguuauucugauaaauuacagcuucuacgaagaaaccacaccccucugaguacggauggaaguuggaaaauucauagaaagcugucauuuccuggcagaggccuggaaaaccucauuuaacagagaugucuuuggguuccugcuuaagcccaagcgaaggaucccgaugcccccuccccagcugggaagaggagcugguggcgugaguuggcacagagccgcaccuuucuuucuccuccuguauccucccgcaagcucugaagaccacucuguuucuuugagcaggaucaguuguaacuagaaguggguaggauuugaaaagggcugguuaaguguuuaaaacuggggcagcuuuccugccauuuuccaguucuuuuagaugugcagggauggagaauggcuguuuuuguugggguuuucucuuugauccugguucagacggggcccucugaaauuucucgcccugaucuuuuguucucuaugaaaaccaggaauugcacggaugguguagaaaguccccguagguggcaaagcaucucugcuguguugaaaugacacacuuagaaaagugucagaaaauggaguugccauugcucuggccccccaggaccuguggcucagccuccauugggccuuugugucugggccagacccuccaggcaagcccccagugaggcucuugggcccgugauugcaggggcgccuugccaucccccguguccugcccugguucugcuaguggagcaagaagcugaucagccuuuguguuuucagauuucuucucuccguuaagguaaccuuguucuuuaaaccagcuugcuuucaaaguuguuuuccuaauaauaucaaaagggggaaaaaaagcugccugaaaauccuuuuuugggaaagagccugggcauaaauaaauaaauacaaccauacaaagaagaagauuaaaaaaaaaaaaaucaaagauggaacuuucgcauuuggccugagguauaaauggcaggcuucugaugacaugcuuuuaguuuuugauucucuuucuuuccuuuuauguucuuguaauuccaaaucaggaacgaugguguuuuuuuuuuuuuuuuucuuuuuucuuuuuuuuaaaccuugcccaaucuuuggguggaggcuuuggaagccgcacauauuccaccauuauaguuacucaaagcugacgcuucccgagggguggcugcaugcuggcgacugugccgagggugugugucccugaaucuuugugaucucucugagguguguuaggccccacuuuacagauggaaacugagacacacagagccgucaagcagcuugcccaaggucacacaccuugucaguggucaagcugggauccaaaaccagcagccuggcucugggauucuaagcucucuguugugcugcuccuugaauauauuaaaaggccuacuaugugcaggaacuggguuggcacuggcaggaaggcaaguucgggaaggagauaguuacauggcuguguggcuucagcuggggagaggggaacacccaggagggcuucuuggaggaggcggccaguaagaugagguugaagauagguaggauuuaguagggcacagugaggugcaagaucagguagaacuggcuuuaguccugacucuggggcuucacaucuaacagcacaggaccagccacucccucacagacuuguuuauuuauuauuauuguuauuauuuuugagacagacggagucucgcuguguugcccaggcuggagugaaguggcacaaccuuagcucacugcaaccuccaccucccagguucaagcaauucucaugccucagccgcccaaguagcugggauugcaggcgcccacugccacgccugacuaauguuuguauuuuuaguagagacaggguuucaucauguuggucaggcuggucucgaaguccugaccucaggugauuugcccaccuuggccucccagagugcuggaauuacagguuugagccaccgugcccggccucccucagacuuguuaggagacaaggugaauggcuggcauggaagaugcccugcacauaguaggugcucaggaaacguuaguggugcucucccccuuuccaauggacagucagcaauauggguuggacaaguauguucuguaauccgagguugugugcccucuggcuggcccacaaaauuugaauuaauggcucguauuuauaaauggggagauuccacaccaaaccccacauuuccagcuuuucuugaaaacucagaucuggugacugcagccugcacuucccacucugccaucccgggcugagcgaggagugcccgucuccagagacagugugccaaggggcccuccuccuaucaaaugcccuccugucucucucuuccuaccuggccccccgugcaggccacagagcguggugcugcaggugaacucugcugcggugggaacgaguuggcaucgacucccucguggcuggcugcuggguuucguguggacagagacauucaucuuagaacaaugcagacacuuaggaaaacaagcacaaggcggucuuuuucccuuaaucacccaucucaugaaaucaagccccagucccuuggaagcucacacccuccacacccuccagacacugagagaaugcaugccagcaugccugugccagcgcgccugugccagcacacccgggccagcacacccgggccagcagaucuuucucugugacugaagacagccggcacuucacaucuuugaaggguuugucuuucuggcaaguagaccgguacuuuaaaaaccaaaacauuccugggauucacugaaagccaguaaacuggcaccguucagguggcgggggggucgggggaggggggaagccaagggugugagaggagccccuccuuccaaaaaucacaccgauccucugaaggugacgaucagauccaggcugcaaguucuucugcaaaggagcuguguccauaagggaacccaggcugcaaaauauagcaaggcccagaagggcaucccucaaaccuucaugggguucagcuuuggacaugcuggcugugguuugucuccacugcacucugcaaagagccccgaaggcccuuuccuuagccuggccauauuucaaggccaguucaauugcugccuccuccaggaagcccuccaugcuucucuguggaauaggggaccucgccugccuuguggucacucuuccuccagucugugucucucuuggagccuaaucacagagacccuguacauccacagcugccucucccacuugcagggaguaguuugugggccaugugugggugcucacgguuccccuuauuccucaggaaaugugaggaaguuccugugaggccgguauucccaccaccccauguuacagauggggaaacugaggcuuagugcggugaggggacuuccccgaagccacacaccaacaaguggcaaugcgagauuuggacuggggcucuguggccacaggccugggcuccuccugccaaccgaggggucugccagccugugccccccuccuccugguccccgaagccuuugcuucccucaggccaucgugcauaaccagccccuucagaaugcgcugcugagcagucccugggcgguguucgugagcacguuucucauuuauuaaggucacaaaaucccuggcccuguuuagugucaucuuugauguucaagggcgguguggaaaucucuguuuugauaugacccaauuucuaggcuuucaaaauguggcuucucuccuccucccucucuguguuuuugaaaucaggugagcagggcugccucgaagcguugaccacuugccccgaggucucccuccccaccccucaggcccaggcacaugggugcagugccagcucucgggccuugccaagaggacucucgggcguagcccaccuguguaauccuccacacauagggaaacugggucuuuuguucuuccucugccaucagcgugagcacugcaggcagcugugcuggacgggaccucccugccccuguuguguccuccuaugaugccagccaggacauggaacuuccaccccgacccccugugcuccagggcuaucauauucccaaggauuucugugaaaaaucacuuuucccuguuuccuuucugccuuuuaagacucucugcugguuacaacucucuuuguaacucgucaugugguacaaauacuugcugaaauuuggucccuguuuucucagcugaucugggugaccuguggggguucuucuggauuauuuuuagagagguggggcagagggagucucaaaacucuaugucuguaucauuucccugugaagguauuuaacauuuguccacugcugguguagcguuaugcuaaggauuuuggaaauucaaggaugaguggugccuggaucuucccuuaggaugcuggcuguggguggaggacagugugugcggcagccaggcuggcucgcggcuggaauguggguuaccuggagagggccugcuuuuuuuuuuuuuuuuuuuuugcuauuuaaaaaaauuguuguaaaauaggcauaacguaaacuuuaccaucuuagccauuuucaagagcagaguucacugguauuaaguacguucucauugugcagccaucaccaccacccacccacagaacucuuucaucuuuccaaaccgaaacucugccaucauucaacacuaccucucuauuugcuacuucccccgccccuggcauccaccagacugcuuucuccucuaugcauucgccuacucgagggaccuccuacugguggaauuguacaguguuugacuuucugugucuggcuuauuucacugagcagaacauucucaagguucacccaugcgguagccugguccgaauguccuuccuuuuuagggcuagauaauauuccguuguauacguggacuaccuuuugcuuacucauucaucugguguucucaaaugccaagacucagugacugcagcagugcccgaagguucccucgaaucaaagaacuuccuaaccccaaccuguaccuaggcucugauacuccugcaucaggcaguccucuaggauaaggugccuguuuaaaaugcaaauauauuaccuucgggggaguggguaacuggcauccuggggccccgcugccauuguccuuaugagggagggagguuguguuguccuggaagucggguccacggucacguccugagagucccaucacgugccaugcucugggcuggggacuugauguucauuguuugguuacauuuagcccuuccaaagacccuggcauuuuugcaguguuaccuauaaauuccaugugcggaaacauggguuauuuccacucuuuuuuuugagauggagucucgcucugucaccaggcuggagugcacuggugugaucuuggcucacugcaaccuccgccuccuggguucaagcaauucucccaccucagccuccugaguagcugggacuacaggcgcacgccaccacgcccagcuaauuuuuguauuuuuaguagagacaagguuccaccauguuggccaggauggucucgaucucuugaccucgugauccaccugccucagccucccaaagugcugggauuacaggugugagccaccgcacccgaccuggguuauuucuacuuuugggcuauuuugaguccugcagcuaugaaaaugggaauaaaagaggguccgcuuuuuaagaagcugaauaucggccuuugcugacaugagaggagcuggcauccuugggcccugcugccauuguccuuaugaaggauggagguugugucguccugaaggcuggguccacagacgugucccaagagcccaucaugugccaugcucuggacuggacgcucaacauucaugguuacauucagcccuuccaaaggcccuggcauuuuuacaguguuaccuauaaaugccauauggagaaauaggugcagagaggugagugggauguaccuggggucucacggccagcaugaguggggcccuguuggccugcugcuccaaagccaucaugccacacccccuugcuguuccaucaucugccgcuguggaggcuggauguccagagcuagagguguucaagguucaaggugauucugguguuaaaagaggaaauaccauuuuacuucugaaccuguuucauggagaaagagguacagcuccgggcacacuggccuggguaccuuugcagcaugugaucagggacugcuccccagcggcccuccaccagugccaugaaaguggccagggcccuaccugcacccggcaccauggaugcaucuuggggcuggaaccucgagucuuacaugcagcagaggcugaggcugugacuguggagaaagcgugacauuacagaagcaaggguuuuggcaccuggugucuguguggguggguauuccucccugguggauguggcugaaaggccugcagggucucacuggugcagggagaugaggggucauuucugguucugggauugucccuaaucacugggcguuccagauccuguaacuguucagcacucccuugagacaggaggucaugguguuucugacuuggagccucuggcucucuuuauuagauucuguugcauguuccagccauccugacccggguguuccaucagauuucugugccugugaauguggccaucaccagugaccccacuuuaaacuccagauucaccuguaugcaugaccggaggggguuagcaucuugaguccgugguucaggacgcagccccccggcagagggaaggcagccccacucucucaugccccaucgcugugguccaugcuuugucugccucagcagucuuggucagaucuggaagcaucuggaggcaucuggaagcuuuggugucuuaguuaugaguuucaaagggcagugaaaacagacuggcagagcucagcgagaccugggaaauauuugggguggggaggaacugcagaauguauucuugguucagagcauuuuucccucugacucuuucugggcaacagaccuuuuaggaauguuuguuaaaugcugaaaaaaacaggaauugauuucucucugcguccacagccaacaugugaggccacggcacuccguguauacuaaccugguuuuucuuuccuuuugcucaacagugagugaccugcaggaagaaggcaagaaugccaucaacucaccgaugucccccgcccugguggauguucacccugaagacacccagcuugguacggggguuccuccgcucccugcccugagacaguugagcuuccguggcacuaaguuggucuuggggaggccaaugaggagcccgauagaucuggccucuugaucagaugcugggggcauuugggagucuaaguucuuagcucaaggucaucuuuagaaaaguccauugggaaaagcaaguccuucauuaaggguuucugcccuagucuuaaaacguaaguuuuauuuuucagguggugaagcaaacagauugggagaagacugacuugaaaagauaguuuguuaaacucauaguucugaaaggagguguagcaggccacucagggccaugccaugccacgccaugccacgccacgccacaccaugccaagccacgccacaccauagcacaccaugccacagaaggccacauggaaagcacuagugugaggcagaggcagaaggagcagggcuaaugccuuuauuugauauuuuauguauauauuuuuugagauagagucucacucuguuacccaagcuggggugcggugauaugaucacagcucauggcagccuuuaccguccagguucaagugauccuccugccuuagccuccugaguagcugggacuacaggcaugugccaccccgcccaccuaacuuuuuaauuuauuuguagagauggggucuugccauguugcucagacuggucuccaacuccugggcucaagcaguucuccugccucgguuucccaaagugcagggacuacagauaugagccacugcgccuggccccaacacccuuacuguggcuuucucugaaggaaugggcaaggcugggugaacaggccuaggccuggcuuguuggaaucguuucacugggcuuugcggugcaggagcuguccugagucuucucaguaagaagacucuucuucuuccacaccacguggcguggcgugguaugguguggcguggcguggcauguccccagggccaggggagauuagggugaggauauuggcugggaguguaggagccccgugagagcccaaggaaagagguggcuggggacucugggcucugcggcucaggcucugagugguuuucauaugaaaggugugcucacagagggugguuuaccaucucuaggaauuagcuugcccuggaggugcaaucucuccagagucagcaaggccccgagaugccaagcaccagaaaauacagaaaacagggcgggcacgguggcucacaccuguaaucccagcacuuuggaaggccaaaguggacggaucacuugaguucaggaguuugagaucagccuggccaacauggcgaaaccgcgucucuccuaagaauacaaaaauuagccgaguguggcuagccuguaauuccagcuacucuggaggcugaggcaggagaaucgcuugaacccgggauugggauguugcagugagccgagaucgcaccacugcacuccaaccugggugacagagcgagacaucucaaaguaaaaaaaaaaaaaagaaaaaaagaaaaugcaaaacacaauuaauaugcuucuucccuuugggccagccagagcugcccgcggccugggcuugcagggugggcucugccaaguggcccaggccccugcgcucacugccugauguaauggguaacagccaagacacauuuuccuuaaaguguguuuugggaucuagcugaucuggaaggcauuuauggaacauucugcguauuuccaaacccugguucgaagggaagucccgguucaucccuuuuuugugguuuccgugacgaggccaggccagcaagagcuuauggagaagaaacgccgaugcaaguucagccgccaaccgacccgaagccagagcuggugaugcugccugaggucgcaccaggguccacggggcuuucucucccuccgcuuagaagagaguggccccaccaggcucgguggcucaggccuguaaucucggcacuuugggaggcuguggcagguggaucaccugacgucaggaguucgaaaccagccuggccaacauggcaaaacccugucucuacuaaaaaauacaaaaauuggcugagugugguggcaaacaccugaaauccccgcuaccugggaggcuaagucaggagaaucgcuugaauccaggaggcggagguugcagugagccgagguugcaccacugcgcuccagccugggcaacaagaaugaaacuccaucucauaaaauaauaaaauaaaauaauuagccaggcaugguggcacacgccuauagucccagcuacucaggaggcugaggugggaggauugccugagucugaagaaguugaggcuacagugagccaagaucacaccacugcacucuagccuggguaacagagugagaccuugucucaaaaaauaauaauaauugaacucacucacugaauauuugcacagcaccugauucuuucugaaguccucuuuguauauuucauauccuuugggcucauaaaugucaucauuguagcgaauauuggggguccacugugaaugcuucuacuccucagucccuucagugacccugugagguggguuguaucauuauccccauuguacagauggggaagcugaggcacagaucuaagaucacagagaucacuaguaagugccaaagucuugaaccccgggcauuuugcccccagagcuaggcuccucccccugcucuagacccucucagugaagaugguggcccucaucagaggugaguaggacaggucccuguccuugggcacguuuuauugcagcuggcuaugacgcacaagguggggagggcgggggcucgguucccacaaaacacuggcacagagauaccacccuggccucugggcacugcuucuccucugacugaaguggagagaaaccugaaccaggcccaccuagccuguguggacccagaccugcugaagauucugagcccaugucugaccccccggcacccccuggauggagcagcgcuugcuguacccacuguggugucccgggacugugggcuccucgagggguccugccucagucuuggagccaccgagaggagcauggcacaguuuagcgaccacuaaagucacacagcucagagauggcauggcggcuggugucugcucucagcuuccuuuuaggaaaaacaaggagccucucacagcccuuuucuucucucccagagucccuggaguccuguuccucaaugcaggaugucagaaagucccagggcacuuggcagugaggguuccuggccacccgaagaccuaccaaaugggaguaugcgggcccaggccccucugcuuuaaacaugccugcagugacuccggggcccacugagguuugggaauugcuccccucuaggccgcgugagcagcccguagcagacugagggccaugaugugcaguggccugcggggguuucauguccaggguccccggucaaggcuagcaggucaugaaugcugacaggcagcaagggcugacugugagcucuggagcccccagauacagagguguuucucaucuggagcaagcgccugcucugaaucaggccccugccccgugagacgcagcugcucccuggucugugcagagccucugauucuggccuacugucaccaucaccaggugaccaggagaucccggcgggaucugcagacauggacacacugccacacauagcugccugccuggggccugcuguccacccucucaggcccacuguuccccucuaggcggggucaggaaugaaagcuaccccacggggacagguaaagaccggagaugccucugagaaaguguuugguaacaguaagccucgaaacggcaucucuguccuccaccuuucacagucucugggucagacgccccauuccucucaguggucccgccgacugaggcaggaccccucaagaagcacacaguccugggacauccgagccaccauggcaugcugcccagucuggggucagacgugggcucagagccuucaggagggagcagcgaguucccugugggggccacaugagcugggcgggcccgaaucuugcuucuccucaguucagcgagagcaagguguggggacaugcuagauagggcaaugcugagauuuuuaguguggguugaaggggauguuuccagaaacgggcucucugaaggcugggauuggguagugaccugcucacucuccguccugcacccccucucauacacguguggacucacggccuggcccugcuccuugcccgccugagaugggugguccagagggggucucagacaugggucacacaggcacacaaaguccucuuuggggcuggagagcuuggaagauuuggcauucgggcucaaggaucucagcuggggagcugaggucugaagggugaaggaaacaugggccagggagagagugucagacagcgggagcaggugccaaggcucagggcagguggcagcaaggcuucaaggagugagggaaggccggaugggcuggagcagauugcaccaggagggcaggaaaugaggcgggagaggggccuuggaggccacauggaggacgccggccuugaucccagcaggagugggaggcugcggaggccuuugcagagauaucaucaggacucccgagaacucccugcacauuaccuggaguguccuuuucaggcaucagaucuguaugacuucaaaauuaguuucuccauguugucagaguuuacacucugcugccgggaaguugcaucacauccgugucagcagcaaaguuucacucaaagccauuuucuuucuuucuuuuguauuuuauuuuauuuuauuauuuuauuuauuuuuaaaaauagagacagggauuucacuauguagcccagguuggucuggaacuccugggcucaagcaauccucccgccucagccucccaaagugcugggauuguaggcaggagccacuuacgcucagcuucaaagcuguuuucauucugaccgacauggucaguguccccagccccaugggagccugucugggcucugggacccuggucucaacuguguccuggccaucuccacuuguauguccuggggguaacuggcuucugccuggagccccucuugugccuuuuuuccucuuuaagagagaggugugguauagagccucccggugaguggagccugggccccacccgacccaugcucugugcaggucccggagcuggacaguguggcagccugagacccccuugcccuucccuguguguguucagaggugcucggcgcccgcuggcuucuguguggugcugggcauuucugcuguggagcacgccuagccuuggugggugcccccuccgcagucccgccuccccacugucuccacggcacuguccuccaugacgggcucagcuggcugccuggugucugugggauccaggcugaaacguggagggaaagcaaacagguagagaaauagaaagagggugaggcugaacacguuuugcuguuacacaucauccccccccaccuuuuuuuuugcuauuuauuucucaauauuuuuucugcauguuauuuuacauacaacauugcauauugauucuuuuccauggaauguaccaaacauuuuccauuucauuauaaccauccagacucuucaaauguauuuauaaauaguggccacagggaacuaccuggugccugaagcuuucccacauaccagauuccggccagcggaggcaucucaugcccugugaaugcugcucucuccuuauuucuccugaaaaauggaaaugguuuggaccagcugcuggcggagucugggaggagcgaggccgggcagaaugaugaguuugacuucaucccuuuccagaagaggggaaggcgggaggaugccccauccaccuuccagaaggcgguuccuugcagucacccuccccuagugcuggguucucugcuucuccauuugucagagaugaguuggccucccccugguuccccgugucccugccacccccacaaucgcugaccgugacuuccuuuugucccuggcagaggagaacgaggagcgcacgaugauugaccccacuuccaaggaagaccccaaguucaaggaacuggucaagguaaggagcuccgucuugguuggaaucuuccucuuagggcgaggacuuggcuuugggguucagggcucucauggacaaagggagcuaaacccggggcuccugaaagggauguuggugcugcaugagaaggugggcagacauguuggcagaggaggacggcagagaggauccagcccgaagugccaagcgccucccaugugcccugcucggcuggggcuuuaacgaccagucuugugaacucuuugcuggacagagcucggcaggaggggauuuuaggauuaggaaugagugcuggcgugagcuaguguaguaccuuacagauggaguuggaacuccgucuggagccugguggggucuagauucagauuuaacccugaaaagcaggaggggucacccuggccacuccuggccaggagccaucugaugccgaugccugcgcugaguggacagucaguuuccaccacgucuggaggcgugaaucccagcugggcgaggaaccuggcugccccgcucccagaagucagggaacagugagggaaggggcccauggugcuggccuucuugggcagcggcuguccuucuccagcguggcuccugcucaccgugaggcagugcuuguguggguccaaggacagauugcaguuuugguugcucugaucgaaaccacgguagggcuugagagagaauccccugaagaggagaggcugugggcucugccugaccuuggugaacccagggugggcucuugggcacacggcuguggcagacacuuggcuuccauagcccacggcgagcuugggcaccccgggauucuugaaaaugccgauggugacagugucugccagaaacagacauuuuucuauuaaaagugcuuuuuaaaaagcuucuccaccuucaccaccacaguggacccaaugcugggcuguacaacuguguuuucaugagggcucauucagaauaaguaagacggcuugcaaguuauguucuuuuaaaaucuacauugaggcugggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgagguggcgggcaccuguagucccagcuacucaaaaggcugaggcaggagaauggcaugaaccccggggggcggagccugcagugagccgagaucgcgccacugcacuccaaccugggcgacagcgaggcuccgucucaaaaaaaaauaaaaaauaaaaaauaaaauauaaaauaaaauaaaauaaaaucuacauugagaccgggcgcaguggcucaugccuguaaucccaguacuuugggaggccaaggcagguggaucaccugaggugaggaguucgagaccagccuggucaacauggugaaacccugucucuacuaaaaauacaaaaaauuugccgggcaugguggugggugccuauaauccuaccuacucgggaggcugaggcagaauugcuugaaccugagaggcagauguugcguugagccgagaucucgccacugcacuccagccugggcaccaagaguaaaacuccaucucacagaaaaaaaaaaaaaagaaauuccaaaugucaguuuuaggguccacccaaagauguugauuauuaauaacuuaaauuauuuaauuuguuuuauuuuuucccucugaauacccacuuuguuauuucaaacagaagaacguugaugaggaaagucacugucuuuuagccacgaaaauguuguucuugggggauauuuaagcaagggaugcaugagaauuaucaggcuucuacaaagaaacagacccaauugugucaauaucuagagagagguuuauuaugauauuggcucacuugacuacggaggcugagaagucccccgaccugccaucugcaagcuagaaagcuggagggccagugguagagaugccagccugcgucugcagcccugaguaccgggaacagggugggagaagauccaggugcuggcacuagcaguccccggcagagagaggugaaucccaacuuccuccaccuuuuuguucuaugggaucagaugaggcccacccgcuuuggggagggcugucugcuuuacucuauccaccaauucaaaugcucaucuccucugaacaccauuccagacacacccagaaacaauguuucauuggcuaucugggcaccccagagcccaggcaaguugacacagaagaugaaccaucccaugcaccuuucuaaagauuuuuuucuuugauuuuugagcaaugcuugagaguucacaaacuccauucacaggauuaucuccuugaaacaacacccuggggagcugugucauucuugcuuccauguggagacucagagagaggugaaggggcugggcgccauggcucacaccugaaaucccagcgcccugggaggccaagguuggggggaaucacuugagcccaggaguucaagaccagccugggcaacauggugaaacccugucucuaccaaaaaaaaaaaaauuaacuggguguggugggaggcaccuguaauccuagcuaugcaggaggcugaggugggaggauugcuugagccccggaggucaagggugcaaugagcuaagauuaugccugugaauagccacugcacucuagccugggugacagagcaagacccugucucaaaaaaaaagacagguuuaaguaacuccccacccccaggugcugggguuagugaugugucugggcuugaauggcucuguccauuuggugcuguguucacugagccaaguugagugcgugugggguccugugcugggcccugggauucggggauggauaagugacuucccugcuaugcaggauuugauuuauguuccuccuggaugucugcagugccacccaccccugccuuugcugcuuugcugccaaagacccccaggcuguuuuggccuugguggggcgagggcuggcugcugcaugucuuccagguuucagauugagaagaaggccacauugaggggcaugggguggacugaugggaaagcuaauuagcauccuuuggggcaaaguacaacuauggggcaaaauacaacuaagaacaggaaggagcugaggaauaaaugccucuccccgacuucccugaugugggcuucugagaccauggcucauggagaugggcugcauggcugaucaucagcuggguuuucuucugaagccauagccagcucaugcaccugccucaccucccuuccccucccuguugcucgucuagggugcccuccccucacccccaaaccccugccaaagaaaaggcaucagcagugagcuuuguccuggcucuguuuuucagggaaccugggccagaaucaugguccccaaagaugaccaugugauaaucccuggagccauugacuaucaucuuacauggcaaagggacaugguggguguaguuagugaccuugcaaugaggaggucauccuggaugauccaggcgggcccaguguguucgcuagugucuguauaagagggacauggggagcuuugacugcccaugaacauggcagcuugacccuggaggcaaggugguagcuucuggcucugaagauggaagaaggggccaugcacuaauggaugcaggcggccucugccucuagaaguggaaaagacaaagaaauggauucuccacuagagaacccagaaggaacccuggagccuccagaaggaaccagcccugcugacaccuggauuuuagcccaguggaacagauuuuggacuuugaccucuaggacugcaagagaauccacugagccguuggaagccccuggguuuguguuaauuuguuacaguagccacaagcaacuaacaccauccuguucuccaggcugcugccuccagcugcagcuggcgugcccuggccacuggggccaggcaggguggguuuugauaccugcagcggcagcauccuuggccauuuccuggaagggccaguugccagacacugagaugccuguuacugcaacugucccaccagccuggagcacguguuucuggagacaggcaaauucuggaaggcuccaccugcucucagacugcagguugcgucucaaagcaggcuggcagacauuuuccacucuugaucaaucauuuuccaaaauaagcauagacacagcaacccggagagcagcuucgguuuggcugucgguggcguguuaguuacuguagugguggcacagaggcgauauacguuaaauauuaguucucacugacuauagccuuuuaaacagagcagcguguggguggcagcaggugaguuggcuauacugagcuugggcugcccuugguugauucuuguuugucaggcaugcagggggcucucugugcguccaggcauauucccugucuggauuugcuuguguucauggauuuucagcaccuccuuucuucugguuugggaaugagucagguccucacuacacaaggccagagcaguaugcguguguggguaggggugagcaggugucauucccugccuccccuccuccuucacugccccagccacccugaccaccuugcuguucugaggacacacugagccagugcccacugggcaucaggugaaaggggacaucccacaagcccacccucacuucugacaccaauggcaaguucaggaucuccaacacugcccugagguuuggucauuugcuagagggacucccagaacccacuuaaagcugucacccucacaguuacaguuucugauggugaagggauacacaugaaaaucagccgagggaagaguugcccagggcagaguugaacgcacccacacagcaccuccauuguccuuucaccauggggucauaggcagcguuacucucccggugaugugggacaaugcgcaugcaguauugccagccggggaggucaucugagccuccguguccagaguuucugcuggagcucacuugcauggguguggcugacuguccacauggcucaucugucuccagccccuccagcagcuggcugauagagugcaacccaaagcccccucccugaaugacauaguuacucccuggcuggcccgagggccccagguaagcagagguacuuuaucuggcagggcauuucggagcuuaggagaucaccucccaggggcugaggucacaggcccaaccucucugugggcaagguuagguucauuaucacguaccuggucuuuggacuuucaaaggcccaugccuggagcugucuucaacacuucuuucaguuuucucucaaugcuuccuccuuggagacguauuuccugccccugucacuccaucacucuccuccuaaccccaguuacuuuuucuuugcugggcuugcugcugccuggagucauuuccuauuuacuaguuuguuuuuggucuuucuccuccccuagaauguaaucuuaugcugugagggaccaugaccauucucuucccagcuaaauccccagggcuggaguugugcugcacaugcagagcuaauucauccuugauagauaguaagagaaccgaugggggucugugucagcagcaccaacaugagguucacaccagcgucucccaagauggcaugcggcuuagagacaagacagaugugguugcuuuuuguuguuguuguuuuguguuguuguuuugagauagggucuuacucuaucacucuaucacccaggcuggagugcaguggcaugaucucagcuuacugcaaccucugccucccaggcucaagugagucuccugccucagccucccaaguaaaugggauuauagguaugcaccaugaugcccggcuaauuuuuuguauuuuuaguagagagggggcuucaccauguuggccaggcuggucucaaacuccugaccucaagugaucugccugucuuggccucccaaagagcugggcuuacaggcgugagccauugcaugcccagccagauguguuuuuuuuuuuuuuuuuuuuuuuuuuugcucuaccccaaaccugugagauggcagggaggaggcucugggaagagggggugaggguugggguaaaccuguggauuggaugcugauguagguggucccaggugcucccuugggaggagauggacaguccggauggugcagacaaaacaccuccauccacauuaccugcguaauucucuuugcuuuccagaacauccuuuguguacuguggacugugaugaucuaaugcuaguggauuacaucuaaguaggccuuaguagaagccaccucccagugguuccucggaggcauuugguccagaagcagaugauuuuagugcaaagcacagaccguaugcaggccugagcagaucaggggacagacagaucuggcugacauccugauccgcuggcuguggugguguggccauugcuuguagccacauugcagucuugaaugucccccuuggaaaugggggacauuuccaaggaugccugccugguccucuaguuuucucuuucucuguucucugucaucugcacuuuuuuccucuugucuugauugcuuguccugucuccccuaguagacacccccucugaccucugcugccucaggacuguugcuguauaaaauauugugagaugcccucugcuccuguuuaaaaaaaaaaaaaauccuuagcucuggguaagcuaggcacugagaaugaggccagucauucaaaacuugucucugagcauugauuauacucauguauuauacuguuaaggggugaaggucggcucuagggucagcuuccuggauuuaaaucccaacucagauuaaagugggagaauaauagcaccaacgugacaaccucaaagugucauuuguaaggauaauguuagaucauacacuugaucacccguuagcaguguaagggcagugugggaacaugagcaugaacagggcagcccagaagggaguugaauggacagaugggcaaugccaguuuggaagugggugcaugcauccgguggguucaggagccuggaagacuuauccaaaagucaucuuugcugguguuucuuccuguguauuuucucuaaccuucuccagcagugaccugaauuacuuaugggugaacacugaaugcugcccaggcaacuagagguuuauagaugagauacuuuaaauuuuuaaugauucuuaaaagagggaguggcuauucuuaugcuuuccagaaugaauagccaagggaaaccuguacaguugccauauaaggagaaaccuagaccuggccuuagccucuagguccuggugcagauucuuagcacguagcgccuaaaaccuuugcgauuuccugagugauaggagcgucuuuuguuauucauaaugagaucuggguuuaugcuaacgaggugacucagggugggggcuggccccagaguaaccaacacaggauuagaggguugggucuaucaguccuacccacccccagccucugggugggguggagaggggcuggagagugaaucaaaucaccaauagccaaugauguaaucagucacacuuacauaaugaauccuccgcaaaacccaucaacagugggguucagagagcuuuggcgcugggaaacacacauggaggugcuggagggggacacgcagggagagggcauggaagccccgccucccuccccgaaaacucuguccugugcaguguuucuuauuaauuacacugucccugaguucuuuuuuuuuuuuugagacggagucucacacugucggccaggcuacagugcaguggugcaaucucagcucacugcaaccucugccucccggguucaagcgauucuccugccucagccucccaaguagcugggauuacaggcgcccgccacuacgcccagcuaauuuuuuguauuuuaguagagaugggguuugaccauauugcccuggcugguugcgaacuccugagcucaggcaaucugccugccucagccucccaaaguacugggauuacaggcaugagccaccaccacgccuggccugcugugccugaguucuaaccuuuauaguaaguugguaauccucaguaaaaugcuuuucugagcucuguguguucugccaaaucacugaaccugaggugagggcccugauuuguaaucagugggaagaggcucaaguagccugggagccccaucugcagcuggugucuggaaugaagucaauuuggugggacugagcccucagccuguggggucaacuguagcuaguguuagaaucagacugaacucuaggacaccccauugguaucagauaaucagagaauugcuguuggaauuuucaugugcguccgugugaagagaccaccaaacaggcuuugugugagcaacauggcuguuuauuucaccugggugcaggcgggcugaguccgaaaagacagucagcgaagggagauagggguggggccguuuuauaggauuugggaagguaauggaaaauuacagucaaaggggguuguucucuggugggcagggguggaucucacaaaguacauucucaaggguggggagaauuacaaagaaccuucuuaagggugggggagauuacaaaguauauugaucaguuaggguggggcaggaacaaaucacaaugcuggaaugucaucaguuaaggcuguuuuuacuucuuuuguggaucuucaguuaauuuaggccaucuggauguauacgugcaagucacaggggaugcgauggccuggccugggcucagaggccugacaggaaugacacguugggugucagaaaaaaaacacagaaaacucccuaagcagauugguugaaagcaggcugacugcaugucaucugggggugcgucuccccccaagagcagguuucacaucucauuccccgguugauuggacaagacccuuccugucuuuaaguucuguuuucuuccucccuuugucucuccgaagaaaaucagcugcaugaaaacgauccucugggcagaaauuggugcuguuggagccgcacagaggugcccucccgugcccccuggcccccaccgggccgugucuccuccugccuguugcaaucagcccucguccgacucuuuuuggaagugauuaaaacauaacugucauagcucugggggagacaggcugcagauccugauuauaauucagaaggaucuaaagaaaaaguaauuuuuuaaaaaaauucugguuaaagccaaagcucauaagacgugugugauggagugguaugcaagagcacaauuaauguauguccuagacaucugcccacaggauucagggcuggcaaaugagugcgucccuaaaaauaaugacuagugcuaucuuuaaaaagucuuuuguggcauagcagauuaagauggauggccugggaaguacaguggcagcgugugcugugguauccaggaauaaguuguaccuccucgggguggcaguggaacugggccgugaacagcuuuugcuucccagagaggacugccauggccugcugcauggaauuugauuuuaaucuguuuguuauuuuuggguuuggucuuggacuggguuugaaauccagaugugacuuuuuuuuuucuuuuuucaguuuucuuuauagcagcaauguuguaucuuguguguuuccuaacaagacugagcucugagcaaggcagccucuggaaccaaaugucugcaggcccaggagaccuuucuagaaaguucauaggugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaagaaaguucauaggcgguucugcaguuugagccccuucugugggucugugccugcuuuagccgcuugagauauggcauugaacaaaacacaggccccgccugggagaagcugccaggccagcuggggagacagaccugauaagugaaaaugagaucgcguggccugcaugcuccgaagaagacuaaggcaggaaacaggacuauuuucucccgacugaauuguccugguauccuuguuaauaucaguugacugugacuugagacuuaucuuggacaccccuuucuguuccgugggucugugucugccuugaugucagucccacaguuucgacgacuggagcuuuguagucaggugugaaacaguggaguguggguccuccaguuuuguucaucuuuuucagauuguuuuggcaauccaggaguccuuugaauuuacauaugcauuuuauuuuauuuuaauuauuaauauuauuauuauuuuuuagauggagucuugcucuguugcuggagugcacuggugcaaucucggcucacugcaaccucugccucccagguuccagagauucuccugccucagccucucgaguagcuggaauuacaggcaugcaccaccaugcccagcuaauuuuuguauuuucaguagagacaggguuucaccauguuggccaggcuggucucaaucuccugaccuuaagugauccaccagccucggccucccagagugcugggauuacaggcgugagccauugcgcccggccuauauaugcauuuaagaccugcuugucaaguucuuuagaagccaucuggauagugauuaauuuguaaaaaugauacuuauuaucuuuuugaacugccaaaguaauauaugcugcugaaaaccuggaagacagaaaaauccaauagaaggcagggcuaauuuuuuuuuuuuuuccauguaugucccuucaggcuucucuguguuuuucauuuuuccuacacaaauuuggaaucauuccagagcuaguaagcaucuagggccacauuuggacuaguaccuugggauaaauuagagcuggaauugccgggucauauagugugcacagggcuagggacugacuuauuuuccuuucugaaugaagacucugaggucuagagagguuaaaugagugacucaaggucacacagcuaaaacucugguggagcugggucuuaaugcagacccuacauauucaugccaugcuguauuuauacaggcauguacaccagcgggucgggauuuuaggggguguuuuaaaauucugccugcaaaaccuuuuuuuuuuuuuuuuuuuuuuuuuuuuuuuuuuugagacagggucuugcucuguugcccaggcuggagugcagugucaccaucacagcucacugcagcuuccucccaggcucaagcaauccuccugccucagaccccugaguagcugggacuacaggugugcacugccccaccuggcuaauuuuuaauuuuuuuuguagagauggggucucauuuuguugcccaggguagucucaaacuccugggcucaaacacucauccugcaucagccucccaaagugcuaggauugcaggugugagccgcugccccaggcaaacccauuuuaaagccaugagccaaaaauuauaaaagacaugcaaaauauuaugaguagucacuuaucuaguauuugcggcaucucucaggcuuggggcuuugcugggagcucugaggggguggaagaggcucugucacuggccuuaccuggcugucaagggcugaguguuugguggagggaagacgucugcagccugggaggcugcgggucagaaggaggucagccggggagcugggaggaucguggggaacccgugguggaaaucagcauggcgagagaguggaagcaggcagaggagggcuuugaagaccaaaaaggguaguuaggauugcugcucugugugucuguaaacuugguguugucucucgaauuuaaaugacaugcuuugaaaacaaaaaaacaaacaaaaaccaaacccauaaaaucucacuaaguggccagagcaaguucccgggggguggcgcauagaugcagcggucuggguucuguggcugggggaguuggcuugggguccguggcugggucagucuucaagagccacccuggguggcacuccaggucucuuggucuggggggaauacccugaccccagcgguuucacggccuccuccccacucagccugggggagaguccagggucggcccugucccccuccccccacuccugucacuaucaguccccugugcucagcuuacuggcaggguuccuccuggcuguccccucugccuccagcgcucuuuccucagguguccacgcagcucguccucacccuuuucugucucugcucagaugccgccugaggcucccaaaacagggucucacucugucacccaggguggagugcaguggugcaaucacagcucacugcauccuugaccucccaggcucaagcgauccuccugccagcgagcuuguuacaauuccugcaccaacacggauacauuguuacuaacuaaggcccuacaccagcaaagauacauuguuacuaaguaaggcccugcaccaacacagauacauuguuacuaaguaaggcccugcaccaacacagauacauuguuacuaacuaaggcccugcaccaacacagauacguuguuacuaaguaaggcccugcaccaacacagauacguuguuacuaaauaaggcccuguaccaacacagauacauuguuacuaacuaaggcccugcaccaacacagauacguuguuacuaaguaaggcccugcaccaacacagauacauuguuacuaacuaaggcccugcaccagcacagauacauuguuacuaaggcccuacaccagcacagauacauuguuacuaaggcccugcaccaacacagauacguuguuacuaaguaaggcccugcaccaacacagauacauuguuacuaaguaaggcccugcaccagcacagauacauuguuacuaaggcccuacaccagcacagauacauuguuacuaacuaaggcccugcaccaacacagauacguuguuacuaaguaaggcccugcaccaacacagauacauuguuacuaacuaaggcccugcaccaacacagauacauuguuacuaaggcccugcaccaacacagauacauuguuacuaacuaaggcccugcaccaacacagauacguuguuacuaaguaaggcccugcaccaacacagauacauuguuacuaaauaaggcccuguaccaacacagauacauuguuacuaacuaaggcccugcaccaacacagauacguuguuacuaaguaaggcccuguaccaacacagauacauuguuacuaacuaaggcccugcaccaacacagauacguuguuacuaaguaaggcccugcaccaacacagauacauuguuacuaacuaaggcccugcaccaacacagauacauuguuacuaaggcccugcaccaacacagauacauuguuacuaaguaaggcccugcaccaacacagauacauuguuacuaacuaaggcccugcaccaacacaaauacguucuuacuaaguaaggcccugcaccaacacagauacauuguuacuaacuaaggcccuguaccaacacagauacguuguuacuaaguaaggcccugcaccaacacagauacauuguuacuaaggcccugcaccaacacagauacauuguuacuaaguaaggcccugcaccaacacagauacauuguuacuaacuaaggcccugcaccagcacagauauauuguuacuaaggcccugcaccaacacagauacauuguuacuaacuaaggcccugcaccaacacagauauguuguuacuaaggcccugcaccaacacagauacauuguuacuaaguaaggcccugcaccaacacagauacauuguuacuaacuaaggcccugcaccaacacagauacguuguuacuaaguauggcccugcaccaacacagauacauuguuacuaaggcccugcaccaacacagauacauuguuacuaaguaaggcccugcaccaacacagauacauuguuacuaacuaaggcccugcaccaacacagauacauuguuacuaaggcccuacaccagaauggauacauuguacauuguuacuaaagccuugcaccaacauggacacaucauuacuaacuaaggcccugcaccaacacagauacauuguuacuaaggcccugcaccaacacagauacauuguuacuaaguaaggcccugcaccaacacagauacauuguuacuaacuaaggcccugcaccagcacagauauauuguuacuaaggcccuguaccaacacagauacauuguuacuaacuaaggcccugcaccaacacagauauguuguuacuaaggcccugcaccaacacagauacauuguuacuaaggcccugcaccaacacagauacauuguuacuaaguaaggcccugcaccaacacagauacguuguuacuaacuaaggcccugcaccaacacagauacguuguuacuaaguaaggcccugcaccaacacagauacauuguuacuaaggcccugcaccaacacagauacauuguuacuaaguaaggcccugcaccaacacagaugcauuguuacuaacuaaggcccuguaccaacacagauacauuguuacuagcuaaggcccugcaccaacacagauacauuguuacuaaguaaggcccuguaccaacacagauauauuguuacuaacuaaggcccugcaccaacacagauacguuguuacuaaguaaggcccugcaccaacacagauacauuguuacuaaggcccugcaccaacacagauacauuguuacuaaguaaggcccugcaccaacacagauacauuguuacuaacuaaggcccugcaccagaacggauacauuguuacuaaguaaggcccugcaccaacacagauacacuguuacuaacuaaggcccuguaccaacacagauacuuuguuacuaaguaaggcccugcaccaacacagauacauuguuacuaacuaaggcccuacaccaacacagauacauuguuacuaaguaaggcccugcaccaacacagauacauuguuacuaacuaaggcccugcaccagaacggauacauuguuacuaaguaaggcccugcaccaacacagauacauuguuacuaacuaaggcccuacagcaacacagauacauuguuauuaacuaaggcccugcaccaacacagauacauuguuacuaaguaaggcccugcaccaacacagauacauuguuacuaacuaaggcccugcaccagaacggauacauuguuacuaaguaaggcccugcaccaacacagauacauuguuacuaacuaaggcccuacagcaacacagauacauuguuauuaacuaaggcccugcaccaacacagauacauuguuacuaacuaaggcccugcaccagaacggauacauuguuacuaaguaaggcccugcaccaacacagauacauuguuacuaacuaaggcccuacagcaacacagauacauuguuauuaacuaaggcccugcaccaacacagauacauuguuaguaacuaaggcccugcaccaacacagauacauuguuacuaaggcccuacaccagaauggauacauuguacauuguuacuaaagccuugcaccaacauggacacaucauuacuaacuaaggcccugcaccaacacagauacauuguuacuaaguaaggcccugcaccaacacagauacauuguuacuaaguaaggcccugcaccaacacggauacaucccauuacuaacuauggaggugcuuuauucagauauccucagugucaccuguucuccuuuggccgucucaggguuccucccaggacaccacauugcauucaguccugaggcuucucugggcucugacaguuucucagacuuuccuuguuucuguugaccuugacaguuuugaggauuacugcucagagaguuuguagacugucccucuguugggguuugucugaugcuuucuucaugauucgaucagguugucacuuuggggaggaagucugugaggucaagugccauuuucaucgcauaucggggcacacccaucugcacaccuucgcuauuggcgucggucgucaucaccugugcaggcgugcucacccgguuucuccacuggauccagcuuuauuuuccuuucuaucaaccaucacaaccugaaacugugggcguccgugugucucuuggagucuaguagaauguaaggcccucaaggcagaggccucgucuguccuguuugucaccagagccugguccgcaguggugccuaguaaguuaguccacccauucaccacauccuuacagagcucuggcgccaggcagcaagugcuggugcugcggacagagccacagacaagccggucauagcuucuggccucauagaccuuggagucuaacaggggagagccuuucaaagauuugcucccauugcuaaugggacaggaugagacagggugcugggggacugagagcugugaugggggaugcugccuggagggcugggguggucugagcucuggaggaggaagugcugcucagguagugagggagggggugguaucuggguuaggggaaguggcgugugcagaggccccguggcgcagaugagcuugggcuauuugaagaaccccagcgaggaggcaggguguucagguggcuguggcuguggcccaggggcaagagggagauggggaggaguggaacugguuaagaaguggacagaaguagggugagaaggcaaaguccaggaucugagacaggaggaugguggccuuccugccucccuuccuuccugccuucccuggaaaggagcacgccugggguguggugaguccuguuagagaugcucacggaacccccucuccccaccccgccccguggcaggggcauggagaggcgggcccugugcuuaggggguccuggguuagggacggcgcuggaaguugcaggagggcagaaaccggccucugaagagaguggggagggagaaggggagcuguccagggcccucaggcaugcaucauguaagggucaggggagucagggaggaucccccaaaggaggcuguagagggugaaggaggagggcaggaagccagugagugugggggucugugggccauggggggugggggaggcagcucuuugggaacugaggggguucgggugcagcccugggacucccaggccagugcucucccucccccugccagccaccucgcagagagagcccgggguggaagcaggguaguuggugcugugcccugaccuucagagguggcauugacaagaccagaaugccacagggccaugcaccucucccugcaaacugcccuuuaauuuauuuuuaccucuguuccuugugggcuugugugucagguucgauauuuuuauguuacugggaaaauagaaugugcuucacagaaauuugccuuguggccaauauugcagguugcagcuguuucagagugacaggggacgguauauucuggacuugugcccuuuuguucaucucugagaggggccauaaacucccauuuccgagagguuacugggaccaaugagaucauuuauuaguuuuccuugcacaggaaaaucacacacucugugccauugauugaguccauuuuauuuuguggaauagacaugucagaagcaggauuggccagguggaauuguguuuggcgggaguccugucuuuccauagguacuuucauaauggaagcaaucuccuucugaaguguaucacccggugaacugaauggaaaaucucuugugaaaaggcuuaagaggaaggcuggccuggaaaaaugaaacucacauccacagagagacuuguaccugaauguucaugucagcaccacucacaauaccuaaaaaggggugauaaccgaaauaaccaucaaccaagggauggagaaacaaaauguggucccccaugagauggaauaugauucagcguaggcacgaaagaaggacggaaacaugcuauaacauggaugaaccuugaaaacaugcucagugaaagaagccacacaugaaagggcagacaucaucggcuccuauuaauaugaaauguccagaaagccaaauccguggagaggggaaguagaucgaaucacacacuuuuaaaggaugaauuguguggagugagaauucuaucucaauaagggugcauacaaaaugcagcugacgguggucacaccaagccugucaguaaugaugcauaacuucccuuugcuguccuggguuaggguggguugagacuuagggugaccagggaggaauggauaucuugugggucaccuugacugucuuggggugaugagagggcaguauuaccaaugcuuaaucauuugcccccauaccaaggugaacacgagaugcucugguccuaguggcugcagaguugugcagccucugucccugugcuagcucuggaccuggugguggccgcagagcuguguagccucugucucugugcuugcucugguccugguggccacagagcuguacagccucugucccuccgcuugcucugguucuggcggcugcagugcugugcagccccugucucugugcuugcccuguccuugugguggcugcagagcugugcagccuggccccagagcugugcagccucugucccuguacuugcuguggucccggugguggcugcagagcugugcagucucuguuucugcacuuucccuggucacugccucauugccguggcgcugguggacugaggccauaaugccugcgucuccugcagguccuccucgacuggauuaaugacgugcugguggaggagaggaucauugugaagcagcuggaggaagaccuguaugacggccaggugcugcagaagcucuugggugaguucacagcagggacagcucugucccacccccaucucccugcagcggcccugggcugggccaggauucucugcauagugacaucggccacagguccuaggaagacacucaaagcugcagugugcaucucccagguggugcccaggcccugggcuguggcuucaggguccucucuccccuugccguuucuacagagcacccagccauggggcagcagcagguuggggacagcuuccaaaacugccugcggcucccauccuguugggucucaggcccacuuugugucccugccacccucuuuugacuugaacuccuucgguucaggaugggaggcagcaggagggaagcgggucugcagcaauauucugugagugaaugugucaccaaauacaugauagcucauguucccucaccaggggcgggcucuagugucugcauuugcugggugaaggcaguuuagugaucuucccgggacugacugaugcaugguuugaugugcagacaaaccgguuguuuauucaucagauguuggaugagucccgagggcuggguaccagggauacggugaucuuugaaacagacguggucccuguccucagaacuuacagucugucugaaaagacaaauauuuuugaaugguuacaguuacuguucagauugcuugugaugagggccuucggagaugccgcagguucugaguagaggacgccggccuggccuggggguggggcggccuugcagcucauauggaagaacgagcgaagaguugccaggcaaagaacggaagagcagaguucgcagaugaugcaugagaggaauucuuggacuuguaguggguucucacgaugccuggcacugucaugucucauugucacaaugguccuagggggcaguacugccaucgccuucgacagguggggacguuggggcccacagucuccuggugaacagccgggcagccuggccccaagcauagcucuugagcccggccgcggggccuuucucugaccugucuacggagcagccccagguacagggccugggucaggcgcuccugcaugaucacagcugguucucacaacagcccugggggucuggcugaaugagcagaugucccugguuguccccacgaugccuuuuguuuggauccaggagugaaucacacaugaacguuugucucuucuuuuaggcuucuuucaucuggaaccgccuucccuuucccucucuccguucuguucugucuuucugucuuuuaugacguuuuggaagggucugggccucuugucuuguagaauauccucccaucgggaucugucugucuccucacgaugagaucugggucacauguuucugcugagagugugacugcgcugccugcuuguccuccugggggcaucguaucaggaggagcacacaaugucaggcugccugucauugguggugcugacaguuugaucacuggguuaaggcaguggccuauggguuucuccauuguaaaggugcuucuuuccuguuaaaaaaaccacuuuuuuauuuguucuauuuugguagagucaggaucucacucaguugcccaggcuggaguguaguggggugaacauagcucacugcacccucaaacuccugggcuccagugauccucacaccuuggccucuagaguagcuaggacuacagauguguaccaccacacuuggcuguuuuuuuuuuuucuuuuuuugaaauggagucuugcucugucacccaggcuggagugcaguggugcgaucucagcucacugcaaccuccgacucccuaguucaagugauucuccugccuuagccuccugaguagcugggguuacaggcacauaccaccaugcccagguaauuuuuguuuuuuaguagagauggaguuucaccauguuggccaggauggucuugaucuccugaccucaugauccacccaccucagccucccaaagugcugggauuacaggugugagccacugugccugacuggcuaauuguuuuguauuaaauuuuuaaauuucauuuuuuuguguuagagacaggguccuugcuuuguugcccaggccuguuuuguacuggccugaagcaauucucucauguuggccucccaaaguguugggacuacaggugugagcuaccaugcucagcccuucuuuccuuuuuaauacauggucucuagaggggcagacucugggacuuugugaacguccuguucacccaugaugcgcuccccaugauuuuaucauccgcugauuaucauucucuaaauuaugcuaaauaucaucucuaaauauuaugcuggagguugcaaaauagugauuucuguaucuuuaucauggcuuccccacuuauuagcuggcauuuucuucuguaaauaagugcuuuucuucuccuguguccuuuuuuaaaaaaaaaaaauccccuaaaauagaauaacacauuccccuggacugaugaauuauuuuauguucaaaagagaaugguaauuagauagcaaaaucugggccuuaugggugcuuguggcuccuggggugucauugcuucuagucucuuuaagccaaaagagguagcaaauauauaguuuuuuaaaaauugugaguucacacugcuacuucuaauuccaguucaaugcuacaaguuuaucccuuaacugucagcauucaguauuccagucuccagggagaaccuugguuccagaaauauauuugcuauuuacucugauugcauacaaaaauagugucagaauuacaauaccaauaccucuaucaacuacaaacaugcuagguacaagauuucuuugccauuauuuuuuaaguacaauauauccacuaagaguauauagucagaauucuguguucagaacuuaacugaauuauuuucuuuuugaguggucaugucauccauuuaauguauaaauaaauuaauuuguuucucucuguauuuaguuuuuguguauauguuuacauuuaauuuuauuuaauauuacuuuuaaaaauguaaagcauuuacaugcuucaaaagucaaaacuauggaaaugacauaccuugaaaggucuuagccaggugugguggcucagccuaucaucccagcaccuugaggggcugagccaggaggaucacuugagccgaagaguuugagaccagccugggcaacauagugggaccucgucucuacaaauuaccagucguggugaugugcaccgugcaccuguauucccagcugcucaggaggcugaggcaggaggaucacuugagccuaggaaguugaggcugcagugagccaugauuguaccacuacauuccagccuaggcaacagagugagacccugucgaucaagagagagagagagagagagagagagagagacagagagacagagagagagagagagagagagagacacagagacagagagagagagagagagagagagagagagagagagagagagagagaggucucacugcuuucucucccacguauacacucccagguaacaauuuucaauggauucugauuuuauccuucuuauguuucuuuacaaaaauguccauauacacaccuacucauuucccuuuuauuccuugcauaaaaggugauguauuuuguacauucuuuuacacacccugcuuguuucgcuuaauauguucuaggaauccuugcauguggagaucaccuuucuuuuucuuuauggcugcauuguacuccacuguguggauguuccuucguuuauucacccagucuccuauguggggcauuuuugucauuucuaauauuuuucuaucaccaguaauauugugggaauauccucgugcagauguuacagaaacuagaauuguugaccucaaguguaauggguugcuuccuugagcugaccacuguagaggaaggaauucucaaauucugagaggcuucaccucucucaccucuggccuucccaggucuguugugccuugguugaucuuuccuguagccacuuucugucuucccuggacuguucagugugcagacaugauguaauauuuccauuaaaaaauggcucccuugcuccugcaacacuccaauuucucugcaucacucaaauguauugaccauuagauuuggcaccggaugggucauugguggcccagaugagagcaguuuuggcgcagugguggggguaacacgcugaucggggaggguccaggggcagagaacugugccuuugagguacauaauuuugagagggagagagaggaagggagugaaccugugguugcugcagcugcuuuucuuuucaagacagggucucacuccauuggcuggccuggaguguggggguacaaucauggcucacugcagcuuccacuuccugggcucaggugauucucccaccuuagccgcccgaguagcugagaguacaggugcaugccaccaugcaugacuuauuuuuuguauuuuuuauagauacgaggcuuugccauguugcccaggcugaucuugaacuccugggcucaagcaauccacccaccucagccucccaaagugugggguuuacaggcaugagccacugcgccuggccaauacgaggcuuugccauguugcccaggcuggucuugaacuccugggcucaaacaauccacccaccucgggcucccaaagugugggguuuauaggcaugagccacugcgccuggccauaguagcuccuuuucaugucuguccacugggaaccaugcaagcugccugcugaaauuacguggauggagccccuggcacagugccuggcacaggucugucgucaauaagcaggaguuguuauugcuguuguuuuuuaaacagacaaauaaaugccaagagcagaacuaaggaguaucuggcucgcugcuggguaccccauccaccccaaguccccugggugacuggcacaugacaaauauuuguugauuaagucaaugaaagaauuccugcaguuucauuaccuaugaagauugugggguccucuugugggacaugaaagggggacagauagaugaguauuguuuggauuuuugguccucagugccauccacagacuccagaagggaucagcuauuugcugaacaaucuuucaguucucauagagcccugauauguuuucaggguccacaaaugccugugacgguggccucaagaacccaguguccccuuguaggugggauagcauaccucuuaaaggucagcaugagauuccacccaugucauccccagcauugguggggucagcagauccucucucugggguuucuuuucugcucaaccucccugcuuugauggacugcacagacaagccccaucuugguggaagggucuccccaugggcuguccuggagggucacucccacagauaugccccauccugguggaagggucucccugggggcuguccuggagggucagucccacagacaagccccauccugugggagggucuccccgugggccauccuggagggucagucccacagacaagccccauccugguggaagggucuccccgugggccguccuggagggucacucccacagacaagccccauccugguggaagggucuccccaugggccauccuggagggucacucccucagggcagggcuggugacuggggugggaucauguuuuucuccgcuguugugacagaggaguaucugcugcaggggauacguggacugcggggggacugccacaaggaugugaauggguaggggguggggugcuguuuaggagagagagagacuaggggagccccugccagagaaacuuggcccugaaaacacaggggugcagcaucuguagcugccucuggacagaguuugcacacucugcacaaauggcucuuacagaccagcucuuggagggaaaccuccuaggcuugugacaggugguggugaggguggggggaugaggugcuggggaggccaugucccauaacucacucugaaggacacagugaugcuuggaccacauuguuuguccuuauucaucuggcccucagaaaguauauuuggagggaaacaugucuguguuuguuuuggucacacauucauucauucaucugaugaaugaauguucauuggcuuacaugugucggguggcucuuggcuguagagacacagugggaaacaagagagaugagccccgcacccugcgccugcccacucccccagcacacauucuagcagagugaagaaagagaaguauuaugggguggagugguucaaccugaaaccuagaugauguuuuaaaggaaugacaagugcuaggaggaaaguaauagaagguuaugggguacagugguggguggggguuggggaaggcaauccagggaagcuccucuggggaggcgacaucugagcacaugucugcacagugagcuugggaagggcguucugggcugaggcucuaaagcgagaaagagccuguuguguuggaggagcagugaaaagaagcggaggcggggcccagguggcagagagggagggagagagccaagagaugaggcuggggccagaucucauucagcccugcuagacaacagucuauuccaagugacaggaagccauuggagguuuuggguagggcugugacguggauuggguuagaguuuaaaaggucacuuaggcuucugggugcaggauggauggggaggagagucaggaguuggaacugagagaucagucaggacaccauugccauggcccaggcaucugaugaaguagcucagcccccagaguggaagggcagacauggggagguacuguacaguuaaacugccauaggaaccaagacugauggccagguuuguggcuugagcaacugguaaaugggaagccguugggaguagggugggagguugggaaggcgggggucuguguuguacaugcuggggcugagauaccugcccuuuuggaggugaugcugagcaggugagccuggaguccaggcugcaguguacgugugaacccagcagcacugagcugauguuuagcaccgugggacugcacggcuucacccaaagaggguguuccaaauuuuauuuggcugaaugccgaaugcccaagaauuaacaucuauauuuggcuaaggugagaauccccaucuuagaaugagaucccaugguacaagaauaagucugaaauguucaucaagauugugucauaauuaucacaauuuuauuauuaaaaacguuaguggccaaaguuuugauguuuugcauugcaguaucaguacagucacacccagcacuguuggguaccacuugcucuugaggucuucaaaccagacauuugugaugcuagaugcucacuuucaacucagaaggcuggaggagcacguggaccuuuggcugaugcugucugaagggauacuccucaugugaagcugccccugggcugucaguuuuucucucucugaguggcugguuaugguagagacuuaccuccucuuugaucuuggaugugaagauugggcuguugcuggugauggcccucuguugaagcaguccccccaauugguacuuugcucccuaccugaagcagauauuuucuaauauuuucagaagcaaacuugaguguuuuguucacuuucauuuuuuauuucugauucuuuugccugcaccuguggcuucucccacccaaugacuugaaacaguaugucagcaagccuuguaucuggcagccuggcuguggaacuggcccucagaaucucaggacaggcucugaauuugcaucugcaucucagccgugguugccuguaaaccaugccagugccuucuauagagcagaauuacaggggcaucuuuaaagcugcaucuuccccucucaaggcacauccuuuugguucccucuucaguuagugcuagcaaaugcagcacuuacuccggaguugcugugauuguccaugaguccugcuauaucaguuguguuauccauaaaguauaacaugaggcuuccuuuggcucaagcagccuuuuucuuguggaguagcugcuguuccaucuuguuugaauaaucacauaagcacuugagaaggcaauucuaaaaucucuugagugucaagugguuugacauauuaaaaccacuuuuuuuuuuuguacugaaaaaaagaacaguggacuagaauauucagauaguaacacagcaucagaaugucuugccucauuuugugaauguuguuacacugaaaugacauaauauacuguugaugugagauccucuugaugugauacuacugaugugaucaccugauccuugagcuccaggaugccaggaaugacacugauguaggcauucagcucuuuggcuuuccaaaggcagaagcccaaaccaaauaggagauuuuagcugaauaccaaggucaaagccaacuucugugcauccguaguagagaagaggucugaggacugggucugggcugucagccauuaguggucaggaagaggaaguucuggcaaaggucagucacaagggagggggagccagaggaguguugcauucaggaaggguaaaggagguguuucuaggaggugagaggaggaaagagaacagacuucugguuuggccauguggaaauugcccagagugaaccagcaggaccccugaggagucccucuucuuuuuuuuuuuuucucuugagauagugucucacucuguugcccaggcuggagugcaguggcgugaucacagcucacugcagccuugaccccuaggcuuggaugaucuucccaccucagcuuccccgggaagcugggaucacagaugcauaccaccaugcccagauaauuuuuguauuuucuguagugcugagguuuugccauguugcccaggcuagucuugaacugggcucaaacgauccucccaccuuggccucccaaagugcagggaucacagggaugagccacuacacccagccgaaucccucuucuugagagaagauucuggaagcagcugccggguucucugccacaugccagguuucuggggguguagcuccccuguguuugcagugcagcccucaagguagacugcauauggccagagugaggugcccgugcugugggagcuccuggcugucguccugcuggucacucacgggcacacccucuccuugugaaggugaaguucuucaucacauguguacucaacccccauguggccaucacucagggucaccugcuacaugggagaauccuccccaguuuucucucuuucugugcuaggaagauagggguccuggccacaacagagcccugagcugcuccugcggcccccgccagugggcacagugaugucugaugaugcaagugaucaugugccguauucucuguugcacaggagucacccaagacccagccuaaggcagcacacaggcauggccagucucuuuggucucuguugccugcuguuuccaccaccaaauucauauuuucaaguccuacaugcagggcccacccaugugaccucauuuuaccuuaacugccucuuuaaauacaggcacauugcaagguaugagagccucgcccacuaggagagauggguagccuggcagccucccacugucccugcuaccagccagcccugcagguugaaccucggaaugugacuguauuuauagagauaauaauaggcugggugugauggcucacaccuguaaucccagcacuuccggaggcugaggugggcagaucacuugaggucaggaauucgagaccagccugaucaacauggugaaacccugccucuacuaaaaauacaaaaauuaccugggcgugguggcacaugccuguaaucccagcuacucgggaggcugaggcaggaggaucgcuugaaccugggaggcagagguugcagugagcugagauggugccauugcacuccagccugggugacgagagugaaacuccaucucaaaaaaauaaaaaaauuaaaagagguaaugaaaguaaaaugaggccauacgagugggugggcccuaauucaauaugucuaggguuccuauaaaaagaggagauuaggacacagacaugcacagagggagaccaaguaaggacacaggaaggagagggcagccaucuacaagccaggagaggggccucagaagggucuacccugccggugccuugaucuuggacuucuggccuccagagcugugacauaaaucuccguuguuuaagccgcacgguguguggcaugcuucguugcagcagcccagacaaacgaauccaguguccuccgcuccucugccgacuccucuuccuccacccugggugacguggccauguucagucugcggggccggaugguggcaggugcaacgggggcgcgucaggcuucccaucucccuggugggcgaggcucucagaccacccaguucuguaugauccuaucucucuccuuccuucuccaagcugcccugcucugcccuuuccaugguuguugaacaccugugggaccuacuugcucucuacuuccagggcgcaaauucagacagacagcuguggaugacucagcgaggagcuguuagauccagauggagggaaaucagaugaauaagcgggaaucguuuccacuccccugcaggauguguuuuguugggcugcuuuguuuuuucucuugcagucauugccacccaaucagauguuuuuuacggguguuuaucuccccacuagggaccucuguuaucugugccauauccagcaccuaggacagugccugucccauaguagguguucagucccuaucugugagccaacaaacgcaugaucgaagggguauuccgagcccagcaggccuugcucuagaauuuuauuaucuugaaagggaugccaaagcuguuuguuuucuaauugagggaggggaggcugcuggggagauaacacugaagacaugggggccuccagcuaaaauguuuuaaacagaacuuugugcugggaaccacuugcaaaacagaaaccccauuugugacuggccuggacuugauugcuuucaugauggcaugucaaugccgcgucacugacagcagcuguguauugaaggcucugugcugagugcuugcagucacccucccagugaaccaucucacgaugcucugugacgucgcuuuuguuguuuugcagaguggaucuaucaguaaacacuggagucuuagaaucgaagacuagcagggaaacuggggguccuuccugcuguguggcccugcagcgggcgugggguggggcgcugguggccggcaccugccaguaccuacugcuaacaaaagggaaauugaaggaggugcaggcugggcuggagcucagucucaguaauugaaucuugaugaaaugugacaguucuugucugugcuccuccggauuguuuccuguucauucuugguaauaaaaucaucgccaguucugugaauaucuaaucuaacuuccuauuguggcauuagaauguuuaagaaacaagaaugggagccucagguguguggggaggcagaggcagcuuuuaagaccuuuuuuaaaauuaucuuuaucaguccucucccuuuugggacccacagggacagucuucucaccuccugacucccacuuucauucuucccagguaaccuccuugccucucaacuacaucuuauuauguuuuuuccauuuuguaugcauagaauguucccgaguauaacacccacaguuuuauccuuaacuauucuucccuuuucaaucuggcgucauucucuaaggaagauuagugaccuggaagcucagcguucaugguucaacaucucaagacgcccccauggccacaugguaaccugccccgcuucggggaccuccuugaggcuggggucuuggugguuuugaguuccuccaguauaucucucuccccuuccucccucccucccucccucccucccucccucucucucucucuuuuuuucuuucuucucucucucucuccuuccuuccuuccuuccuuuuucuuucuuucucucucucucucucucucuuucugaggcagggucucacucagguugcccaggcuugggugcaauggcaugaucuuggcuuacugcaaccuccaccucccggguucaagcacuucuccugccucagccucccgaguagcugggauuacaugugugcgccaccacgccuggcuaauuuuuauauuuuuaguagagacgggauuucaccauauuugccaggcuggucucgaacuccuggccugaagugauucacccaccucggccucucaaacugcugggauuacaggcaugagccacugcgccuggcccuuccagcuuuuucugacccucuucucuugugcuucucauugcagaaaaacuggcagggugcaagcugaauguggcugaggugacacaguccgaaauagggcagaaacagaagcugcagacggugcuggaagcaguacaugaccugcugcggccccgaggcugggcgcuccgguggagcguggacugugaguuccacgccacagggggagggacugucuggagggagcccguccucucgacauucgucauccacauuugucauccacauucaucaucaucccaucuggccuugcaucuuaaaauuggguucaucucccugcucuguaagagguagaacauugcaggggagaagaacaggagaaggguuagggagauccuagaaaagggaccuggucaggccacaauucuccauccuccccaugcugcagaggagagaggcaauguuuauggauggguggaucagagggacuuugagagagagaagcagccuugggggguucuuguugggacucaaccccaaauacugguggcagcaacaccuagugggcuguuugucuaugacccuggcauuaugagaugugacaucacgguauuuucagccaagacaugaacccggcaggugaaagacuaaaccaggagaagcuggaaaguucuccucgguccugcccacuccuuccccaccucccuccccuggaagcagggccaugaggguguggcuucagggcucucugugcugggccagaggucuccgugcuuuggugagcugggcucucagugguaggcaggagacccuggagccuggccuugcacccgguuucuugguaucgagaccuugggcagacccaggcugucucguggguggcuggguccguggguggggaaucgggugccuuguaaacuguaaaacccugcaggagaaguggugauguugaccaaaccugaguccgcaugcugaggaagagagaggacagacucaggcaaggcaggggcuaaugucuaauguccccagaguggccucugcucuuggcagccuacccuuguugggaugguucauugcggagagggagcccuuuuuuagugccagagauaauaacgcacauccuugugauggguaaguggccgugaccugcuuuccaugcucuuuucccuucugugcuaauuuuacuauccuguuccuuucccucaucacugcccaauuuauugcuuuuaaaaacauugugcuucuaaaagugguugcacaagucaccuuaggccaacaggaaaggagacagugaagcuagaaguaaauucaccagguugcucaucagcucucuugauuuguccacacuucgcuccauccuugucucgcuggggucucauuuagaugcugugucucuguugccuucugcacgugggcucagguuccuguguaaccugaucuaaagcgucucccuuccuccuuccuccugcagcaauucacgggaagaaccugguggccauccuccaccugcuggucucucuggccaugcacuucagggcccccauccgccuuccugagcauguaacggugcaggugguggucgugcgggugaguauaaccgaguggucggccugccuguaacuccgccagagaggcaacaucuuccuccugcaguuuuccugcccucccccuccuuuuuuccccccaggaggcuaccuucuauuuuucccuuuugacaaaaugugugucucacccuggcuccgagauaaaugauuggaacgggaacaauggcauugauuugaugagaggcagaagcagaggcaugaggguguugagguuuaauuuuccacauuuuugaaaagaacauucauuucucuccaaagccaacugguuggaauucaauccccuugaaugugcuuauuacucauuggaggagguuggccccgcgggaugaaacagacacccaaauuaaagccgcuuugcauucguuggggauuauucaucaugccccaucaucucuuuuuuuggguucauuucucuugauucacuuggagaaauggaaccagaacccagguccuucuaacagagggugaaguagaguuaccuuucucuugcuauuucccuuacauuuauuuuuuauuuuauuuuauguuuugugaaaggguuucacucuguugcccaggcuggaguaccauggugcagucauggcucacugcagccucaaccucuugggcucaagcgguccucccgccucagccucccagguagcuaggacuacaggcacaugccaccgugccuggcuaauuucaaauuuuuguagagacaaggucucgcuauguugcccaagcuggucucgaaguccugggcucaagcgauccucccaucucagccucccaaaaugcugugauuauaggugggagcugccaugccuggccuuauuucccuuacauuuaaguggacagucgcugccuaggguucgugugugcaguuucccucaguaaaugugcaaugagcgccuacuauucucuaagcacucagcauaggcugccgagccacuaaaggaggaacacaugccuggcgucugugggggugaccacugcggccagaguugaggucacgcucggaaccuuggaugccucuguguuuauuuuacucgagacauccggcuccacuuuccucugguuuuuaaacuucucagucccguggucucuguggucggggaggaccuggcugucacuguguuuuccgaacccauucuggccccucuguuacccugggagcucagucuugaccggacgggaaugcuccucucuggcauccggcaagggccaccugccauguguccauguuuccuuccuaaggaggauguuuguggcuggugguggugacucgggaccuggggggccauuccuauggccccgugucuuggccacugguucacaggcagccggccugaaaaggcuucccuaggacacauugggaugugguucccaagccuaccuacgucagcucggggccccaggagcccugugcaggcucagaaacuggaguauuuccuuucaggcuugcacuuggguccaagauaaucuuugcgguuugcagaaaguuugaaccaggcaagcacuugcuggugcuuccugccauaacggguuagaggaguguuguuuggccacgaccaaagcagaaugaaacgggagcaggggguccugugaaccgggcgcaguuacuccccagaccuuagagccgccuucugucuucucugcagcccccuggccucugagcuugcucaggggaccccuuaucuaaccccagauggaaugguugguguaagggauguggcauuuccaggguggaaggaaggaaggaaagggccuuauuuacugccuggccacguggcuuugggcugaucacuugcuuuugcugagcugcaaugcuuuuccccauaaaaccaagauuuuacuacaaaccuguaaaacauccagcuucaugucuacaauccuagaccugggcccagcaccuggugggugccucaggcauguuugauccuugacuaggugaacacaaugucuggaccuuccuuggcaggcacuccugagaaucaggauaaaugucacccacacuguuguucaauaacaagcaccaacccugaguauuccauggaggucaaacucaggaaagggauggaagcccagaucuuggugguguccacugugggcuggcccagcgggaaaugaguucccagucccuugagggguucaguggugguuggauuagccacccaggcuccaucuggagcuccugugacaggcgggcugccaccccuaccaucaccacugccaugccccccucacuaccaucauuacuuuuuuuuuuuugagauggagucucacugugucacccaggcuggagugcaguggcacaaucucagcucacugcaaccucugccuccuggguucaacugauucuccugccucagccucccaaguagcugagauuacaggcacaugccaccacgcccagcuaauuuuuguauuuuuagcagagaccggguuucaccauguuggccagaauggucucaaucucuugaucucaugaucugccugccuuggccucccaaagugcugggauuacagcugugagccacugugcccggccaucauugcuuuucuauaccugccacgcucugggagaagugugacauauacugugucaguuuccuagggcagccauaacaaaguaccacaaaccagguggcuuaaaacagcagacauuuauucucucgcaauuauggaggccagaagucugaaaucaagauguugucaggguaggauguccucccucaugucuccuccucuaggggaggggucuuccugccuccuccagcuucuggugguggcugucaguccuugguguucuuggcuuguggccacaucucuccagucucugccucugucaucacauggccuccucccucugucuguuucugugucuguuuccucuucuaauaaggaggugagccauauuggauuaaggaggggcucaccauaauccaugaugaccucaucugagcuaguaucugcaaagacccuuauuuccaaaugagaucauguucugaaguuugugguagauaugaacuuugggggacccucuucagucccgugcacacacaugauugcaggggauguucccuguuauuuauguuccuuccaauugcaugccucaccucuccuggcugcaaagcauagaggaucccuuuggggaauccugaccugggguguuucuccugagacccacacaaaugccaacucucaaggccacguggagaccagaggguggggaggaggauagggacagguuguggucgcugaaaggcacccugcccaggguccccugcuguguacucacccaggccuggcaugcguguucaacaccaccccuccuucuccuguugcucuuuucuaagaugaucuccggccccgcagcuucgucugcccugucagugcaucuuuccucaacucuccacugccugauuuuguauguuuauuuugggguuuucagaaacgggaaggccugcugcauuccagccacaucucggaggagcugaccacaacuacagaguaaguggaccccugucuugcccuuccaggcccugcugccccgagugagugggaccccaggcugccacuucagccagggacaccagcgcccauggggcugcucccgcuccacaccccuucucuguagcaugugauucucaugcugguucccaccccagcucuccucccucugcacacuuucuucagaguuuuuaacauuagaacugaguuaccuuccacagacuuugaauuuuuucauuccuaucuuaaaaggugagcuguaagaacauugcaaaguggggcaggcagagagaguucaggaugguuagagagaaccauugucucaguucauuuauccaucuacauuagccccaucagaggugggagcuacaucuuuaaaccagaacuuuccuuugacagacacuacuaagccaucuguuaucuccuagagaaagccagagggcagguguucagaagucuaaaaggcuucaaaucuauugaaaauagcaaaucaaacaguaucugugguaugugguuuuaaggacuccuugugauaaccugcuaagaaucuuuagaauucacugcauuugugccucuugacuaaaccuguuucagaugaaacagaacauuuaaaaauugauugucucagcuaauccaucagcuaaguucacagagugauuaauuacuguguugugaauucauggaugguauuucaaaaauuggagcugacacaggaaaccacucguggcuugcaagcucucagggaagaugaugggacaguggagugcaggcugaugcaugugcagaggcccaugaagaggccucccagucugccccaggcccacgaagggaacagggagagcuggaaaaggggaggaugagaaugugguucuuugcccagcacagugggccuuuggcagcagcucugccuauucagcaguaggagaagggcugcucguggggaacugggauugggcuggugucuuaguuguuuauuguuguguaacaaaucacccccaaagucaaguggcuuaaaacaacaucuguuucauuugcugcucacaauucugugggucagcaauuuaggcugggcucagcugggcgguuguucagccagucucgccugggguugcucauaugaugcagacaucugaaggcuggauggaggcuggggaggcugagaugggcucccccuaccucuggugguugguguuggccuccccugggucucuuuccuccucacagugcugggcaucuucccagggugcucucaggguccugagagagugagaaugcagcugcaguccccuugaggccuugucuuggacauccauaccuauguccucaauucugugagucaaagugagucacaggucauccuggaucaaggugcaggaaacagacucugccuccuugugcaggaauggccugugcacauuguuggguggugggcaugcugugauaggaguuccccucuaggugagggggucccauaugaggacagcaaggaggagcugggcccccugccauaaaacuagaaugguccagagacagagaaugagcaagugggugggagaauugucucagcuauucaucagcaguaaguggccccaaggaccugcugcaugccagccuccuugcuggaucaacagagacacugagaggugggcugagugcaguucuuuuccuccagggcgacccauccugcugaugagaaaggaugcauccacagacauguacagucuaacacaggggcuugugggaagugccucggggcccuaagggaauuuccaggaggaggggagcaccccaaagucagggaaggggagauuucagugaaagccaccucaaucagauaucagauggcccugagcagugaggaagggaguugggauuuucuagccugagucagugucccucugccagccagggucaggguaaaggagaggcugggucaccucuccaggaugaugccccagguagguucuccucagggcuggucaucccauccuugucuccuguuccuuccccuccccguggcugcggaggcucugacggaacauuugaaucauuggaugucugcugaaaaccagcggcccaaagauccacauucaguuuccuaaggcagcauugccaccuccuauccagucucaguguuccccuuucucuuucaagagguggcuaugaggucaccccuuccaggaagcccuccugucugccaagcaggagugcuuggcuuccuguuaguucccuuagccucuggacacauguggccaacauugaaauauuggcuuaugaggucugucacucccaggcauccugagggcagggccacauaguguuuaucuccaggggauguuaauuucuguaucugcacagccugcacauaguagguacucaaguaagugcuuguuaaauaagauggagccaaaggacuugagccuagagggauuuggggacaaaguaaagacuuccuugccucucaggaaggcagugcauggaaaggaucugugcacucacucacugggaaucuuugaggagaagcugcucaccacucccgucucccccauugcuuccgcugccgccugccugagaucagggccuggccucgugguucuccaggauccuuuaguuccacaaguccugcaaguacauuguguuuacuccuggaaacaugaguaaccugcaaccuuguguguguguuuguuuguuuauuuauuuauuugagacagggucuugcucuguugcccaggcuggaguacaguggugcgaucccagcucagugcagucuugaccucccaggcucuagcgauccucccaccucagcaccugaguagcugggacuagagcgcacgccaugacacccagcuaauuuuguauuuuucuuagaggagguuuugccacuuuggccaggcucgucuccagccuugcauuuuuuuauuguuuuguuuguuuguuuguuuguuuuuugagacagaguuucacucuuguugcccaggcuggagugcaauggugcaaucucugcucacugcaaccuccaccuccuggguucaagugauucuccugacucagccucccaaguagcugggauuacaggugccugccaccaugcccggcuaauuuuugcauuuuuagcagagaugggguuucgccauuuuggccaggcuggucucgaacuccugaccucaagugauugacccgauucugccccucaaagugcugggauuacaggcaugagccccugugcccggcccagccuguguuuugagcguuccacggcugcuggaagaccuguugucugcugaaaucuucauauuaaccacucuucugauuuaaguaccuccccuccaaacaacauuaccagggugguuaaugugcaaauagagauggugauuugcugcugaccuugugcaaacauuaauaauucacacaagcaccucucguuuauaauuagagcaggcuggaacacagcaccaugugacuugcguucuuaucaguaggccuuuaccugggcagcgagggcccagcuuucuggcuggcucugucccucauccuccauugugcugcuugugaaacuguguucugagugacccaucucauggcucucucuguguucuuguuugcaggaugaugaugggccgguucgguaaguaaccccagggaaaguggggagauggaggcauguuagggcucccccaggaagcucccagagaguguacaugguuaucuggagggagugggaaacuagaugggucucacugcccccauaguucuggaauccuagagaaagugcacagcccacccccaccuuucuguauaaugggcuuguuucucagagcugagaguggcuggguugugcuaggaggagugggguggaaggcugggugaccagcuaggggagcaggaggggccugggauguaacacuggcuggaacugucaggggcuggagcaagagugguugaggguaaaagggagggaggagaggcagccagcacauggagcgucguuagcuggcuggaagagaguggcucagcucuguggauguccuuccauguguauuauuuccuccuggaaaccacugguuuagcagacuuccuuagagucaggcagccagggcucauuccuggcugguggcuuguggccugccccuuccucucucugcuccucauccgugaaaugggaguguaaaaggcucuccccaggcaggggcugcugugaguauugggugagaucacaggugagugcccugcuuggccgggggacagcccucuaugugggcugguuuuauuaguguugguuuucaguggcucuucccaaagagagagagguaaucacucucucuucccucaugaaagccugagaccucaucuucaucucggugagggaugguaacguuucaacccucaguaccaggauaccccggcccucggccuggccagccucagugcuuugggaagcauuucaaaagagaaaccucuugacccccagauacccuguucuccagugagcagggaggggagaacagcucuuaaaaggaaaaauggaaaccagauagaagucucccaccugccucucuagcggagcugauaucugucuuuugggggcccucugggugggggugccacccccugaguccuauacaaugagggcugggccagcuuggccauggggcucuguaaccucaaguuauuauggggaccagcuaggaugccauugcugcuuaucuauuguauuaggguucucuagagggacagaaguaauacgauagauagauauauauaaaggggaguuuacuaaggguauuaacucacacgaucacaaggucccacaauaguccuucugcaagcugaggagcagggaagccaguuugagucccaaagcuguagaaccuggaguuugauguucgaaggcaggaagcauccaguaugggagaaagauggaggcugggagacuaagccagucuagucuuuucauguucuucugccugcuuuuuauuuuggcugugcuggcagcugauuagguggugcccaccuggauuaaggguggucugccuuuuccaguccacagauucagauguuaaucuccuuuggcaacacccucacagacacacccaggaaccacgccuugcacccuucaauccaaucaagcugacaguauuaaccaucacgccuguggagaggggaaguggcucagauccugcggggcuugaauugagaagaugcagccagcguguccccccuaggcuuucuuuacuagaccuuaagcugugcugggaacauucacaggccuucucuguuuuuuguuuguuuguuuguuuguuuuuaaggagaauuccagcucuuuuaaauugucucuauuauuaaaaaacaaaugcaggaagagaaagagaaacauccuguauauaguugcugagggaggcgaaaccgcaguggggucacagcucaugggaccggggugaggcgucuccccacccugcgucuagguagaggcgcguuuugggggcccagugccccccucugucaccucuucuccaucuuuucuuccuggaggaggcucagaaccccuuuggaauuguagaggccuaaagaugaggagagggccgggcgcgguggcucaugccuuuaaucucagcacuuugagaggccgagguggauggaucaugaggucaugagaucgagaccagccuggcuaacauggugaaaccccgucacuacuaaaaauacaaaaaaauuagccgggcgugguggcgggcaccuguagucccagcuacucgggaggcugaugcaggagaaucgcuugaacccaggagguggagguugcagugagccgagauugcgccacugcacuccagccugagugacagagcaagacucugucucaaaaaaaaaaaaaaaaaaaaaaaaaaaaaaaaaaaaagaugacagugggccccucaagcauuuuugagucuuuuuguuuuuuuuguggcgcugucacuuuuguguuugguucgggccuuguuggagguuuagggaaaagacagucuguucaguucaguugggagcacaugggccucaggcuguguauagcacccuguggcccgagggcccagaagccuggccccggagccccugccaccccaugaaugagcuuuagggucugauggcuggggcaguggcucccuagguaagagccaggugucacaugugaaaaguggacccagcugccacuccaggggugggaggacuguggaaucgcaagaccauguacaagaggccgauggaauuguucucguuacuuuguaggcuuuaugugcugugcuugagaaaaugcaaacaggcuauuagucggugacaggcaauuaguuccacccccggccuugcugcuucugcugacgcagguuccgaagucuccugguuacccagccuggcacccucaggcacagcagggugucuggcccggcacccgccccugugggggcagcagcacgccuugucuucgcuucccugccaugccauuccccuccuucagcccccgagagcaccccagggugcucccuccuccagcaaccuucaccugaaugcucucccucuagauuaccccauggcucacucuuucagcucugccagcucuugguucaaaugucacugaucagggaggcccucucugacuccacugccccaaacuggccuccacuggcucuccuccccaccccugccuuaguucuuucuguacucaugugacacaccaagcagcacucagcucauggggauggccuggcuccucuucccugugccaguguuuacacaacgaagcuugcacgugucuggcagacacuggugccagcaaacuuucaggggcacccacagccccugccuuucuccuuucacacauggcuccuugacccagaggugcucugugggcuggagcugaccuuuccucggggugcaccccacccccugccaaagcagccagcccuggccacagucugcacgcagcugggggcagauguuuuaggagcuucuggaaggccgggcagacccuccuuggcuaaugugcugggcuuugccaggaguggucuucugggccucaguuuccccacgaguacccugagccagggagggauggggacuccauucugcccacuccccaucauuccggggagggagguggcuccacagguccucgcugccuccugacagcaucacuguccuggaugaggugggugaggaggcuucucuccacggaaacaagucucagggguuccagggagguugcagccuggucuccauggcaaugggugagcuggugcggcuucuccgcgggcggcccuucccccuccugggccugcccugggcuggaggcucuuucugaggcagaggggaaagaagggggaugugccuuccucacucucuucccccucauuguaacuccuaguaauuccccuucacgucucucccauuucugccaacagggcuuguuccaaaaccucuggcuccaucccaucacccguggcuccugacugugcccuccauaacucccacguugcaggccacagccccuguuaaccccucucacaguccacccggcucuugaaccugcgcugggcuuucuggcaucucucucuccuugugccugcuggucccucgguggagcgccuuuccuccuccucuugccccagcaagccuggcuugaaccccaggacugcuuugugaagccuuccucagguccccccagcccuugguucaugggucccagacucaggugucuccagggaccaggcugauaauauaaaagaggagagugucuagauuaugcaaugauaaugucaucugccccuucaccccagggcuggguggcaguggggagugguggggucuggcgcaagcuggagaguccacacccccauccccaggggcagcuuauugcugccaggugggagugcaggcucacuguugccacagccuccaguucuucaagagaagccagaaguuaagaacuuuuggacaaacuuuccaauuuaagaacuguucgcucucgccggguaccguggcucacaccuguagucccagcacuuugggaggcugaggcggguggauuacuugaggucaggaguucaagaccagccuuaccaacauggcgaaaccccgucucuacuaaaaauacaaaaauuagccaggugugguggugcaugccuguagucccagcuauucaggagguugaggcagaauugcuugaacccgggaggcagauguugcagugagcugagaucaugccacugcacuccagccugggugacagagugagacucugucucaaaaagccuaaagaccaaaacaaaacaaaagaaaacaaaacaaaugaaaacuguugacucaaaucaaaacauuacagcgaccaagcugagcauuccugcagauugagcuugggcagcccuggcauauggucaggucgguuggccccccgucuggcuucgucuuuucugacacuaacaggguugcacuaucauaguuuacucccucuccaggcccucccccaagucugugccucuuccaagagaggagucccuccuuguuuaucucugugauguccccagagccugcggaggcucugggggacaggacgagcgggagcuguaaggacugaggaccgacaaugcuccugccaggcuccaugcuccugccucuacucacugccccacuuaguuccacaccaagagcgaggcaggggcugugagaaugcugccuuuauggaggaagaaagggggucggagagggaaggauuugcccagucauggggugugaaguggggcagcuagaacaaaauaggaucuauuuucguucccaaggccaagcacaucacaggggugcaguaugcucucucugucucucucucuccccuaggucaggguggucccuggggaggccccuggguuaccccaagacaggugggaggagcuuccuacccgacccucuuccugucaaccugggcucugcggcucccagggcugcuccuuguauuggggccccagccuggcugguaacagagggucccuccacugggcucagucuucugagcaugcucugcccccaggaaccuggaggauggaaguugggggcccugggucccuuccaaaugcccuuggguccugugccugguccccagugcccauuuucagagccccuggccccucccugccuuguggacugugugacgugaugccaguccccuggguccaggggcauggcagccggcggagaggccucugcggccccgaugucuccuugaguggcuugacucugccagcccagcgguggcccagcuaaauauacccuggcugacgucaagcacucuucugcuccugggguuuuucuuaagcugcauuuauaguuugcguauugcuuuguaaagauguaaaaauuucacuuuuuuuuuuuguuuugccccuuagcagacugucuuauugaguguagucuuagaugauuaugaaaaucauuuacagcugccgcauuaggaagcuggcgugugugcagaggcagggcauuuuggucaauguuggucuuuaggugaagaaaacuucccucccuucccccagucacgcacaugcucacacacgcacacaugcgcucacacaggcacacacacgcucacacgugcucacacaugcacacacgugcucacacguguacacacgcucacaccgcacacacgcacacccgugcucacacgcacacaugcucacacauggacacacgcucacacacgcgcucacacguacacacgcucacagcacacacacauguucacacacaaccucacacgcacacacgugcucacacacgcacacaugugcucacgugcacacaggugcucacacacacacaugcacacacgugcucgcacacgcacacaugcucacacacgcaaacacgugcccacaaugcacacacaugcucacacgcgcacacacacguacacauacacuuuccuucucuccuuuccucuuuguuucucaccaccuccacaaggccacggaaggggcuacuugggcugggcugggcaggggggugugagcugccuccuggggcccagccugggaggaagggucagcaugcuuccucugggaggaggcuuggccaacuucucuccguaggucucuggcuuaccugggccuaaucccuucuuucuuuuucugggcucucuuugucucucuccuaggccagggcggucccugaggaggcuccccuaggccacccacuagacgggugggaggagcuuccuaccccacucucucccugucaagcugggcuccgcagcucccagggcugcuccuuggguuggggccccagccuggcugguaaaagagggucucucugcugggcuugguccucugaacaugcucugccuccaggaaccuggaggauggaaguuggggggcccugggccccuuccaaaugcccuccucccugucuuuucugcccuggcagugaugccccacagcucugugucuaccuggagaccucagcccucugcuugggguccaagucucuguuccauaugccccuauggaacuccccccuccauggcagcaggagcaaaggcucugaggcaagugugcaccagugucagcaggagcagcugggaggccgguugguggagugaagucagggagggugcauguaggaggauaacgcugagucugagugucccauggcacgugggagagaggauggauuuuaucugagugucccauggcucgcaggagagaagauagauuuuauucuaagcaugauaagaagcaguuggaggguuuuaguuguggugggaguggaggggggaaacaaaugauccuguuugcacuuggaagggcucacucugccugcuggggagaagggcucaggggccaggaguggaguaggaggcugcagcugcucccaggcgaggggcagugaggcgugagcaggacauggccaccgucgcgggggaagugguuggauucacaggugacauuugccaguagacaaggagugugggaacagggagaauucaggacgccucaaguccuaggacguggcaggugcagaugccagaugccaucuauguguuucauaugagaagguaaaaagcagguggaagggacccucugcagccucuaguccacgcuguucugguuguucccaagcgcucuugcucgccuugguuuggccgggacugaucaucagggucagcccuuucauucugguaggaauuggaaggauucuaggcaggugugggaguugaggcugaaccuccugagggaucagaagcuggcagggcccuggauuagggcagcaccacggguuuccauaaacgcuccuucgugucucucuuugcauguccucagagcgggaugccuucgacacgcuguucgaccacgccccggauaagcucagcguggugaagaaggugagcuauuggugggauguuggaugugcucuccccuggcucgcggcuuuuugacagcacaaacgccccgcugggaagaaggugggaaaauguuuggaaucucagaaauguuugccacauggauugaaauguaauuacagucaaaaaccuaaccacagugcauaaaaucagcgccuuuuaacucaaccucgcugcucccugggugucuuccugcccgcccgcuccgcuucuguuaagugaauuacccagcccccauuucuuucugacucgagaccuuuuuucaauguggaaauguuuuuaagcaugucagccugcugcucucgcuggccucauuuaccaucuacagccugcccaguaaacacgcaggccugugcggcugagcugugccauacauggauuuggcccguuucccuccagacagagaaugggcccucacuagcccaggcagccugcuggucaaucuguggauggaaaaaucuccgaggcucuggaguugggggcugggugugaucagcuucugggggaucugccagggaggcuuguucccgucaaaaggaacuggagcccacuggcugcucauuaacuuauccgagugccugcaggcaucccauucaggaggcugcugcaucccuccuucccauaacaucggaggagcgcucauuucaacccauggugcaggcaagagaguucuccuuugucuaggacagcuuacccaaacagcuuucuuagugcaagacuugucagaaccuuuaauaggcugaccuauacuguacuucuccaagagggagcuugguaggaagcauuuuucaaacuuguuuguuuauagugggauuuauuuaucuaucaauuuugggguaagacgcauuguauuuuaguggaacccacuuuuggaaaauguuggccuggguuuggacgaugagaucauucauuuuuggaagcauuuugcaaaaggcuguuggaaccgugcuaaugguccuucugggacaaagccuuccuagcacucuuggguggugagggauauacuuggagcaucagagucccccaccuccaccucgucacauguggcccccagggacccugacagaaccgguucagggaaugaaucaaauccagcuuccccacuuaucagcugugugacuucuggcgaagggcgagauuauaccccccagccucaguuuccccaucugucaaguggggacagagauguuacccaccucucagggcacugugaggauaaacugggauucucucugugcaugggcuuagccggcagcguauagucacugguagcauugagaaugguguggccugagauugcuuucaucucucgguagauaccauguuaauucauucugcgaaagacacauuuucggcacuggagccaccagcaaggaagaagacagaauccuuugauuugccugguagcuucccacuccagccugucccuuccucaccuccacauugcaaguuuaggugucuguagcucucugugccccagaaugaagucaggggccccugcccaccucugcagguuucucccugggucguccccuccuacuccuucccaucccacccacauccagccacagccugaagaccccaaaggguuugcagaugugucugggugcccacucggcucacucucaccuugcacuggcccacccucaggcccagcuccaaugcucccucuccauggucuuaacggggguccgcacacccauuaauggcucaugaaaucucccuugcauugcguguuucccuguagugcccuaucucuugacuucuccgucccaccacuacacgcauauggagaauuacaucacaggcccuuuggcgggggccagggguggagcucucuguguuuguguccuuagcaccaagcagcaugccuggcacauaguagcugcucaguaaauuugagcagaauggguaagaaaucauaucaugggcaggcugggcgcgguggcucacgccuguaauccuagcacuuuggaaggccgagguggguggaucacaaggucaggagaucgagaccauccuggcuaacauggcaaaaacccgucucuacuaaaaaauacaaaaaaauuaggugggcaugguggugggcacccuuagucccagcuacucgggaggcugaggcaggagaauggcgugaacccgggagguggagcuugcagugagccgagauugcgccacugcacuccagccugggcaacagagcgagacuccaucucaaaacaaaacgaaacaaaacaaaacaaaacaaaacaaaacaaagaaaucaugucaugggcagugguggaugauauugaguuucuaucaaaguuggcuuuggucacugaggaauuacaggugacagguuuuaagcuugugccggagagaagccagugccccuugguacuuacauaauagggcucagagagaucacccuggguggaucuccccauguauugcaaaucgauaggcaggcugggcgcuguggcucacaccuguaauuucagcacuuugggaggccaaaguggguggaucaccugaggucuggaguucgagaccagccugaucagcauggggaaacuccauuucuacuaaaaauacaaaauuagccgggcuuggugacgggugcuuguaaucccaacuacucgggaggcugaggcaggagaaucgcuugaaccugggagguggagguugcagugagcugggaucaugccauugcacucuagccggggcaccaaaagcucggaugauccucaguggucuggggugcaggcuucaaaccuguagcugucuagugacagagugguucaauuccaccuuuguaggcccggcgcaguggcucacgccuauaaucccagcacuuugggaggccaaggcggguggaucacgaggucaggagaucgagaccauccuggcuaacacagugaaaccccaucucuacuaaaaauacaaaaaaauuagcugggcgugguggcaggcgccuguagucccagcuacucgggaggcugaggcaggagaaugaugugaacccggugaacccgggaggcggagcuugcaaugagccgagaucacgccacugcacuccagccugggcgacagagugagacugucucaaaaaaaaaaaaaaaaaaaaaaaaaaaauucaguagguguggcucaaggcagcacuuuccucagucuucugaguaugccguuuauuguuccaggucacaccuaagauacauuugcaaauguaaugauccuccccuggcaguuucaucuuucuuaagagcacagggugcucuccaguaugauuguuaaauaugucaugcgugcacggauuggcauaugugugcauggguuggugagcagagacguguagccaggauagaugugggcauuaugccaugaaaacuaggggcuacugucaggauauugaguuugaaacaugggcuuuuuauuuuagcaaacaggagaugaugaaagcguuucacagagcuggggcuggcaaaugucaagccugccccuccagaugggaccugcaugcgggccauucauggcuccugugucucuuuuauucuuggcagucucucaucacuuuugugaacaagcaccugaacaagcugaauuuggaggugacggaacuggagacccagguaugugcugcuuuggcuugaaggauccuuuguccaccgccauuuucagucaguguuuugaucccagguggggcgcgugaacaaagcuggcgccauuuuguucaucucacaaggaacucccguggugcaggcagaaauaaccaccguggccuucucagccccucugucuuccuuuccuggggcugcugccacaaagcaccacaaaccuaguggcugaaacaacagaccuuuguguccucgaagugcuggaggccugaaguccaaaaucaagauggggccuggguggguucccuccaaggcugugagggaggagcuguuccuggccucccucccagcuucugugguuuugccaggaucuuuagcauuccuuggcuuguacacacaucacucccuucuuugccuucaucuucauguggugucguccuugugugugugucucuguguccaaaugucccccuuuuaucaggacguggucauguuggauuagagcccacccauggcuucaucccaaccugacugcaucuauguaaacccuguuuccagauacggucacauucagagguccuggugauuaggguuccacuguauccuuuuucuuucuuuuuuuuuuuuuuuaaagacagagucucgcucugucacccaggcuggagugcaguggugugaucucggcucacugcaaccuccaccucccggguuccaaccauucuccugccucagccucccgaguagcugggacuacagguacaucccaccaugcccagcuaauuuuuguauuuuuaguaaagacgggguuucaccguguuggccaggauggucucgaucuccuggccucaugaucugccugccucagccucccaaccacuguaucuuuuuuugggagacacaaaaccccaaaacaccugagugguguuauucaacccauaacacacuccagggcuccaccccagcccaacacagggccuuugcacacgcaguuccucugucuagaacgugcuggccccuucagccucugcucagugcugcugucacacuguggccaggaccuagcaaaugucccccugguagguauguacaacacauuucuucugcaauaaguauaucaagucuacuuccccagccccgaccccuacucaaagcuaaaggagcauccuuaaauuauauuuuugggcacuccgagagcauuaaagacaaaauaugauuuucccaggauuagcagggugcuugaaugcggagguuuuugagcucuugguacagacaucccuaaugcacagcugauccuucuuaaaccccaaggugaaugcauucauucccuucucuuucuuuaacuuuccucauuugcuuuucuaauuaaaaaacuaauucagguucauuguagaaaugucugaaaaugcagauaagcaaaacaaauaaaaaucacccauaaucccgucacccggagaugaaugcacagaggguuuuguucaggccuuuucucuacacauauagcgagucauggacagugugggucuguauauaaaagcaucacggucuguuuuuaauguauauauuuauuuguguaucguuggccaacacauuucuuauuuuccgcaguuuacaaauguugcacauuuagccucagauuauuuucuguuugagacguuagcaccccagaagccacugaggugaaaaguaaaaaucuuccuuucucuuuuucuggagaccucccccuucagacucuccaggggcagcuaacugcaguucaugguuggauguguauuuuucuagauauuuucuuuuucuuucuuucuuuuuuuuugagacagagucucauucugucccccaggcuggagugcagugacacaaucucagcucacugcaaccuccaccuccuggguucaagcaauucuccucccucagccuccugaguagcugggacuacaggugcgccucaccaugccuggcuaauuuuuuuguauuuuuaguagagaugggguuucaccauguuggucaggcuggucucgaacuccugaccuugugauccaccugccucagccucccaaaguguugggauuacaggugugagccacauuuucuaugcacaaagguauuuuucuaaauaacaguggaucuuaccgcccacuguuuuguaauguguuuugugucacuaaauacacugugggcaucuuuugguguaagagaaaguguguguguguguuucuaucugauccuuuuucccuugcucgaucuaucggucugucuauauuuugucacuuuuaaugggaaguguaucucaucagcgggaaggcugcacugcaccucauuaaaccagugccucacgacuggauguuuuucugcuccuguaaacagcagugcagagagcagcuuugugcacggcugucugugcucgugccugcuuccucggaauaaaagccuagaaguggagucauuagagcgaagccugcaccgcacacuuugaaggcucaggaagauuugcugugugggggccccugguacugucauggggcgugugaggggcacugcucccccacauccauaccagcuguccccacagcccuucucagaggugucugcacaucaguauuagcagcugagccucuuacauugagacucuaaaauuaaauuugcauuuguuuuuauuuacucaauaucuucauuuuuuuccccccgauuaaucguacuauauagagucuuaaaaguacauuuaaccacuggucccccagaaaaggucgcugguuacagaaaugcagggauuuuuguuuuguuuuguugcaaaggaauuuggguauuuuuauaaauaccauauaucauuuaugaagacuguaaaucauuaacgucuugaugcccuaggagucggagaggcccugguuuaauuucuucaauuucuauuugugugugggugagugugguuuauguagucugguaugugugguuuaugcagucuguugggggugugugugugugugugguuuauguagucuggugggugugugugugugugugugugugguuuauguagucuggugugugugugugugguuuauguagucuggugugugugugugguuuauguagucugugugguguguguguguauuugugguuuacguagucugugugguguguggugugugugguuuucguugucuguguggugugugugugugguuaaguagucuguguggugugugugugguuuaugcagucuguguggugugugugugguuuauguagucuguguggugugauguguguguguaguuuuuguagucugugugguguguguugugugugugguuuaugcagucuguggugggggugugugugugugguuuuuguagucuguguaguguguggugugugugugguuuaugcagucuguguggugugaugugugugugugugugugguuuuuguagucuguguggugugugugugguuuuuguagucuguguggugugugugugugguuuuuguagucuguguggugugugugugugugugugugugguuuuuguagucuguguggugugugugugguguagguguguguuuucccuccuuuuccaaaccauucuuacauugcggacagcgucccagcucugugauggugagugaacuccucagccucccugagcuucuguccacagaauuaaacuggaggcgaugggcagugugaggacugggugagauggcgcacugagaucaagugggcagggcucggcagggguuagcacugcggaugaggaggcggugguggggccucugggccuccguggggauucugcucccugcugagcuagacagcagguuguggagagagggcaccacgcugggugcuugugaaaguggagggucacccgcucgcagcugggccccccagcccugcccucuccuuguggccgucccucccuccuuccugugagcccgugugcugggacagugaggagacaccacggaaggaagaaaagacucagcaggcucagggccugcgggagcagcggcguggccaccccagaccuccuggggagagguguggguuggugccuucauucacguggcagcuuccauucccuggaaguuaguccauggagacgugggcauggcagcucaauguuguucugcugggaaggugccagcacgcuuaaccagggugcugugggcaugaagcuuccauguggagacacacuuaaaagaauucuucaaacccgucugaucuccuuaaugauaggaguggcuggcugcuuugugguguggaaggcugagggcaugugacauggaggccaagugccauuugcccaucaacugacagcguguugaauuuccaggcgcaguggcucaugccugcaauccuagcacuuuggguggccgagguggguggaucaugaggucaggaguucaagaccagccugaccaacauggugaaaccccaucucuacuaaaaauacaaaaauuggcggguaugguggcacgcgccuguaaucccagcuacucaggaggcggaggcagaagaauugcuugaacccaggaggcagagguugcugugagccgagguugcagugagccgagaucgcaccacugcacuccagcagggcccagacccuguccugagucccuuaagggacuguugcccacuggcacuagcuuuaugcuuuacagcucuagcugcagcucucccugcuaaaggucagggcuucugauauuggauguuugugauuuugacuuuucaucuuuuuuuuuuuuuuuuuuugagacaguuucacuccuguuacccaggccggaguacaguggcgcgaucgcggcucacugcaaccucugccuuccggguuaaagcgauucuccugccucaaccucccgaguagcugggauuacaggcaugcaccaccacacccgcuaauuuuuguauuuuuacuagagacgggguuucacccuguuggucaggcuggucuugaacuccugaccuugugauccacccaccuuggccacccaaagugcuaggauuacaggcgugagccacugcgccuagaaguuuuuacuuuuaauuuuuuuaaaaauucaaauuuaagaauucuggagauuguuuguacaauaacgugaaugcaccuaacaugauugaacuggacaguuaaaaguaguuaagaugguaaauguuaugguauauuuuaugguauauuuuaccacaauuuaaauuaauuaaagagaaagguuagcauaagcgagacacaaaagauaaauggauaugcgauuccacuuacgugagauacccagaggagucaaauucauagagacagagagcagaaugauuggugguucucaggggcuggggggaagguagaauagagaauugggggacagagugucacuuugguaacaugaagaaguucuggagaugggugguggugagggugacccaacaaugaggauguacuuaaugcuacuggccugugcgcuuacacacgguuaagaugguacauuucagcuuauguauauuuuaucacaauaaaaaauaaguuagcaacauucaaacaaaaacauuuuaauuuaaauagcugcauguggccauuggcuaccauguugaauagcagcuccagaggcccccuggagaauggggccacagucacuguggucucugcugcaagacagaguggugagggccaccaggucccagcucugcacccugcagauuugaaugaauccuuccagcagcugaugcugauggagcacucacgugugccaggugcucccucccagccgucucgcugugucuucacgacagcccugaaugaugggagucacuacuaucccuggggucaggagugggggacaguuccagaggcacgguccuagccaggcagcugcacucagcuccaaacacucaucauauuuggucuuugcagagccccauguguuagagcccccuccccuuuugcuuuuuucuagguuaggagccaggucucaaaagacuucacauucaggccuucacuugauuccagauucuccugccuaaagugagaggagggauggauugcuuuacuuuaaaauauuuccagcuggguacaguggcucccacccguaaucccagcacuuugggaggcugaggcaaguagaucacuugagcccaggaauuugagaccagccugggcaacauggugaaacccugucucuacaaaaaauacaaaaauuagccgggcaugguggugcgugccuguagucccagcuacuugggaggcugaggugggagaaucgccucagggaggaucaccugagccugggaggccgagcugcagugagccuugauugcaucagugcacuccagccugggugacagagugagacccugucucagaagaaaaaauaugccccccuuaaguuugugcaaagcauuugccaacuccuuacccugcccggaaacaucacaagucuuucucugcaguuugcagauggcguguaccugguucugcucaugggccuucuggaagacuacuuuguuccucuccaccacuucuaccugacuccggaaagcuucgaucagaagguaugugcauggucuccauccuugguaggggcucaagaaaugcucauugaaaugcagagcauagacuaucccggcagcucuuccugcagccuggcugcauucuucagaaaguaaaaaaugcacaagugauauugcaauuagauguaacucucagcaaaagaaauaagaagcccaucagccguccacaacgcauccgaguuuuguuugccacauuuucuuugcggucuuuuccaugggaccguguaguuuuuaauaauugugaucacaucucgguagaguuguaaacccuucccccauucugcugcagcuccaccaccugugguuuucccugcugcuucccaagcuuuccaaauaccaucuccagugguggcacgaagucccaaggauggcucuguuaccagcgucuuuccauuccccauucuugggcagucaacuugaacauguuucuauuguuuuucccuacugaaacaacagagcaucuuuuugauacagauuuuuuuuuucauuccuguggauuguuuucuuaggaaaauuucucaaauagggucaaauuuggggcauuccuuucaaucugggcuggcccacgccacccggucccgcugucacugcccucgugcgugggccucucccugcugucugcccucuguccagggcuucccgcagccaagccucucacagcaguauuuagcacauugccuuuaaaaacuuggccauggauggucuauguugcuuuggauucaugggcaucugucauuuuauuuucccaaaguguuagacccaugagucagggaggcagacaauguaagcugguggcgacagccagagaaauagcagaaauggggccaguguuuaucaaucugcccacuucuggcacguugcagucuguuugcuuguggccaaauguuguuccuaucuugccugcugagauggaaucaggacagauuagagaggucuuggcacauggaguccauguugaaucgagagagagagagcgagcgagcgagcaagagggagugcagagggaaugagcagaauugugcagaacucaccaggaaacucaccaggugccugugcugucauccuggaaaugaaaggucagaccauccagcgaagaagcgcaugcauuuccaggccccgauauggcugguugcagacacauuguuuuggagagaucuuuucuuucuucaaacuaguaagaaugcuggcgagaacagugaguuuagccaggagaccuagggcugguuucuuuccaagacaaggcuuuguacaaaugucagaggcaucaucuccugggcccuggccuucuucccuuugaaacugggaugaaagucuuugacaauugcugcccuggccugcgaggcuugaggaggcuugagucaucugccuuccccucugaaucggagcgaggaagggaaggcuauuuucagguauagcaugcagcacaccauucauccuguucacucaggagaaagggagccugggguggcgguguggcucugcggguggcuggaacacucuccuucggaggaugggaggcugucaguaguuccuccuccagccccugccuuuuuucccuuucuccucauggcagcugcuggcaaggucuucaugagcccauaguauuuauuaucuaccuuguagucuucgugaauccuggacagguggguggucccugcuguggaggacucacccacuucaggcugggcccaacacccguguacucaaaacugcuugcggaugggauguugauggcaucccuugcuaaugucuccugugggcugagaccccgaggugcguuugcucuggcccugggaauccugacagcugcuccacauuuuugggaggagggacugagguucagugagcaaaaccagagaugcgucaugagcugcuguccccgaggguaguaaugacuuaugguuuaaaacaauugcauuggauuuaaaaaauaucacacuggacagcucagagccuguaggcucgugccccaugagcuaucucagaggcaugaguguggccuucaguuuuuuuguugcaaagccacuguuugagccuuacccugcacuggccacgugcugagcaccuugcacccauuggucaucauuuugggagacucugcaggcucccucucucugucgaguggggugcauccuggagacguggagaucuuuccuagaagaagacacgaguugcuucccccucagcauuacuggaugaggacagggaaucucaggaaggcuuagagaccagcccaggguugcacggccagcaagggcagagccaggagggucgacuccuauuccagaacccucuauucuuuccucaccuggccaaguugauuaaaaccuuuugaauugcagagagaaaggauuucugcccauguggcuggcucgaagcagguguguauauggccuggucucugcugggccuuggggccuccuacugcagucacagcuggggugagcgguccccaggccucuccgggauccaugugcuggguauccagggaucuaggcucaggggacacuucucugccuggcaugaaagagggcugggggaggaggcauggccuugagagauaacaggcaugggaggguggcaauuuccugccuggcauuuccucagccugagaagaaagcagaaggaaaaucucacuucaaaaccacuuacuguggggccgagcggcugcagagcaaugaggcuuggaaggggcuuugcucuccccuuaaacuguucucucaugguguaggggugaccaccucgucacccgaucacacucuccagccgucucugagugucuccacgugucaugcaucucauccccagccccuccugagcauccacucccucagcguggaagaggauuccucaggcuuaagaggugcacgggagaggcacgugaaaagaccgguccaaauuggugcugacuuuuacaauggagaagaaucuuuucuuaaaagaaaaaucuuuucucgcuauucccucucuuugcuauccugucuccaucucgauuuggggucaagccuguugugugugugugugugugcacgugugcaugugcauacgugugugugagcucauuugaugauauggacgguggucagcuaaagggaccuguguugcuaggggaguggaggugggaggcucuuggaggagaacgggcacagauucuacguuucaguccugguuccaugccugugagccccgugccuuguuuuucuuuucuuuuuuuuuuuuuuuuggaggcggggaaggaaucucacucucucacccaggcuggagugcaguggcacgaucucggcucacugcaacccccgccuccuggguucaagcgauucuucugccucagccuccuuaguagcugggauuacaggcacaugccaccaugccuggcuaauuuuuguauuuuuaguagagacgggguuuuaccauguuggccaggcuggucuugaacuccagaccucaugauccacccgccucagccucccaaagugcugggauuacaggcgugagccacuacauccagcugccccaugccuuuuuagggcaccgauguccuagcccaucucagcccagcaccacccuccuuugugaaggaagaugauauucaccucguacagggcugggaggggaaagggaaccuguauggaauacacugaccccaugguggaugcacagcacccgcaggucgcucccugcucucuccuuaggggaacugcguucugcacccuccgcacgggccguccucacuccucccccauugccaguguuuggccauccucaggcccagcccuggugcagcacucccgcaucuccaggcaggcuguccugcaggguuggggugucugccauguggcccaguguucccauuggcaguuucugaguuggccucuggagcagggucuccgucugcugcacccccgccccuggguggacauggccugcccuccugccgggcugugucuuccccacugacccuaugacuagccagacccucuugcgguuggugcuggcaggucauucgccccuuugcuucuccgagcacaggccgugugcacuguggaagcuuuuccaaagcaccccacacuguuuuccaguguuguucguuugauuaacucagggaagccucuuuuuccugguuaauuauuaaauuacauugcaaguaaaauuguucuuguuucugauucauuggccucaaaaucaugaaaauaugaucguugaaaggauuuuuuguuuguuuguuugcuuguuuuuuugagacagaguguugcucugucacccaggcuggagugcaguggcacaaucucagcucacugcaaccuccgccuccuggguucaagcgauucucaugccucagccacccaaauagcugggauuacaggugugcaccaccaugcccggcuaauuuuuguauuuuuaguagagaugggguuucacccauuggucaggcuggucucgaaugccugacuucaacugauccaccugccucggccucacaaagugcugggauuacaggugugagcuaccacgcccagccaggauguuugauuacuaagagcccugaagucccuugcacugugacaucugugcuuguuugcuguuuguuuguuugauguccccuccucccaucagccuuggcuugcggcagguggguggcuggauguaaucugguucauugccggcaucccucugaguggucuuuaaacacagcccagaaggcuuuuauuuuaaaccuguucagccaucauuagcaggauaaaagcuucagguacauuugggggcugaggaguaauagacccuuuaauuucaggggaagucacgguagggcggagguggccacguuucuguagcaucuaacaggaccaagguccugcaggcugacgcuugcagccaccaucgaucugacuuccguucugacugguccacugucccuacucagugcuaaggcccucccuccccugagggcaccccauccugcagagacacagccucacgugcaggucuuuacagcccuuccuggggcagugccaggccugcgugccucugcacgggacucauccuuucugggccucaguuucccugucugugaaauggggucacugugggccaggcgcagcggcucacgccuguaauuccagcacuuugggaggcugaggcggguggaucauuugagcccaagaguuagagacuagccugaccaacauggcaaaacccgucucuaaaaaaaauaauaauaauacaaaaauuagccgggcacagugaugcgugccuguagucccaacuacuggggaagcugaggcaggaagauggcuugagccugggagguggagguugcagugagcugagaucucgccacugugcacuagccugcgcucuagacccugucucaaaaaacguaaauaaauaaauaaacaaagaaauaauaaauaaaauggggccccugugacuucucaucagguggcuggcaucuggggcagagcaggcucuugguggccgugagcccucgagagcaggccgggcaccucauccuuccaucucucagcccagaucacuggugugaggggugagaaccaccuaguaagcgcacauggcccuccgcagacuuccucacccgugucugcccacccuguggcccgccccgggcucacuggguccuuguggacgucagcguugcagaggcucgguccuguccaugccggcuguccuccagcagugggccgugugugggaacgacuguuggacccuaacgcugacccaccccccuuccuuggcagguccacaauguguccuucgccuuugagcugaugcuggacggaggccucaagaaacccaaggcucguccugaagguaaugccccuggcucagguucccccgggagaggugcgcacggaggggaagaaaaacggguccuagaaguggcuggaaggcuggcauguuguuccccagaugggccccacgucucuggcucuggggcaagggucugccaaccccagcuccucagucuccucauuuugggaaccaggaggacuucgcugguggagcuggcagugccgguucuuuaauaaccacuugacuuugaaggacguggccucugcccacagaccucaggauuaagugcgucucuagcuggccacucaggcuggaaaugcagcuucgugcccugagaagaaauuaaaggcuuacucaacuguaaugacuguugggcuggagguccccugaugcucagccaaaggcaguacuugguagcagggacuuggcaugcucugcgugggucggagcuggaggcaggaggccagcagagcuggggcgggcgguugcuucccugucccccccccggcuccugugccaaguuaccuauaggaggacucucuaaccugagugagcaucacaguuccccaaacacacuuccuagguguuuggggacagccaggcucagcagaacauggguggcacugccugugaacccugcuggaaaguuacagggcagagcugaacauuaaaggcuuugacaaguccuauaugaagacaucuguuugccuccaucaaaaccuuugccaugcaggaggagcccacagaacucagacacugugguuuagugcccugggcccccacuuugaccguggcccccuaccuagcccugcucccucuccugagucccccauggugcuauaugaguugggagcccaugaugcuuccuacaccuguugccagcauccgcucaacggcgggcuuuguagagucuccaaaauagcuagaaaauggauccugucccuuccaucuacccacugcagccaccgcuuccugccaguccacgcggaagguuccuggccggucccuuccugccuguucauccuccucuugggguuucacaggacaauuucacacccuccugucucguguguauggcuguuuauucuuuuuuguuuugagacagggucucacucuguugcccaggcuggagugcagugguaugaucacagcucacugcaaccucuuccucuuggguucacagcauccucccaccucagucugucgaguaacugggacuaaggcgcauaccaccaugcccggcuaauguuuuaacuuuucuuuuuuguagagacaaggucucacuauguugcccagacuggucucgaacuucugggcucaagcgauucgcccauuacaggcacgagcccccaugccuggccuuguuuauuuuuuauugucccucccuccccacuagaacagaagccucaagggagcagggcuuuguccccugcaugccggugcugagaauggugccuggccuggaaacugcucgacagcacggaucaaagcacauguccagcagggaguguggcgagcugcugccuguagauaccggcccggccugggucucugggaccccucguugcugcugcccugcagcccuuuuguugcugugaggcagggccaugagggaguggcuagaggcccgagggaugcugcuuugccucuccccagcugugcauccuugaacagguuacuuugccuuucugugccagggccuccuccucuguugaggggagugaugauggcaccugccuccacgcgucauggggucgcuggauggggggcggauguucaucacacaggacuugucagagccuucacuguucaacucugcccuguaacuuuccagcagggcccacgggcagugccaccacgugcugcugagccugacugcuccugagcaccuauuacgcucaagugagcugcucccaugagcacuggaagaggguccugcccacagaacacaccaggucccugcugaugguggcugcuagcucggcguuagugucuggugggucgcacacugucagggaggagaaauccuugcucauguccacugugggcuuggcuggggcuuccuuuaguuuccuguagcccaaagccugggcccuaucugcagcauggggugcuucccccguacccucagaagagccccugguggcccuuugccucugagcugcugagggagcccugcuucuuuguccucccgaacccacgacuuuuuuuuucugagacagagucuuacuuugucacccaggcuggagugcaguggcgcgaucccagcucacugcaaucuccgccuccuagguucaagcaacucucuugccucagccucacaaguagcugggauuacaggcacccgccaccaugccuggcuaauuuuucuauuuuuaguagagaugggguuucaccauguuggccaggcuggucuugaacuccugaccucaggugauccaccugccuugcccucccaaagagcugggguuacaggugugagccaccacaccuggcccuuugucccguuuuugaggagugaggcaggagccuguccagaggccaggauauccucugacaggccggccuccuaggaggguguuugccccugagcccggauguguuuccuacucaucugccgcuggacggcacguuagggaacccaccacggacguguggaaaccaggccagaggcagaggcacugguccagggcaaauagcaaguucugcagccucccaggcagggucccuugggugucccagggccucuguccagcccaggcagggggcagagcuggucugcagugcucauuagcaccuucgcugggccagcacugggcaggggccaagccgcagagauuuaugagauggggucccugcugggccucuuuauuuuguggcugaugcaaugaaugagagacuuuuccuucuucauucaaaaucagcuggggagcaagaaucaggagguaacagagauaagaaugacacggagaauggggugcaguggcugcggucucccugacacccuccucugagcuaggcagacuuacccggguacccagggcugguggggagggaggcaguggcuguggccuccccugcaggccugagacugcccuguugguccccacccggaggaagcagagcagucucacacccccugcacgugggcgggucugaagagccaggccugcaccugguucccuaggcccccagcaaugaugggcauccuggcccccugcccccuuguggggaccuggcggagacuccagugggguccccgacccugcucuuaaggaggccccuugccugggagaaaggcuuguggcucgcuccaaauucacagagccgagugcggagcucgauggugggguggguguuuggggagcacagagggacugagguucaugggucacagaaggugauuccuaucccugggcgcaggugcuaagggguggcugugguuagcaggucuggcaggggugugaggguuaaguucuguuuguccagcgaggcugucuggaaguucucagagcucagaccugggggcugcugcgugggggcaucggugucaggcugcugcucuggucucccugugaguccaccaugggaguggagucagagggggccaggaggugauggcccccaccccugggagcuccucuguccuugcugccccccucgccuuggccaccuccaacuccauggccgccauucucccuccccugccuccacugggcuguugggagcugggguggacucuucaggucagggggagacccugggaucccugacagagccccggguguguccccaagcccgccgagccgaguuccccgacagagccccggguguguccccaagcccaccgagcugaguucagcccugcuuuugcucugacagcacacucgugggcaggucauuucuccaugugagucuugguccucuuuguaaaacgagagggaaggaaaggaggcugugcaggcucugaugagggugugugagucgagaaacuccaugcccagugacaaggacaguugcugauucuuagcauccaccccaccugcucucucaguaaccgaugucguuucuuacucuugugaucaggacuaaagcacagggucaucccauggcugcuuuuggaucacagggagucaggacuccaagggccucgagcguuaccugguccaggcccauuuuacagaugaaggcacugagccccaaaucacggaagucacuuagaggucacagagcaagugaaaugaacaaggugucugauucccaggaagguucuuguccacauaaagaaaguggcccaagacuuccagggccccagagggagcugucggguccauuaaguguuacugggguuuuuggucccgguaagugucauuagccaugucccccaaccgguucuuagacauguccugaugcagauccaggaggggcugugggagugucucuguucuugucaccccaggugccuguccccgcagggugucagcccgcgccaggagcucucacaaaaccugugugucuggggaggcacugcccagagcguccuggacauggugguggccagucuuuaaggggaagcgcuguguguggaugcggcagcuggugucaugcuggagacguggcuucugagaguaccuaccgcaaugacaggaggauggcacgccucugaaguuucucuguuuccuucugcagacgugguuaacuuggaccucaaauccacccugaggguucuuuacaaccuguucaccaaguacaagaacguggagugacgggggagcuguggaugguggcaggagugucccagcaagaaaggcggcauccgucugugcccugugccuuuccagggagccaggcgccaugggcuucugguccaagcuguguugacugucauccccaccccaccccuaccucacgccugccccacccccugccucuuuugguuguuguucuuaaucuccucuccauguaguucccagugggcaagagccuuugaaaaugcaggauucuaaacacucgugcuugcguuugaagccucgcgucacucagucgcgugggaugaugaguccguuguugucugccuuggccgaaagaugaaaaaaagccugaaccccaacccccagcugguugagagcacccugcauucugccucauggugcaguuagcgaucacaggccuucagaaguacaacaucagcucagcaggaacgccggcuccccgaggacccaggcuugacgauucaccggggaucuccugggcugggcucuccuuggaagugaggccuuuuauuaaaaauaaaaggguuuugcaguuugaaaaacuuuaa

SEQ ID NO: 192570 - RNA, 412825 nt, Homo sapiens
gcgcguaggcacaacuuccggaaggaggcggaagagcuucucggcucuaggcucuggagucccgggagcagugaggggccacccggggcacaggaaagggccgcuaggggagggccgggugcacucggggugucugggccgcgggucugagggaugaggaggggccauggccagcgacggggccaggaagcaauucuggaagcgcagcaacagcaagcucccgggcaggugggugugccgcggagggccaggucggggucaggggucagaggucagguggccgcguuggccuccugggcugcggguggagucgggggucuggagagggcaacuuggacucugaggagacugcuggauggugugacgggcguuggggggcucggaggucggagcguggggucugggggugacaguggcugcacguaggaucgaggcuugcaaggacgaggaggagcuauuggcguuuuuccugacacuggcaggcuucuuuccgagaaacuccugggcuccuuggggaggcuggaaggaacugauucgggucaugcugugaaguuugguggaguccggaagcuggccgggcugaggccccccgucugcuggguggaucaguuucugcagggggugugguguuuuugacccacuugauuugccuguggucucuugagggcugcggcucuugccuugagcauagaagaggacuagaguuucccugugaguuuccauguuucugcuugcuggugucaaaaccaccuccuauguuguguuagcaggaaguuuuuuuuuuuuuuuuuuuuuuuuuuuuuuuuuucuucggcuggaaugaccuggguacacccuagaugcuauacagcuccagagcuccagaguccuugucugauugcuguggcgcugagcuaugccagggcccuagggaaugagacauuacguggaggguaccuaggauaaaaucagccacuggugaaaacagaucagagauaagcaaacgucaagauuucagaacauaguucuguuccaaagcugaagucuggaaugcugaaaauuaugaauuguguuacgaagauaagucugaguagaaucauucauaaacacaguaaaaugguuuguacuccuguuucauaauaaauauuauuguuugaguguuugaaugauaaacuuuggaauuuacugcauccaguuagaaaaguuuacuuuuggccagguguggcggcucacgccuguaaucccagcacuuugggaggucgagguggacagaucaccugaggucaggaguuugagaccagccucaccaacauggagaaaccuagucucuacuaaaaauacaaaauuagcugggcaugguggcacaugccuguaauccuggcuacuugggaggcugaggcaggagaaucacuugaaccugggagguggagguugcagugagccgagaucguuccauugcacuccauccugggcaauaagagcgaaacucugucucaaaaaaaaaaaggaaaguuuacuuuuaagagugaucuggggguuagcagcgugaguuacugacagcucagacaguggcuuugagaaugaagggagucaucaaagguggccggagacccuauucgacuccacaggaccgugcuugauucgagaacaguaagaccuuucaacaaaaccagugucaggguccaaggugagugaagauucuggaauggugguggguaggagguccugguagugacaggaacaaaugcuguagaacauaagaguccagggaagaggagccacaugacaguguaacuuuuauguguuacuuuuaggucuuaagguuuugguuccucaucagucuaaacucuaauucuuaaucagcuuagauguaagaauaacagagcugcuguguggaguuacagcagugacucaaccuuuggauugaaggcuguggcucuugguaauuuguccuuauacugaguugaauuuauguccaucuggaaacuauggaugugacauuuggaaauaggguuuuugcacaaguaaucaagguaaaaugaggucauacuggaugagggugggccuuaguucgucaacuaguauuuuuauaaaaagagggaaauuugaauacagagagacacacacagggaaauggcccuauggagacagaaacagagauuggaauaguacauuuacaagccaaggaaagccagggguugcuggcagccaccagaagcuagaagaggcaaggaaggaugcucaccuagagacuugacagagagcauggcccugcagaugaccacuugauuuuggguuuuuggcguuuaaaacugagagagaauaagugucuguuguguuaagccauucaguuggugguaauuuguuauggcagccacaggagacuaauacagucuccagcuuucuucugugugaaccugaaauaccgaacaccagcuuuccuuuuccucugacuuugaugcuauucugugucuuaggcacuuuugagagcagcuucuguauuaccuuugugaaguuggagucuuggagaguucgaggcugucacugaagagggcagaagaagaaggagagguugggugcaccaggaaggccugugaagccucugugucucccauccgucuuguggcucaagccucuggcagugcugcucuuucagguggcaggcuggaacucuucccugaaggaggagucacagaggggugcccguuuuccuaucaguaguggugauuggucacuagcugcguauuuauuuaguccacaccuaugcaagcacagugcuaguggagauccuagccagguuccuguggcuuuggcagcucuuucaauuguuucccaugauuguuuucuuucuuuuuuuguuuuuguuuuuguuuuuguuuuuuuugagauggagucucacuguguugcccaggcuggagugcaguggugugaucuuggcucacugcaaccucugccucccagguucaagugauucuccugucucagccucccaaguagcugggauuacaggcgcccaccagcacgccugucuguuuuuuuguauuuuuaguagagaugggguuucgccaugucggccaggcuagucucgaacuccugaccucaggugauccauccaccucagccucccaaagugcugggauuauaggcgugagccuccaugccuggccuuguuuuccuccuuuuuuuuuuuuuuuuucugagacaagagucucucucuguaguccaggcuggagugcaguggcaugaucucagcucacugcuaccuccaccuccugggucccgguugaagcaguucuccugccucagccuccugaguagaugggauuauaggcacuggccaccacgcccagcuaauuuauguguguguguguguguguguguguguguguguguguguguguguguguauuuuuuuugagacggagucucacucuguuguccaggcuggagugcaguggugcgaucucggcucacugcaagcuccgccucccggguucacgccauuuuccugccucagccucccgaguagcugggacuacaggcgccugccaccacaccuggcuaauuuuuuauauuuuugguagagacgggguuucaccgugcuagccaggauagucucgaucuccugaccuugugauccuccugccucggucucccaacgugcugggauuacaggcuugagccacugugcccggcaauuuuuguauuuuuaguagagaugggguuucaccauguuggccaggcuggucuugaacuccugaucaugugauccaccagcuucagccucccaaaguucugggauuacaggcgugagccaccacacccagccuuguuuuccucuuuguuuuugagugcagcccucaucucaaggaaacucaggaggaagacuacacccacuguacaauacaagacuaguaagggaucuuucagauaguucaacucuuuuuuauuuuugagauggagucucgcucugucgcccagacuggagugcaguggugugaucuagacucacugcaaucacugccucccggguucaagugaucuuccugccucugcugccaaaguaacugggauuacaggcgcccaccaccaugcccagcuaauuuuuuuguauuuuuaguagagaugugguuucaacauguugguguggauggucucgaucucuugaccucaugauccgcccgccuuggccuccccaagugcugagauuccaggcaugagccaccgugcccggcccacaccuccuguuuuuaugcagccugaacuaaagucccccuuuuuugcaucaaacucaguguuguuggugccucuggcuuccuguucucccugguaugugcuugcuuucacuagugagauccacagguuuaggaaaaguaucuuucucauucuugcauugucaguaccgauaccugguguuuauuccgaacuaucuccucgauuagccuggagagugagugguuuggccagggcuauaaacugcaggagagguggucuugcugguagacccucgguuuaugcacacccugguccuuagguugcauauguggcugacgcuuuccuagaaacuuuguuucuggaugagccaggauguguggugugguagauagacccuccuagucagaggacuaggaguuggugguccagauuuuaacuuucuuuuuccgguaguggucuucaccaaguuaccucuggggccaucagugucuguaucuguagcacaaagcgguugaguuugguuuaaguagcuauggcaaauggggagauaucuuuggcuuagcacgauucucuuugaggagaaaagaaugggcuucuuggaccaguuuugagaauuugaugauuugcugauccagcaaauauguauucaacccauaguauguguuaggaacagccccaggugcuggagauaauauuagugaacaaaauagaccuagaucucugcucucccagagcuuacagugcagugggagagccggguauaaauaacauagcucaguuaaauggaguuaacuguuggaaggugacagcugcuaucaaaacaaugcugggaaagaggacuagguggcuuaguggcaggugugguggugagaaggagcccuucacugaggugacauuugaggaaagauuugcacgaggugagggaacaggccaaccaggaggcuggggaagagcgguccuggcagaggagugagcaggugcagaggacucccagagcgaugcuggcgugcuugaggagaggagcuggggccagggugggucuggccgagagaaggggagagucguggggugcgucaugaaagguggugggguagggccucaugaccacagugaagacauggacuguucuuugauucuggcugaauggggaaccuuuggagggcuuugagcagagaaguggcauggucugcauuagguuuaaugggauaucuuuggcugcuguacugaagacagauuggaggcguugggagucggggcaagggcagaagcagggagaccaggaggccagggugccgcagcguccaguggucacuggugguggcggcuugcaccugaguggaagcuguggugguggcaagaaaugguaagugauaagaauccgaagguuuggccgggcgcgguggcucacgccgguaaucccagcacuuugggaggcugagguggguggaucacuugaggucaggaguuugagaccagccuggccaacauggugaaaccccgucucuacuaaaaauacaaaaguuagccaggcgugguggcaggcgccuguaaucccagcugcuugggaggcugaggcaggagagucgcuugaacacaggaggcagagguugcagugagccaaggucgcgccaccgccccgcagccugggcaacagagcgagacucugucucaaaaaaaaaaaaaaaaaaaaaaaaauagaaucugaagguucagucucugacugucugggcugguucuuucccgggccgcugacucucuuggcucccgaagggcuguugcuuuccgcaguugcaguuggaauucucgccacacuucacuuuaaaaaugccaagacaaaaucacagcacacugggcuugagaacacaggcagucuuucagugugggucugauguuugcuauuuuagcucagcuccgccuggcaggguguggucugcugacagaggguaugcaggcagcugggguauguggaguaugacguuugaaaguggcauggugguggcugggcgcucuggcucaugccugucaucucagcacuuuggggggcccaggcggguggaucaccugaggucagcaguucgagaccagccugaccaacauggugaaaccccgucucuacuaaaaauacaaaaaauagcuggacauuguggcaggcaucuauaaucccagcuacucaggaggcugaagcaggagaaucauuugaaucugggagguggagguugcagugagcugagaucgcgucacugcacucuagccugggcgacagggcaagacucugucucaaaaaaaaaaaaaaaaaaaaaaagaaaguguuaugguagcaagaaaggcccaaauugagcauggcaaggaugugagugcugggauaaagcuggagcacaagaggguucuuagugauguggcucugacagccuucagcuuacauugccagagccacgagaugucugugagcaaaucagacggucggcugaauaggccacaguccguccucagccgaaggagaggcacuguuggggauaaugaauucauuuggaaaacguuuacgagcuccucuccugugccaggugcuguggugcgugcugagcaagccauguggcucuucacggcuggacgccugcccugugaacacaugcgcacagacugcagugcugggcagguggcagucccgggacccuggcagaguagcaaggcccucacuggguggaaugcucauguccuccuuacacaggucccgcuuccgccgagaccuggcuguacagcaggaaccgaucuggcugcugaggucaggggaggguguauaggaguggggagcgcuugacuggggaggaggggcauggaggguggugagcaggcacuggagcugcuuccaaggccauggugaagaucugagcugugguccuaagagccaugagagaguguugaaggguuuuaaacagggaggggugugauacugugacacuguuugucauccuugaagagagggcgagagaggaaacuggugggcuucugaggaggccgaggccagaugcugugggguuggagaggaucgggcauguucaggguacacauggcacacucaggauucacugaugggcggggugcugggggucgaggugaucuccagggugcuggccugaggggaugggagugugguaggcagaauacuggcccccuaaagguguccucauccucaucccugaccccugugaauauguucuguuacauggcagaggggaauuaaggucgcuaaucagcugaccugaaaugggggaauuguccuguuaccuggugggcccaguguaaccucacgagcuuuuggacguggucagagacauggugugggauggacuccacccacagcggcuggcuuugcagauggaggaggcagccaccaggaauguggcgcggcuucuagaagcugcgaaaggccuucugcagauggcuaacaggagagcaaggccuugcuccugcauccgccaggagcugaauucugccgccaaccggagugagcaggaaagggguucucccuucgagccucccggaaggggcacagcuggcugacgccuggacuucagugugaugagacccaugccggauuucugaccuucagaacuucgagauagugaaugcauguuuuaagcugugguaauuuguuacagcagcugugaagaguuggggacugugccgagggaugucugacagggaauggcagguggcccagcaccucccucagcagaguccugcacuuggaugugggcaggaguaccuuggucagcggccuuggggguggucacuggguaaccuccacaaaguguguuuaaacccaggggacugaagucagcucggaggguucuuccuauguccuauguccugcucaggccuaggaaccaaauagagcccugccucuuuccucagaauguuggcugcugcuucuggccgccuugcuuucuuguguuuuuuauaaaucuguauugccuuuugcuuauguuuugaagagauuguuuauuggguaagaacccucaguccuguuuuccaugcagagggaagccccggagucuuguuccggcagugauuguguguuccccgccaguuggguuucucuucuuguuugugaguggagaugaccuuccugugacgggggccgcggaagagcuggugggugagauuuugcuguaggugcaguuccuuuucuuguuccuuucagcgguuacuuuccauguuauuaaaugucuuacuuuguccagaaacacuuugaaaaauaaauugaaugugaaucauauuuccuuucucuuacauauucgucugauagaguaaaucuggacucuggguuaauuuuaaaugaagacaaaaaugauugaucccugacaauuuuggauuauuuauuuauuuguuucuuaaguaacaagagcaggaggaaguaccccaucgccuccaaguguuuuugaggaaccaugggauuccucauggaauugaggagaacaagucuucggagaccacuugucuguuuuucuuucuguuuuucuuuuuaauuuuuuauuucuauagauuacuggggaacaggugguguuugguuacaugaguaaguucuuuaguggugauuugugagauuugggugcaccugagcaguauacacugaacaguguauacugaacagugcacccgagcaguauacacugaacccagucuuuuaucccucacccgcuucccauccuuuuccucugagucccugaagucuauugugucauucuuaugacuuugcauccucauggcuuagguccuacuuacuauuuuuuuuuuuuuugagauggagucuugcucuguugcccaggcuggaguggaguggcgcgaucucagcucauugcaaccucugccucccggguucaggugauucuccugucucagccucccgaguggcugggauuauaggcacaugccaccaugcccgccuaauuuuuguauuuuuaguagagaugggguuucaccauguuggccaggcuggucuugaacuccugaccucaagugauccacccgccucggccucccagagugcugagauuacaggcgugaaccaccaugccuagccguuagcucccacuuaugagugagaacaggugauguuugguuuuccauuccugaguuacuuuacccagaauuguugucuccaaucucaucgaggucucugcgaaugccaguaauucauuccuuuuuauggcuaaguaguauuccaucguauauauacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauauguauacacacauauacauauauaguauacacacauauacauauauauguauacacacauauacauauauauguauacacacauauacauauauauguauacacacauauacauauauauguauacacacauauacauauauauguauacacacauauacauauauacauauauacacaaacacacaugcaccgcacuuuuuuuuuuuuuuuuuuuugagaugggagucucacucuaucaccaggcuggagugcaguggugugaucuuggcucacugcaaccucugucuccuggguucaagcuauucuccugcuucagccuccugaguagcugggauuacaggugcucaccaccaugcccagcuaauuuuuguauuuuuaccauguuggccaggaugaucuccaucuccugaccuccugauccuccugccuuggccucccaaagugcagggauugcaggcaugagccacugcauguggccacaccacacuuccuuuauccacuuguugauggaugggcauuuguguugaaaagaagucaucucuguuuuucuuucccugaacggccacaguguagcacggccugccuguggcuaggacaagggcagugcucacuugcaggggccuguccuggcucuguggccugagagugacaccugccccuccuuuccuucucuggcaggcucagcaucucugccccuccucagcucagcccuucacccccugaacacaggccguggagaucugcaucgugcagugcuucuaggugcaguggggagcccaggaacaggagcccguguccugucacaggguggggaaugucaccgugcuuggcccugggagcacaagaugacccaccugcguaguucuuuuuccugaggagucggggagcgugucugugugcggagcaggcucagagcagguguucccugcagcgcucagaacugagguggcuggggccuuggugucacaccucacgcuagggauugucuguggagugcuucccuugggcuaggcacuuauuuuuauuuuuuuuggagauggagucuugcccuguuacccaggcuggaauacaauggugccaucucagcucacuguaaccucugccucccggguucaagcaguucuccugccucagccuccccaguagcuggggcuacaggcucaugccgccacacccagcucauuuuuuuguguguguguuuuaguagagaugggguuucaccguguuggccaggcuggucccgaacuccugaccucaggugauccgcccaccuuggccucccaaagugcugggauuacaggugugagccacugcacccggcgggcuagacacuguacaugcaaccacacguguaguccucauagcagcugggggugguaccguguggucccuauuuuacaaaugaggaaacucagaagcugagcuacgugcucaaagccacacagcucauaaguggcaaagcugggguuugaaccuuagaagucugugcccuuacccaucacagccucauccuuaucuccuccauucccuaggggacuuaacagguguugaaauuauuacagagaaagcugacucacucaccaggaaucugauccugcugugggcuggcuuggguggagguguuccucccgcccccgcacccauccuccuguuugaacucaggcugcugccugcugggccugccugcccuuggagcccugcugagcucagccugaggccuggcuccuccaggcugggggaaaaccaggcuugcugugcucggcagcagagauucuucuggagugaggugagcagcuuguucuagguccccccugguguucucuuugcagacaagaggcagagguaucaggaggcccagagggaacagggcugccugggcucuucccauuucugggccccgugcuguggggaacuuucauuuugaguauccccagacuuuuuguucccccuuucugaaauguuuccucuuuucuggugauaaacauggaaauuccaccccgagugcugcgguucaugaaggggcacguaggcccuuugaguccaguugcuuagaauaccuguggguuuccuuauuaaguaggaaguagaggcugagaacgucuguguuguuacugauggcagccccccggggcagggccaggcauugcugggcgcccucuccucccugagucugccuuccguaaacggccugcaguggggaaggugggccucugcucaaggccccgagcuccuaggggaacggguucaccuucaggcccauccaaggcagagcccuuuccggcuucggggccccugauauuucugggcccccgacugcauccgcucuguucccacgggucccuccuggguguucuugcucaugcuuggguucauuugagcgcugccucgcccuccgccauccucuuccuucucaugugcgcugugugcaccggagcccggccgaugcugauagaauuuuuaagugugccgugcagcuuucugcaccugggccucuacuccuugcugugcugguuugaaaugggccuucuuuuaucaaacauuuuuacuaaacuaaaaaauaaaauaggcuugcuggcucuaaggcuuucaccuagaugaggcgagugauguuuauugcagucgucuggaugagcuccugauccuuggcugaaagccaucaguggcucgggauguguggagaggacagggcagaggacccggucuuggaaagggggugggucccuuggugucacuguggcucucuuagggguggcagcuccuccgcgagggcuuggugcacccgcugcccuuguuuucacgugaauguguuuggggcgggaggcuagcgaguugccugggacucccuacauuaugcuguuggggucgggagucaagaggagaucuggccuugcuucuuuccgaauacggaagggaucugggaggaagaaagguucagagacaaccacaguuuuauagaaucuaugacuauuuuccugcucacgucuggggccuugggaguugcuuucucgggguggaggaagagcacagagcgccaccucuucuguuuugagacugggucuggcugcugccaaguucucagguuuauugauggugcaguaggugauuccugugcggccacagcugccuccuggaagggcugguagaggguuguuggcugugggccgcauuuuguuuucucuuagaauuaaucucuauagugaguuaguuuuguguuccaaaaccagucacuagagccacuguaacagcuugugcaucagccagaugugccugccucagccgucaugcuuuuaaauagcugagagaaaaggccaccuuuacagcagcucacuagcuuuuaagagggugucaccuagcuggguuuugucgugagagaaugugcuguguucuuggaaguuaauuccuucaaagauacgguguaccuuuaaaaugcuuaaucauucacacacgugcacagugaggaagagaauuaaauggaacaagcaguuaugggaugcgcucuguuugcacaugaggcccuggggcgugugcaaaggugagccugguguuacuccugcuaccgagggacuucguuugcugagggagacagaccagccaggagcuucugccgcaaggaugcuggugccaagcgggccacggaggggccaggaagcccuguggcaguauaggcaaggaaaggggaguuuucacugaggacaugagaugacauuaaaguggacuuugaagguuaccugggguguggggcguguucuguagucaggggcugggacaaggccuucuuggcacaggguggcuugaacacagccugagugaggaggaguacaggguguguuugggagccuggcgggucgcuggcuaccugagaacagaggugugcguggaaguagugggcacagcuguggcuguauggugggauggugugcguggaagcagugggcauaguuguggcugugugguggggugguauggauggaaggagugggcacagcugcggcugcguggugggaugggaggugagggucaguguucaggaugguggcugcaggaguuuuggcuugaggcucuuuuguguuuggaguagggaagguuucugagcaggagugaccugaucagaccuccugcuacuguuuauugaccucuugcugugugccagagacagaggcucaggucaaggaacuggccugagauugcauggguaggacgaggccagccaggaugucgggugagaaccauggccguggggaggagagagagaggaaggggacugucaggaagugcuugcaauucaguuaguucaguagauauucaaaacggacccugugccacacuuugcaaaaggugggaaaaaagagcccucccgagaggggaugugugagccgagaggggcaggaggacacugcacaggccucauaggaccugaaggcauacgaguucuuccccaaggccuguaggaagaccuugaaggauguucagcuggggagugacccauccucugaugggcacaggacgacagagcugaggccaaacccuggggcagccggugcaacugucauguucuucucaggagcaggggaugggucagggccagggcugauggacaggagaagagagaugugugggagguuuccaaggugaccuagaggauguggagacguggguggguggugugcuucagggaggagacgaggcugacccuccuguugguggauggcaguucuggagguggucacaggagauacauggucagaaugagagaaaauggagccccgauuuaaguuagugggacagaggguuuucgaugccaggacaugggccagugagagccaggggccgccagaagagggcucgagggagagguacgaggcagggaugagcacauugucuauuuuugugugacugguagagagugauguuguccaaggguggggaccgaagagugggugugaggaguggccgguggggcacagcugauuuuuugggggaacccguugacgugaggugguggauucguggcugagaguuggcagugguuuugcuuggaggcacguguuugagaaccguuuacucggguggaggaggucaggagagagcaugauuuuucauaagagaaggaaggaggacugaggacucggcuuuggggagcagaguugggaacacacagaagagucuggggcaugcagagaggcuggcaggaggcagaggagggagcaagaagaaagagcucagugugaugaguccugaggggaagcugggcagggccaggauugagugagaagcagcaagaaggagagaggggaaaugggccucggugauggcuggcugccaggguggcggagccgcuccgaaagucaugcaucacuuagcgacggggacgccuucugagacauguguccuuaggugauuuggucccugugugaacaucacagagcacauuuauacaaacccagguagaguuagcgcagugucgccugcugcacaccuaggcuguacggcaccgucuguugcucugaggcuaugugccuguacagcaugguacuguucugaauacugcaggcaguugucacacaaugguugguauuuuuguaucuaaacaucucuaaauauggagcagguauaguacaaauacagaaugaaagauaaaauggcauacucguguagggcagcuggugcgauuggcgcucacgggacuggacggugcccuuggugggucggugaaugaagggugagugaaugggaaggucuggguccucacugugcaucguguagaugucauuagcacucuacauuuaggcucuacuagauucauaaacacaccuucuuucuucaguaguaaauuaaccuuagcuugcugugacuuuuaaacuucauaaacguuuugauuuuuaaaaaacuuuuugacuccuuucuauugacacauagcuuagaacacaaauacguuguacagcugcaccaagauauuuuucuuuauauccugacucgguaagcuuuuuucucuuuuuaaaauuuuuuauuuuuuacuuuuucagcuuuuuguuaaaaacuaagacacagacacacacauuagccuaggccgacacagggucgggaccgucagugccacuggcuuccaccuccacaucuugccccaguggaaggucuucgggggcaauaacaugcauggaaucaucaucuuccaugauaacauugccuucuucuggaaugccuccugaaggacuagggacuugccugaggcuguuuuacagcuuuuauuguauuuuguuuuuuaaacaagcagaaggaacauaacucuaaaauaaugauaaaaaguauaguacaauaggccaggcacaguguaauccuguaaucccagcacucugggaggccaaggcagguagaucaccugaggucaggaguucgaaagcagccuggccaacauggugaaaccccgucucuacuaaaaguacaaaaauuagccgggcgugguggugggcaccuguaaucccagauacccaggagucugaggcaggagaaucgcuuguacccuggaggcagaggcugcagugagucgagaucacaccauugcacuccagccugaaugacaagagcaaaacucugucucaaauaaaaaaacaaguauaauacaauuaguacaaugaauacauccauaaagcaguagcauaguuguucauuaugaucaaguauuacguacaguacauaauguaugugcuauacuguuauaggacuggcagugcaguagauuugcuuacaucagcaucaccgcaaacacaggaguaugcuuugugaugugauguaacuuuggcugugacaucacuaggugacaggaauuuuucaacugcauuauagucuuacaggaccaugguccuauauguggucuguuguugacuaaaaugucguuauguggugcguggcuugacuucucuguguuggacaauuucuuucuuucuuuuuuuuaaaggugcccaccaccacaccuggcuaauguuuguauuuuuaguagagacgggguuucaccauguuggccaggcuggucucgaacuccugaccucaggugaucugcccgccucggccucccaaagagcuggaauuacagacgugagccacagcgccuggccaggacaauuucaaaauacuuccauuuccuucauauuuucuguuuucuauaauaaacacacauugcuuuuguuaugugcgggaaaaaaucauuguaaaaaugcuguuuccaagaccuauuuccagagauguccguuugacccaguaauugccucagccccuacuggguucucagugcuccgagggcugugaggagugugacaugagacaaaaugcagccccuguagcagggaguuugugguccagaagcagcaccacauagcugggagccuugcaggacagcguauguguugcugccagucagaguggugugggugucggggcgggacagcccucggagacccucugguuugggucucagguaccacauguuucugcuguugacccucggggugggcacaaguuucagauuaugcuguggacggaggggaugguggaauuguucacuguugccaugaugguuuuucguacauuuuuccuccaaagcuccuagaguuaauuuccuuggaaaauuuacuucugaauauauuuuauaaaucuggggaguaucaccauguguuagaaugagcugagugguaaauucaguugccaauuugaguacguauuucagaaagcugcuauugaccccuaagggggcacugaauaaugacugugcuuggagaagagagguugauuagccaucaaaugaauuugacuagaugacuugccuguuuacuucauauaugugaaauacagagaagcauuuaaucguaaauguuucauuuauuuuaugauccugagaacauugcagcuggauuuauugcuuuuccauacuuuuauuuucuuucacucuucccuguuucccucacugcuauuuucaccuacugcuguuuaaccuucaauuaaaaaaaaaaaagcuguucugauacaccaucagguuuguuugaaaagagcaccuugguguagaggcuucaaauucaaaccagaaaaacauucugcaggaucugccagggagagcugccuccugucaaaacccagcggccuugcagcguuggccagagucgcucugucccucuugacucugacuugucucuuccugcuucagagucacuuguauccucauggauuagcugccuucacugaggcggcccaaggacagggagagggacucucgcuuguucacugucagcuuuccaggaccagcccgggccugguguggagcaggugcccagucaguguuuguugagugacuugaauggagaaacauaacgcagcguagucaguagaagcugaagacaucuguguugcacgcugcugucaggcaaggaccaaguuggaggccuuagcuauccagaaguagauucucagcaaguauuggauuuuaguauuuuguuuauuguuuuuuuaaauuuaagcuuuucugaaucauguuguaaagacagcucugggcacaguccugaagaguugguguugaugucagggacccauucucuuucucuugggcauuucccccugccccgacccccacaacugaccagugucuccagccuguucuuaugccgugaccccucugcucuucucccuggaggugcccucccaauuuuguuuuuuuuuuuuuuuuuagacagggugucauucuguugcuggagugcaguugcuggugcugguguugcuggugucacugcuggagugcaguggugcgugaucuuagcucacugcagccuugacuuccugggcucaggugaucuucccaccucagccuccugaguagcugggacuacaggagcacaccaccaugccugguuaauuuuuauauuuuuuauagagacgggguuucaccauguugcccgugcuggucuugaacuccuggacucaaacgaucugccuaccuuggccucccgaagugcugggauuauaggccugagccaccacgcccaaccccaguucucguguuagaccuuaguuuaccugccucgccugccauggguguccucggguuccccuuacgagugguggcauugcaguugcaucucccugugccuaugcugaaaaggggagcuuuggccacaauucugagggcuguuuuuggggagggcauggggaggucuuuuugguugggggucuucuccagggcacagccucuuggggcaucucucugccggccccucccuggccugccccggaguaucuugucccuugugcacauuguuccacuuucaccugugugcggccucuccugucguggguuagagucugugacccuucaucaguguuugcucaugcccucuuccaucugagagccccggcuguguguuuguaggaucagcaggauguguacccauugaccagaacacccaacuaauggccccugccuugcucacuacuaaccaguuaguccuccucaaguuugggggcgaugaaaucugucauuuucaugugaagcaugcugaaguguguuguucuguggugauuuacgcuacaaacuugucauucauggugggacaaguggacuuggacuucuucuucuuauuauuauugagauggagucucacucugucgccuaggcuggugugcaguggcacgaucucggcucacugcaaccuccgccuccuggguucaagugauucuucugccucagccuccuggguagcugggacuacaggcgugcaccaucacacccagcuaauucuuguauuuuuaguagagacgagguuucaccauguuggccaggauggucuccaucucuugaccuugugaucugccugccucggccucucaaagugcugagauuacaggccugagccaccgugcccagccggacuuggacuuauuuaaagguugaaugaaugaggcuggucagccaucucgagccuucccuuccaugacgucccggccuuccugggacacaauggggucagggagggggcccuuccuuuccucccuuccaucuuuguggagauaccacguacauaccacaccguucgcccauuuaaagugcuugguguuuuuaguauauucacaguuaggcagucauuacuacagucaguuuuagaaaaauuucaucaccacagagagcaacgcuguaccuguuagcauucacuucccauucucuccuccccacccuuggcaaccauggggcugcuaucuggcuucagggauuugccuguucuggauguuguaugucgguggaaucauacaguaugcggccuuuugcgucucucagcuucauguugucaggauucacccaugcuguguugcguaccaagacuucauucccuuuaugaccuaauauuacuccauugugugguuaggccacguuguauugacccauucaucagcugguggacauuugccuucauucuuuggcuguuaugguuaaugcuguacaagguuuugguguggauguguauuuucauuucucuuggguaucuaccuccgaguggaauugaugggucaugcgauaacuccauguaaccuucugaggaccugccaaacuguuuuccacagcagcugcccauuuuuaauuucccgcuagcagugugugaggucccggucucucugcauccucaccaucacgcuuuagcgucuuuuucauuucugccauucugcugggugugaagugguauccgauggugguuuugauuuguguuucucugaucgcuaaugauacugagcuuacuuuuugaaagauuucuguuuacagugucaaaagaaugggcagacuuagaguuaucagcacugugcccccaggaguccuccauguuuugacccuucuggagaguaaggcggugcuccagcagugugcccguguccaggccacgcacaccucaccuucacagagccagagcgaucuuuaaaaaacuagaaagcguuucagacauucagaaggggcacacaggcugauguaauacagaacacaccguaucuccauccagcaugggaaagaggacagcgcacacacgcaguugaugccgcuguggggucuuugccugaacucagcugcucccuccacccauucugaguuuuguguuuccauucccaugugugcaggagcaguuuuuuuuuuaccacucauguguaucaaaagugauauauaguaucauuucgcauuuaaaaaauuuuuuuaaaggaugccacacugucaacuugcucuccucuucaguguucuguugaugacauuuauuuggauugguucuggugguucuaguucauucacaucugcuaugguuaguauuccauuauauguauguauucuggcuuaugcauuauucagucaaugggcaucuagguuuaucucaaaaaaauuuuuuuuaucuuuuuuagcauuauagacauugcugagcucaucuccugugugcuugugcaaggguuuucuaggucgucuaucaagaaguggaauuacgucauaugcaucugcuuuucauaaggaaucacuaggguucucuuuaauaaaaaacaguagauuacugcaguguuucaaagcaguuuaauucauuaaaaaguuuauugacuaauauccuuuuuuuuguauacaaagucuugcuuuguugcccaggcuggagugcaguggugcgaucacagcucacugcaaccucaaucuccugggcucaugugauccaucuacuuuagccuugugaguggcaggggcuccagguacaugccacugugccuggcuaaguuauuuuuuugguagagauggggucucacuauguugcccaggcuagucuugaacuccuggucucaagugauccgccugccuggucucaagugauccgccagccucccaaagugcugggauuacaggugugagccaccauaccuggcugguuaauauacuuuuuuaaagacagauuucauuaucugaauugagguagguggguauguugccacauauucuuuuaaaauaucuuuaguuguagucugcuuuucuuuuuagcuaugcaaaaucaaauaaaagugcaauuuugauuagauaaaaugggguuccuuuagucucaguugaacuuuguuggaacauuuuuuguuuaguaaacaaaaaugguuugccuaugaagaauuuaugaauuuccggcugucccgggaggaaaagccuguggccugugauaauguugcagagacuuuuuuuuuaaaaaggacaugcaaauaguggccaguaggccaagaagcaugcugguuuugagcaauagagauacauugggaaaugauaggaagaauguaaacguucauauacagagagauugauaauauugauaaacgcuauuuguaggucaugucccaguauucagauuucugugauauacgguuaucucauuucauacauguucuuauucccauuuccaggaugagaaaacgaaaacucagaguacuuacuugguuaaaacuuuaccagcuaguaaguguuggagcugggccuugaacccgagccuuugauuuuuaaaccugaaagcuuucuaccaaugucagagagacauccaagacauuucaggaaaaggacaugacagauagauugugcuugaucuaagcaggcuguaucuuuuucccacccccuggcauagagcaagcauuugauucugcucauaggguuugugggucagaaauucacauggggcacagugggaugucuugucucuucuccaugaugucuggggccucacuaggaagacucgagggcuggggcuggaauuauaagagggcugauucacugacuugucuagcagugaugcaggcuguccacugggccuucagcuagugcuguggguuguaauguguacauaugggagauccuuguggcuaauuuuggcaucuucagagaauggguagcuggguuccaagagcgggaacccaagaggaccagguaaaagcuguauugacuuuaaaacauuauaacaucuucccugagauacagauagaacacaauucacccacaauagccuucacccauuuaaaguauauaaugcagugguuuuuuuagugucuucaaaguguuguguaacuaucaccacaaucaauuuuagagcauguuuauugccucuagaaaaccucguguguccuuuaacuaucaccccugccuuccucccuguucuaguccccaaguaaccacuaaucuacguucucuguauauagaauugucuauucuagggauuucaaauaaauggaauaauauaaugugcauuucuuugguaauuaucuucuuucacugagcauaauauuuucaagauugaucuacguuguagcuuguaucacuacuuuuguuuugagacaagguccugcucuguugcccaggcuagagagugcaguuuugccaacauggcucacugcagccuugaucucaaccuccugggcucaagugauucuccugcuucagccugccauguagcugggaccacagacaugcaucaucaugccugguuaauuuuuugauuuuuuguagagaucaaggucucacuuuguugcccagacuggucuuuaacuccugggcucaaguuauucuccccaccuuggccucccaaagugcuggauuacaggcaugagccaccucucauccuugucuuuuuccugagcuuaggggcaaaauauucagccuuucaccauuaagugugauguuaacuaugaguuuuuuguagauauccuuuaucaggaugaagauuaccuuuaauuccuaguuuguugauaauuuuuauaaugaaugaguauugaauuuuaucauaugcuuuuucugcaucuauuuagaugaucaugugguuuuuguccuuuaugcuauuaauauaguguauugcacuaauugauuuuugguuauuaaaccaaccuugcauuucuuggauaaauuccacuugauuaugaugcguaaucccuuuuuauguguuguuggauuugguuugcuaguauuuuggguuuuuacguguauauucauaagagauacugguuuguaguuuucuuucuuugugauaucuuugcuugauuuugguaucacgguaguacuugccucauagaaugaguugggaaauauuaccuccuuuucuagguuuuggaaggauuuaugaagaauugguauuaauucuucuuuaucuauuugguagaauuuaccagugaaucccucugggcuuggacuuuucuuugugcguaguguuuugauuacuaauuuagucucuuuauuuuuauuuuuuauuuuuuugagacaggaucuugcucuguugcccacacuuaagcgcaguagugccgucauaggucacuguaaccucaaauuccugggcucaagugauccucccacgucagccuucugaguagcugggacuacaggugugugccaccaugcccacuaguuuuuugguuuuuaauagaugaggucuugcuuuguuggccaggcuggucuugaacuccugggguucaagugauccucccaccuuggcuucccaaagugcuugauuacaaacgugagccagugugcccggccucuaauucagccucuuuccauguuauguaucuagucauauuuccuccugcuccuugaguaaguuucaguuguguguaucuuucugggaauuugcgcauuguaucuaauuaauuuuauuuguugguguacaguuguucauaauauucucauaauucuuuuuauuucuguaagguugauaauaaugucuuuuccaucaugucugacuuuaguaauuuaagucuucucuuuuuucuuuuagucagucuagccaaagguuugucaauuuuauucaucuacucagagaaccaucucuugguuuuguucauuuuccuuauauuuaaggaaacaaccagaccagcagcuuucugugucuccguggaguccugcuaugguucugggaguugccucuccucucuuucugucgaguggcccggccagugcauguggcggcuccugcgucuccccuucaccagaguagcucugccuuuaccuguuuggcauuuccauguaacauuucuuuugaaaaguugguuuacugcuaaaguacuggcuuucauacagugaaaccccacagaacaaaacuggagcugcgugcauuaacauugauacauaaagaacaaucuugagggaacaucuaguugcaaagguacauauguaugaaaugauaacaguguaaacuuugcaaaugugcagaauaauacuguauguugcccagagauccacgucucuuccauaauaguauaaacucuuacauggaaauggaaaaugucaaauacagguugguagccaccucagaggaggcagguagagaaccagaauggggaggguuucaacucuauuauaugacaaaauguuggaauuugggggaagugaaucucuggguggugucugugugguuauuccuuauguccuauaugucacuaagcuggcugcagccugccagggguaggugacuuugggcaggcuacuuuuuuuuuuuuuuuuuuuuuugggacggagucuuacucugucacccagguuggagugcaggggcgugaucucggcucacugcaagcucugccucccggguucacaccauucucuugccucagccuccuaaguagcugggacuauaggcguccgccaccacgaccggguaauuuuuuguauuuuuaguagagacgggguuucacuguguuagccaggacggucucgaucuccagaccucgugauccacccgccucggccucccaaagugcugggauuacaggcgugagccaccacgcccggccaggcaggcuacuuucuuaagcuuucugucccucaguuuuuccaccuuuugaaugggaagaguaaugauaucugccuuauuggguugcaaagauuaaaggacuuaacacauugagaguuuaaaauaaugcucaucucuguuagcuacuacuauuauucucuaugcuuuauugcuugcaguauugauaguaaaaaagaaacggcauguugagcaaaucuggaggcuguugaaagugguuggagcugagcaguggcacguggcaugguggucacagggcuguuccuucacuuuucuguguguuucauuccuuugguaaaaguauccagcaccagccccacugggacccgccugugguucaugccacagggcgucuguguccucagcacccaggacagugccugccucguagguccuuccugguugagaggagggaucagcgcuuugcuuucaggucaucuucaguuugaaacugaaacucacucugauguaugcagaaauaaaugugauguuuucaucuggaugcugacuuuagaauuuucuucugaaaucauauauuucuccuuauuggcuuuuuuuugggaaggagaagucauaacaaacccuucaaggggccagacucuuuugaauuccuuucucuucucuggguuuccaaucuuccucuguggagugaggggugggacugggcuccugggccuuugaaggaaggccgggugugggcucauguuucugcuugcuguggugacaggcccuuggcugccacuuugaugucccacugauuccacugcuccuggccuucagaucagguacgugcuguuuuguuugucucaaccuucugccagccacuuuuccuaguucuaagugugauuuuuuuucuuaaggaaucuuccuucuuuucuuuuuuuuuuuuuuuugagacagagucucgcugucgccuaggcuggagugcaguggcgcaaucucggcucacuacaagcucugccuccuggguucacgccauucuccugccucagcuucccaaguagcugggauuacaggcacgugccaccaagcccggcuaauuuuuuguauuuuucauagagacgggguuucacuguguuauccaggauggucucgaucuccugaccucgugauccgcccgccucggccucccgauaagacuggguuucugugcuccugugacaugcucuuguaggaaucaucauagaacagucaaaaugccaguugaaguuuugcuuuugugaguaaacuguaagggccggaauaguuuggauguguugugcuuaccuuugccuccccagugcccuguccgagagucaguaucaaaaaaauguuugucaaguuuugcugaaaaaucuuagaauauaaaagugaacauuugguauaauuaauauguugugcugcaggcauaggaaugggauacugaauagaaacugagugggaaacugaaaaaugacccaauguaauauuuuaacguuaaagaugauguucucaaagcagugggugaaaggagagguuacugaauaaaugacauuugaacccuucuuuauuuuuuuuuaaaguuuccuacuaaacacuauauagcaaaauaaaauaaauucuagguggauugaaaacuuaaggguaggaacgagcccucuagaaggauugaacuagcacacggcaauguuuaugcacucucagaagggucaggccuuuccaagugucguccccaaaguggagucacgaggaaaggacacaagaguggcucagccucccagaccaaggaaaacagauuggccaccgccauugucuuucugugacugcucuagcaaaucaucacaaacuuacuggcuuacagcaaacaugguauccuagaguucuagaauuugcaagucugaugugggucucgcugggcuaacaccaagguguuggcggggcugguuccuucuggaagcuccaggggagagcguuuucccugcucucuccagcuccaggaagccgcccacguuccuuggcauacagcccccuuucuccacguacagagucagccauguugcauuugugugaccuuccgcggucucuucugcucugaccacagccaggaagguucucugcuuuugaguacucaugauuagauugugcccauccggauugcccaggauggucucccaccucauucguauucuuaauugcaucugcaaaguccccuuugccauguaaggugacguagucacagguucugggcauuaggauguggacgucuugggugggggccguuauucugcugaccacaccaccagaacgacuaagaaggaauccucuguuuacaagguuuuuuuuuacaaagcagugagaaaguggugagcaccucauuagaaaauggacaaaggguaugagcagacaauuuacaaaaagaagagguacaaaugaacaaaauaaaaaaaaaaaguuuuaccuuacuaaugaaugaagaggcacauagccgacacggagaccacuguucucuuguugaaugagcaguggugugugguguugacacugcuggugggauaugaaccacggcucuucagcaguguggaccaguggccuuuuuaaugugugcuuuaugucccaagcuuuccauuucuaggaguuuauccccaagagguuaucauaguugugugcaaauauuugucuccaaauaucuuuauuacuuuuuuuguaaucacuauauuauuuuauuuuuuagagacagggucuuacucuguaacccagauuggagugcaguggugcauucuuggcucacugcaaccuccaccucccaggcucaagcgaucauccggccauuuuuuuguaaucacuuauuuuauuuuuuugagacagggucucacuguguaacccagguuggaguucaguggugcaaucuuggcucacugcaaccucagccucccaaguagcugggaccacaggcuuaugucaccacgcccagccaauuuuuuuguauuuuuuugugcagacgugguuucgccauguugcccaggcugguccuaaacuccugagcucaagcgauccgcccaccucggccucccaacauugccaguauugccuucaacaaacagagauucguuuauuuccugugucugguagucuguggugagcagcgcaggguugggcagcagcucaaagcugucacagccccaugcuguuuccugccugucugcccugcugcccuucaugguggcaucuucacucacgcacgauggcugaggccucaccucuguguuccagguggaaaaaagggaaagaagcugggggccaaaggggugcuagcuaagccuguuuuuuuuuuuuuuuuuccagaaaaguaaaaaccagcauuuauuucuugccggcuaugaaaaauaaaugugugucacagggccagccguggcugacgucagccaaaggagcaaaggcuucuggguagagguugaugagucaaccaacagugucugccacgugggguauuucauuuccaucaguuuuccaaauuuacucugaugcauguaagacuuuuauaguaaaacuguuaagucuuuuucuuuuugagauggagucuugcucugucacccaggcugcagugcaguggcacgaucucggcugacugcaaccuccgccuccaggguucaagccauucuucugccucagccuucccgguagcuaggauuacaggcauguaccaccaugcccagcuaauuuuuguauuuuuaguagagacaggguuucaccauguuugccaggcuggucuccaacuccugacuucaggugauccgcccgccuuggccucccaaagugcugggauuacaggcgugagcuaccgugccaagccuguucaaucuuuuaaaaaauuauauuuaucuuuugcaauucugcauucaauuucagacaaaaugauggcaggugagaauucccaggugggcguuucuucgaguuuuuagucugugggcagaggccucaguuccuucauugcacucccagacacccucaucaccguguagaugcccgagggucugugguggugcuugucgggcugagguccauucucagggaugggcugaaugcccugcuugugugggguguggggugugggcuuguauggugccacucaucccuucugaacugggcccucaggaccccggguggcugcaggggggccugcgacagcccaugaggagcugcuuccuucaguccuguggguuccugggagcccaccuuucggcugagcugguggagggcucuugggaaggcaggagagaggcucacugguuuuccuuuucuuuuccaucagcauccagcacguguauggugcccagcacccccccuuugauccacuguuacauggcacguaagugacguuccaaccucacuuggcgucucggcucugauaugggagggcuguggcaaccccggucuuccugcuuccuuccugcucccaggcauuccucagggaggagacugguuucucauucagccacacugaucaagcagucgcuuugugugagauacugugcaccccgugcugcgcaucccggugaagacggcggaugugggagccacagccugauguggggaggugggggagcccuggggagagccaggagcuggcauccuuuagccaugggcagccuggcugcaggccauccaugcuggcuuguccuuuccccuccuccuucccgcauucuccaccagcugcuggagcccggcccuggccuguccuggccccuccacagcaggcgggagcgcagaguguggggcuugugcugggcuguugugacccugcaggacugcaccugucugacaaguuucucacgugagguggggccgauguuguguguuguccuauuuugggggaaucuuguuuaaaugaucaugucuucaaauccauauaccacaggccugcacccugcacaggcgcuccuggcccacaccccucacugcugggcaggagccuuacugggauucggggaaggugccccaggcacuggccagagugagcuggggugguccugcaggguaucaccauguggcccugcgccuccucccaggugaccuuccuggagcccccucccccuccugccacugaguccucaugggcuucgccugcucuucuuuuggcugucucugugaauuguguuugcuuuuucacucacuauugcuagaucaaagcugaacacuucuaugccugucuuuucaccugggaauucuuuccuggcugguuuugggugaagccuucgagcauguacgaguaaagacugccuuugcauugcaguuugcucagguccacggccaagaugccgaccacaccagugaaggccaagagggucagcaccuuccaggaguuugagagcaauaccagcgaugccugggacgcuggggaggacgacgaugagcuccuggccauggcggcggagagccugaacuccgagguggucauggagacggccaaccgugugcugcguaaccacagccagcggcaggggcggcccacgcugcaggaggggccagggcuucagcagaagcccaggcccgaggcagagccgcccucaccccccagcggcgaccuccggcuggugaagucggucagugagagccacacguccuguccugcagguacgaugggaggacugaagagauggucuggguuucuggccaagcuaagaaaguggccagaacacacucacugugggagaaucaguggguucccauccucauuugcagcaggcccccuggcccacgagagcccuuaugguucucuuccaaggguaggggaguggccugcgcucuuuccuagggcccccaagugcuuucuucuguccuagcuacgugcgugucuccuccuaguggaguggaggcuucuggccuagcuacgugcaugucuucuccgaguggaguggaggcaccaggcuguugugggcuggccgugagagggccacgggggagcaagcgccuggggacacugucucccuccuaacuccaccagcuugugaugguuccaugggugacauugccagccgaggggucaggccucugcauguuuaggggcuggcccucuaggcagcuuacaggauuccugccaggugugcguacacgugggcucaggucuguaggggcugggagucugacuuuugggucggccacguuugcacucugacccccucggguggggucgugucuggugccaugugcauggcacuggugugcagcagcuguucuugaggcuguuucuguggcugcugcucuuuauguguugcaggccaucacgucugugauggaaaagcugcaugguugugcgaugaacccacugugggccgcggguacuguuuucagagcuugggagaccccacuggacagacugagguacaucugugcccugcggcaaguccauucuggugagagggacagaugcagcacugcccacagucagcaagggggcacagagcgugcugggaggcagcaggugccacggucaagagaggcagagaauggggugggaacgcgguggcccugagagcaguggggagcaggugucaucugaaacggggaggucagggugucuucgugucaguggugcuguugggaggcagggggugaggggcaggggcgaaguccagcuggauuggccacuggcccucauagguaccucccuccaaggucuucugggggcuagggugcucuccccacauuuccagcugagaagauggagauuguuaggguggccugauuuuacccuggagaacuagguuucauaccuaggucuaguuuuuaaaaccacuuucuaggaauugguuaacuucuaaaauguuacagcucucauuaguugagaaugcugugcgugauuucauuugaucaguuuucuuuuuggaguguaauaaauuuuaaagucuuugaacucguaacuggaaaucuggugauggccuuugcgggaggcuuggaaaccuggugacugacugaagcaugcacugaccgccuucugcaggcccaguccugggcagcgcccuucagccuguggcagucggaguuggcaggaucccuggcuucaucugcucauggguggugcugacauugaagcucugugagccucucagcaccgugcccccuacccccaagaugcagggcacugucaggcugagaguggccaggaccgcaggaccacacgguguguggcugggggaucugacaagaggcaggcucaggcugugaccagcuggggucggggagcuaugagaugucacccugggaugucacccugggauggccucauccuggaagagccaagcaaaggaugcugcaggcagcuugcgcugggagaagggggcccaugaccucauugccuugugcucccacuugccugccuuggaguuggccaccuuuccuguguuugcuuucugggcaagcuuuuuuugaguacuucaguauagugacaaugauaccauauauugaucauuuacuguguggcagguacaguaucaagucccugugauacuaaacucauuaagcuuugcagcagcacuaggacauggacuuaugggcucugcucaggagugagcggccccuuacguguccugaugaaaccacaucagucauuucugaagaucacagggaaguccagcugagcaccuuuaauucugggacucagugcacagcugcucuuccugcugaauauucacucugaggaacuguaagugcugcugaagcaggagccucugaaggagggagagggggcacugucacccaugguccuccccucugcucaggugcugguucucagcccugucugcaguaaggccggcagcggaaacucuggagccagacgccccgggcuggagccccagcccacugcuuggugugcggcugcuacaaaauaggaaucacugcaagggcacugaggcuggugggaggagauccuccuggggguuggggggagucagggagagugggcagcggggaugggggaggagacagggcgguacucugaagucuauguccccacuuuagcagacuuuucuggaaauuuaacugggccacauucugcccagaggccauagguugccuggcuccuggauagccugaggguuucugugugaauuauuuucccccacucccagguuauaagggaaaugggggugcucugugggaaggagggcgcgggggagugcggcuccuaccuccuugcucagcggcugcuggaguggaugucggcccgucagcugcagcguuugcuucggcuccauuuccuggaguuuauuuuucacucuacuuuaauuuucaguuuuugaaaaaugagauagcuagacaggauuuagacccaggaguuuggagccuuucccagccucuugcuuguuggucucggauggcaguguugagugaucugagggccuuagggucuucccuugggcugacccggucccggguugcuggguggaacgugcugucucaccaccugcuuggaucccccugggccuguccgucuugggggucaguggggccauggugggcagcagcagagggcgggagggagggcgggcagcuuguacucuagugccacugcggucacugccugugguggggucugggaaggugccaucccucaccugucuggcuuccuuuguuuccuugggaugagggucccugugggaccuuccucccagggcacuggugagacccaggagggccaggcagguggcgggguugggcacgcucuugagauggcaggugagagcccucgcagcgcccugguuccugcuguguccccacuguugccuucuguccucagcaccucugcaggcuuucuccuuucccucaugguaacucacgggcuugcccuccgcacucaggccuggcugacccgagggcaccguccuacacagacccucugggucaugucaccugggcaggcccugaucugccaccccaggcacuggugggagccugaccuccacacagcccgaggggcccuggaguuuucuggcugucauuguguugcuuuuaugcaaggugguccauuuuguuggugaauaauacucugccagugaagcgagugaauuucaaaggugucaguuccauguuauugcucaagaaaccaagguccccacugcugagugaugggaagaagggacccaucagcauucacaaagggacaguggcacagcaaggaggaacguguagucgggaggagcgcccucacccucacccccauucucucaccccugcagaaagugccagcgaugccgccccucugcagaggucccagucucucccacacucggccaccgucacgcuggguggcacaucugaccccagcacucucagcagcucagcgcugagcgaaagagaggccucccggcucgacaaguucaagcagcugcuugccggccccaacacggaccuugguaagcacccugcccucuggaggacacacacagacauuucuugcuguuucugaaauagaucacaucuuaaaggauucuauguaugcuuauguaaugcacacgcguccguguguaauuugccuugcaggaaggugauguuuucauguaauauuuucaagucagucacuaagguaguagcaauuugugcuuuagacaaguuuuguuaauguuuuucccaugcaauuugaaaauguauuuugcguuccuuuuuguuuucuuuuuuuaaaauuugagacaaggucuuacucuguugccuggcuggagugcaguggugugaucauagcucacugcaaccuggaauuccugggcucaagcaauccuccugccucagcuuccugaguaugugggacuacaggauugugccaccaugcucaccagauuuuuuaaacaauuuuuucuacagauacgggucugccuguguugcccaggcuggucuugaacuccuaggcuuaagagauccuccugccucagccucacaaagcacugggcuuaaggcgugauccaccacgccuggcccauucuguuuuccuguugucccauuugcacucuuuauuauugcugcccuuggugagcccuucgaggcuggccagguggacauccuuguucuugacaguauucugaagacaguggcucaugggggcacagcgcuggugaccaucaacucaaucugcugguuuuguacuuuccuaccauggggcuugcagucaucagagggugacaggcugugagcccugcaagggggcaggggugaggcuggggcagaggggcaggcccacagggcagagcacagucaccagugugacucuuccugcgcgaguugcuuccaggcacacgcagugcccauguggacugccguggccaggcucuguggaacgcacuugcuuucaguuccucugguggaauuccugcugaauccacguccuuccuuucccuaucucaucuuuguggagugccacucuggcuagguguuugcuagacgcuggagcucucgggaggaccggaauguggccuuggucaugagauugcuucauugaggggacaaaccuguaucacacaguuaugacuggugucacuguggcacucuaagagccagaggugcaacgccuggcuuggccaggagguggcgaguggcgcacgcggaugggccgccaggagccacgcaggagccaugcaggggccauauaggagcuugcagcagccgggccuucacgcucaagcccagggcagggagaggguuuccgggcagaagcagcgguucaaagggcauggcugaagcuguguucucgaggcgggggagggcucuuggaaggucuccuggcuagaaggacacagcucugaguagaguucucagagugggugguuguuucuuccuuauguuuguuuuuuuuugaaacagcaacacuugcauguguuauaacaugacacagcacagcaggguguaugugaaaaugaggccugucccagcccccaccuucccuuccuuuccacagcucgaggugucuccuuccagcgauggcccaugcaucuguuguuuuaaacguuucguguugaugcaauucaaacuugcagaacaguuggcaugaauagugccaacaacucccauaugcucuguacccagaaucaccaauuguuuacguuugcccauuaccauucugcaugugugugccuguuuuuguguguauauauacauuuuuuuccugaaccauuugagagucaguuggagauauaucccuuuaccucugaaaccuucgcugcauauuuccuaagcacaaagacauucccucaguaucaucacagcacaggggucacaaucaggaaauuuaacguugacacaguacuauuuuaacacuuguauuauuuucauccacaguccauagucacauucugccaguugucccaguaauguccuuucccucuuuuuucuuaguccagacuccaguggggaccaugcguuccauuuggaugucacgccucugucuucuccacuaaccuggcgcagcagcuuugccggucucugcauuuccaucuugacacuuuagcagagcacgggccagugauuuugugggaugucccuugguuugugcuugucugauguuugcccacaaugagauucugauugauaauuuuuggcaggaacaucacugaagggauucguguucuccuuggucaucacagcgggggcacguggugcugguggguccucacguugaagauguggacuccgaucacuugguugagguggcgucugccagcucuuuccacugaagagcuccccuuuuuccuuuggugaugaagugcucuguagagagaugcucuggggucugugcauuucuacaguguauuucuuuguccccuugcacggcaaggcaguugugcaccucacuuuuuaagggaaugauacauuuucccauggcguacguggagaaccgccuuagucuuuagagugcccuguaacaugccauccuauggauuucccccgacuugacugcaccagccccugcgguugggcagcggguuauuccuaacuugcuauuauuacaaacaacuugagaacguuucuucaggcgccugaaccuccuucugugauggugacacagagcaucccuagccaugggugaggcgagaaggcagugugggggaugggucugugaguucgccuagagcaccagguguggaggugucacccaccaagacaggagauaaagguagaucgugcuuacgggagucuagucuuguaguugacguacccaucuuggccacuuccucuucuagcaugccagugccccuucucugcuggcucuccugccuccagggugguguggagauucagaaccacguugcaccugggagaguggguccuggagccgggcugccuguguggagagcuggcuccacugguuacucgccacgugaccuugagccagcuuggugaugauccugcucucagaguucuuguuugcgugauagacaugaugaaagcggugcucauuuugcaguuuaaaugagauaguacauaugacaugcuuaacagagugccuagcacauacuaaacacucaaaaauguuaguuauuuuuaugguuguuguuacguucauuugaacuggccuuuuuaucuucucacuugauuuuugugcuauugacguauauggucacuuuuguggucauugacgagucaaggacuuacagauguuuuccugguuguguccugugguuuccagcaguaggcagguggaggagagacagcuggugaaagcaagauuugccugaugggaacccugugcugggucaggcucugaguacccaccuggagcauucuggaggacuuuguaauugaaccaacuuuuggaaauuaaaaucacacuuaaaaguaaagcuuucaagacuuguaggaagaugggaguauguagggcuagauuuuagcacguaaaaaucaaguauuuuguuagguugaggggacuguggguuuuuuucuuucuuuauaauucuauguaaauaucaaaucuaaaaccaaaaagcuaaaugcagagcuuucaaaguuaaacgaugacugcauuuguauuuaguagcaagagaaaacaucgccaguaaauugccuguuuuuauaaggcaguuaagauagcuuuggaagacaguggaauguacuuucuucacauuacaugaaagacguaaguggcaaauauuugccaauguuggagaagcaaaucacugaugugagaagugccuacagaaaugagucuaccugcugaauaucauucuguccagcggagugcuguuuuucuuuguuuagcuuacgcucuguuaugagccuggggaugaaaguagcaaauagaacuuaauagcucauuuuacucuuagcauuggcucaauauuuacucacacaaagacugccugcuuugaagccccggaaaaugacacucaaguuggucacauguaucuggugaaugguagugcgauuugguaacauguagaacacgcaguuuccugaggaccgucuagggccugccucgcagcaguggggccucggagggcaaacuguguguggagcucagcucuggcccucaaggcuuucgaacgguaggacagaaggcacgacgacccguccgucaaggaguggggccaggccacggcuguguuccacuuccccugaggggugaccauccagucuaggcuuuaugagagcgugcugauagauggaggucagcgggagaggguguuuuggggguugggagggcaugaacagaaguuuggagccguacaccuuggcagcacuaauacgaguagaugcccccuugguguccguggcucuagggcagccgugaaggggccugggcccuuggugacaggaggaagcaggugcggccuuggaguaggcccucagugugauggcuggccguguccuuacucaugaaguggcucaaccuaccuguuucgucagcuguagagggagcaugagaccugcccugcaggguccucgugaaggucagugggaauuuauguagagucacucauccaggcucuguugagcaccugcugugguuguaggcacuggggaggaaucggcggcgaggcuugcgagggcccugcccucaaggagcugacauucucgugugaggagacagagggagcucgcucaguacccccgcaaccaucagaaggcaggaagcauauagggagagucaaggcauguggaggguagaggcuggagcugcucugcaguuggcuguuucuggggcgagaucugcacggagucagguauuugaagagggggcaugagcauucuagggacaggcccagaggugcaaagguccugcgggcaauagagcuucaugugcuugagggguuucugaggcucuggccugguggcugagugggguguggggagaggccugcaaggcaggcagggaccagguccccagggcugagaaguccaggagaaggagcucugcuuuuacuucgagcacagcaugaagccucugggagguuuugaaccgggggaguaaagcgcggugcagagcaucagaaagcgguugcuauucuguggaaggaagagccgaugacugcuucugagcagaguguugccaguggccauggacgacguggaguccuugggcagcucaugggaggggcuggaggagggucagaguagggugggagacuagggggcaagaguggaggccgugggcuggggauguggguggggugggcugcgugagucgggggcugaugaaaucuggagcuggguagacuggcgagaaggcaagagccaggacccccauagcuuagagccuggggucugcagggauggggaacagccgauagacacagaaaucagaacacacuccagagauggcauuucacuggggagacaaaaucuccuccucaugaaacagagagccagggaaagcaguguguuuaaaugcucccaugguuacagccacugggggccuucacucugugcugggcacugugcuguagagacuguguuaucagccaccaaaagaccccccucugcacccccacccccuuccugcgugccccagauugcuggccuuaucgcugguuuacagcugaagagcucgagacaagguuaaacaggcggcugcccuccagccccacagugagggcagagcuggcugggaaccggggucaccccgggcugggcucccagccuccaggucacacguuucugguuaguguagacagugggcauucuuggugcuguuggaggccugaggaagggcggcgguuuucucuccugugggccuuguuggagaucucgcuucugcugugggagcuggggcccggcccccaggagcugaggcggggagggcgguugguucuugcgacccggccgucagcguucagcgucgcccucuaguggccaggugcugucuuugcagccugggcuucaugaccacagcagggcacguuggccuuguggguggggggugcuuacacuugcgcgugucuguguguguucaccgugcuuacugaaaggcaggcacagccucagaagagaauaacgugagggacgaagaugaaagcucuggcuaacucggccuugcccuggcgucucaucagggaagggcuuugucaaggaaggcagcccccuggccaccuagaacugcugaaugcagaggcccggggcagagggaacaaacuccagcuugcacaguccuucugugcaugcacuggcccagccacacccagauccuugcuggcccugcucuguccucaaguccccugcagugagugucacauaguagguacuugucauuugaugguucgcugacucuucagcuagaccuuucuugccuucuuuuggugcauacaugguccugugucucugguuuuacuuuguuucuuagauaaauuuacuagguaaguaacugacacuaccauccaauggcagcucagcagcaaugcgauggcaccuccuugagccaaggacgggcuuucccaaccgugugacucuggguuugcguuuuccccccguggcuucccccacaucaccguuacucugcuuucccucaaagcuugcccccggccuuggccccuuuuugcccguguguucccacuuaggacaggagcugugccuauuucuuuucucugcucauuuugucacuaaaggguuucugugaucaucauuaacggaaauguuauugaaaguuagagaaauggaaaagauaauaaaaccaacaaaccaaaauugccacuguuuccacaugcuguauuaacuagaguugugcuugcuuuuucucucuaauuuauucccucuuaaucaguucuuaccaguuuuucagagcucacuagcagaaauggcucucucucagcggcuguuuuaucugcagagugaucugggcuucaggcagggcaugcgagagccucagugaacacgcuggcuccccacuuucacagcauugccggcauccuuuuuucugggugauguguucccugcucgaugugguauuugaacuacaugugaugucacuuggcuuaaaauaaccaaauuagauaugauuuggugaaaauuaggaauuuuauuuacuauccauaguaauguaaaucuucaguuuaauaggaaaccuuucacuguuccuucaggugauuuguuucuguugaauggugauuuuuagucuguaauauuaaaagcaaaugcuaaaagagaguuuguaagucuuugguaugguuuuaaaggagccgccuuaaaaacuuaucuguugcauguuugucuuuuuuuucuuauaauuucuuuuguagaugaggauauuggauacagacuugagcaauugugcgacugugguauuuucucuaugugagggauaggagaaggaaaguagggcgaguauggcaggauccccagggacucauugcuccucgcccuguacaacauuuucuacuuguaacuuagcuccuauuaugguuuccucuaagagaguaugaguuuguguccaucugcccauuagacugugauccucucuugggccguggcuggagucacucauccuccuguuccagugacuggcacaugcauggcacauucucaggaaaugcuggcagaguuaauugagccaccagcggucagucuccuucucuccuacccuguguucuucagcggugaguggggcaucacugguuuuccaguugacacagggugccuuguaucuggggccuuccgugaagauguguuuuugcuguagguaacagaaaagcagacgcaaggacuuuugaacaaauucaaaaguuaaguuucucagcaagaugccuggaggcagguagcuguuggcacugguucacuggcucagugauguccucaggaucuaagcuccaagucacuugaccucuuccucacagcucuaaaggggcugucaccaucauggggugauggaaggagcagucaccagggcaggcgucuucuuacugggagaguagggcugccuucagagccaggccacauggccacuccuggugguagggggagcugccaaggaugugucuccugugggcuggacaugggcacuuucaaaccgggauucuggaaacagagaggugggauggguuggauauugguuuggcagccaacuguguuugccauucacagagauugaugugugugucucucaccgcccccccacaccccccacccgauuucuggguccuuaaugucuuucuguccuucuucuucuucuucuucuuuuuuuucuuuauuuugagauggagccuugcucuuucgcccagacuggagugcaguggcuucaucucggcccacugcagccuccgccucccagguucaagugauucuccugccucaaccuccugaguagcugggauuacaggcacccaccaccacacccggcuaaguuuuguauuuuuaguagagacgggguuucaccauguuggucaggcuggucucgaacuccugaccucgugauccacccgcuuuggccucccaaagugcugggauuacaggugugagccaccgcgcccggccuccaacccucuuaucacauuuaccccauggcucagugccgagcgcuguguggaaaacguaguauagagacccagauguuugauugcauugaacugucuacagagugcuggguguagagggacucaguaaaugaacuuugaauucucauagucagugacauggcauuuagaaugaacccuccucuguucugauuuuuuuuuuuuuuuuugcccggaaauggagcugagacucaaagggccacaaaccaucccauuacucaagugcauaguacugaaagcugccgagaaaauaauguuuuuguuuuaagaugguuuaaauuccuuggagucuauuauuuaaaaaauauuuaaaaauuauuaaaaauuuuuaaauuuaaauuaaauuuuaaauuaaauuaaauauuaaaaauauuuaaaaauuauuuagaaaauauuauuuaaaaaaaguauggccacagaccauuagaacugacauguaagacugagcugaaaagaaaaucaagcuaaaaaaggauauaaaauguguuaacuuagaaaaaugugauaauguaccuuugacuuucuaggggcucuggguaugauggugaguugucacccaagccugaggacagagugaugggagccugagagggcggaggugagugccuguggcuggugggucccacccagggucuggaguggguagaauagugcugaucuucggccagucagaccugaguagcuacaauuauggaauuggguuugcugauaugaggaggggaaguucaaccucuucacagggcuggccgagcaaaugugugcagagccaauagggcuuugcuccuccccaggcauggccuggauacucuaguauuaugggauauuuuauaagaggauuggcagguucugugaccgcagauucuuccugcucaaccgcagauucuacaggugcauccuguagacacuuuacaggcgaaguuacagggaagaggauuucuuuaagaaggaaaguuggaagacaguggugagcaauuagaauucaccaccagcguggaacgauggaggaucaacagcagcaggauuguucuccuucuuuagaauucagggcuucagggauuaguguugauugugauggugauggugaugaugguggugaugauaguagugauggcgaugauaacugugaugaugguggugggaaugauagugauaccaacucuccugcuugucgguguuguggacccugucagcccgugcugaggacuucuguccugucugcucugaggccccagugcugcuuugcuuggagcuguuugggaggcacaguggguuugauguuagaaggaagaagcacaugcaugcgucugugugacaaagccauuugcuugacgacacgcuggcacuacuuggcacuguaccucugcagcggcagugaccaguguuuauccagccuuccccacaggcuagcucauuuguuuggcauuuacuccauaugaugaguagggcggcaggauuccugugauucccauuuugcagaucaagaaacugaggcuuagaaauggaggaggaccuaaggucagaugccagccaguagcaacaaucacuugauuuaauccaggcuucuuugcauugcacacugcuuugcuuacuuuaauaggacaugaagaguucgguuuuagaaauuuuauacagggccaggugaaguagcucauacuuguaaucccagcaguugggaggccuaggugggaggauugcucgagcccaggaguuggaggcuacagugagcuaugaucaugccacugcacuccggccugggugacagagcaacaccgugucucuaaaagaaaaagcaaaaaaauaaaaaagaaacuugguacaggauuaaaucauagaugauuaaaauaagaaaaugggaagaaauuucuaaugaacagaaaugcaguaaggggcugggcacgguggcuuaugccuguaaucccagcacuuugggaggccgaggcggguggaucaccugaggucaggaguucgagaccagccuggccaacauggcaaaaccccgucuuuacuaaaaauacaaaaauuagccgggcgugauggcacacgccuguaaucccagcuacuuaggaagcugaggcaggagaauugcuugaacccgggaggcagagguugcagugagccgagauugugccauugcacuccagccuggguaacagagugagauucugcuuaaaaaaauaaaaaaaaauaaaaaaauaaagaaaugcaguagggaugggaggugaaaaauaaaaaaauaauccaguuaccaucacaacuggauacaauacaggaaguuacaccuuaaaucaguugccaagaauaaagcaaauccuugguuuugcauagagaggugaaggauaucaccuuuauccugauguuauuguguguggugaaauguagucagguaaggcuuugacuuugguguuuagccagcuuuuuuuuuuugggagacagucuuguucgguugcccaggccagagugcaguggcgcgauguuggcuuacugcaagcuccgccuccugaguucacgccauucucuugccucagccucccgaguagcugggacuacaggcaccugccaccaugccuggcuaauuuuuuguauuguuaguagagacgggguuucaccguguuagccaggauggucucaaucuccugaccucgugauccacccuccucggccuuccaaagugcugggauuacaggcgugagccaccgugcccggccuucgccagcuuuugagguauucauauaaacuauuggaggcuuucucuugaaaucccagacuauguucaaauugguccuaaagagaagaaguucaaguuugcuuaaaauccuaauguagauuaucuuaggguaagagaaucuaaagaauagguuaguguauuaauuugccugggcugccauaagaaaauaccacagacugggugguuuaugcaguagacauugauuucucccaguuccagaggcuggaaguccaggaccggggugcuggcugauccaguuuccgggaagggcucuccucccggcuugcagaugccacauuuuugcugaguugucacauggcauuucuucugugcauguguggggagagagauccagagagagagagggagguggagagcgagcgugcacaggagcucucugggucucuccccauaaggacacuuauccuguggcucagggccccacccucaugacuuaauucaacuucaguuaccucguuauagucccugucucuagacacagucacgcucugggagaggccuucaacauacgaauuugaggauacaguucagucucgaauaguuagcauaucuuuuucaacucaucuuuuaacccaagguaaacccauggauuuguuuuagguucuagaaguaagaauaaccacauccccugccacccugacccuuagcaucucgggggucagggcaguaugggaaacaggaccaugggcuuugggguggcgcaugucagguccuguccgggcuucgacauuuacuaacacagugaccugggcagugucuucaucuguagaaugggguaaugucagaggccuccauaguguuugggaggcgugaugaggccaucugcggagugguuagcagggagcccugcccggcugcuguguucuuaccgucguuuuccuguguguccuccccacccagauuuuccacugaggccaugaaacuauauagauggcauuuguuguccuuuuauucagguuaauauuacaucauccuccucucccaugcugcuauaaucuucauaaccaucauuuuuaauggcuguauaauguuuugaaaaugaucuuuacuuaaaauucuuauuaaaauugcauaucuaagucaaaauuucauuuauaugcuugaucaaaauguagacuuguuugagaguauucaaaaugugucacaucagcucacgcauacagaagugauguuccuggguguucuggaggagggaggaaugcucuggggcucaccacuugcaguuuaggaacugguaacauugauuucuacucuauuuaccagcguuucuaauuggaaaagcugcauuauacgaaguuaaaacauuuacagugguuccucagggcuugcagccugacaaauaaaucuccuucgcucccgacccuucuauuucugucuccuuucagaaguguuccacacauauucgaguagauuuauauagacguguguuaauauauuucuuacuccaccccauucuuuuaaaaauacaaaugaaaacguaauaguguuacgugccccuuuucucacucaaaaaaaaaaaaguauauauuuauggagagcaugagaacagguaagauuuaguauauagguauaaucaucuuuuauuuuauuaugagggucaaaauggcauaaaaucaucaaauuuuuaaguaaaaauucuguuuuaaaaacuugaggugcaauucaaauaacagacaauaaacuguuuugugguggacaguucagcggcuuuugguacauucacacugcugcacaaccccuaccucagguauuccucaugcaaaagaauaggcagauauuuaagcuuugggaggaguuuuuuuuaaaacaauaauuacauaauuggcgaguucuuauucuuagaaucaaaugaagagguagcucugcuuucgacccuucuagacgccccauggugauacacucuuccauuaaggaacucagauuccuccugggagauaggagacaccaaauccguccuuuuguccucaugugaguucucugggggcagcugggcugcugagagucuguacccuuacaugcaggaugauugaagaggcugggcuuacuuuggggagcauggcuggcauaggccaggcugugugucagaguccaucaugcggcugucauccaggacagccuaauuaccaaguacccugggugcagggcagcagacuggccucagauuccugugggcaggggacagugggcaucggauauuugaugagcuuguuucggccagauucaggcaguggauggugacugggccauguggacaggcuuuggugccuguccguggccuggucaggaagacccauugcauggagugguaaggagcugucagggacagauucuggggugggguggaaccagaagagagacacaggugacaagaaagcaagguucccaucucuucauucauccgucagacacgaguaggugccugcugugccaggcccugugcuggacggugaugagcacuugaguuguguggcuucugaaggcuggcauuugugggugcaucuugucucaugggugugauuuccauagugggagauggggcaagccucucuuagggagggacucacuuaagcggagaguugagcggaggaggcagaguggagucugaguggcgaggguggcagcagcagcaacagucacaagcaacggucacaacgguguaucgagcugcgugcugagcgcguugugugcagugccccugcgauuccuagagacuuacagaggcucagugucuggcucagggucgcccagcuaguggagccagcacucgaggccaggugugucagagagagccagcauccagucugucgcccugcaggacugauaguuucagaagaaggcagugguaggaaaagccaaaaaugcagcuggggucuguucuuggaaggucuggcccgccaggugaaggcauucgauuugaggcagcuguggugccaugagaaagccacuggagauggagaggaggugcugagaucccgugcucagauccugccucugccacccucagaccguccagcuacuuaaucccgccguagccucaguuucccuaccaguaaaaucaaggaauugguccaggugguugccaaggucuggaaaucuuuguucuguguguaguugggagucccagaagguuuugggcagggauuggaaugaucagagcugugcuuuggggagguuaaucgggcuucuggugcuuugugauuauccugcuguagggcuggaagugacgugggggugacacuuugaaauucagcagcaggugaauuagcugugcucugagcuguggcuguuuggaacucccucaugccguuucugggucugguggcagcuucugcuccccugccgcugccuccuccugccugcucguucccuggcaccagcgcuggcuucucugcacccccugugggcacagcaggcacaaggauaaugaggcuguuugggugggcuuguggugcugaggagacacggagcacccaugaaucauggggaucacaguggcccagaugugaggcuggcauuugaaguuugcaggcucuggggcucccacggguuggucacacugugggcugccuggccucacagccucgucagccacucuucccaccccuuuggggacacugcccaccccuguggggacugccgccuuucugcuggcuguguguggcuuugguuuagcucgauggggguuuugaaauggguuuuccgugaaguugauugaggaauuggcagaaggcucacuguguuuagcgaaaauggauuuuaguugaagaugcagccagguaacucaaacuuugggauggcuuuacugacccuuguuuuauuaucauacuugucaaauguagggacugcuauucaguugacaagaaaacguuuccuaauccucguaagcuuaaauuugcuuguuucgacuuaauguuagcauuuaucuuuuuugcuuugguucuuucaagccauuugaugcuucuuuugacucuuuccaugcugcaguugaucuuuguggcguguacggucucuuuccuguuauugauagagucugucguguccggagcuguccgugaggugauuuaugcggccgcugcugccccuugguccgcucuuugucucccaggcggcuccgcaggucuuucuguaugcaggccacugcauuucauuugcuucuuccuuuacuuuaaugaccuucuagaucagaccauuaaauacuucacuaaaguacacucuuuucuuccauuuauucaugguuauuuccucaauaaaguguauauugaauucguaagacacagauuuccuugugugugccuguuccaucagaagucauugaaacuuuucuaggcuuggggcuucugugcuuggaaauucugucccuauuaccuaagccacauauuaaagaauaagaucuauuuagcaaagucauuuuuugauccuuaguaugcggcauuuaauuuacaguuauuuucagugagauuuuaaauuugcuuuggccaguaugggugacuucucuggagagggagaaaucuuauuuuuacuuuaacuuuuuauuggcuuuuccguuuucccaggguagaagaagaaugcuuuaauaauagugaaaauuauuucugauuauuucauucaauuacaauauguagugagcuccuaccaggcgaggcacaggggacccaaaggcuucugcuccaauggagaaagagaucugccgcagauaauacgguagaacuagggaggguuagggcccuuaagcauaugucagaaguuccguggaaacacagaggaacgaguaaugaauucugcuggggauuuggcugggggugggagcaggugggccuucaggggccagaauagcugcagagaaguuauccugucugugcugggccccggaggcugagccaccuccucagcccaggacuggggcagggguuccaugaaggcaggggcaccugacggacaagaaaucagaucuaaaaaugcagacaguauuugggaaaguggcgugguuuggacaucugaaucucuuugucagacauaggaggcugagcccuggugcuccuuccaggagccuugguggcgaccagaaagcuguugcugguuucugccuuuccgcagcccuugcauagucagcgcacacccuggccucuucacccacaggcuggcguggcaggagcaccagccuuaccuucuuagagaauauuuacuuacauucaucuuugcuauucuuaaauauuauuuaaaauuacagauggucaguguuugaaauuuagaaacuacugagaguaauaauaagaaaaauaauagaaucuaaugcuaugugccaggugugggguguggaguccuugauguauauuuucuugaucauuucucacaguaguccugugaaguggaugcuauuuuuauuccuguuugacagaugaggaaacugaggcuugaagggguuaagaaacaugccugacauuccaagauuuugacgucacagagccagggcucaaacuuaggaaugucugaguccacugggcacaggcucuccugccugcugugcaaccugccaagaccagucucaggaagaaagauaaaaacccauguaaacuaccacccuggauuccccaggacguuaaaaaagcugaucuucuuugucuuuuugugagggcuguguguguguguuuuccuuuucacguagacuugagauuaagcaguguaucuaauuauauaucuucuuauauuuauuuuauuuuuaauuuuuuuuuugagauggagucucacucuguugcccaggcuggagugcaaugacaaggucccggcucacugcaaccuccgccucacagguucaagcaauucuccugcaucagcucccgaguagcugggguuacaggccgcugccaccacacuggcuauuuuuuuuuuuuuuuguauuuuuaguagagacaggguuucaccauguuggucaugcuggucucgaaccccugaccucaggugauccacccaccucacccucccaaguggugggauuacaggugugagccaccaugcccggccuauuuuuacuuauuuuaaauaaugucuuuucccaugacacuaacuuucuuugaaaacaugauuguucauggcuuuauaauaguuaucaaaauacauucauuucuuccauuugcuuguaggugaaacauuucugaagacauucuauuauuuggguguuuaaguuguuuccaguuuuguuuuugauguuguuuuuuauuuauuguaauuacuaaccugugagacacaccccugagacauaacucuugaacacuuccuuguguauuuccauggcgugagcccuggggcgaggacucgguguuaaacagagcugugcggcggucgcuuguucacucguguugucuugcuugucccugcgguucccugcuggccccaugcaguuugauagccgcuguugacuuaauuacucuuugcccuucguuuccucuguaucaguguuuuugaauugaagugccccugggcacagaguccuuuauuuggaccuuuggauguuuucucgcucagaguacgcaauccuacuuccccuguguuugauuugccaagguuuuucugcuucagacuuucuaaauucuucagaggauuggugggcaguucuaacaagacggugcccauuucucuuucuaauuuauucacuuguuugcucacucaugaauucagucauuugcucauugauuuguucacucauuuacucggaaaauguuucuuaagcaucugccuggugcugggcacugacgauacaaagauguauuugugaguggugcucccugcccuguagcagcucauccauguugagagaccaggcaaaacaggaaaauuccagcuuuauggcaaggugaaggaaggggaugggugccuggaccuccguggauggggcuuguuuggcuggugggaggauggaagauggagggagagggccugcguggaggggaggccugcuggugggucgggggugaguggagauaaucggcuggagcccgugggguauaccugcgugcgccaugggcagguaggucccacugcagccuuggggagggcucuggggaacgagaagcagauuggauuuuacccugcagguggugucauuucccugccuacaguucuuuaacaaucacacucacacccuugggauagggucccaagccucuggcccucuggcugcugcgaguguccugggagccugcccuggaccuccugcugcggccggccgccugccugccugcucuuggcggcagcuccuccucugccugcggugcugucccugagccuccccacuggaagcugucuguggcccaugugccucguucccccacacuuugguuuggaggguaucacaggggcgggauugggcuuggugccgggccuggcucagggccaugcuugguaaugauuugguaaacugaagaguaagcucugccuggagcuguguuuacucuuucccuuaucucagccaaaaacuguccuuuucaagaaauuuacugccuuucucuaagcacugaaugaaguuauucuuuccaauaagauuagguaaauucuguggaggacuugaaggagaaccagucccaucagaagucagcccaagaauaguaccaucucaacagcaguagauuuuauuggggcacauugugugugaggcucuuugcuuuaggcaguggagugagguggggaacaguacagggaaguuagccacgugguagaugacaggaugagucaugauucuuuuuuuuucuuuuuugggcuuuucagagccuuuugaugcuuaugcauauuaucaauccccaugaccaaaauaagauaggccacauuuccuaacauuugucuacagagcugcuuauucacaggccacuuuaacauuucacggucgugguggucuacaggaagcggguagagcuugugaaaacugaaaaccuuauucauggggucauucccucugauugaaccucauucaaagggucauucccucugauucccuaauuaucagaucuuaacaucugaauucucucaguguccuuuucacauaggcaaaaugcugauguucgaacauuaaagacuuccaguaaaaagaacaucuuguauugcacagcuuagaaaauucuuucuaaacucaucaaguuguauacauuuaaguaggcacaucuuuuuguaagucaaucguaucucaagagaguggcuuaaaauuuuuuuuuccuuuugguuguacuggaauagcuuucucuguaacuucuacccauuggcuguaauaaguggggcuguauuggaugaguccaauucccuauucacauugcuguaaguauaugaggauacuagguuguccuuuuuuuuuuucuuuauuccuucuaaaaaaaaucugggauacaggugcagaaugugcagguuuguuacguagguuacgugugccauggugguuugcugcaccuauugaccugucaccuguugaccuguccucuaaauucccuccccucacccgcccaccaacgggugcugguguguguuguuccgcucucuguguccauguguucucauuguucaacucccagcuaugagugagaacaugcuauguuugguuuucuguuccuguauugguuugcugaggaugauagcuuccagcuucauccaugucccugcaaaggacaugaucucauuccuuuuuauggcugcauaguauuccaugguguauauguaccacauuuucuuuauguagucuaucauugaugggcauuuggguugguuccaugucuuugcuauuguaaauaguguugcaguaaacauaugugugugcacguaucuucauaguagaaugauuuauauucuuuuggguauauacccaguaaugggauugcugggucagauaguauuucugguucuagauccuuggaaaaucgccauaccgucuuccacagugguugaacuaauuuacauucccaccagcaguguaaaaguauucccauuucuccguagccucaccagcaucuguuguuuccugacuuuuuaauaauugcuauucuggcuggugugagauggugucucauugugguuuugauuugcauuuaucugaugaucagugauguugagcuuuuuuaaauguuucuuggccgcauaaaugucuucuuuugagaaguaucuguucauauccuucucccacuuuuugaugggguuguuuuuuacuuguaaauuuaaguuccuuguagauucuggauauuagaccuuugucagauggauagauugcaaaaauuuucucccauucuguaaguugccuguucauuuugaugauaguuucuuuugcucugcagaagcucuuuaguuuaauuggaucucauuugucaauuuuggcuuauguugcaguugcuuuugguguuuuuaucaugaagucuuugcccaugccuauguccugaaugguauugccuagguuuucuucuaggguuuuuaugguuuuggguuuuacauguaagucuuuaagccaucuugaguuaauuuuuguuuaagguauaaggaagggguccaguuguaguuuugugcauauggguagccaguuuucccagcaccauuuacugaagaggagauccuuuccucauugcuuguuuuugucagguuuguugaagaucagauagauggcuguaaguaugugguguuacuucugaggucucuguucugcuccauuggucuauaugucuguuuugguaccaguaccaugcaguuuugauuacuguagccuuguagucagguagcaugaugcuucuagcuuuguucuuuuugcuaggauugucuuggcuauaugggguuugauuccguaugaaauuuaaaauaguuuuuucuaauucugugaagaaugucaaugguaguuugaugggaauagcauugaaucuguaaaguacuuugggcaguauggccauuuuuacgauguugauucuucccauugaugaggauggaauguguuuuccuuuguuuauauucuguuacuuccuugagcagugguuuguaguucuccuugaagagguccuucacaucccuuguuagcuguauuccuugguauuuuauucucuuuguagcaauugugaaugugaguucauucaugauuugacucucugcuugccuauuguugguguaaaggaauacuugugauuuuugcacauugguuuuguauccugagacuuugcugaaguugcuuaucaguuucagaaguuuuugggcugagcugaugggguuuucuaaauauaaaaucaugucaucugcaaacagagacaacuugacuccucucuuccuauuugaauacccuuuauuucuuucucuugccugauugcccuggccagaacuuccaguacuguguugaauaggaguggugagagagggcauccuugucuuguaccaguuuucagagggaaugcuuccagcuuuugcccauucaauaugauauuggcuguggguucaucauaaauagcucuuauuauuuugagauauguuccaucaauaccuaguuuauugagaguuuuuaacaugaagggaugugauguugaauuuuaucaaaggccuuuucuguaucuguugagauaaucgugguuuuuugucauugguucuguuuaugugauggauuauguuuauugauuugcauauguugaaccagccuugaaucccagggaugaagccuaccugaucaugguggauaagcuuuuugaugugcugcuggauuugguucgccaguauuuuauugaggauuuucgcauugauguucaucagggauauuggccugaaguuuucuuuuuuuguugugucucuuaccaguuuuggacugaggaugaugcugguuucauaaaaugaguuagggaggagucccucuuuuucaauuguuuggaauaguuucagaaggaaugguaccagcuccucuuuguauuucugguagaauucaacugugaauuugucugguccuggacuuuuuuugguugguaggcuauuaauuacugccucaauuucagagcuuguuauuggucuauuuagggauucagcuucuuccugguuuagucuaguuaggguauaugcaucuaggaauuuauccauuuugucuggauuuucuaguuuauuugcauagagguguuuauaguauucucugaugguaguuuguauuucuguggggucaguggugauaucuccuuuaucacuuuuuaucgugucucuuugauucuucucucccuuuuucuuuauuaguccagcuagccaucuauuuguucauuuuuucaauaacccagcuccuggauuuguugauuuuuuggaggguuuuuugugucucagucuccuucaauucuucucugaucuuaguuauuuuuugucuucugcuagcuuuuggauuaguuugcucuugccucuucuagcucuuuuaauugugauguuagggcgucgauuugagaucuuucuggcuuucuaaugugggcauuuagugcuauaaauuucccucuuaacacugcucuagcugugucccagagaugcugguacauugucucuuuguucucacugguuucaaagaacuuuuugauuucugccuuaauuucauuauguacccaggagucauucaggagcaaguuauucaauuuccaugaaauuaugugauuuugagugauuucuuaauccugaauucuaauuugauugcacuguggucugagagacugcuaugauuucaguucuuuugcauuugcugaggaguguuuuacuuccaauuauguggucgauuuuagaauaagcgccauguggcacugagaagaauguauauucuguugauuuggaguugagaguuccauagacaucuacgagguccacuugguccagagcugaguucaaguccugaauguccuuguuaauuuucugucuuguugaucuaauacugauagugggguguuaaagucucccacuguuauugugugggagucuaagucucuuuguaggucucuaagaacuugcuuuaugaaucuuggugcugcuguauugguugcuuauauauucagaauaguuagcucuucuuguugaauucuucccuuuaucauuauguaaugcccuucuuugucuuuuuugaucuuuguugguuuaaagucuguuuuaucagagacgaggauugcaaccccugcuuuuuuuuuuuuuuuuugcuuuccaucugcuugguauauuuuccugcaucccuuuauuucgagucugugugugucuuuguguguaagaugggucucuugaauacagcacacugaugagucuuuacuccuuauccaguuugccagucugugucuuuuaauugggggcauuuagcccauuuacauauaaaguuaguauuguuaugugugaauuugguccugucaucaugaugcuaucugguuauuuugcacacuaguugaugcaguugcuucauagugucauuggucuuuauauuuugguguuuuuuugcaguggcugguaccgguuuuuccuuuccauauuuagugcuucuuuugggagcucuugcagggcagagcucugcaguuuaucuggugguaacaaaaucccucagcauuugcuuguguggaaaggauuuuauuucuccuuugcuuaugaagcuuaguuuggcuggaugugaaauuuuggguugaaaauucuuuucuuuaagaauguugaauauugauucuuucucuucuagcuuguagaguuuaugcuguuagucugaugggcuucccuuugugggugaccuggccuuucucucuggcuguucuuaacaguuuuuccuucauuuugaccuuggagaauuugaugauuaugugucuugcgguugaucuucuuguggaguaucuuaaugguguucucuguauuucccgaauuuacauguuggcccgucuugcuagguuggggaaguucuccuggguaaauauccugaagugagauuuccagcuuguuuccauucuccccauccccuucugguacuccaggcaaucguagguucggucauuuuaugaagucucauauuucuuggaggcuuuguucauucuuuuucauucuuuuuucucuauucuugucugcauaccuuauuucauuaauguggucuucaaacucugauauccuuucuucugcuuggucgauucagcuguugauacuuguguuugcuucacgaagaucucaugcuguguuuuucagcuccgucaggucauuuauguuccucucuaaacuuguuauucuaguuagcaguuccucucaccuuuuaucaagguucuuagcuucuuugcauuggguuagaacaugcuccuuuagcucaguguaguuuuuuauuacccaucugcugaagccuacuccugucaauuuguccaucugaucuucuguccaguucugugcccuugauggagagacacugugaucauuuggaggagaugaggcacucuggccuuuuggguuuucagcauuuuuucguugauucuuucucaucuuugugaguuugucuaguuucggucuuugaggcugcugacccuuaguugggguuuuuuuugggggacuuuuuguuguugauguuguugucgcuuucugccuguuuguuuuucuugcaauagucaggucccuguucuguagggcugcugcaguuugcuggggguucacuucaggcccuauucaacugauucacucccaugccuagagaugucacucauggaggcuggagagcagcaaagaugggugccuccugcuucuucuggaaccucugaccuuuaggugcaccaaccugaugccagcaggaucuguccuuuauaggguaucugauaaccccuguuggagggucccacccaguuggguggcauggggagcaggacccgcuuaaugaagcacuuugucccuugguggagagggugucuuuugcugggggagaacccacuugucugggcuaaggguuggugggggcugaggucaccaaaugaaggggcccuacuuuugcuugaauggggacccugggcuaagaucuaggugagcuccaguauaugugagaauugccugucuccuggggagcuccccaagccagagaccccaucauuccuggguugaaaaccacuauccuaggguaaaggacagcaagagagucggugcugggaccauucagaccaauguggguaaccucugcugucaggaaccacaaguauccggcugcaucaggcuucugggagugacugcaauuugaaauccaaagcaucuuacugucuucuuugaagaaauacacauguaggaggccgaaugagguauaagguugaggguccaugacagugucucugugaagaauccaaaagccagggcaacaccaaacuguggugauucauggugacccacagccuuacaaaucugauuuauucaaaggugugauauagaaaaguuuaggcuuauauacauaaugcacguuuauuauagaaaaauuuggaaaauauagaacacugcugcaaagaaaucgccacgugugcaucaccagcuccauucaguuucuguucuucgugugguugauacuacuguacccuaccugccauuugagguccccugggaagggcaggcccauucagggaggcccagggcccugggugaguucucagggcaugggaagcuguguggcaggugcccgcgugguguuugugccguuguccaugcugggcaggaugcagacugcaguguggcuugaauccugccucaccacuuacggggaggauucaaugaauucauggaaggcagggucuuagaauagugccuggcacgugggcaguacuuaauaaauguuagcgaugcuauugaguuuucuucucauggucacugcugggucugcucugccuucuccggaacucuugauguaauuuaaucagcucacagcacuucugggguaagagccugcugcgugccacaugccgucacaggagccgggagugcggccgugaccaggaccagcaggugcugcacacgcacaccugaccccauccgcacacaagugggauggacaguggagcugugauucagaugaugcaggaccauggucuggggcagcaccacccagggcgacagugccagcccgggugugauuuaaagugucccuguagccgugguaaggaaguagcaagcaacaggugagaugaguuuuaguaauacauuuuauuaauauaauauauaaacuauaucaccauaacacguuauaaauucaguauauaauagauauaaaaacugucaaugagauaacuuacacucaguuuucuguacuaagccuagaguguguuuccuacuuagagcgucucucagcuggaccacuuuuuggguguccuguagcuuccguggcucgaggcuccuguguuggacggugcaggggugaagaaggggcugcuuaugaaggugauuuggauggucauucugauggggugacagugaagcguagacccaaaggaugagaggagauagccaccugaugauuugggggcacauaacccucuaaggagggguguguggggaugagcuuggugugcaugugguccuucuccaagaaggccgcuguggcugcagugaagugaagguggagcuuggaggcgagcgaggagggaggggaaucagagcugcauccugcaggccccugagggcgguggaaggaggucacauuccaugcuaguugugguggaaagccaguggaagguuugagcuggggcuggcgcgauucgacuuaggcuuucagaaagaucccuguggcuuuucuguggagguaggaagaccaguuaggagggugguggcuggagucgguggagguggaggaggugaugagaagucugggguuugaggggguguauuuuaaagcuguggggaggaggcuuguugagggacugggugugaaggaugagggaaggagggccaucaggaguggcuguugaggauggggcaacuuggagaggagcagauuuggggagaaaagagacggaauuuggcuugggacauguaaagccugaggugcccugagccaucagucagggugucaagugggcagcuggacacaggugugucuguagugaucuguagccgaggcagaugccaggauggggacgugggguguggaugcuggaguuacauugagaccuggccugcccagcauucuuuuucaugugcugaucugcuugggucaauacauuuuuaauucugcaaagaaggguggugccuguguuuucccuuaacgcaaggcauuugcgugugcagcaggcgucaguggaguuuuggagugucagggauaauguaauaguuauguaauaacuuaaaaucgaugacuaaacauccacguuccccccagagaaauuccuuuugccaccaggaauuucuuagaggugccuuuuucuuccugggggucugaaccccgccgugcccaugccugugcuguguuuccucucugcaggggcccagcuccccucaccagcacaggggacccgcaauggcucugccuuuggaaucugcccgucucccuuuaccaggagaugcagagaacuuuguucucucccuucauaugaauuauauaauacccacuugccaaaaaagauuacagugaauuguuuuuuuucuuuugagacagagucucacucuaucacccgggcuggagugcaguggcacgaucucagcucacugcaaacgcugccucccagguucaagcgauucuugugccucagccucccaaguagcugggauuacaagcauacaccaccaugccuggcuaauuuuugucuuuuuaguagagacgggguuuugccauguuggccaggcuggucucgaauuucuggccuuaagugauccacccgcuuuggccuccccaaagugcugggauuacagguaugaaccaccacacccagccuaaacugaauuguuuuaaauaaaaauugcccucacauauugcauauguaauaugaaaaaacguuuuucaaacagaaguucaccugggugaugagacacugugguggucuucuuuuuuuuuuuuuuugaaacggagucuugcucugucgcccaggcuggaguacaguggcgccaucucggcuuacugcaagcuccaucucccggguucacgccauucuccugccucagccucccgaguagcugggacugcaggugcccaccaccacgccuggcuaauuuuuuguauuuuuagugagaugggguuucaccguguuagccaugauggucucgaucuccugaccucgugauccgcccaccuuggccucccaaagugcugggauuauaggcgugagccaccacacccagcugguggucuucuuuuaacgcuaaacuguggcccuuugugugacuggauguucuucugcaagccgacauucgguaccaaugugggguuccauuguuuggcugggccacacuuuccuggccgccccuguucuccauuuguuucuuccaaguuuuucccauuaaacacugccucagauaucuuaguacucacaucuuagcucucaucucugguuauuuucuugggauaauuacucaauguaaaauuauuguuuccaaagauaugccuauuuuuaagacuugaucaaguuuucuuuuuucacaucuuaugggccaucuguguuucugcugucaauuuccugagcggauuuuucgcugaugguuuugucuuguccuaguguguuugggagagggcuuuucguguccugguguccuggaagguggaugggaugcagguggagcuugggcacccagggcuccugugaggcucagcagggccagccuggguggaagcgaggucccggagacugucccggagcuugcuugagugcuaugguccuacaaagugaaguguuguacccauuuuagagaugaggacaugaguuucagaggggugacuggacaaucccauagcacccacgcagcagagucaggauuugaaccugggcagacgcuugccccauccagagugaaacuuguggacgcugugcaggacgguuccuggcuugcagucagcacucagauagcuguugaaugaauacacgaaaacguaaaucugguuuuaguuuccguuuuuuuuuuuuugaaagacagauuagcucacuguaaaaucuguuuuucuuccuuugccaggaagccaucaacagagacucuuuccucuauccuguuguagaguugauugacaggguucuuugugccuggaaagcaaauuauguuaaaauuaucuucacgaccuauuuauaagugccacgauuccucagcacucuuugguuauaaucuguguccucaggugaguggggucucccgggucccauggcgcccccugccuguucaggucaggcuucuaacuuaccuuggagagugcucugcccgccgucaccacgcgaugguguugugaccucacguggggcaagucaugcaggccgagucggcguuccugagcucccaugcagcgaaugcaucaccucgggagaaaacuguguucaauguccucuuaaugacguuggcauuuucaccaucggugcagcuuguguuucuaaaacaugacuaccucacccacauugccuaucccuaaggcauuucagccacccagagccccuucggaaucugcuuuccuuucucacggacuuaccuuuugaacaugcguguaccaaaugguauuuuauaagucguagucuucucguaucaaaacgaguccuggccgccagcagaacgucugaucagccuaggugaucggccugcccagagagagcugcugucauuuccacuugaggaugcgugugggcuuggucacuuugugcagccugguggugugagugaggucucagccuuaggugggcuucugaagggugaccuaugacuccucucuucucugagaguaccuggguggagcguacuggggucccaggaugauggaugaugggccacuuucuacuggggcgggcagugaagacuucaucuggaggugcuugucuuauccgcagggacugucugucucaaccacgugagcagcguuaaggccgcucugcagcucuuugugcggauauauggcaugggugcuccccuuugugcuccccacccuaacacaaucucaaguguuguuaggccugugcgucgugcaguguaauuuccccacaaggugucacugcagauuauucccaggacuuucacgccccagggacuuccgugugccauugacuaagauuagaagcaucuugaggccagggggcugcuccacacucccgugccuuccaacacagcagagguucuggugcagcgucaggacuccagugggauuuuucuuuuguauuugagagaauggauggaggugggauacauuugcucagcaugauuucucacccacggauuaauaaauauauguaagugugauaaaguuaaaaaauggaggccucauaauucugcaggaagaaagacaaaggaauuaaagauugaaaaggcaagaagccuuugaagcagccuguuguccucuuaguuguucacauucugguucuaacaacauguccacuugaagaacuaccugggccacugcgagauguuugucacugugagauguuugucuguugcauuucucuacccacucccacggccuguccuggaguucacacucucccugucucuggccugggccgcuuugggagucucccgucuggcccaagggcguccagcuuaccucuuccugcccgucucccacaggagaucuuguuagaggccagucugcuuaccugagcuucugcuuucagauccuugguuagccuccugcauggagcucagaguccagacuccucagccugggacaggaggccacaccucucaccaccucccacuuaggccuucucccacccuccugucucuguuuggacuguucucugccacccacugucacucuagccacaugggcucaucucugcucuucaggugagcugugcacaugugcacacacagauacacgcccucacguugagcgcucauuuccuuugugccuggugcuguucuuaguaccucaugggucuuauuucauacuugaaacgaccuacauggcagguucuauauugucuguuucagaugagcuagaggcacugauacaguaaacaaaguccuuaaggucacacacucuccaaugucacaggucugggaugagagcccagaugugucccccacccccuccacauuucugcugguggucagggguggggguuucccugcuucgcuucugugcauucuccaagugucggaucaaauagcaccuccucuuuguggcucuuuuuucuuugacucuucucucuguccuuacaaaauuaauugugcaguaaucaaacgcauuguuucauaguuacuuguggccugggcugugagcccucaggguaggggugcaucuuauucaucuucagguuccgugguucagggcacauauuacguagguaccuggugaaauuagguaauguuugggaugucuugaaaauguauguuguggaacucacccccuucauggccuggugaguagggguuugugagggaugguccuguuguugcuucucucuuccugugcucccugaugcuccugaagucaccucugcuuuugcugcugauuagagacagaacucuucuaaccgacuuacuagcacggagagaauacaucugcuucacauugcugccaaguuaauacugcaucugggaaggccagagaaaaaccaaguuaagagaaucuuacugcauaauuuaugaaagacugagucauaaaauaagcauuuacaguggccuguuugcccaagguagggaaugcuaaugcagcuauuauucaucccgauggggccagcggcguuucuaugccuccaaaaggucuucuggcucuuaguugccuccauggauuucugagguuaucucuagccuuuguuuccaaaauuggcucuuuuccuguuugggggccggagguuuggaguucagugccgcgugaaacaauuuuguaggaacuguguguguugauauuucuaaacaauggaggucguaaagaaaaaaaucccaagacaccagauucagugccagcucaguacuaggcaccaugaaaggagcagggguacacagggaaaugagacuggcuuuguucccaaggcgcugugcucggcgagagacagaaugucugccuggugcugugagcgcagagcccuggguggggaaaggaucugaaguggagacauuucccaguugcugaugguacagcagggcuggaaggguguggagcugggcauagguauugugggcaucaggcgugccgcacccaaggcgggaaugcauggggacgcugaggcgagugacuggaggcaggcuggcaugguggauggucugcuuucugaaggcuugugguugccaggccugagagugacugcucaucguaugugacuucucuccacucacacuacuucccaucacccuucgagccccuggaggguagggcccuauucucaauaaaugacagaucagugauugcaguguuuccagcagcccucagaucucccagggcuagaaaucgcagggcgucauguugcauguaggcugcaagcugugagcagcucuguguguguccucauuccagcccuggcuggaaagugcagucugucugggaccgcucccauggcacagagcagaagcaaagggcugguggaaggucccagugccucuuugagcuuugccaggacagugugugucacaucacuuuccgugggccagcugauggcacaaggccaagcccaacaucaaugggcaggaauguauaauccuuuuacagggaagugaaucuucaagaacagugauacaggcugcuacucagagcacuugaaggauuugaaucugggaaguaaugugauccuauuuauaauuuuuagaaaguucauucuggugcaaguggccuggaaaagugcagauagauucagggucagcguaggugggaaauacauuuauagcugccugugccgagcgggcucugggcagagggucaagcuguuggaguggggaugcugaagaaagaaaagcuuuaagagguaucuccgaggaagauggagucagagaaucuagugacugguggugugagggagccucagggucccagugagucaugcugggcauuggagucacgguggaugacagugaccucaucuaagaggacacgagaggaagagcagauugggcaggccgaaggcauuugauguuggccacuggguccuggcaccaugagaauggagguguugguggacgaaaucacccagugggcucuugucaggcaggagcagagagcauggacagagcccaccccugacauuuccauaggagggaggaugcugacguggaggaccuccugugugucugacauuguugcaggagucucuguagagucuccuguuggauuuccagcaacucuccagaguagauucucuuuaccacuguuucguuuaacgguugugggaaccgaggcccacagaggucaagauaccugcuccaaggucauccagcagaugagccugaaccugcaguaacucccggacucggagcacaagcacguggcuuguguguuccuucucaaguaggaccacuccugguguccuuugguucaagaucauaucuaguauauaaugaaauuuuguuuuaugcaguuuuucaagugaguucacacccauggucugauugaaaaaguaauuaguauuccuauuagagcuuaccaaacaauccccugauacgugagcauccacagaggaacagagcagcacuguguuugugaucuuugauuuauagcugccugugcccagcgggcucuggcagaaggcuauaaauaaaauuaaaauaaauggaaacaaugcaccuauaaauuggguugcaggaaccuccaauuaccuuuuagaggaaauccccaauaaaaugcuguuuggcaauccguuugaaagagaaggagcgauagaucaucguggcgaagucaggaaagugaaggacaggauacaauguuggaauguuucaaauauuaaaauuagcugauuccagugaauugcuguuugguguuaucaauguuggaagguccuuuccccccucauuauuauuguaucuuuccaagugggauaaaagccaucaguugcaagugcaggauuuuagggaggcaagucaguauuucucuuauuccuuuuguuuuuugagucaacuucucggcuucauguucuggaaaauggugggggcccagcaagaggcuggguuugggcaggaugucuggccugauuuugcccuuguaucugagagacaguccaugcaucauggcagggaagggccaaacuggagaccagguggccauggggcagauccagagcgggagcugugggccuguguguggggaagucacguugucucucuuuagaaaucuuguuaugcccuucuuaauugugucccagaaaguuaugauuuauggaaaagaguacguuuucuuuuaaaauauguuggcuggggccgggcgcaguggcucacgccuguaaucccagcacuuugagaggcugaagugaguggaucacgaggucaggaguucgagacaagccuggccaacauggugaaacccugucucuacuaaaaauauaaaaagcugggugugguggcgggcaccuguaaucccagcuacucaggaggcugaggcaggagaaucgcuugaaacagaaaggcagagguugcagugagccgagaucgcgccacugcacuccagccugggcaacaagagcgaaacucugucucaaaaaagaaaaauaaauaaaauauguuguccacauaaaauauuuuaauaaaaauauguaaaauacauuuauucuuauucuguggaaauaaaugauaauuauuuggcugauguuuggauaucuggugcuaacaagccacugaagucauuggccagcgacauucucacuggucagacuuuggccagcaggcacuggaaugcgcuuucugucaccuggcuuccacuuggcucuguggaaugugaggaagaagggauagaacagggacagggaagggcggaugguguccauccccagcuaagcugcauggggauuccucuuggagacugaacaugagugucagcagaagccuguagagcacaaagcauguaugcauucugaggcccuguccgccugggcagcuccaggaagaggcaagguuagaucucuccugacuaggaggcccagccucaauuaaagcugugauuugaaacuuucagguuagugggaagauacauaugaguuaaucucuuucuauuuaagucuuaauuuuauauaugugaugacuaggcaguguuuagaaucuuuguuugcugugugucaaugcacuaaugugacuuuuaacuuauuggaccauacuuauaggaagcuuaaguuguuuggacugaagguuauagcucaggcccuauuauaaaccuacuugaauuguaggugggggaugcucaauuagaccagcucaugguaacugcuaagcuaccugucaccacuugagggccuuucaagaucggcaguuagaaaccagcauggccggccggcuccuugcauugcaggcacaguggcuucuccugagucccacggcacauucuucuacugggcucaagcugccuugccugaagggcuuugugcuacugucccuguccuuaaggucuucaugacucgugggggugauaagacucaagccagcaacugagaaaggacgaauauucaaaggaagggaggaacacaucuggcuggagugaucaggaacauuuuuaaaggagaaggugacaacugagcagaggagcuuggucuugaagaaauggagagaugggauaauauuccagaagaagcaauggaguaaaguugugaaggugguuccagagcagugaaaggucuaguuucccuggagccuugucuuuggguaaaacugcaacugcaugccagccuacugauaccugagugcugauaaacaaaggcguuuuuguggguugaagcaaccauaggccagggugcaaggacuugucaggagagaggaauuggguuuuuguucccauuuggucucucugccagaugccuuaacauuuuaaaagucuuuucuuuccauuuucuuuuucuuuuuuucuagaauucuuauucuucucaacacuuuuauucguagcauuuucuuauuuaaauuguauuuggacccucuauaucccuagccucugaaguagacucaaccccagccaaaaggagcaggugcaaagcucaaauccugauuaagaggaaugaauacagacugcuggguugacuaaaauagggaagagacucaaggguauaaggaaauaccagaauaaaaaagcacacuguggcaaaugaugucagaaagauggugaaauaggaguuuucagcccucaucccccccagcaguaauacugauuuugacaaaugcccacaggugagaguaccccuguggagcacaggaguacaagugcagaggucuuagcagucuuguuggagaaaaucacucaagaauagacacacugaagaggguaagaagaagaguuucacuuauccauaacaccccucccugaaggcagcauagcucagugccaacucccuugguucuugauuucucucaaaagggaaggugagagcauagugaacacccagugaccccagccaugugggaugcucuccagcaggcccacuccuuucucaucccuuucagaacacugaguggaucagcaugacugaauaguuugggagcaacuaagagcaaggaaaaggggcugggacugucaguagucagggcauggaacucaacaaagggcuacaguuucuacuaacugccuuguggacuucacuaagaggcuaguccacaaauuucauaggaucuguuugcugcagacacccccaccuagcccacauaugccuccagcauucuguaugccucccuuccuuggcagcuggcacaacugcaccccuguagacagcacgugagccucugcagauuguguacaagcagacacagacagcuggcuugacuuuccuauauugagagaaagaacuuaaccuuagacacuucugagcacugcccuaaggaaaaauaaauggaagcuucgugacaccuggccuggcuuugugggauugagauaagguauagaauccuaagacuuacccccaaauagggaacaagaggaguggaguggguacauuaauaggaaaggucugagaggcucccagaauuccuagucaggcugauuggaagaucuuucucuucugaagccagucaguaaagacuggggaaagugacuguuacuucaaaugcaaagacagcaaugcaagacuuaacaugaaaagucagggaaacaugaccugacgaaaagaacauuauaacuuuucaguaacugaucccaaacagauggagaucuacaaauuuccugacaaagaauuuaagacaauugagaaaacagacaacucaacaaaaucagguaaauaauauaugaacaaaaaugggaaguucaacaaagagagaaaucauaaaaaagaaccaaacaaauucuggagcugaagaauacaaagacugaacuaugaaaugcaauugagagcuuuaacaacagacucuaacaagccgaagaaucaguaggcucaaagacaggucauuugaaauuacccaauuagaaaauaaaaaagcaugagaaagagagaagaaagucuguaggauuuauggaacaacauuaagcaaagccauauacgcauuaugugaauuucagagggagaaaagagagaaaggggcagaaagcuucuuuaaagaaauaagaacaaaaaaugucuuaaaucuggggagagaaauagccagacucaagaagcccaugggaccccaaacagauugaaugugaaaaagucuauacugaaacacaauauaauuaaacugucaaaagucaaagacaaacagaauuuggaaagcagcaacagaaaagcaacuugucauauacaagagaauguccuaagacuaucaauggauuucucaacauaaacuuuguaugucaggagugaaugggcugauauauucaaaguaaugcaaggaaaaaaaaaaccugccgacuaagaauacaauacccagcaaagcuguccuaaugagggcaagaguuucccagacgaaagugguggagauucauuacugcuagaccugcuuuaaaagaacuaugaaagggaguuaaauuugaaaugaaaggauguuaauuaguaacaugaaaaccuaugaaaguauaauacucacuggcaaaaguaaguauguagucaaauucagaauaccucaauauuguaaugaugguguguaaaucacaguuaacgccaguauaaaaguuaaacaccaaaaauauuaaaauaacuguagcuacaacauuuaguuaauggauauacaaagauguaaauuaauuaugguaucaauagcaaaaugugcauguguguauuuguaagagagagaacuaaaaguauaaaguuuuugugugcgauugauguuaaguuguuaucagccuaaaauagaugguuagcacuaugcauuuuguaacacuauucuaagccucaugguaaccacaaagaaaaaacauacaguugauauggaaaauauaaagagaaaagaaucaaagcaugcuauuacaaaaaaaaaaucaucacaacagaagacggcaagagaggaggaaagaaacaaaagagcuauaaaacaauugcaaaacaacaaccuggccauaguuaaguccuuaccaaucgguaauuacuuuaaguguaaauggauuaaauuauccaaucagaagacaaagagugacugaauagauuaaaaaaacaagauccaacaauauacugccuauaagugacucacuuuaguuuuagugacacauaggcugaaagugaagggauagaaaaagauaucccacaccaaugauaacaaaagagagcaggggugacuaucuuuauaucaggcaaaauagacauuaaguuaaaaacugucacaagagguugggugcaguggcucaugccuauaauuccagugcuuugggaggcugaggugggaggauugcuugaggcuaggaguuugagaccagccugggcaacauagggagaucuugucuccuaaaaaaaaaaaaaaaaauuagcggggcaugguggcacgugccuguaguccuaggugcauauuugauguuaacgugaacuaugaucacaccccuggguuccacccugggggacagagcaagacccugucucaagaaacaaaaaaagugucacaagagacaagggcauuguauaaugaugaaggggucaguucaucaagaagauauaacaauugugaauauauguguauccaacauuggagaaccucaauauauaaagcauauauuaacagaauuuaaggaagaaauagcaauacaauaauaauaagggauuucaguacugcacuuucaaaaauggaucaaucauccagacagaaaaucaguaaggaaacagcagacuugaauaacaauauggaccaaauggaccuaacaagauauagacagaccauuccauccaacagcuguagaaugcacauucuucucaagucauaaggagcauucuccagauuagaucauuuauuggaccacaaaacaagucuuaacaaauuuaagaggauugaaauaauaucaagaaucuugauaucacacaauggugugauacuagaaauaaaaggaagaaaguucacaaauacgugaacaagacaccccuaaacuaccagugggucaaagaggaaauuaaagggaaauaaaaagaaaucuugaggcaaaugaaaauggaaauacagcauaccaacacuucucagauacagcaaaaguaguuuuaagaggaaaguuuauagugauaagugccuuguuaagaaaaaagauugcaggcagggcucaguggcucacgccuguaaucccagcacuuugggaggucgaggcaguggaucacgaggucaggaguucaagaccagccuggccaagauggugaaaccccaucuuuauuaaaaauacaaaaauuagccaggugugguguugggugccuguaaucccaccuacucgggaggcugaggcagagaauugcuugaaccugggaggcggagguugcagugagccaagauugcgccacugcacucuagccugggagauagagugagacuccgucucaagaaaaaaaaguugcaaauaaacagcccaacuucuacacuugaaggaacuagaaaaagaagaacaaacgaaguucaaaguuagcaggagacagaaaacaguaaagauuagaacaaguaaaugaaauagagaguagaaaaacaacagacgagauuaaaaagaaccuaagaguugguuuuuuaaggagauaaaauugacaaaccuuuagcuagacuaagaaaaaagaagacucaaaugcaaucauaaaugaggaaauauugauaaauuccuagaaacauauagcauaccaaaagugaauuaugaagaaauagaaaauuugaacaaaccaauaaugaaaaggagauugaaucaguaaucggauacaucccaacgaggaaaagcucaggaccagauggcuucacuggugaauucuaccaaauacuuaaagaagaaugaaugucaguucuucucaaagucuuuccaaaaauugaaguggagggaacacuucccagcuguauuaugaggauauauuauacccugauuuaaaagccagacaaggacauuacaagaaaagaaaauuacaggccaguauuccugaugaacauagaugcaaaagcucucaucaaaauacuagcaaacugaauucaacagcacacugaaagguucagacacugugauuaauugggauuuaucgcugggaugcaaggaugguucuacacacacaagucaauaaauauguaucacauuaauagaaugaaggagaaaaauuauaucaucucaauagaugcagaaaaaucauuugacaaaauucaacaucuuuucuugauaaaacuuucaauaaaucagguauagaaggaauguacaucaacauaaaaaggccguauaugacaaucccauagcuuaagaucuuacaaaugccuuuccucuaagaucaggaagaggacagggaugccuucccagccagagcaauuagacaguaaaaagaaauaaaaggcauucaaaucaaaaaggaaaaauaaaauugugugcaguucgcaugaucuuauacguagauaacccuaaggacuccaccaaaaaacuguuggaacuaauauacaaauucagugaaguggcaggauacaaaaaucaacaugcaaagaucaguuguguuucuauacacuaacaacaacucuccaagaaacuuaagaaagccccauuuacaauagaaucaaaaagaaugaaauaugauacuuuggugugaauguaaccaaggcggugaaggauucuucuucuuuuuuuuuuuuuuuugagacggagucucgcucugucacccaggcuggagugcaguggcgugaucucggcuuacugcaaccuggaggugaaggauucuuacacugaauacuuuaacaguugguaaaaggaaauaaagaagacacaaauaaauggaaauauaucccauguguaugaaugggaaaaauuaauauuguuaaaauguccacacuauguaaagugaucuacacauaggacaaucucuaucaaaauuccaaugacauguuuugcaaaaagaagaaaaacaauccuaaaauucauauagacccacaaaauaucccaaauagccaaaguagucuugagcaagaagaaugaagccggagccaccccacuuauugauuucaaaauauguuacaaaacuagauuaucaaaacaguaugauauuggcauaaaaacugacauauagaccaauggaauguaaaguagagagcucagaaauaaauccaugcauuuguggucaacugaucuuugacaaaggugccaagaacgcacaauagggaaaaggguagucuuuucaauaaguuuguugggaaaaguagauauucccauacaugagaaugaaauucgacccuuaacucacggcauauacaaaagucaacuuaaaauggauuaaauacuuaaagguaagaauugaaacuguaaaacuacuggaagaaaacauagggaaaaagcuucuugacauuguucugcucagugccuuuuuagauaugacaccaaaaacauaaaacauaagcaaaaauagacaaaugggauugcaucaaauuaaaaagcuucugcacagcaaaggaaauaaucaucagagugaagagacaaccuauggauuauaagaaaauauuugcaaacuauacaucugauaugggguaaaugucugaaauauauaaagagcucaaacaacucaacagcaaaaaugaaaaccaaacaaacuaaauaaccugaugaaaaagugggcaaaggaccugaauagacauuucucaaaagaagacauacagauuaucaauagguauaugaaaaggggcucaacaucacuaaucagagaaaugcaaauaaaaaucacaacgaguuaucauuucacaccugcuaguauggcucuuaccaaaaaaacaaaugaggcugggugguggcucacgccuguaaucccagcacuuugggagccugaggcagguggaucacgaggucagaaguuugagaccagccuggccaacauagugaaacccugucucuacuaaaaauacaaaaauuagcugggcaugguagugugcgccuguagucccagcuacuugggaggcugaggcaggagaauggcuugaacccagaaggcggagguugcagugagccgagauugcgccacuguacuccagccuggguggcagagcgagacucugucuacaaaaaaaaaaaaaagacaaaugauaacaagcauucgugagaauuuguagaaaggggaaccuuuuuacaccauuggugggaauguaaauugauauagccuuuauggaaaacgguauggaggguccucaaaaaauuuaacacagaacugucagaugauccagcaaucccacuucuggguauauauccaaaggaaaugaagucagugccucguagaggauauuuguaccuucguguucauugcagcauuauucucaauagccaagacauggaaacaacccaaguauucaccgaugaaugaaugaguaaugaaaaugggugugugugugugugugugugugugugagagagagagagagagaaagagagagagagaaaaugggauugccauggccuuaaugauccccagaauggauguguugaaauguaaucagcaaugugauaguauucaaagguggggccuauaggaggugaugugauucaugaagguggagcccucauggaugagguuagggcccuuagaaagaggccugaggaaguggguucacucucuucugcuauuuggccaugugaggacaugacauuugucccuuuuggccguuccgccaugugaggacacagcaagagggccguugucagacaccuaaccugccagcaccuugaucuuagacuuucacccuccagaaucgugagaaaaaauuuucuguucuuuauaaauuauccagucucagguauuuuguuuuaacaguacuaauggagugagacagugauauuauucacccuuaaaaaagaagguaacccugucauuuacagcaacauggaugagccugggugacauuauccuacauggaauuagccagacccagaagauauucaucaucuuccuuauauguggaauccaaaaaaauugccuuccuggaaguagagaguagaauggugguuaucaggaacuggagggcugcaaaguggggagaugugagccagagaguauaaacuuucguuuauacgaugaaucaguucuagggaucucauguacagcaugaugacuauaguuaacaguacuguaugguauacuuggaauuuguuaagaaaguagguuuuaaguguucuuaccacacacgcacacaagguaacuguaacaugugaggugaaggauauaauuaacuugauuuugguaguaauuucacaaugucuacguaaaucugaaucccauguugaacaucuuauuugcauaccauuuuuacuuuuugguuacaucuguuaagcuggaaaaaaauugcauccagauauuccugguaucccuaauaauaacauucuguauuauuauuuggcccauccaacaugaaacaaggauagauggguuuguaaguuacagguauagguauuuuugcugcaacuuaaaaacuuuuccuuaauuuaaaacaggcaccaucaauuuugcauucuuugguaaaggcaugaagaacccagagcugaaauaacaagcugcuuucuuuggggccauuugaaugauagggacaacuaagaugugggaucucauucggccaaaagccauauaggcugagcagucauggguuugggucucuaugggaucuaagacuuggaauuuauuuuuaacauuuuauuugaaacuuuucaaacauggagaaaagcugaaagacuugucauggccauccauugaggccaccauauagaguauguuaggucuccuccaucucucuuucugucucugucuguccauccaucauuccgucucuucuuuuuggaugcaucucaaaguaaguuguagauaucaguucuccccguaaacacuugaguaugcaugucauuaacuugauuuaggguuuucguggagguaauauuuacaccaugaaauguacaaaccugcagcacaaaaaucagugggaugaguuuuaacaaaugcaugaccugugcagcgcgaucuccgaucaaacuguagaacaucagccuuacugcagaacguucuccagggcccuuuggcagugcacacacuguguagccacgcccagcgggcagcuucgggagaugaguuggggagggagggcuuuggcgcccugacagguagggauguuccagagcugcuguugcgugcccagggcaugccuugacagcaucacaguugaauggagcagugucugggugacaucgaugagaagggagcugaaggaggugcugcggcccauguucaugaggagauggaaggagugcagaauggcagggcugggauccugauguacccugggacuuggcugucucugagugucugcagugccucgagcacacugugcguaccugaggcaguuggugggaaauggauuuaguuccaugcguucagcuggguggccggauuucagggcaucauuugugaaaugacccacuguaauguggugguucaaggggaggcacugagccaguucugcugcucgccuuuagcucaggguccucaucugucaagugggaaucacuugcuucuguuguuacgagcauucgguguacuaauacaguaauacaaaccaccaccugcacagagcagcgcucagucaagucagcuguuguuguugucauugauuuuuaugauaauaacuccccugcagagauaaaacagccacggguauacaguggcugcccggccggugcugcagcagcucuuccuccugggaugccaggggauugagacucggcuuuauucugaagcugucccaaauaugaaucauucacuguuauuaagccaccucagcaugcccccuuuguuaucugggcccaaaagagcacagaguguggcccccaguacauuuugggugacgccuuuacacccauccagcaaguuggggcugggaguggguaucacgcguucuguagaugacgucuguagacuucugggguuuuucaauagaggggccauauuguuuaucaucuguuuuggggguaaacggggcacucuuaacaguuuaagaggggcaggugagcggugaacuggguaaacugagauguaugauauccuaguucccuggggugaaggaggccaagcuuuucuguuaaugaaaauaaacugcaucucauucacagcggauugaccugugagcguaaacacagccuggggaguagcacccggcagcacccuguguucucacaucaucgggaaggacagcugccuuccauucaucaugcuggcagaugccguuggcugugcuggggccagaaagcauuugggauggggucaggacaucucaaggcagauagauguuugugggguuguucggucuugagggucacacggucucugucuucuuggcugucauuugcaaaggaguacaagcuugggcuggacuggccagccagccuuccuguggguguaaacauguggguaaggcaugcuagaugcugggcgugggcacucugguccaagcacauucuuaucaagccguucuaagcauuccaaguaggagucucauugagaagcauccccgucuguggucuugccaugccacggugcccauguccagcagucacugaguacaccguuaacugcuguguagaccgugaacuauuccacugcgugcugcuuccuucucuucuuacucuccucuuuggagaaguuuauaagcuuaguugcauuuaguuauaaagcaucugggcagcccugucucccucugauuguacccccugugggcauucauuaagcaccuccucugugccaggcaguguagccaccagcauaaagcuagugacugagugugugccagaugucugugugguugagucgucagcuugacguggugggacagaagugaguuugcaggagacuggguauaaggauggggagagcuuauggguggguagaggagcacagcacagccagagugaaccaggcagagguggggccgagugauuccugggaaggguugggcugagcuggaugcuuccaucugggucccccguggggucuggagcagucacuuacccaguuguaaugaagcccuccugcucacuugcaggcaucauagcaguugacggucugagcacagugaggcuggccuggacgucugagcggggucaucccaggcccagggguccuacugggcucuuaaguggagagugguaggagacuguuggguuggagaugcugcgcccuccuucaugccagcaaguauugccuggguggucucaaaaguccugugccauagucagauuugguuucuaggacuucuccaacucuggaauucucuggagaagggaguccugucugugccuggaguccagugggcccugguguuucuuggucauacccuggcguccagugacuguagucuuugauuccugcauuaucugcaggcgguugccugugccaggagaaggccauuuuggugagacgaggaaugucuuuguugauccguggaggaaagaacguaacagugggauauugagauuguuaaucaauuguuuuaggauaaauacccaacuuucucuccucuuagcugauuagauuccaucuuucucugugcuugagacguaaggacgucugugcuugggcacaagguuguaucugacguuauuuucagucuucuacauggauccugaauaagucuuuuguuccauggagaagauuaagggcaguauuugguuggaaaauuuuuaaugaagcaccuaacagagcuauuauuauucauuucugaaacaacuugcugcgguuaccguaguaauauuaagccuuuuauuaaauauuuuuccuuucgguuuugagguaaguuuucauuaaaugcugaugggggagcuggagauccacgaaccuggugucuggaaagaauuuucuagcucugcugaguuaaaucauucaaggaauuuauguuaugggaacauaaagcuuauaaaucuaguuuaucauaucuaucauuuaauuguucaugcaagccagcucuucauguagcgauuuacaguaaucucagugaaauaacaguguugugucccaaaaugaauaaugcaugccaagaaauuguugagcuccuuaaaaucauuaugcucaaaauauuaggcucuuuuauuugaaagugauagaaugaugaucauguacuaguugcaagcuggggacuucagagucugucguuccugcuuugcguugggucgccagcccucaggaaggaaccgcggcgagccgauuccaggaggaggauacgccuugcugcagucggcccgcaggagcagccggggagcuggcaacagccagggcucugugggagggcugggauguuggcuuagggguaaaaaaauucuguguuuaaaagaugagaugcuuuuuagacauccaucugucugggacaagaaauggguaucuugccauuaguauuguugccaggcagaaaccauggaguuuaucacaaugcaucuggaaggcagcaaugugccgagugcuuuuucuccccucuccuguuacucaucuaucucaacagcacacauauaccaugaugugguuuuaaauaaugaggcaaacaggcaauagcuguugugaucuuucaaugagaaugguuuagugaguuggauuuguugcuagcagcacugauccauuuguauguauguuugucagugggcguggcgacaucgcuuacucaccuaugcuuuccgucuuugaagagcuacccugcaagcaguguugaggucagaggagacaguucacugugggcuguggggugcuuaagugugggaggaagggugacuucuuuuccagaagagggaaaggcucugcuccucgggaaauggacggaguuuuccccaaugggaauaucaucaaucauugucaucaggccugggccaccuuuaccaucucucacacuuaaaaaacaaaaaaaacuguguuauaaaaaauuucaaacaugcacaaagaucgagagaacagugcagugaagcaacacaccuaucagccagauucggcggguaucaagauacgccaccagccucucaucuucacccggauucggcggguaucaagauaugccaccagccucucaucuucacccggauucggcggguaucaagauaugccaccagccucucaucugucccauucuuuucuuuuucuuuuucuuuuccuucuccuuugcuggaguauuucaaagcaaaccccagacauccugucauuuccccuuucuguacgucaguauacauuccacaaaaaacaaaacaacuccugcgguuuucagaacccggugcuggugccgucgagagacuguuuaggcggguguccccuucuguggaaucucgcgugggguucagcaguccagggccgggccuuggaggccaucagccuuccuuaucggcugugcaacuaaugaucuuuggucaauugggacuggacugaggacucugcaguguggaaaaccaguucugcggugaccucucccucauuuuuggagaccccaggugggccuaaccuggaggcauuugguauguuuugugccauuaguuugacauuuagauucccacauaggagaaauaguguagaagagauugccaccaugggagaccugggaggcaggaggccuggccucagguguccuggagaguuguaaaggccagaauacaccuuuucggaggagcagaagucaccuagccagugcugguuuacauaucuaccaguaucugcccuagacguacccaguagguccuaaggcaugaagguuggccugguuuauguuaugugucauuuuccucacuucuguuugucaagaacauuuucugcacguugagaaugaucauuguuacgcauucugcugcuucucugccuuucuucuaucccuucucuucacacgcuccuccugccccacuguguggacgugucuguaggaaaaugugggguguguuggguuuuccuguuggucuaagucaugccugccaggucuguugaugaugucugaggucuguguuuuucucagguuaggacuuuugaguccuuucuuacaaagggcuuuauguacaaaacaacccuguaguagaggcacccaggcuuguugguccucuguguuuggagaggagugccccacucauuccagggagggaaaaugggguuugaaaugaaaaaguuuccauuguaaauggacacuuuuauguaaaacaucuaaaaacauguagaggaccaguucugauggcaccuagagaaauagucaagguacccuagugggugugugugugugugugugugugugugugugugugugcgcgcgcgcacgcgcucuacacaguaaauacccggagggaagacugcaaacacuucuugagcagcagauauucuuucugggugacauuccuucuuagaagggagggguugggaaacuauuaaauaguugggagagugaucuaaguuaguuggaugauggcuuugugauaggaaguuuuugcucauuaagagcggcuuuaaagcuuuuaauuuuuauauacuucugccuguaacuuuccccacucccuccaaaaaaaugguaucgcggaggcggugucagaagagccccagaaguauucuaguggaacucaggucguccuccacccuugcgggcauaaaucucaugcuagaagcuuuccuucagggacccgagagaacagggaaggagugcuugcuguuggaaggcaguggagagccagcuagaggugauucuaggcucaugaacuagucuaugacuaacugcagugaguuuuuaaagcagguuguauaagaaguuuaagugaugccucaucgaggcucugauuucagagcagccuguaugguucucuaagccgagggagagaccuggcgcaacagggagucgaccaaccguuugcagccccucugucagugccuuagacaggaauccagguaggcucucucugguacaaauguuauugccuuuuucuugguaacaagggcuuuuugguuggcauugcugagucuguaugaugauguuuaugcuguuacuguauauuacuuuuuuauggcauacuauuucuguugcaaauagucauaaauauuguuacaguuuugagugcauuaugacacguugcucuaaguagucucacguacacuuuggguugcagggcugagcaauuuguauuuuuccuuugguguuucuuugaguguguuucagcccaccguaauagcaccucacugcuucaccaugcaguuuuuuuuuuuuuuaaacuccuaugacauuucauugcugguagggaccucauggggacccuuaaccagugcacccucuccucccuguccccagucucuguuugagccauuuugugauacaugguucacagaucacccucagauccuggauucaccacuuaguagcuaguuacaauacuuaaccccaucugucuggaguggcuaucucacaauuugugugacgcucuaggcagagggcgugguuguggccauuauuauucugaugcuggacaauucuuucuucuguggcaaugcugucugccugcagguuguccccguugaccuggcccuggcugcuggaguggaugccuccguccaagugggucuccagacggcagauugcucugugggugaccugccaucacucaggcagcccuagccugcccucaaggcccucugccaacugcauuccuccuggacaccuuuuugucucucaguguuucucugugaaauucuagaacugauuaguggaggccucagaucccauuaccucccaggacagcuuccacgcacugugguccucacugaaccugcuguugacuaagacacagucucugucaucuuuauuagagaacagcuaagucaagucaccuguccugggcuggacaggugacucagauucaucugucuuuuuacucucaucccagccugcaaggauugcugggagaggcugggcagugggcagcaggcaaagggacaccuggaaaugugggucacacaacccgguucauuuauugucucuguuuuucucugauggagugaucuuggauugguugugcagcuuuuggggagucuucagauauaaaaguugcaacgacaaaaugaggugccggauacaagugucagcucugccgugcuccgugacugucgccuggucccguaguuucucucauucgguuaugauugcucuuucuaugauguguggcugguggauugccgaacaugccuucuuugucuucacuuuaguucuuguuaguuauguauuuagccagguugguuuagaugaacuuggguaaaugacagcuggugaugauauuuuaguuuaguuaugguugcuaccuggggaacauuuggaggaaguuagcugccccuggaacagcuccugcauuuguggagacauagcccuucuuuccugggugugcaucugugcagcagcucgacugcaugccugcugugugcuggagugcaugguggaugcaggcaggggccacauguuccuggagcuuacaggucagcagagauggagacgagugcugaggggcacgcaggagggccucuucucugcccugucucucaggagacaggcugcugugugccgugggguugugggugccuuugagguacccugugaaaugucucauuuccuggcauugucaugcaccugaugccagcaugguggcugugugugugugcgugugcgcaugugugcauuagaaauucacacuugcaaaugugguaugcagaacucuuuugggaagguuuaaaacuagauccaaaaucuugggaaauaacuauuaucccauucuaaaaauguuccaguuguacccacuaggaugauuauaauaaaaaagaccaaaaagaaaaaaaagacagggauuaacaaauguuugcaaggcuguggagaaaucagaacucuuauacgcugcuggugagaauguacggugacgcagcugguguggaaaagagccugaagguuccucaaacaguucaacauagagcugccaugugaagagcugccaugugacccagcaguuggacuccuagguauguauauucccgagagaaaugaaaacccauguccacauacagacuuguacaugaauguuuauagcagcauuuuccauaauagccaaaaaaggggaaacaauucaguaucuuucacaggugaauggauaaagaaaaauagucucuccagacaguggaauauuacuuggucauaaaaaggaauaaauggaugaaccuugaaugcauuauguuaagugaaauaaaucacagaaccccacauauuguaugacuccuauuuauaugaaaugugcaaaauaggcaaauccauagagacggaaaguggaaugguaguuguggggcugaggagugacagugaacaggcacgugguuccuguauggggugauggaaaugucggugguaagggucgcacaggucugcauauacuggaaaccacugagucccacauguuaaauuugaugguaugugaauuaugucucaauaaaaaaauucaaaacauaccuguuggcuuugccgugggaugucccuaaggugaucuggaagaggcucugccucaaagagguuucagucuguuggagaggugaggaauaguaguagaccacgagacacagcugaacagguucgacuuucaccguauuccuaccugacaucaccuccaggguucaaacccgggcuggggcaggcauggcucucaggucacagagccccuccugcugcugcacucaucucuagagaccccuuccagcgggagaggcuccccagagcuuggugccugagugccugugcccgagagccugcuggugccggccuggcccaggcccugaggcaggaggcccucgaugguuugagaaggcacugacccaguuuguuugaaacgguuugccuuggcgcucuugccugguccuggcuguucugcccgguuaaggacagagugcgaggaguccugggagcucuccucuguggccugugugagccaucaggauucaaugcagugauuagaauuccucaucuuaucuucagauggggagagaugccacugggagaagaaucagaaauggaauuucagagguacuuagugaccuccauagcucuuuguugacugugguuggcagggcuaggaagggguacacggcucagcauacaguggcaguuggguuuuaggcucuuaacaggggugugcucuuucugucuuucugccaugaaugucauguuggucaaaguagggcacauuaagaggcaggggucaugagcugguggcagcaagccaguggcaggcuccucacagccccuggcuuuguugugcauuuggguuugaugaagacaggaggcuuuuccuuggacaaacugggccuagaagaugcuucgugggcacugugguggggcucaggggcgccgcaggcagcuguacagcucuggugguuucugggagucagccgucuuucccaggcgugcugcagcugcucagcuauuuggggggaugucgugggcaucacaguggccuuguaucuguguaagcccuugcuggccuguccuucucaaagugaaugagggaaauacagaagaaagggugccuugaagcucuuuggaggcucccucccaucccagggccucccggcuucccggcccgcagagaacuuuagcaccuccccucuuccagaaccccaggguggcggcugcugcugcgugugccccccugucuguggucuggccuguuucuucagcgacaccauucacaugcugaucccuugguacacguucccuugaggcugagcacaagcuuaugagacuuacggaaucuucccucuguauuugggauccugauaacguuuguccgaaucucaguggcgugagguccuuguuuucucagggguggacgaaucugccucuggagacaucauacuggguugaaggcuuguucuugguuccagcuccacgaggccucugccuuugcuccacuucacucaccugacuucuuucuugaccccuuugaccaucagugcccagccuuuuccucacaucagacuccugcugaaucuauugacuccugucucucugcuccugcuugagccuccgucugagcuccguccaucucgccuuguguaaaguuggcuguuuccuggcugcaucgcgagcuccucuagggagagcugcgcuuugcucaucucccugugcgcagacccugcccguccuggaguuccaugucacuggcguuuucugcaucucugccgacugagguccguuccguuucuugcaugaagagccugguuuggguccccuggcgcucuugugggacuggacgacaguccauugccugcacacugugaccuccaaugcugcuucuguugggagcacgauuccuuugcagcccuuccugcugaggggacacuuuggaggccuuuuaagaccaggagcuuagcaggcaguugucuauggagagaugggggccugagaggaugacggggccuuugcugagcauccguguguguuuccaaagcauuugccccucucugccuucauccucggcucugccuccccucguccauccuuucaugcuccaucagcaccccagccuggucauauuucucaccugcugugguggggcaggggugacagaggcaccucuaggaucugagcagaaccuugggaacguugaaagcaggcgagaggcaugaagccgccuccuucaggauguucuacucaaccguaccguggaaggaugggcgcaggaaaucuugaacauuugaaaaaaauguccuuuacgugaggguaggccccacgccuggcucugugcccacguggcuggccuugacucuuucgggggcuuccuccagccuccaauagaggaucagcgugagggagugagggcuucacgucagcugcugugagggaugacgugagauacggguguucuuaaagugcuguuucccuuaaaaucugguuuuuacuuacuucgcugaaacuggucaccaaagacaccacauuugccucauuguacuugagagcggaacaggaacggagaaauuaauuaauucaguuuuauagaugaagaaggggagccugaagagguucauuguucaacagauacuuacugagcacucacucgaggcagggccucguccucugggcccuggagacucagcagugagcacguggcuggucggagugaugggcacagagcugggcgcaggcaguuuuggaaagcacaugagacucuuuucugccucagggaucacuuucucagccaugccgcaugaccucagaggcauuuugcaccaauggacacuucgugaaaaauuuuuucccaggguucugugacauuuugccccgauuucccccgcugucuccgaguguccccugugaguggacucuuucuccuucacacccaugugcguuucuggacuucuuguuuuaaacacgcucuuccuugguugggacucugccugucuuuccgcaccucugagccucauugcccaguguccgugucuuccggaggugccuacugcacugucuugggauuuugcccugucagaaaugugucacgugugauaggaaaaucauggacgugguugagagucaggccccugaguuuccuuuccucauuuguaaaauggggaugggaacugcucuccaggaugacaaauugucacguggaaaccagugcacggcgcagacacugcuccacagugucgacaucccuucucucccuccccuucccguucccugcuccuccuccacugaacaagccaccccucuccacuuccuguuuacaucauagauggcgccaaucucuccuacccaggguaauguuuggucauugucauuuuggccuuucuuuuuccccauaucuaguuauugcugaagcccacccccaccuguucuuguuguuuccggauguucucgcgcuaauuccuucagccuuuccuuucugccuuugaugggucugcccuagaucagaccuuuaugaugucugcccaggcauugaaguagcuucccagcaagucuccuugcuucccucuucccccugcgaugcauuccagguccuggcaggaggugaaucacauugaaacguggcuuugaccucugcuuuuacagcuccccguugcuugcaggacaaagaucacacuccugauauuuaaugccuuucuuaaucggacuccuaauuacguguucauccucuguuucauccagacauaggaaccugcugaucccccggcucauuguuaaucucugccuaauacuugugaacaguaacuauuaaaauauaugauaaaacauagaauacuccaaugacacaauagauggcaggguguaguagucauuauaauaguuaauaauaaguaacagccauuaauauuuuucuuugccuggacugugucuuuccacccauuuucuaugggcccagugcuaccaggaagccuccuccaccugugcuacccaaagcaccuacggcagagcccuggacacagguugaucagaggcugagguugcugggaagugcugguuuaucccugcuguccugggauaauuauuacuugugcccaaggugucugcuuuggaugauacaccauaugguccccuuaccuauacauaauacagagugugaauggcaauccacugaaaucuagcuuacccagagcccuucuuucuugcccaucucacuagacagguggaggguuuuguauuguuacuuuuuguguucuguuuaacaaaccuuccucagcaccucaucugugcagugauaccaccaggaguuaggaacacggggaugugggagguacagaccaugagcuugugguugggguucagaggggccuggaaagagguacagcucuugcuggcaugaaugcaggaagggagugauugugccacugugggguggaagugaccuugugcagccugggagucaaggugggauccaugccgucccuuucacggaguagcagugggcugcuggguagaaauccaggauugaugggguucuagacagaagcgcucuggggcaccagauccaggcucccgcaagauaaagcaggccugaccgugccguguggguugugagccagccggggggguugauggucaguucuugacugucacagggucuuucguugccauccgagccuuucuucuaugcuucugugcguuuuauuugaaauuauauguaggggacugugggauuauguugcuuugccuucguaauuacauugcauacuuaucuaaaauuaauugagcuuaucauggacaagacucucucuagccuuucuguguauccagcuuccugucugguggauuucucagucaugugugacaucuaggcgugugcucgcuggccuccggagccacagaaggaaaguggacagagggagucccucggcagugcugagaggcugccccuuuccucugcauguccccugagguuuguuccgggggcuucuaaagggugacaggugugggaaugaugagccugggguacagcacgugccagagaggucuugugaugccagggcccuacccgaaguguggauguggugaaaagcugucuuaggagccucugcguggcugccccauuaauauuuacguagcguagcaucagaacgauuaugcuugcugaagccaaucuuguuauugacucuaccuguuaagaaauggaguaaccugcugccagguacuguuaccagcaaaggcugcuaaccucagaagggguuugagcugaguccugcuguauauguuuuaaugcugaaaguauaagaggcugacugaguccaacuggaaaguaaaaaugugaacuucaagcuucuaauuuguugaaaggauuuagauuuuuaacaugaaauagcaguagccuuuccuuuaauuaaaugccaugcaacauuggcugcgggaucaaugauauugaaggaaaaaaacaguguaauuagaccuugugaagugacuaacaaaugauuagggcucucuuucaagagugggggugggggcugguaccagacgugcagauuaguugcaguuugccuuuccuugcuauagacuuugaaaggccaaaguuuucccuuaaacauuuugggucuguuucuugauuuccugucagcaacaaauggauauagcucuaauuuaaucacuuccguauuauuagacauuuagaucuuuuuuugauguauaaauaaugcugugaugacauaaauauuuguuugcauuuuggauaauuuccuugggacagauucccagaaaugaaauuacuggcucagagggugcaagcauuugaaaugagguugggaugcgagcuagaggcaucucuccccaugaggucuagucguacaauugccuccagcccuauuucuugcuugaugaagacuggaguguucccuggaaugccugugucucccauguguggggugcccccauggaaggggugccguggucaucauugggucacagugucuucccaagcagguuugguuugcccuaugccaaccucaagcccucacaguuaaaaacaaaaaacagaacaacacaaccacuuacaucaguccuuuguguggauuucuuguuagcguaaccaggccuggggucucugggagagcucucuuugcucugcugccaucuugccauccaagaagcacuguccagacugaaaucucugcugccccuggguggggcuggucagcccuccucagcccugacccaaaagcugcacgucaaagcccaucaucgcuguagucccgcagcagagggccucuguuucugagagcugccuuucugagaagguaguugggguuauaaauguccuuaaaacauccuuauucuagacuuuuuuuagacaucuuuacugagauguaauucacauaccauacaguucaccauuuaaaguguacaauucagugguuuuuaguguguuugcagaauugcuugacugucaucacagucaauuucagaacaauuucaucaucucacaaggaaauccuguacccauuaguagucguuccccacucccccaauccuucccccugccccaggcaaccaggaaucugcuuucugucucuguggauucauauaaauggaaucacacaaucuguggccuuugaaacuggcucccguucccucgcauggugcugucaaggcucauccggguuggagcacgccugcuucauucuuuuuuggccaaauaagauuccauugaauggaugugcuguguuuuauucauccacucuuagugaauggacauaugggguguuuccacuuuuugacaguuaugcagacugcugcuauggacauucaugcacacguuuuugcagucguguuuuccuuucucucggggauauacugaggaguggcgcugcuggcucacgugguaacuccauguugagcaucgccaggagcugccagacuuuccugcagcugccacagcauuuuaccuucccaccagcaaugcaugagggcucuggucuucccacauuuaaacauugucaccauccuucugugaucccacauuuaaacguuguugccauccucaugugaagggguaucucauugugguuuugagcucccggauggcucuuaaguuugagaaucguuucccaugcuuauuggcugucuguauaucuucuuugaagaaaugccuauucacauccuuugccuauuuuuaauuggguuacucaucuuuuuguuauugauauccaagacucuugacacucaauacugucuuuuuaaguuggcugccaugaggaccgggcuggaggcagccgacagcaggcaagccgcccugugccggcaggcuuuguuucuuguggcaaacaccccccccagcucugauccauguguaucucacggaugaccaagcugggccuuagagcuacguuucauguuuaugaugaaguagucgcgggaacgcaugccauccguguuccugcagaggcgccugcaggcauuucugaugcuuccccaccgauugugggaggagacaucucuccugcagaagagcagguggaccgagggggagcgcugagcgauacgcuggcgggugugcuucgagcgcuucuugggagaggcggccucaaccauuccagauggaagggcuaaggagagggaggacacccaccgcugaguaggguagaggaguuauuuuccuaagaggauuuguuuuucccucuaugaauugggugcguucacuguggcaaauuacuaaaaauaaaagaauucuauguguguugcacaugaguguuaaaacuagcaaauucaaacaaaacaaaaaugaugagaaaaaaaagucccacaugcccacgcgcagaccagaauccuuuucgauagaggucuguguagugcugugccccuucccgggaccagaauccuuuucgauagagguccgcgcagugcugugccccuucccgggaccagaauccuuuucgauagagguccgcgcagugcugugccccuucccgggaccagaauccuuuuccauagagguccgcgcagugccgugccccuucccgggaccagaauccuuuuuugauagagguccgcgcagugccgugccccuucccgggaccagaauccuuuuccauagagguccgcgcagugccgugccccuucccgggaccagaauccuuuuuugauagagguccgcgcagugccgugccccuucccgggaccagaauccuuuuccauagagguccgcgcagugccgugccccuucccgggaccagaauccuuuuccauagagguccgcgcagugccgugccccuucccgggaccagaauccuuuuuugauagagguccgcgcagugccgugccccuucccgggaccagaauccuuuuccauagagguccgcgcagugcugugccccuucccggggccagaauccuuuuccauagagguccgcgcagugcugugccccuucccgggaccagaauccuuuuuugauagagguccgcgcagugccgugccccuucccgggaccagaauccuuuuccauagagguccgcgcagugcugugccccuucccggggccagaauccuuuuccauagagguccgcgcagugcugugccccuucccgggaccagaauccuuuuuugauagagguccgcgcagugccgugccccuucccgggaccagaauccuuuuccauagagguccgcgcagugcugugccccuucccggggccagaauccuuuuccauaaaaguccgcgcagugcugugccccuucccgggaccagaauccuuuuuugauagagguccgcgcagugcugugccccuucccgggaccagaauccuuuuccauagagguccgcgcagugcugugccccuucccgggaccagaauccuuuuccauagagguccgcgcagugccgugccccuuccugggaccagaauccuuuuccauagagguccgcgcagugcugugccccuucccgggaccagaauccuuuuuugauagagguccgcgcagugccgugccccuucccgggaccagaauccuuuuccauagagguccgcgcagugcugugccccuucccggggccagaauccuuuuccauagagguccgcgcagugcugugccccuucccgggaccagaauccuuuuuugauagagguccgcgcagugcugugccccuucccgggaccagaauccuuuuccauagagguccgugcagugcugugccccuucccgggaccagaauccuuuuuugauagagguccgcgcagugccgugccccuucccgggaccagaauccuuuuccauagagguccgcgcagugcugugccccuucccggggccagaauccuuuuccauagagguccgcgcagugcugugccccuucccgggaccagaauccuuuuccauagagguccgcgcagugccgugccccuuccugggaccagaauccuuuuuugauagagguccgcgcagugcugugccccuucccgggaccagaauccuuuuuugauagagguccgcgcagugcugugccccuucccggaaccagaauccuuuucgauagaggucugugcagugcugugccccuuccuggcucuggcguggccagcgucuucuggcgacaggcguccuggagacuggcucugggaccacugaggagauccugcugccaggcgggucuccuggagcagugagcaggacagguccucucgggcucgaguguaaauuacacgaguguuuccugugguguugaguggggguuacagggugugggacagagggagaaggugcacaucagcuuccacuuccuuugggggaggcucugcucauucugagaagcucuuuuggcgaaggcauauuugaaaacagauaauaaauuaauuuuuuuuuaaggcagggucuaagcucuguugcccuggucaaucuuggcucacugucucugccucccggguucaagccauucuccuaucucagccucccgaguagcugggacuaugugugcaccacuaugccugggguuaauuuuuuauuuuuuuguagagauggaguuucgcccucuugcccagguuggucucaaacuccuggggucaagugauccaccgugccucggcuucccaaagugcugggauuauaaacuuaauuuuuagaauuguguuuuaucucacguaaaaugacuuaacaguuaauuguaggacaguuucuagaauaaaaugugucucuauuuuaauuuuucauuccuuuuaaaacauucaucuuuucagguuuucaaaaucuaacaauguggccagcgucuagcccagguggccucucuguguguuuuaccaguggcuugcagguuucuguccucugugagcagcucagguggccggagaccccagggggcccuccccuuuauucagaacuugcaggauugugggaguagauggccuggcuucucuugugguucuugaauuugucucugaggacauugcauccucagauucugucucucacugggguggccaccugggccagcggugcccauguucuacuggccagaauugcgcaccucccaggagggggaggagggcggcuguugcccucacucauguccccccgcucagaacccaugggcaaacucagaauuguguaucccggccgcacuggggcucugagcagucgucuuggccauggcugacaguggggcaggaggugggcuuccucagcccacucugcuucucucuggcuaugaucgguguugacccaguuugacucugacuuuucaccuuguccuaaggaucccaugagaacaugucuguagaaggcacagagcacagucccuggcccuguuucucccuuccugugcuuccaggagggacugggcauguggugucaggacaguguacuggggccucuguauggccucccuggccuuguggcuucaggagggacuggacauguggugucaggacagcguaguggggccucuguauggccucccuggccuuguggcuucagacaagugacugagcucuccugggccucagugaugacauucagguguuaaugagugagugugaagauuggguggaacgcgguauggaaccuggcgcacaguaggugcucagugaaugucagcuuuuguuccccagcuccaugaggucuucucgcucuuagcaccccccaggugacuggcccucacgaaguggguccucuguagaucucggguaugugaagucaacaguggcccaaggaggcugugggcaggagaggcuugaaugguugcagauggaggugcugguggugcaguugggagugagaugagauuuggagauuuucucuugccgugagccuuccucagcccccucuugcuucuguucucagggcauguaugcacucuguggcuuguccagagccugcaaccuugguugaaaauggcucccgaggccauucucccagugaagcacuugcuuccacucacugcuguucagccccgggagccagccagcgagagcggggcugcgggaauuggcuguuuggagacaggguaggagggcugcaagcugagggucugcagggguggguguaggggguuucccauccaaggccgcagcccagaagggugguggauugccucccuguagccauagagaagcagagaggaggcuguggcagggcagaggccccacccugggaggugcagcugagaggccggaugcuggggcuuuuuggaauggagggggcuucugauucuggggugcaggacuggggagcaugggaggaaaggggacagucucuugaagaggcaccguggacccgauuuuagaaauuucuaaauuaaaauuucuguuuuagaaauuuugccuguagguagagugucucugguccgugggcuuccgaagcaucuuguccagauuucuaccacugcaguugccauagucugcgcaggguaagcguggcauggcugccccagcaggagcugcccuccugggggagagagcaacucucacuucucuuucugugguugcacuggucauggguuagguacucacaccagguuuauggagugaaggcaacaugcgccccguccucccagggccuugagucugaugggcacccaugacaagcagccaggagguggcucuccagguggucacucuccaagacaaugagaggaggagcuggaggcuucauggaggagaugauguuccaaggaugagcagggcuugccucggaggaaagcgggaggggcaggagacauacugguaugccaguaguagauucggaaugucucuucugaucaaguacuguauuggugacauagguggugcauacuaauucccaauugaccaagggacagaagccaccagagcagugagcucagagcccugcucucuuugaugccauuucuuucaggcuggcuggguucugacuggucaggauaaguuggucuaucugguaucucagcaacuagucaccucuaguauuuaaccuugucauuugaugcacuuucuuggucaucgugcuuaucccaauuaggauuuaauuagagccccauaauaggguuuuaaaaguguauuggaaaccaaaggggucaugcgauaugauuuuacacaaaacaaaagcauuuccgucauucaggagccucauucaguccccaugucucugucggcuuuucccuuaaaauguccccuucccucagcccggguugcaccugcuucuggccugcauagcuuucucagaugcucccccuccgugaagaaugccucccuccauucuccugucugccggccucauggacaucucuuauguccagggacauagagccuucucugcgaggccuucucuagcucagcaucuagcauuguacagaggccucucgaguugucccugggcccacuccuuguguuuauucacucagguagcuguuugccuccuagggguucagcacagcacaucgccuaguggagcauuuguccagcaccuuuccugacauuccugaugccuccacgugcauauuccuuccuauuuguaaccagaagcugccugaaauuacacauacacacaccccaacuuucaaauagaagaagaaguuaaagcuagagaaguuauuuugaaaaacucuguuauguuaaugauagcaauuaagggucacgaagccuagacucccauaacucgagaaaagcugccaggcaacaagcaucuguggcucucucaugguccuguaguggaagcagagacagagcagccacuaucccuugcugcgguuugggcuccaggguccugcagaaagaacaccuuccaaaaggcucauuuaacucuaucacaugaucagggaaaccaguuucccuccuggcugucuguggaagugaaaccuuguugaaaucugccaaaggcuggagaggaaaagaacaaacuuauuucucaggccuccuguacuuugcccucugacauuccgcuuuccacaaacagauuggugaggagcacacaauucaguagauaaacgauaacaaucaucuuuuggauuggugguuuucucuugcccccuauuuucaccugagaagaaacacagccuuuuucagaaaguuaauuauuccauuuugaaagccugagggugauggggguguaguauguuucuagguguaccugcacuauuuuggggaccuuauggagugccagugguguucccgagggaguaccgugggcagcuccuggcuggauugauucccaccucuguugcaggacagugcccggcccauaccaaguucauccuguguguugagugcaguggcgugaucgaccgagugagugaggaacucaggccuagggauuugcuggcucccauuugggcucugccauuucugguugcuaugagccucccaucacugugcuugacuuucaucucccaagucacccagcaauaccuguggcaucuguccaaauacuggugguggucucaccgaacccacaccaggucauaccucugaaaucuuugccuaacauccaucucccaaccuccauuggcuccucagcaccuguguguauaaauccaggugguuggcaccuguuccuggcaucucugcaggauccaggcccugccuuccucuccagucuuauuucuugcaggcaccaccccccgcugcaucuccacccucuggaugggugcaccauacuaagcucuugcagugacgggcagauguuuuauuguuuuacacucugugcuucuguuugugcugcuuccucucuagcugcaguguccuugacauauaccuuacuugguuaguuuuaggucagauauuuauuuuacaaagucaucuaugucccugguuuuaaaaauggaguagcguagguugagcauccauaauccaaaaaucuaaaaucugaaaugcuccaaagucugaaacuuuuugagcagugauuugacaccacagguagaaaauucuacaccugaucuuaugugaaaucacaugugaacuccuaggugcacaacacacaguuuaucaguauccccaagggaaaugagacccuuccagccccuucagcugugauuugucuugucugcgcacauccagauuccccugcacaggcauguccacaggggguaauaagaccacacgugugcguuggacacaccaagggccgguucccccaaugcccccccaugggggaggccugugugcauuacuugcuguggcuuuuugcuuacucuuuguucuggggcguaaagauacuauugaaaaugccaaaaaagaccuguagauaccccucugaguaacaaugauaagaacaaggaggauuuauguuuaucuguagcacagaaaagucaggcuguuggagaaacuggacugugguguaagugaaacaucuuacagcagagugugguguuggaaugaccaccauaugggaccugaagaaacagaaggagaaaccguugaaguucugugccgaaauugaugaauagaaguuaaugaaaaauuaaaaaccagugcauaaagccaaaaaauaaagaucuuuuaaaaauuuuuauuuuaucuauuuuuugagauggagucucacucugucacccaggcugcagugccguggcguaaucuugccucaccgcaaccuccuccuccuggguucaagcgauucuccugcuucagccucccaaguagcugggacuacaggcgugugccaccaugcucagcuaauuuuuguauuuuaguagagauggaguuucaccauguugggucaggcuggucucaaacuccugaccucaagugaucggcccaccgcagccucccaaagugcugggauuacaggugugagccaccacucccgaccccaaaaaugaagaucuugauuggguauugagagagugaauccaucagcaucacacugaacauccacuuaaugauacaccugucaagcggcaagcaaagcugucucuccaugaacuaaaaguugaaaagaacuguuacucuucaacaggcugguugcagaaauuuaagaauagauauggcauuacauuuuuaaagguuugugcugaucaugaagcgguggagaaauuccuuaguuugccaagaucaucucuaaugagaagcugaugccugaacaagucuauagugcugaugaaccaucauuguuuugguguucuugccccagaaagacacugacgacagcugaugagacagcccuucaggaauucaggauccuaggacagaaucacugugcugggcugugcuagugcagcaggcaugcggaagcguuaacuugcugugauccgcaagagcuuguauccuuacuguuuucaaggaguggauuucuuaccaguccuuuauuaugcuaacagaacggcauggaucaccaaggacaucuuuucugauucccuucacaaacguuuuguauccguggcuugggcucauugcagggaggcuggacuggaugaugacuacaggauuugucauuucaugacagcuguucugcuuauucuccagcugaaauucucaacaauaauaauguuuaugccaugcauuuccccccagaugugacuuuauuaauucagcuacgugaccaaguaucuguagaucaaugaagaauagauaucaaaacacuuucuugggcagcacguuagcagcagugaacagagguggcauggguuuggaagguugcaaaagauguuuagcacgaaggaugcuguauaugcugcugccagugcuuggaacacagugacaaaacaaacagcugugcaugccuggcacaaccucuggcacaaccucugggcugugacucuguguucagugaugaugaugaaccaaguggugacuuugaaggauucugugugucaaaugagacaaaaacgaugucugaccuccuuacauauguaaaaaauauaccuucaagguccaucagaaaacugggagaaguggauaucaaagaagcccuccacaucgauaaaugagguaccaguuguuaaccauuggaagaaguggauaucaaagaagucuuccacaucgauaaaugcauuaccaguuguuaaccaucaguagauguggaaauagccaaaaugguuuugaguccagguaacugugaugauagugaugaugaagaugaugacguuaacacuguagaaaaagcaucuauagaugacauggcgaaaaugugcgacaggcuuacugaaggacuagggcagcaugcgaucacagcagggcaagaaaucacgucaauugacaaaaucaaagagacacuuaaaagacagaaacuguugcuaauaagcagaugacuccagaggaaacauuuaaaaaagccacccggcagaaugccuucucaucccuagagcacccgcuuccuggucccucagcugcuucugauguuucuucucacugagaaaacaaaaaccaaaaagcaaaaaacccacaguguccaggaaccuuuuaauggaaacccagcacuguagauggagacuggaagccgccauuguuuguugcugccguugcuuuacagcgggugcggguguucuggggaggcugcggugccgcuuagcuacucugaacgcaguuuuuucacuguauuaaugguaggucauauuuuuuacuguuaaguacguaugugggaauaaguguaagaaaaugauugcuuauugguagcauguaaauuuagagucaggaaugaugaugaugccagacaaccacagauuguccucacgaguggcugagauagugacaccuuggcuuuugggugguucaguauacacacauuuuguuucacgggcaaaauuauuuuaaaaagguaugaaaucaccuugaggcuauauguguaagguauauaugaaccauaaaugaauuuuguguuuagauuuaggucucauccccaagauaucucauuauauauaugcaaauauucuaaaaucuggaaaaaaacccagaauucgaacacuugggaucccaagcuuuuuggauaagggagacucaaccggcaguauaagauuuguacuggaaagaguaguccuccguccccacccuuccucaucccugccuuccgucucugaggugaggcugucauuguaccucuuggcuauuguugcugguacuugucuugauauuucuaaauacuaugcuaauuuugcagauuuuuacaguuuagccguauuuauuaacuuucuacucugaagcagaggguuuaacucucuuaccaugcuucuuccucuucuccuuccccauccucucaguuuaauuuuuggugacauugggauucauuguuugugauguuguaacucuaacucugguucaugacugaguaccugucacguauaacuuguuuuauccuagaguuguucauuugcggggugaggugggggagcucacuguguggguaggaguagguggggggugccccuguguucugcuccaacacagcccuuucuggggguucuuugcccucaguuggccgcuccguguuggcguccccuugucaggcuguuaucugcgccgcuccgcugccucccacugcugugucugcuguccauccuucacauuucugcugacauuucuugucugccuccuuuacacccuuguccuuguuuaugacauuauuccuuuacugcccuguuggugagaguuagggaguaguagagauaaaucugugcuuugcuuaguuucaagauggcucuccagcagcagcucacggagaaucuuuccugauguccccuucuucagagaagagaccaccccuccucuggugacucacuguaccuugcauuccuuucucccauaguccuggugaacagugauuucacuggcuagauuucuucuuguuauuugacagugagccccuugagggaaggaacuggguuuaaucacucccuuggaggcuaguucugggccugguccguggugaguguugauuggcacccgccaaugggauggauuaauguguggguggacucggucuggggagugucucaguggcuuugcccagaggcagcuuacacagggggcaugcucagcaagugcuggccacauggaguugaucugugaggcuccccuguguguggcuuuaggaacaggacauaugcguauuuuuguagaaccucuuuaugcuggugacacucagcguuuagccuagaaccacauguaagccuaagugauugcagugcacaugcauuucuuacuauuguucaguguuucuuccagauuuuauuauuacaaaagguuuuaaaaaucauaauuaaaggcaguuaauaagaaaugaaucuuaagaaaaaaagacgcuuaaaugauggguugauuuuucuguuauucuuggcuuuucagaaaaaagguucuuauaauuaggaguucuuugcauacaccacuuugugacagauuucugguucagucucaaaugugauauuuuacauccaauuagaaugaaugagucccaguugcuuuaugguuuggguucacagagugugcugaauaacugcaucugucagcauaacagaagcgugcucuuggauuuguacauuaugucacaguucaccaauguuuccccauguauugucucuuuguuccuuguaaaaauuaugugacuuaagcaaggcaaguauuuuuauuuguccuguguuuuaggggaggaaacugaagagggagagccuccagauagucuuuggccaagcugguccuugaacccaggugcacugaacccacaaccaguguuuguuccucuacccucugcucucugucugcucucuuuagaguuagugcuugguaauuuccuauugagaaguaaagcuuucacagugcagaugagcaugaaauugugauuuuggugguguuuuccugaaaauauuccaaaguuucaguuuucagaaaggaaauccacuguuguagaagaaaugcuauuuauuucucauucacuuaaucucauucauuuucuacuuauguaaguuuuuuguacauuuuaguuuucucucuuagagcacuuaggauuuuacugccugacugugugaaaauauagagacagaaagcugaaaggaaagcugucuuagucuguuucauguuguucuaacagaauaccacagaguggauaaucuguaagcaacagaaauuccgucucucccaguuucggaggcuuggaggucucgcaucaaggugccggcaucuggugaaggcuugcuugcugugucaucacauggucgaaggcaaagggcaaaacgggacaaaaucugugugcucacaugacagaggagcagaagagggcaaaucuacuuuugggagcccuuuuauaaugaccuuaauccagucaugaggguggauuacucaugaccuaaacaccuucccacaaggccaccucccaacacuguugcacuggggauuaacuuuccaacacaugaauuuuuggaggggacaaaaacauucaaaccauaacaaaagccagacacacauguuuuaaacauaaagacaggcaguugaaauaaaaggguagaaaaauauaugucaugcaagcucuaaucacaagaaaacgaauuugcuuauaguuacaucaggaaaaguagaccucaagacaaagaguuguauuagagacaaagaggaauauuucaugaugaugaaaggaucaauuccuuaaguagagagaugaguccuaaauguguauguaccagcuuuacaaugcaugaagcaaacauugacagcaauaaagagagaaauaaacaaguuuacaauccuaggcagaaaauuuaacagcccuccgugaguaauugauacaacagguaaauuaaaauguuaguaaaguguagaagauuagaauaacauuaucaaccagugggaucuaauugauuuauaaaauaccgcaucuacuaacugauaaugcacguccuuuucaaggacauauggcacauucaccaaguagacuguauguuggccccaaaaaguuauaguaaauaucagaggguugaaauaccaccaaauucaucugaccaaaugcuuuaaauuaaaaauccauaacaacaagauacacagagaauccucagauauuuggaaauuuaccugcauacuucuaaacaaccuauggaucaaauaaaucacaaggaaaguuugaacugaaugauaaugacaacaggugucaaaauuugugugaugcagcuaaaacagugccuggaggaaacuuuauacuuuuaaaugccuguaugagaaaagaauaaagguuuccaauccauauucaacgcucucauuuuaagaaacuagaagaagaacaaaaaccgaguaaaagaagagaaacaauuuaagggugaaaaaucaauaaacugaaaaauggguaaacaagaaaagaaucacuaaaauauaaaguuuuuuugaagagacccuugaaaaaccucuaguuggacuaaugaacagaaaaagagaaaaaacaaguuaccaauaucagaaaugaaagaggagacaucacuacagauccuacagacauuaaaaagguaauaagggaauguuauuuacaauuuuaugccaauaaauucaugaaauggggauauuucuagaaagacacgacuuaaacuaauacaagaagaaauggagaccuuuaauauccuuauauugauuaaaaaaauuaaauuuguuauacaagagccuucacucaaggaaaacaucaggaccagauggcuuugucggugaacuguaucaaacauuuaaagucuaucaaacauuuaaagaagaaauaauagcaaucuuccaggaucacuuucagaaaagagaggaguaguaaacacuucucauuuuuuuuaagguaacauaaucccgauaccaaaaucuuacaaagacauuauaagaaaagagaaccugagaccaauauuuaugaugaauauagacaaaaaauucuuuaaaaauauauuagcaaauugacuuuugccuuaaccuaugaaggaguaacugccaaaggaauugcuguccuguuaucaacagcuagaaaacuggaccagauaugugaaacaacuguuuucagauguuggacaacaggcagugcagggcugugacccugugagauaggagauaaguaaggugaacuuuauaaggacucaauuugcaauugaaugcaguugccaagcagcagcauaagugggggaacccuaaugaaacaggcagcuuugcugaguguaggaauuaggaaagaguuuugaggaggccaaaacagaaucauauauggagcagaguguuggagaggagggaauuguauagggagagaaccccagaugucugcaaagucccaucaaguccuuagcugaguauugaucugcucaggaguagggugggauucuaugagcuggggaaagucaccaaaaagcagugaguugaauaaucccaaaugcagugggaaucgaguguuggagagacagcaccugcaggaaccuggcgaaugagccauaugaaccuggaagaaaccauucgugucccuccagcccucucuauugaauaggaugagaucaugccagcugacaaaggagaaguuuuuacaagauccaguuccaguaucacaguggcaauaaauugauacuugggauaucuggcauucaauaaaaaaguaaccgguaugcaauggaacagaaaaauaugacccauaaucagaagaaaaauuagcaauuagaaacagacucaugaaugaauaauaaaauuuugaacaacccaauaaaauauggguaaaggauuucaacauacaccucacaaaaaguagagagauggccaguaaacacaugaaaaucucuucaaugcucaacaucauuaaucaucauaaaauugcuauguaaaaucacaaucagauacccuuuaacacguacuagaauggcuaaaauaaaaagacugacaacgcuaaauuuuggccaagauguggaacaauucaaauguucauacauugcuggugggaaguguaaaauggugcaaucacuuuaaagacccuuauggcagauuuauuuuaauuaauuaauuuacuuauuuauuuuuaaauucagggauacaugugcaggaugugcagguuuguuaccuagguaaaaugugucauggggguuuguuguacagauucuuucaucauccagguauuaggcccaggauccauuaguuacuuuuccugauccucucccucaucccauccucugcccuccaguaggccucacaacaugugguauuugguuuccuguucccgcguuaguuugguaaggauaaugaccuccagcuccauccaugucacugcaaaggacauaaucuuguuccuuuuuuuuuuuuuucuuuugagacagagucucgcucugucaccaaggcuggagaggugcaguggcacgaucucagcucacuacaagcuccaccucccggguucacaccauucuucugccucagccuccugaguagcugggauuacaggugcccaccaccaugugcagcuaauuuuguuuuguuuuguuuuuguauuuuuaguagagacgggguuucacuguguuagccagguuggucucaaucuccugaccucgugaucggccugccucggccucccaaagugcugggauuacaggcgugagccaccgcgccuggccaaucuuguuucuuuuuauggcugcauaguauuccaugguguauauguaucacauuuucuuuauggagucucucauugaugggcauuuagguugauuccaugucuuugcuauagugaauagugcugcagugaacauaggugcgcaugugucuuuguaauagaacgauuuauauuauuuuggguauauacccaguaaugagauugcugggucaaaugguauuucugucucuaggucuuugaggaauugcuacacugucuuccaugauguuugaucuaauuuacacucccacagacaguguaaagguguuccuuuuucuccauaaccucaccaccauuaauaaucacaauucugacugauaugagaugguaucucauugugguuuugauuugcauuucccuaacgaucagugauguugagcuuuuuuucauauguuuguuuggcuacagguaugucuuuuuuuuuuuuuuuuuuuuuuuuuuuuuugagacaaagucuuacucugcacccaggcuggaaugcaguggugcagucuuggcucacugcagccuccaccucuuggguucaagugauucuccugccuuagccucccaaguagcugggauuacaggugcaugccaccacgccuggcuaauuuuucuauuuuuaguagagaugggauuucaccauguugcccaggcuggucucgaauuccucaccucaaaugaucugcccgccuuggccucccaaagugcuaggauuacaggcgugagccacugcaccuggccuuuugaaaagugucuguucauguccuuugcccccuguuuaaugggguuguuuuuuucuuguaaauuuaaguugcuuauagaugcuggaugucagaccuuugucaggugcauagauugcaaaggcaguuuuuaaauaaagggagauguacaucugcccuaugacccagcaguuccacuccuucacaccugccuaggagaaauggagacauacacccacaaaauguauauccacaagagcguucaucgcagccuauuuaugguaaaaaucagugacacagaagucuaagaaugggugaauguguaaacaaguugugguauauucuuagaauacuuuuacugcuuguaaagaaugaacuacugguacuggcaacaugugugacucuuacaaacacauucugagcaaaauaaauaggacacaaaggauauauacugucuguacuguuuauaugaauugcaagaacaggcaagucccgucuauggugauagauaccagaaggcaguuaacugggagugggggccaagaacgacuagaaaagggcaauagacauguucugugucuugucugagggcagcaauacuuuuuuuuuuucuuuuuuuugagacagagucucacucccacccagacugcggugcaguagcgugaucucggcucacugcagccuccgccucccagguucaagugauucuccugucuuagccuccccaguagcugggacuacaggcgccagccaugaugcuuggcuaauuuuuguauuuuuaguagagaugggguuucaccauguuggccaggcuagucuugagcuccugaccucagugaucuacccaccuuggccucccaaagugcugggauuacaggugugagccacugcaccuggccuagcaauaugcuuauuauauguaaauuauacuuugauuucaaaauaucacgccccccaacaaacaaacaaaucucuaaaggggaggaggaaaggauggaguauuguguccagcacuuaacuggagacagacaaaaagccaagugguggagucugaccuucaggagcacauacauuacuucuaggagacaaggcuggugcucaugacccccccugucauuggcgcucacagaagagauaagugagugaggacuguaguugucaggaaggcaucuuagauguggcaggucuugcgaugggcccugagagcugcauggaauuugacaaaucggagauuaaaguggcgacgucacagaaacuuuguaguuuugugggaacaccauagggcguacaguggaacguaagucuucuaccauccuugacuccauccugggauccccuccccagauucugccugugcuuucagauucucguaugugccuacagaaauaaucauuguaucuacagauuguucccuuuucacuucauaauuuagauaaacuuacuucauauccgcacaaaaagacagacauucuuuucuauggcaacaguguauucuauuacaaagacacaugugcauacaaagaccuagcaaugucauuacuggguauauacccaaaauaauauaaaucguucuauuacagagaacauuuuugaauguuccuguauuuggccaucuugcuuaucucagaacucuguuuccugccauucucucgggucugccucugucucuguuggcgucauuccucaggcugguugggugcagaugguugcagcaguucugacccccacaucugacccugguagcuuucaggggaagaggaguggguugccuccaggaacuucccaagagccggguggaguguucucagaagcccucagcugucugugcucaguggcuuaaguaggcgccuaggcccauugcugacucagccuuuggugaggugugggcuagcucugcggggcuccaacuaggcccaccuguggguucagcugccucugggcugacuccccacccccagggcugcugcagggaagcaugguuacuuugcacagcugggauucugcuagaaagauguaccaaacaccuaugaggauggucauguggcuucccugucgaccccauucagcauguggguaaagcuacaagauuucccgacguugaaccaucccuccuucauucuuuaccuguauuauucuuugaauauccugcugcugugcuuugaucuacuaagauuuuauuuuggaucuuuuugucuguauucagaagugagauuugucugugcuacaaaagucuuuuuaagaauggaagggacguaguggacagacccugguauugaagguugcuuaguuccugugugaccuuggucaagucacuuaaccucucugaggcucuuucauauacaauagugaucacagcccuaaguaacacaagcuuguuuugaggaucaaauaagauaauauguaugaaagcucucuuuuaacaccaaagcuugagcagaguuugaggcuugucucauuauguauauucaggauuuuugaauuuuugugaauuucuuccagugaggagagagguucagagaacauuaacgaaugaguuuccucucagcuuuuucucguaaaccauaaucagaaaaccagaguuaugccgagggagagacacugggaacauggucgguaaacauuacauuauugguguucagauaugagguuccugcuuuucauaauauccuuaggguacuggggaagauuugauauuuucugagauugcuguaaaaugcaaguuauugcugcgacuaucgcccaauuauucuguacuuauuuuacuuagacuuuaguaauuggaaaaagauuagaugucaggacuuuguauuuuguugauuauauuagcaaagucuucucuuuaaucauuucuuuuauucccguuauuaaucauuagcuccaagcuguuaggaaaacaaccuaaugguagauuccuaacuuaaaggaaagaaauaauuacuugaguuuccaugggauuggacaaguguugcuauaccuagacauugaaauggauucucuugccauuuggggcaugggagugagacacucaaggagacucggaaggucgauggaaugcagggcccacagccuuaccccucugccugaugcuuguccuucccugcccuuggaggugcuggaccuugcuccaggaccccucugccucuggccagcgccucccuacucgugauuuuuuucuacuuguagguauuuauaaagccucauugacuuguauuagacuaccuugaagacuuuguugucuguguagaauauggccacauccuuaauuaaugguguauaaagacaagcuuaucuccgugaaacaauuucuuucaaaaccaguagugagaaaaaccacaucauauauguaugcuuaaauagcauauagaaaguugagauggaagaaagaaaggaaaaccaauuaacaugaucagguuggggaaaaagccuucaggagagaguggggggaaggaagagagagaaggaggugggagggagagagagaaggaggugggagggaaggaggccaguguacucuggacuucucugguugaaggaggaagggaucauggggccucacguguuccaggguagcuccaggauucuguuguaaacagguaaccuguagcuugguuugaauagaauggucacuuaccuucucucagauauugaaaucaaucguaucugaaauguugaugauuuaguuuaauuuguuuauggggcuccuugccuccuaauuaaacagguggaauguguuaaagcacuggggagguuugcuaaccuuuugcaaaucuuguuuuuccuugucucuuuuuucaucaacagaggaauuacggagguugagcugguccggaaucccuaagccagugcguccaaugacguggaagcuccucucaguaagucccaccgcaccgcccaucagcgccuccuuccugugcacagggacugcaggcgucuggccugaguagggccugacagccacagcccacggguuugccuuggcuuuguugcagugauaaaggccuuugcuauggcuaagcugacauuuuccauucuuugcuuaauuuuaagcuugguuugacaggacuggcagaaaacaagaauagguaauaauuaugacaacuauauuuuuuccucagauuuuauuagaaaaucuuucuauguuccagccugugauauagaaagguuucagcauagaugguuguuucaacuccgaggaguugaaacagggaaauauguuuuaaauuuguuucaaauaugcugaaaacaaggacauauguuugaccaaguuuuuuuuuuuuuuuuuguaaguauuaguagcgcuguuaggaaaagagaagaaauggaugagacaagugguuuguguuucugugggugagagaagugguuuguguuucugugguggaguguggaguucuggcugccgcagcucuggcgcucagcugccggucuggaaguccuuggggaaagguugggguaggcgguggugacaucagcaaugcccucguacacuuagcucaggcuugccguuggaagugaguuuggcccugcccaccauuucagaauuguuuauagacaguuuucuucucuuuuccuuuuucauuauuuuuggagcuaagucaauagggagcucuaaguguuuacucuaaacugggucugacuuuuaguauuuaagacucuuucuggcuaaugagccuuaauaaguuugcagcuuaguaccucguaauccuaaaugcagacgcagcucugaacagcgaauauuuauugauuaaauauucuuuugcaauuaaaauuagacuugcugccauugcuuauguuuuuguuuugugcuuuuuuauuuuaaccuaguuuuccaguuuauauccaguuuucuaaauguccccuaagauagguugcagacuucucagguugguuuguaggaaguuaugaugaaaacaccgaauugccguuuucuauuuauuaaggaugugccgugucuagggggaaagucucaugugaguuauuuuauacugugcuuucuccucuaauucucagccucugcggguugugguuccgcuucccuaauguguguagcacagggguugauguggacauggacacucugauuucaguagacagaggagcacaaggggaggugacagccccacucugcugguuguggacaggagggcagguggguguagguggagucugacccaggaaccccggcgaggcaagugagagugugaacccaggagaucugagacuggucucaguugauuuagaaaguuuauuuugccaagguugagggcgcacuggcgacgcagccuuaggagauccugacgacaugugcccaagguggucggggcacagcuugguuuuauacacuuagggagacaugagacauccaucaguacauguaagaaguggcgagggagcuuccaggucacagauaggugauacacgaaugguuacauucuuuugaguuucugauuagccuuuccaaaggaggcaaaucaggugugcaucugucucagugagcagaggagugacuuugaauaaaaugggaggcagguuugcccuaagcaguuucuagcuugaguuuuuuauagugaucuugggggcccaagcauuuuccuucacaagagaaagccugagcauucucagagcguugacuuaugaagggacaggcacauguaguccuuuaaccaucauagcuugcaggggccuuugcuugggagacggagaugaauuagacacuagccugccauuaggaggaggucgggugcugcagacuuguggugggacaguggugguggaggccagacugcaugcuauaggauggacaggacacgaguaugaaccaggggguggaggaguaccacagcgugggggcaguuuaguacagagggucagcuucugcuaagaggggacuucacaccugggaucugcauggccauggcagguggggaaggaggggaggguguggagacuugcagucacaagggauacggaugaacguggugguucuuggcccucucagggcuuggauugacagaugaguaggaaauaaauguuagaucagggagcaaagcuugucguugcaaauguugggugcuaagaaaggguucaugaggaugccaaguaaggcuucuuggggaagguggcaucuuacguggcaucucaaaaguguuguuaguguucucucugcuagugggaaguggggaggccaugagagcuggggcacacaguaggggugggacaagcaggaacacaggcugggguagaggggcccaagaggagaccaggugacagccgcccuacugccaucccuacccaccccauugcuuggguuuuauucugaaggagaaacugggaguggugagccuguguuucuggaagaguaaagccuugaaagagccguugguugguucauucauucauccauucauucauccauuggcauuuauugagcacuuuguguuuuaggcacugugucgggugcugggaaauagcaggcagggaagaagaccaagucgucccccuggggccugcagaacagauaguagaaggccugccuuuuucucuugcccccuccaaccccgacagaccuaggcuacguggagacggaucccauucucucaggaucuuauuccugugcucccagugcacugcugcccugugucugucccuuacugagugcuugccgugcgucagaccacgcauucagagauucuuguggacaggcguguggcaggcaacucagggaacaggcuguucuugcccagugucuggcucguaggagcagugcugguuguaaggggaggcugcucuuggcaggcucuugggaggggacuagagcugggacaggaagaacugggaagggacagguaagggaguugaggggccaaaggcuacagggguggaguaagaggacucuggcagcuagaguagggggcaagcguugguucuuuuuccgggaacaagugcucacugugcauuugccaugcuccaugcccuguguuggugagcacugaugccauccagcuccccaggcagucaugcugcaccauggcucugggccuucuguaagaggagagaucugggagcacagugcacaaugcgagucacccaucccugagucagcaugugcugcucacacaucugcccucagccaggcccucugcaggugcugggguuacaagaaccucugggacaaugguggguacugggaacucagcagggaaggggucuccccaaucaaggaugccucuuuaucauucccugaaucccaagguuuaaaccuggcuucccauucaacucuccugggagcuuuucccgauccugguguccgggcccacgaagcaaauuggaaucucuaggguggacucaggcaucaggguguugacugacucuagcaugcugugaaccaugcaguccacagagugccuacccugcggcuaggcagggaaugggaggcgagggugugggagguucaggccugccuucuucaccuguggguuuccauucuggucacaugucauuaucaccuuuggagcucaggaaauacuguuacgucgguucuuggggguucucacgugugcccagggcugaagacggcugcucuaagacacucaggcuccaguggggcaagguggggcauacaugagccaacugggaagcaggucauugaaaguuaugcgcuaugcccgccacugcaggcagcacacaccugggcugagguaccagggcaggagagcuggccuggggcguuggagggccugcguuggaggagagaggcugagugagacucgcugagagccaugagcguguugucugggaggguucgggugagcaggguaagaugggagggauuuaucccagucugugaguccuuccaggauccagagguuaacaguuacgcccagaauugagaauuuaucauuuguccagcuuaaaaaggcagauaaccaaagaggcagauaaccaaagcugugcuugaaugggaaccuauuucagggucuggcaaacaucaugacucuuuuucauuguguuuaugauuugucauuaacaugauucuaguagccuuauuuuuaauugaugagugggcagugccacuucaaugaagaaggacgagaaacaugacuuggcauuuaugaaaaacuaacaucuagucuagaacauaccauuaagccacuaguaauacuacuuaauguuuacauuuuaugcaagcaggguaguaacuuuuuaaaaauuacugcuauacagaaucauauuucuggcucuuuuuuaaauaaguauuucagaaacguggcacaaaaacuacuuaaacaucgaacauuugcauuagugagucuaaugguuaaaaaugaugagugaagcuccaguauuaucuuuguuuuugcaguuuauugagguagguuugcauaggaacacagugggagggaacaauuugauuuuugugucaccgggacaauuuagauauaaguauaugcaugcauuguuuuacauuuaugaugaguguuuuuauagcaugcuaauacagcaauuaaguuuucuguaguucugucauuuaaaauucauugcauacuugaauguauuucauuugcauaauuucuagucuugcuuaauuauugaaaggccucaacuugcauauguguguuuuccuuuagggaugggagugucaggagcacguguaggguuuuuauugccugcauuccgaugaugacgugcuugccuuuuagaauuuguguuucaaguuaauuuacauuuuggggagugggaaguauuucugagagcccucuugcaaguucacuauggauuuuuuguugccacugaacgcaguugaugucaggcugccuacaccacggccuagcugaucaccccugcuggcccacgcugcccuguguugaaggcugggccccuucacuggcacacaggccuucucuccuggcugcugcacacagcuucacacccaucauuggccaggcucuguuuccggccuugccccuagccaacccggacacauuucccuguguccucugugcuccgucucuuucucuccaccucugucuucuccacuaucaaaaccaaacccagaaguguaugcuuggucuuacuugucccaagugagcacacgcaucuuucucccugagucucagggcuguggccaccuuugggucugacaggaucucugcacgucgugaucacucuugcacucagcgaggaaggacugagguuccguuguggggcaaacagcguuccaagcccuuggacgaacauuccgcccucguggaccucacauuuuggugggagaagacaaacaauacaccgagaaguagauuugaugugcuguggaaugugaggagugcuguaggaaaagggcugggaucagcuuggugggauggugagggccgaggaggggaaggggcuguugaaguagguggguagcggucagggugggccgcacugaggaggugacuuugagcagggacuuagaggagcaagggaggcagcuaagcaggugccugggggugcauuccugucugguucauucuguggagagggcuuacccguucccucacuguguuucccaucagggaauagugcccaccagacacaggugaugaagagggagaacaguaaguaacaggaagcagugccgugggcuccucccacagccggggagguggagaccgagagagggugcucuuguggaaaggcggcugcuggcccugcacagacugagagcagcggccagcggcuguccucgaaagggcagccagucaacacccugggcuugguggccccuguggucuguagcagcuaaucucugccauuguggcccagagcagccacagggaaucuguauaaaggaaaacacauaguuguguucccauaacacuuuauuuacaaaaaugggugggcaggauuggcugauggucaguuugcugaccccugaucuagaugaaauggguccuagcagaggaagaguaaguucagagaggggcacugaggcaggagagguguggcauuuaaggaacauuuaagcagcgaaguaaaagugggaggggccauggugagugacgagucucggccucuuggucagagaggcaggaagggccaggcccgcaggagccgucagccuaggcagggccugggcuuuuaugcugggcaugauuagaagcaauuggaaguguuuucgggcuggugguguuaaaaugaugugauugucacagagucucuagagccagcguguggagaaaggaccguggggucuuuguccacccacugauggacagucaccugugagcccggccagucuucagcgucucuguauccagggcugagcagcgggugggagaguggcuggggcugggugaaugaauguuguuguuguguguaucuguggguggcucuuagcaugcggauuuguccccaggucuucggugacuugggaucacauggcucuccugagcagugugggaccucagguuaggagcuggggcuuggcuugaguuugccuucguguccaugugacucugggcacauuaaccacguuuccugagccugucuccucgucugcagauagggacagugacggccuucugugauuagugggauuaaagcagcacugugugaagcacggagcguggugaggacccagcccuuccuuaguucaccugcggguauggcaauucgggggcaaagaaaaagaaguaaucuuauguaauuguuauugccaagagacggacaggcuugaaauaacaacaaggugcagacgggucuggaugaagccuguggcucugagacgguuaucugugaagcuggcuugaacuugaaguagaagcuuguuucacucaggucuggcugucacugcccccccuuguaauuuuaugccuucccaucacugugggcagggcuagguacccaacagaaggagcucugcgccuggcaauccaccagcacaucccagugaaagaggccugauucuggagaugcucaggugggucauuaaauaaucacccggaaggcaccgcagaaccacgccuggcacuucugugcacacucggggcugguuauucuuuuuguuacuguuagaauuuuuuuuuuuuuuuuugaggcggagucucacucugucgcccaggcuggagugcaguggugcgaucuuggcucacugcacgcuccgccucccagguucacgccauucuccuaccacagcuucccgaguagcugggacuacaggcgccugccaccacgccuggcuaauuuuuuguguuuuuaguauuuucaccguguuagccaggauggucucaaucuccugaccucgugaucugcccgccucugccucccaaagugcugggauuacaggugugagccgccgcgcccggccagucacuguuagaauuaugugaaucaauacgcucuuuggaauacugcuauuuccucauuuuaugggaaaacagaggccaggugggaauaauggccacaccuuuccuccaucacgaggacucugagugucccucucgagugcaucuuggcagcuaggcuguucugugccccucuccagaauacuguaauucaccgagcgauuguuuucuggagagaguguucuccucuggggcaccuccucccauuggguuggggaugcgucugacacgcguguaaccaggcgguugugacccgaugcccuuucugccagggcuacuuggaaaucacgcaucgugaaccuugaagguauccgguauuccuuugagcuaaaaguucacuguaggaaguuuacuucaggaaguaauugacauuguuagcugauguguguuugagaauacugggcaauuagaaauaaucaaaauacucacaaauuggggaaaggugacauagaaaugcguaugauggaagccagugucaccuucaaaauggauguuuuagagcacgguuggcaaauguuuucuguaaaggccuagauaguaaauauuugagccuguaggccauguggucuccuguagccacuccacugugcugcgauagggcaaaagcagccacacacaguacauaaacagaugggccgugcccuguccagcaaaauuuuauuuacacaaauagguggugggccguaguuugcugauuccuguuguagaacaggacuuaacaacagugggaauauggccaugauuuuaaagggaaaggaccaaucauaaacugggcuacauuaaaguuaggaacuucucuucaucaaagacgucauuaauagagugaaaaggcaagucacagaaggaggcuguuggcagcagggcucacguguggacuaucuggauaugaacaccugugaaucagaaaggaggaggcagauggccucaugggaagggacucaaacaucuguacucauacuucacagaugcagacacgcaauggcaucccuuugucuccugggaaauucagaugaaaaugaaauguagcuuaauagauaccacugcaaagccaucagaauggcuaaugugaaaagguuccacaguaucaaguguuggcaaggauguaggacauugggaauuugcauacacuucugacaggaguagagucacuuugaaaauucuuuagcaaagucuuucggagguaugcaaaccuagcaggcccacucccagguauacacuuaacagaaaugcaucucauguacuguaaaagggagcuucaagaaucuuuaaagcaaaaacuggaaacagcacaaauguuuguuagcagaauggauuucauacacagcaguguuaugcgacaguggaggaaggaacuacuguuacgcguuauaacaugaauuaauuuucaaguguaacacugaaugaaagcagccagacagaaaaaaugccacuuaggaggggaggagguaaggggcggugaccgagaggccugcuaagacggugauggucuggcuuugaccugggugguauugacggauguguucaguuugugauaaugcacacgauuuugggguacaccuuuaucuaaguaugcuauacuucaauaagcauuuauuaaaaagaaguuucaguggugugauccuaauguguuaacaugagugugccugaguguaauuuauaauauggaauagaugacaguggaagcuuaaggaggauggaaggaaugccagugcucacacagcugaaaagauggggcuagagucuggcuucaugcucgaggccuggcggcucucugagucccgcucucuuucaggucagcuuuucucaguggaccuguagcuugugauucuccccucccaucagaggguggccgccgcaacuccacacugugcgcguucacuuucauucacagcagcagccaagaaaagcccuggcuuggcuccuauuccugccuugggccaccucuccaccuccaaacugucagucaugguggcuggaagauggcuuagccguguagcuuagcccaguuaagaccuguccugaaagaagaggcuucccauccggaccacaaggguugggcagagggugacguggcucccagagcagcuucagggcucuguucgagcaaggaugaguagauguuugguggcuaacacagugaugucuacuacagauggggaaacacuuucaaaggcuaaaagugccauccgggauguauuuguucauucagucacucguucauaugugauucacccagugaaagcuuguugugcccgccaucugguugguaccaugagggccugguccugagugaacuuccugcuagaugcugcuggagugccaggugaccagccccaccucgugggagaagugacuacugaccaggagcccagucagacuucaugggagaagugaccacuggagacacuugagggaugagaaagacauggccaggcacagcaguaagacugcuaggaaaaaaacaaggagaaaagccuuuucuguuuuuuugagacagagccuugcucuguugcccaggcuggagugcaguggcaugaucuuggcucacugcaccuucccucccggguucaagugauucuccugccucagccuccugaguaguugggauuacaggcaugugccgccacaucuggcuaauuuuuguauuuuuaguagagaugggguuucaccauguuggccaggcuggucuugaacuccugacgucgugaucugccugccucggccucccaaagugcugggauuacaggugugagcuaccgcgucuguccaaaaaucuuuuuaaaauaagauacaggaacacuaauuauaaaagaaaaacuaucaacuggacuucaugaaacuuuaagaccuuaucuguuugagacauaaaagcaagccauagacuggggagaggaaugacaguaaauacaaaggaaaaagagauuuguaucuagaguguguacagagcucgucaaacucagugagaagacgacacacaaccugaguaaaagcugggccaaagauuugaacagauacuucaccaaagaagagaugcgauggccccacgaagagauguuugguaucauuaaucauuauggaaacgaaauuaaaaccacacccaacugcauggcugauaguuagauucacaguacuaaguguuggaaaggcuguguagcaucuggaauucucauacauugcuugucggaauguaaaguggaguaauuucuuuagaaaaagaggugacaucuuagaaaacuaagcauaucccaauguuauggcccaguaacucgacuccuagguauuuaaccaugaaaacccaaagcguaugcccacgaaaauccugugcaggaauauaacaaaccccaaaccggaaacaaccgaaaugcucaucgacaggcgaaucuuuaacaaacugguggauccguucaacggacacagcuagaaaaaggaaaucacagcugauucacguaacuuggauccgucugggaaggugcugugcugcugagugaaggaaaagcuugcacgauguguagguccugagugacuccauuucuggggaguccuagggcagccucagccaugcacagugaggaggugagcaccuccccggccagggcugggauggacugcagaggauacugggaaguauacaggggcggggggauagaagugugucuguaucuuccuuggagcaggaguuacauagcuggaugcccuugucaaaagccaccaaacugauugcuuaaaaugggugcaucuuauuuuauaaauuagaauuggccauuuauaucuggggguuuugcaucugcagauucaaccaacugugcuucgaaaauauuugggaaaaaaaggccggcacgguggcccacgccuguaaucccagcacuuugggaggcugaggcggguggaucacgaggucaagagauugagaccauccuggccaacauagugaaacccguacuaaaaauacaaaauuuagcugggcgugguggcgggugccuguaaucccagcuacucgggaggcugaggcaggagaucacuugaacccgugagguggaguuugcagugacccgagaucaugccacugcacuccagccugggcgacagagugagacucugucucaaaauaaaugaauaaauaaauaaaugguaacagugcaacaaaagauaacauaaauaaaaaacaacacaguauaacaauuacuuacauagcauuuaccuuguaucaggugucauaagucaucuagagauuauuuaaaguauucaagcagaugugcauaaguuacaugcaaacacuauggcauuuuauauaagggucuugaguagcuaagaauuuugguaucccccauagauacuuagggacaacuauauauugucaauaaugucaaguuaaaaaguagaaacaaggcaacagaaaccaugaaauccugggcagucuggcccaggaaucaggcucuucgugaccuccuugugcugccuggcccuuucugacuucaaguccccuuuauguacugagacugcagcugccaugggcccaugagucuuugaagauagcacauuugcauaagugagaguacguacacacguauguguguauaugcaugcguguauaugugugugugugcguggggugugugugcgugguugcuguuagaagacaguucagacuuuggaauccugucugguauaugaggccucuagagaagcgcuuguuucaucucgcagcccuguuguagaagagccuugggcccaccugcugcagggccugugggacuguuguccaggugaguggggagggccugcaccgggaggcugcggacgcaagcccaggccccuuccugagugcugucgggaguggugcuugcauuguguucagcuggcugaccuccucuguguguguuucuuuuuucccacaauuugugcuccucucugugucagauuucagaaugccaagcuuagguaugaugcaagucuuuuuauuucacgcuuaauaauagggacuccaugaauuagcuauaaccauguauauuuuuuguuuauuucucacccaggguuaccuucccgccaauguagaccggagaccagccacucuccagagaaaacaaaaagaauauuuugcauuuauugagcacuauuacgauucuaggaacgacgaaguucaccaggacacauacaggcaggugggaauccuuucuuuuuuucguauguugccugauguacuuugcuuugcugugauuuauaggaggaaauguuuuaucaaaaccauguggaguuggucagaguuaaagaugcaggucccugauuagcucacagauuuuuauuuucuaauaaauaaauuuuaaaacaaauaauggcaaauuuccucugcuaguacuaucuugcuugucuucaguucccucuacaaaaguaaaaagaguauuuuaaauugagguuacaaaauaaaugccuuggauuccugagaccggccuuggggugauggugggaguuuguaucacagugagcugcugucugguaauaaaaggccauuccuaaaggcccaggcccaaccacuuagcugauggcaucaggacagagagguugccugggguucucuggcgcugggcucuucggucuagguagggaugugauaccgacccaggaaagguguguucaucaguuugguuuugcaggggacacacuucagaucauagcagaagguguagccaaguuaccauuuugugauuuaguuuaauauaaagugugucuaauuaugguuucuuaaauagucaguugacagaugauguacauaaugggaaaauacuuaaaauugauuuaugauucacaguacauccagaauuugcuguuagaauagcucuuugaggacuuuauaauucucacugucuuuguaauaugugaaaggucaaaauggugguucuuaauugguauuauugucuuagcuaucugaaaccagcuucuggguuuccugaggcacggcaggaauguuucccucugcaaacccugcuucuaggugauggagcuuugccacauuuucucuuucaguugugggauagccacaucucuuuguuaguugguuuuaucuguaaaaaaaaaaaaaaguccaaauauaugccuuaccucuguuacauaacaaagauucuuuaaguuaaaugccuuccuggacagcagcuucaaagacggaugggacacagggcugcaggaggaaaggugacuugcuuaggagugaggcuggggcaaagcagccaucuccauuuccuuccaggccggagcugccccuggcccguguugccuucugucucucaucagggccccuggaccgcacuggaccgccacccaguuacucugggaaacugauuugauacacagauuacuuuggauuugcuuaaggaaauauuagcuuaccuggccucuuuugccacuccacugguuuuaggaaauugauaaauuuggcguuguuuugaaccuauuuuuuaaugcauuuuaauuucagaaaagauuuccaaaggaugacacuagcaucuaucugcgaguuuuaccaaguggaauucuguuaugaguguuggaagagaaaguuaauuacgaacagguugcauacaucuuuauuuaguuacugugauagguaauaaaaagguuccagauuauugugaauucccagacuauuucuacauuaauauagaugagacacgccuguggcaacgcgguaguuuuuccugucugccugaugcuuugaggccucuuagaacugcgccuucugcguucucgccaucgccauuucaggcagagcugggcccgguggggguuuggagaccuugguuucuccuuuacauccacuugggcguuugaccuguggacugagcccgaccagccgucugacccgcagugggcaaugccaccccugcacacugguggaggcagcaggagugggguggccucggcagguuucccgcuugcuuuccauccuuucuucauuugauuuuuaugugcucacucuucugcugaagaugcugugucaaagccacauggagagccacauggagucagaguuaaacguucaucuggucugucuuuuccucccucagucagcucucuuguggccuuuuucugauuugcccaguucuguguaugaugggaggcaggcgggauggauggaggggugcacagagccccaccugcccagccuuguggaggaccgccucucuaauguuggagccucuccugacaauggggaugauggcagggguugggucugguggaugcugccucgucugcucaauaaaugugugacaggagcuccuauguaagcgggcuuugcuggcccuggucaugcagagguggcucagaccugguuccugcccugcaggagcuuaugcugcucaugcuggggacagauguguguccacacgaguguaacuguaugggagagcaauuaggccgccaggacacccugaugagagaccugggcccuugucccugcuggcaccugggcuccugcauggggccagcuucaguccuuuggcccugccugucuggauagaguagugcugcuucugccuccuccucuuccuccuccuccucggcagcacugcugcuggcgggccuccuuuggcacgcaucacagaugugugugugugccucagcuuacuccauuuggcuguugacucacaaucuugauguucaccaguaacguuuugagauacuuggagcaggcauuuuguagacaaggaaacugaggccuggccacagugugauaaguggcagagugaugaugucccagccuccuggguguuagaguccucuguggagaugugcaaggauggggcgaaaugaaaugcaauugcagcaucucccuuggcauuaaaaugugccugucuucccucaguccauuggugccguuguccuggauaaacgggagcgugggcuagugugagauguucacgugggaugucgggagccugccugugaugccaggccaagcccacaacacucuuguuugguugcuucuugaaccacaaguguccuccucugcaguguuggggacuuuauuaugacucugaugucagacgguggccaagcaggaaccagcugacacuaacagaggcuuucaaaggcuuccuuugagaaauguucuagauucccccaggacuucauaaaguggagaaaaauguggccucuguccaggaagaagcugucacagcugaaaacuuguaaacuauugauguacuugaauugcugucugugucagaggcugaaaaucgauguuuacuaauugcuauggcugauguuacuaagcagccgaggccugcucuguuucuaaucaugcagcaacggcugcuggauagggacagugucaagcaagccugucgccuaggccugggcgagcuguucagagagaacaggcuuuggauaccuccuucaggggagaaggugguaacauggagaacgagaauccucaaggagagagcgggguagaggccggggaaggacuuaccucaguauugcuguuuuaaucauaucgcucguaaugauguuuguugugacguaacauaaauguccguuucuccugcuucuccagauccacauagacaucccucgcaugagcccugaagcguugauccugcagcccaaggugacggagguaagaagcucuugccguggggaguuccccucguugggaguggcugaugcccacugugcuaaccagacagugggcgcagccggaggugcuucacccagaagcaagguugcuguggugagcugccggugcaucuagcccuuguggacacaguugcugacaggacuucuauuuguucuuuaaauauuuuuacuguauaauauugacacacagcgaagaauguauguaauacauauguguggauguaugcacucauguuccaccaccagauugaggaaacagaaccccccagugcugcccagcuacaaacauggccuugaccucaggccugacccagagcaccaaggccgcuuguguaucccccaccccugugcaacccccuuccuggaugacgcuuucuugccuuuuauguuuacgauucuuugugacuuucauucaugggacaguagggacacaauguauucauuuaauuugggucuuuuggagcugcauaacucuuuguguagucuggucucugccucuuguuuuuuuuuccuuuauuuauuuagagacaagagucuugcucugucgcccaggcuggaguacagugguaugaucucggcucacugccaccuccaccuccuggguucgggugauucuuuugccucagccucccugggcugggauuacaggcacccaccaccacgcccggcuaauuuuuguauuuucuguagagauagggauuugccuuguuggccaggcuggucuugaacuccugaccucaagugaucugcccgccuuggccucccaaaaugcugggauuacaggugugagccacggcgcccggcgucucucauuguuuucuaagauucagcuaaucuguuguaucuaguuacauaauaguuuguuauuuaaauauuccucacucuccuucgucuucuuccuguuggacauuuggguuguuucugauguuuugcuguuaggaaggguguuaucuggagccuucacguacauuuaugcaggugcucacaggcaagauuucucuaaggcuuuuacaaaggaguacaauuauugcaucauuggguguggugugugccuguuguaccuucaagauaauguccacaagcuucccagacggccgcuaccaaauaaacuguccucugcagcgugugaguguucccuccgcacgccgcacauccuugccaguucuucaugcugugggacuuccuguuuuuguugcucugguggauauuccuguugcaguccucacguuuguuucucugguuacucacggaguuaagcaucucuuuguauauuuacggaugucuucugucuuucccccuucugcgaaauguuccuccugccuuuugcccauuuuucuuuugguuugucgauucgcuccuuuauuaguuguugaucuuuacaugguaagaauucugauucuuugucaguuuguauguuguaaagaucuucugcccucugcagcuuuucucuuccuuuuuucuugguggaucuugaugaucagaaguuguuagcucuagugugguugaacuuaacagucuuuuaaggugagcacugaugcauguuaucuaaagaacuuuuuucuacacaugaagguguucacccagauuuucauccagaaguuuugcuuuucacgccucuguguucaguucaucugcaguugauggccaugugugaugggaggcaggagucuguuuaauuuccuccugggacaguggcaguccccauacuguuucuggguccagcucaucucccauauuuguuaugucacuccuguuuucugucacugccacauucauauagaucuguguuguguuguguuguuuuuuugucgcaguauuuacguaguguucccuucauaucgcaccccgcaaguaauuuagcuucaugacguccuccuaccuggugggggugcacaccgcccacugguuuccucuucaccguggacuggccagucccaccccuugcucuuccacguacgucucagagucaguuugccaaggucuuucacuuguuuuuuguuuuuugggucuguuugguuuaugacuggaauugcauggaaucuuucuauuccauggaaaguuaggggucagaaaagacaguuuuuaguuugggagaauggauagcuuuaugaaauuaaauauucauuuuugugaaugugcuaguuccucuuuuaaaagucauuuuuaaugcuuuucagugaagguuuugaauuuccccuaugaagcgucucguacauguguuaccgguggaggguguccagguucuuggugcuuugaacaaagaauuggacaaaaugcacaaacaaagcuaggaaagaaugaagcagcaaaagcagacauuuauugaaaaugaaagcacacuccacaggucgggaguggaccugagcaagcagcucaagggccugguaacuggauuuucugggguuuaaauacccucuagagguuucccaucgguuacuuaguguacacccuauguaaaugaaguaguggcccgcuaucagucugauugguugcagaaagcgaccaaugagaggcugaagugaagcacccuaugcaaaugucugauugguugcagaaagugaccaaucagaggcugaagucacaaaauuauauuccuaugcagaugaagacuuggccugggaccaggcugcuagguugcuggaggggaccaaucagagguacuuucaguuuuucaucugccacgcagaagagggguggauugugaaggcaguagccucugguccuuuuguuaccugggcauggaaaguuguuuuuuuuuguuuuguuucguuuuguuuuuuuuuguguuuuuuuuuuuuuuuuuaguucuaggaagcuagugugaauuggccuuagguuaccugccuccagacccuauucuccugccugacguguuuuauuagauuuauucuuaguuaucacauguuuuucuuguuauaguaaauguuaucucuuuaaagcugaaauuuuuauuauuugagauauuuuguuuugcauguugauugcuucaguaaaggcacguuuaaacuuugacauuucuugucugugcaguaaaucuguuaaaaaaaaacuuuaggauuguuaaagcaaaaguauuuacagauuguagaauacaaaaagagaaaauuaguauccaacagaaguagucauuuugagacacuucucuuugauuguccuuuuuaguaguugugccuaucauaccuggaaaaugagauaauuuguuauaaccuccuuuuuacuuacgauuuuaaaaaugggaaauagagccugccacaggaccuuugguuuauucuuauuuauuuuuuccuaccacuugcugcauucuuuguacagcugaccucucaggccucuuggucucagaguguggacccugagucacggcuagugguagcaauuggcaauugguccucuugucucugaccaccaugggccuugagcuguugguuuggaaagccuccccugucaauugagaaaaaugaugagacaacgcucaaucauuuuuaggagguuuauuugccaaaguuaaggacacacgccugggagacaggucuaugucuuucucccgggaugauuuucagggcuccaaauuuaaaggggacagggcuggauauugagaagugcacaguuuucauauaugagggagacagagaaaaacauucaugccuuugucuggcucagugaaucugcauuuuuuuuuuaaccuaaaacgacauagacaaauggagcagagggaaaaugcagggagucugcauguuacauaagauaaccuagacacaauggggcagggaacaaucagauaugcauuugugucuggugggcuggggugcaccugugaacauaaguuguccauuuacacugccauggugaaauuuuuacagaaacaccuuaaaagaucuugcagcucacuaggaauuuccuugugggcaaaauaugggggaggcauguagcuucaucguguagccaucuuauuuuggaaccaaaaggggaaggcaaguuugcauggcccaggucccagcuugacuuuucccuuuggcucaaugaguuugggauuuugaaauucaauuuccuuucacucccucugcagugggucuugcucagguccuaugugcucccccugggggugcugauccucuccaggucccaguucagcaaggcuuggcagaguggaucaacuuggaggguagaugagcuucugggagagccaggcuccugcaggcuggcagagugugaagaguggguaaccugagcacagccuuguguguguggggaaacugaaugaugagcaaggggcuuuaggaaaguauugaaauguuugucuuggccgggcgugguggcucacaccuguaaucccagcacuucaggaggccaaagcaagcagaucagcugaggucaggaguucaagaccagccuggccaacauggugaaaccuugucucuaugaaaaauaaaaauauuagccaggcgugguggggcguaccuguagucccagcuacuugggaggcugagacaggagaauugcuugaacucgggagguggaggcugcagugagccgagguggcgccacugcacuccagccugggugacagagcaauacuucgucucaaaaaaaaaaaaaaauuugucuuguguuggccaguagaaaaaauugaguuaugguuucuggcauuguagaggugcagagguuagauuucaauacaucugcaagugauggcaaaucccgaaugugccuucacaggccagaacucgauuacuaucuccaguacgaggucauugucagcacauuguuuguuccucuauaugcuuggcuuugaccucaugguccaagguggcuggccuagcacucuuuaucacauuugcauuccacuagcagggauaauaagacguggguagagaaugccauacccccacuuuaaagaugugucccagcagcugcucauagcacuucugcuuguuuccuacuggcuguaacuuagccugucauccaaagugacaugguuguauacuuagcuguauggaucagggaaaauguaacuuugauuuuuuuaguugugugcuccccuaaaguuugggcugcuaauaggaagaaggauuucugccguaagcaucccuccaacccccugcaucuaucgaaacauuugcuuauccauuccacaggugauggcuggguccacugugaucaguuucuacuuuccuucuuccuccuuuucuccuucccuuucucuuucucucccucuggucagcuuuaucgaggucuaauaaaauucacguauuuuagguuuauaauuggauguuuugacagcugugguuuuuuuuuuuuuuuuugagauggagccucgcucuguugccuaggcugcuggagugcaguggugcgaucucggcucacugcaaccuccgccuccuggguucaagcgauucucuugccucagacucccgaguagcugggauuacaggcacccaccaccauguccagcuaauuuuuauauuuuuaauagagaugggguuucaccaucuuggucagacuggucuugaacuccugaccuggagauccacccuccuuggccucccaaggugcugggauuacaggcgugaguaacugugcccggcuugacagcuguguuuauagguguguaccagcucccuaauaugugauacagaacauuuccgucacucugcgagguuccccaugucccuuugugucagucuccucuccccacccuugcacuugacaacugcugaucuucuuucugucucuagaguucugcccuuuuguagaauuucauauaaauggaguccuagaaacuguagacuuuagucugugucuucuuuuacuuaguguagugguuuugagguuugugcaugcuguugcaaggaucaggaguucauugccuuuuccugcugaguaguguucccguauggccguaccacagugugucugucugugcacccguugacggacacuggaguucuuucuaauuuuugcccauuacaaaauaaauuuucucuaaaccuucauguacuaaucuuauuggggaaagcaaacauccuguucucacugcugauuuuaaagggaagucuuuuaacguugcaccauugacuugugauuuuaaucuuuacuauguuaaggaaggugccuugcucuuaguuuuaaaaucauaaaugguuguggagguuuaucaaauccuuuuuccucccaucugagauauguuuuugcuucuuugaucuguuaauguagugaauuuuauuagauuuucuaguauugagccaacuguauauuccugaaauaaauccagauuggucaugauggauuuuuaaaaguguauuucagaaguuuguuggcaucuaacgugccaggccacacugcaggauuaaguuugcuaacaugugaugugccacgcugccagacguggaagccagguuucucuuuaauuuggaaagugcuuucugaccauuguacugauucuucaguuaugcccggauguggaauccucucagcugcguuguuuucucugguaauagugaugugauccuuggugugaaaguauuguuuauuuucaguacuuaguucuuuggacauaaggaaaccucuguguuuugcuaaccuguuaagacaccugacgugggcacaaaacgugggcuguaaauuaacguauuugaaugaggugaauguugaguaauucacacaccaaauguggcauuucugcucaucgcgagagaguucuacccauuaauuagguuguaaacauauagucaguaguuuugguauacucaguguggauuuuaugugauauaugguugccuuuuaacccaauucuagauuucuacaguucgauuuugguuucauucaucaaguguuauaacucacaugggggggggauguuccuugaaucauguugcagaaacuugaguuguaaauaauuucuucuuucugacgcuacgaugcuucuggauuuugagggcuguacaucccacaggucuucucaguagaauucucuauuuugcuccucucccagaaauuaucuccauggcgcuuuguauaccgugaugucacauugcugaugcauauagaauuaugauguuuuaaaauuucucaaaucagauuguuuauaaacgugaguacagcaacauuuucaauuucaauauaguuccuuuuuaguuaugcaaaaucucugagcucccucgugugcacugaacugcugguguucugggccugccuuggaggcaugcgggguguuuguuagguggacacggugaagaccgggguccuuaguaggggaccucaagccccuccugggagccuucugugggagagugcuguugagguuuuuaggaagaaccuuuuccuuccgaauuagcaugcauguucuggcguucagauuucugaaguuuggcaagcaagcugggaauaccucugguuuuuaaauuucuucagcccuggugguacccaguaguagcaaccauuuuuauuauuguugaguauuaacugauuugcagaaaagauacuuugggaagaguuuaaaguuuguacuacuuuuaaugaauucccacucucuaacaaagacgugaacaucaagaauguuacuagaacuuuaguagcuaaugauauccagugaguacuucuuguuugaaccauuucagauuauucuguguuguccuuaaacacagccgcauccuuagggcguccuuccuuuauugcccuuugcuagauaauaucaccacuuaagcgacagcucacuugcuggaaugcgaguugcuguccugggacagagccccgcuguguccgcuaaaccagcccuuccacugagcugacucuucgccuccacucagagucccguucaagugggcacguuguuuucaccuuuccugcgauaacugcaagcaacacaccugcauuuuugacacacaaaguuguaaugguugugauucccgaagaacaccagcagacagacacccggugggcacguggggacacgaagacucagaugucucuguccucagcagcgcacaguugaagugagggaugaagacagaugugcgugaaacccagagagaucauauacaguugucaaugaaaccacaguuuguauccugccgacugcauuccaggguggcugaaagaauuggagaagacagcccgaggaggggcagcguauggggcaguccacucuggagggucaugcccaauugcuggggccgccucacgucucugcucugugauuucuucuauuuccuggcccgguugggccguggaucucucccuggugcaccuggagucucuguggaucucuuuccucaggggacucugcaacccagccucacgcccugcagggggucacagaccucagccuggugggcguucgggaccgagggcugagggccgaggguugaggugaagugcaguggcacagccaucccaggcugcaggcgaaggggcuccccuucgagaacccacaggaugguagcagagcgaaguucagccugcgggggcgucuguacucggggaagcuguggaccaggcauggagccagccuguuugcccuccccgcccugauggcugcuccggcuggcuaggccucuucucugagauucuuggcuuaguaccucuggcuuuugccgcuugaauuuggggaccugucggcucuuccuguuucgcuucaguggacuuccacccuagcucucgccucugguugcugcucugagcgugagucuagagggaccagcaagguccugagggaguugcgaggaaucgggcccuguccaggggcauggggagucugagaggcccccucaauguuuugcagcagccaggucuucccccugccugccccagcaggguaagaagcagcacacaggaguguauuuccucucggcugggccgcugcugugagacagccccaguggacggggguggaaaggaaucuccuugaagagauucuuaccugacuucuuuucuggcugagacugucuaaggcagcaguggaggcacuggguagugguugggacugaggggugguaggaacucccagcaaaccgggaaaagcaucaguugcucagagcuugcugggcugcugccgagugccccgcugcccguggacgcaccuucaagggagguggcaugcuuaauuuuuacccagaccccuuuaagugucacccuguagacuuugaaaaugcuuauuuggaaaaaaaugauaugaaaucugucauauauauguauauauauauguguauguauacauauauacauaucuaaauaaaaucuaucuaucuaucuaucuaucuaucuaucuaucuaucuaucuaucuaccuaccuaccuaccuaccuaccuaccuaccagucugagagcaaaagcuuagaacuggcucaaugcgguuuuuugaaaaaagaauaaaaaaaaagguacgauuauuugaugcagggcuucagagucccacagcauguguccuuugguguuggggaugggaccucuuuuucuuauaacaggcuuucagugaugucuauguggcgagcucauuguggugaaaaucacgcggcaagauaauuucaggguaacccucggcaauaccauccgagugugcucucagccgcgagugcuuuccuggcuugccugcuggugaccaggaugaaaaacgaauuuuuuuuuuuugagacggagucuugcuuuguuguccaggcuggagugcaguggugugaucuuggcucucagcaaccucugccucccggguucaagccauucuccugccucaggcucccgaguagcugggauuacaggcgcccgccaccacgcccggcuaauuuuguauuuuuaguagagaugggguuucuccauguuggucaggcuggucuugaacuccugaccucaggugaucugccugccucggccucccaaagugcugggauuacaggcgugagccacugcacccggccgagaaaauuuuuuuuuuuuuuuucugagacagagucuuagucugucacccaggcuggagugcgguggcgcaaucucagcucacugccagcuccaccucccggguucgcgccauucuucugccucagccuccuguguagcugggacuacaggcgccugccaccaugcccggcuaauuuuuuguauuuuuaguagagacgggguuucaccguguuagccgggauggucucgaucuccugaccucgugauccaccugccucggccucccgaagugcugggauuacaggcgugagccaccgcgcccggcugagaaaauguuuuaaagccucuguggcuuucagagggggacgguggggacucuuaggcaccacaguacaaaucaggugauuucggaaggaguuuuuaaaaugauacuaaauugcuuugggauuagaacuaguuuuugccauuucaaaacaccagcauaacucauaugaagugauucaagacaaaagauaaaaaggaaugaggcagugaaaacaacagcaagcagcaaggaaagggaagccugggccuggaggaggccucuguccuuucugauggagacagucauccugugaguuggcuucauagcuugccagcaugaagaggagcucagggucugugccugucgccucugcucagagccuuucaugagcaaguugguaaagcagcagauugauuuggguccgugcaggguguccugaguagccauccccugggcuagcauccuuagcuuccagcccugcagccggccccggggaggagggcacgggguggccgcuggaagagaagccugcggucgguuggcgggugggggacaggcggggccucuggggacugagcugagugggucucucaaggcggacacgcgagggccagcggucccagaaguuggggccaagggagccucuggggcauggccagggauguccugaaccuaggggccaagcuucccccugccuugcugguuucccacaggcuguuccucaaccugugggcgggcaggaaucagugguccuucuccauccuucugggggcaugaccuucccgugucccagacguucucuguuuauggaaccuuguuuccauuauuguagguguuggggauuuuccuccugagucuagacaaggcugaucugugguagcauuuugaggauagguuucugucugcuguguuggugggauggcugccccuuuugcaguuuccugguggguggugggagguccuggcagguggggcucacauuagccucucagccacgugcggggcgccugggaccugcgaccugcguuuggcuuaguccaggguggagccaucuugguucuuggcuugcccucagcacagcagugaugggagaaagggcagcugcaggaaauucaagcaguuauuuaccuuuucuucccuacugcuacccaaaaaaauguaaaucguauauguuuucuuacuuucuaaauuaauagcuaucguuggagggagauaagcagccagaaggugaguuuagauccauaauuacauggagagcaaggagagccugcccagaauaaauguuggggaggggcugcacagcucugugugguuuguggcagugauuuaauuggcgaggcuggugugcauuuaggauagguuagcugccugggcgccgcugucuacagugggaauggugggccugaacacagcuugcaggcagcacaucccucagcaggaaagacgcucaggccuccucuuaguagcagagacucugcgcugauggcaggcgcgggagcacucaccauggguuucaucuggcagggccucuccaucccagauccuuggaauaggaaggcuuggaaauaggaaggcuuuucagggagaaaagaaacagcucuccaccuacgagcaagucacuaaggaaaggcugcucgcuccguuucucagccacauguacuucccagauagacccugagcuguuucacuggcccguggcugugugugugucccagauggacccugaacuguguguguguguguguguguaugugugugugugcucuaggugcauguguguguguucuuuuuuguguaugugcacuugugccucuguguguguacaugggcucuuuccugcguguguauaugugcgcaugugcuuuucaugugugcgcgugugcucucugugcacaugagcuuuucucuguguguguagauuggugcacuuacacucuucucuguguacacgggcuuuucucugugugcacgcuucguauguguguacucuucugugugcaugugcucuucuccacaugugugcucuucugugugugugugcucuucacgugugugcgcucuucuccgugcgugugcucuucuuugugugugugugcguguguucuucuccgugugugcacacaugcucuuuucucugcauagaaggcuccucuccuccucccuccucagcuuucacuacccucucuucccgucaccucucugcagucucccuucaccaagugcuucuaucuucccugucccuuucaauggaguuacuucugccccuuccucucugugcauuuuuccacucagacaggugggggcccugagguccugacugguugacguuugaagugccaggcugcagcauugccugguagaggaaacagaugggagaggcugaucacaaacccaggcaggcacccauggcauucauuaucuguccacacagacccccagaaugagcccagguccugccaauggcacaaaaccuggagaagggaggaaggggagggcucacaugcagggcaucagggagcagcugcgccauccucgccuccaccguccucgccuccaccauccucgccuccaccaucugcgccuccaccauccacaccuccauuuagccacaaagagcuucccaguccuccucugugccggccgugcaggacugagggcacugcuguaaaguggguggaggaaacccuucccagggacccaccuugaacugggugagagccacaggccagagccggggcagugcgguggaggagcugcugcuuuggguagggagguggcagaggagcuugucucugaggagaugcaugugaacuaagacuuggguggaacaucgugggagccgugggaaguuugggagacggggauuccagguggaaagagcagcagugcaaaggcccugagacagccgcagaguggcugggccuggugagagagcacccauugccggcgaggaggccagagagcagggagcggccaggcacacaccugaagccaugcucaggagugcauugucucgucagggucuuggaaagccacgggggccggauggugugaccugacauuuuuagcagcaaccucugcugcucagcgggauguggagcauggggguguuagcaggaagaccagccaggagacugucacugcggaccaggcacaaggugaugguggucaggcuuguggcaguggagucgggggaaggggcuggaugccacacgcaucuggggugugcuauaguggugauggcgugugggguccgcaggucucccugggauucucugaggggcggaccucaggagcagugcccuaaaagccugugccuuuagcggcagagccaggcuuugugugcagugucacacgccuccacgggacacccacuuuucaccguugcagccugcuugccacguuaaaggucauuuuuguucaaugcuugagcuggcuguccuuuauuuacaugucaguuggaugacagcggacaucaagccgaguuaaaucugaagaauuuggacugacugauagcuuucuucagucaguaagaaauuggaauucuccauuuuuccucaaaguaauacaagcgugcucuuuuaaaguacauuacuacccaggcuggugcggagcgucccggagucugggugggcagaggcccucuguccugacuuggaugaggggaagaagguaauugcugggucuuuggguugccugugaaagggcacucacuuggcaggugcuucagcacuguuuguuugcuaacugaaggcuuagccaccuccugccgugccuguuuggugguccugauuugccccguagugcauagugcauuccaugucucucccgaggcugugcucaggcagaacucggucuaucucagguacaguucagagaugcgggccucauggaggcuccugcuguggaaccgagucgaggccccggccugcgcagaucucuccccugcagcagccuguuucaugguccacagagcccgggagcuuguugugccgagaggacuugggcuccccucggcauccucccugggugaaguuggguauguccuauuugccaaauugguuuuauccagcacuuaggcugcugaggaaaguacugcauucaugcuuaugaguagauauagccuugagaaaguguguguuugugugugugugugcgugcaugugugagacaggcccucugaaagugaggggccuuguuaaauggugggggugcuccacugccuaaauucuuccuauacacauacacacacacacacacacucacacacucacucacucacacccagcacugcagugcgacugcccccugcucugggcggugccugccuugacucccucuguccagggugcgugcuccuggggcgcugcacugcuuguucccugggcuguagaggaugccguguggcgacagagcuggguccaguggcugcuggcugccgcgguccucuggacacacguggagggaugucaguggccucaggcaccccgggccuucuugguuaggaggugcugggcagaguuuccccauuucuuccuaacucuguguggccagcuuccguggagucaccgccucugugucauuccuucuuccuucuguugcugcugcuccuguucuuguguggccccuguccccucugcccccugcuccugacccuuuugggggcucagaggccccucagaggcuugcuggugaguggaccuaagggcuguugagcuggacccgugccccgugccugccuucagggacccagccugccugucuucuagucacacgccguccccugggcuugcuucacgcccuaggggcucggcagggcuggggcugcgcguuggugacucguggugcagcacuguuggcugagggguugccgcccugcuucuucaucucccucuggccccacacggcuccucuggccgcuacuugcagcucggcuaaauagcauucgcaucauuugcuaagcuuugguacaugagaaauucuuaaauggcacuguguuguugaguggguuuggucuuugauguuaaauauucaguucucucuagaaaguugucaacugaaaauggaaagcguguaugaauauaugugcgcgaacauauuccucauuccacccgcgucucucaggugccugcuguguuaggugguggcucuguuacucaccugaacagccgugugcacugcaugcuagcgugggguggcggggggccuggacuuuagggcuggucaugccacucuggguagucuccuuggguugagagacuucaccugucggucccaggucccuccuuuguaggucccggguugauggugauuuuggggauggagccuaccaagcccaguaagauuuaggauuguaggcaggguaggaagggaucgacuccccagggugcaaguguaguuggcucugcggggcugaguuuguauggcagcgauguaauucauccaucugucggagcguguguuccugaagucuaccuccugugccuuguuuguauggacaggccuggacagagcaguugggccuggccuuagcuggcaggcagcccgaaggucaggcuggagccaucagccagugacccaguggagaggagugggaacuagagggccacacaguagggagugguuggcucuuccaaaaagagaguggggagggaacagguggcagcagagucuucacggagggaguggugcuugaagugaauccugaaagccaggggagucgagacccagggugcgggaguggcaggcuuuccaggcagagguaggaguacgggcugaucacucagggggaucgagacccagggugcgggcguggcaggcuuuccaggcagcgguaggaguacgggcugaugacuggcaggcucaguuggggaagaaugcuguagcucagugcagccacaaugugggugcuggcuggggagacccuggggcagggaccagacugaggggccagggguacugcacuggggguggugggggcucuguccgugggaggugaggagcaugcagaggucuucagccaggugugcacaugugcacguguauggugugggugauaggauuguguugcaccuugguauaaugaaacccuccuuaugagugaagaugggagcgaguaggugggaauaagaggugguggagagaggguccacugaauauauugagaguauuggagggaggaggccggaaugacuccugcaugccuggccugcgugccugaaugccugcugagauuucguaagugauggaagauguuuaaguuugucuucuugaauggugauaccuuuucagagguuuaaagaaaucuguuuacuuuaugagggaaauuuagagcauccacccacccaccuguccauccacucaucugcucgccugcucacucauccaugccucccucccugaggaagucuccacugauaggucaggugcugcugcacgguggcccgcgggguguggaggagcagagcgcuucugcugggagagccagcucagggacggacugagccaggggcugcugaagugcugcacauugcuugugggacaauaaauaauuuuuuuuaaaaucaaguuucaauugucuuaagggccgugcgugguggcucauuccuguaaucccagcacuuugggaggcugagguggguggaucacuugaggucaggaguucacaagcagccuggccaacguggcgaaacccuguguguaccaaaaaauacaaaaauuagccaggcaugguagcgcaugccuguagucccagcuacuuggaaggcugaggugggaggauugcuugaaccuggaaggcagaggcugcagugagcugagauggcaccacugcacucuagccugggcaacagaguaagacccugucucaaaaaaaaaaaaaaauugauauuuguuuauauuuguaucuuaauauuaggagcaaugagaaaauacaguguacauuuuaaguaauagaaugcuuucauuuuaaaguuucugccauguuuacuuuuugcuuuaccaccuguuccauuuucuuucagauuuuugaaaggaucuuguucauaugggcgauccgccacccagccaguggauacguucaggguauaaaugaucucgucacuccuuucuuuguggucuucauuugugaauacauagguaagauuucuugcaaacauuaaacgugaacuuuaguggacuugcuguguguuacuauguauaauuauaacaauauugaaaauugcuacuaaguguaauguuauuaaugauagguaauauuagagaauaauaguuuucucaucaacaacagcuuuccaaaaugucuuuaaucuacaugcucaacuacugaagacauuaaauugcaguuauaaugaugaauaucuucuuuuuaacaauauuugaagauagauaauauauuuggggaguguaguuuauucuaaaggccaucacaguaauggcuuuaaugguuucagucauucaaucgaucagucauucagucaaucagucugucugucugucuaucuguuuaucuaucuguuuauuuugagacggaguguugcucugcugcccaggcuggaguauaguggcacgauaucggcuaacugcaaccucugccucccggguucaagugauucuccugccucagccuccugaguacuugggacuacgggcaugcgccaccaugcccagcuaauuuuuguauuuuuaguagagacgggcuuucaccauguuggccaggguggucucgaacuccugaccucgugaucugcccgccuucgccucccaaagugcugggauuauagacgugagcuaccacgcccagucaguggcuugaauuuaaauggauaagauuaaggugauagagugucagucacauauuuugcuuacaagcugaaaaucaaaucuucuuuaauugcguuucuguggccuuucaucacuuuucuacuuuugcuauacuaguaacauuugguuucaugagaguauuaauuacuugugaaauaacugguugaacaguguuuuagguugggcuguguuuuuaugcuguuucuuuuuaaguacugcauauuuuuccuuuaucacagucaacuguaauguaacuuaaucuguuuugaauauguuuuuaaguuaaaaccucugauaauaaaagugaggaucugcuuuuuaaugcgucuauggauaaaacauaaauaggaaagaggggacuuuacuguuuagucacagcauuuuaauuuaaaccugguuuugucuuccugcaagccuucuggacuuggugcucgccuguuguuauuacaugguguuuuuagccuuuccagguuguggucggccucagauucccauccuugcugugaucuggagagaugagccuuacccgaggacagaugaacagauuauccucagaagaugaggacauauccaaguagugaauuuuacugcagcccucugacacuuuguuuccauuugugauuucauaggagguugucucauugcuaagcaacuaaugagagcugccucggcucacucccuaaucaucucuuaaguaggggagaggcuacuccugagggugcuugcuuuucugccucuuaccccucauuugacagauaaugaaaaugcucuuaaugauccuagaacaguaggaccucugucaguagacuucagaguuguuaauugaaaggagaaguucaacugagaugugauuagagaauugauauuccauguuaaauagaccauuuaauuaaugugguaaauaaguuuguuuuaacuacuuuaccgccaacuucuguuguaagaccuaagcgauucuuaaugcauuugccugauuaucugcaagacaggaugaaggggcaugaccacgaucuuaauuguccagaagaaagaaagccuggagaaaauggaauuuguguccuauaaguggugucuucagaugagcucagagacacucuccuugccuuccugcguccccauccuuccugcaucgccgucacacacgcaggcacaugcacacacacaugcacacaucagaacacaacuacacauuggguauacggugucacuuuugaacaucuguguaaaacauaccauuuauuucugucagucaacuauuaaguggacauauaaaaauguuugggccaggcgcuguggcucacgccuguaauccgagcacuuaaggagguugaugcagaugaaucacgaggucaggaguuugagaccauccuggcuaacauggugaaaccccgucucuacuaaaaauacaaaaaauuagcugggcgugcuggcaugcaccuguaguuccagcuacucgggaggcugaggcaggagaaucgcuugagacugggaggcggagguugcagugagccgagaucgcgccacugcacuccagccugggugacagaaugagacuccaucucaaaaaaaaaaaaaaaaaagaaguucgguccuggauuucacaugugauuauugcauuuguaguccuuuuuagaucuagcuuccuagguuuggggaauguucauuaguacaguccaaguccgccuuucauuauguuguaaagaagcguuuaacuugcguggugugcuguccagauuccuuauggggcugaaguugagucauucacgcggcccuucauggagcaccugcccuggugcuggguguggugcagagcgcugcgguggggagaugacuucgguucaacgcagccaguguugacagagcaucuccuggcccugugcugugggaguggggcaggagaacaaggaaagccugaucccuguccucuuggaguuugugguuguagcacggaagacagauuuuagaggaguaauuuaaagucuuaauuaaaguaauuaacauucacauuaucaagaggaagccugggcugcuguagggaccuguccccuuauaggggucaggggaggccuccagggugaggugauguuuuagccaugucucgcgggaugaggaggaggcuagauugaggccgggcauucagagagggcagcagaagggccggccuggaauccaaggugcagugacaaguaguggcauugggaggaagggcagggcggcuugggcugcagugcugagaaggagaagcuuggggucgagucccaggggugugcgaaacccccagccacugugcucagguucuuaucuuugaacauucauucuggcagcugcguggaugagauuggaggguuucuggggaagcucauagaccagggacccgcaggguccagcaccggcagaggcacgggugcccuccagagaggcuauucugguuugcugaacucuuaguuugcugggucuucaagccgguaaaccucagaugcucugcuuagugaagaucuucaagauugacuguuccuucagagaacagagccugguaaugggauucugugguuucgacaccugagcaccugccaguccuugggccucagcguucagguuaucaugugaccgcucauacaccuuuggugcagcugccaguggcacuagcccggguguggcuaccuccugagagcugcagcuggccugguucuggggaugagcuuguguuguuacuuggauauuccucuuuucuuugaaguacaggauagcaucccaguuaaucaaagguuuaagaaauccccggggugugggauuucuccaggggcuuucaggcaacagcagacagaucugugaugccugagugggagcugggcucuuucuggggauguguguucgccauguguccagagccuguaaagauccacagauccuggccugccauaugcucccacugguuucacgggagguggggaauccuggaguguggcauugguccugaguaggagcagcucuucgggaguggcucaucguucuggcugucagugggagguuccaacucugcacaugcuggcacucagagcccucucaguguuacguucuuugacuuggaaagaaggauguggugggcuucagauucccauccuugcuguaaucuggagagaugagcuuuacccgaggacagaucaucccccgaggaugaggacauaugcauguagugaauuguauugcaaccccucugacacuuuguuuccaguuaugauuucauaggagguugucucauugcuaagcaacuaaugagagcugcugugguugagguugacacacaggaccuggucugaaggcagaccagucgacuaggugaacugcuucccagcacagaggagaauguucaucuucagcaggaggcuggccaggaugucagagucagagaaacaguuuguagugggggagcaaugcucaagcuguguggaggugugcucagagguggguuaggguucgaugggucuccaugggugccaggacacugccggccugagucaggaauacaugguaugcaucccagcaguccucguggagcucaccacuauuugagaagggcaguuugguccugcuguugauggaugcagagucuguaaaugcauguuuagggcaugcucuugcacacacacaugcugugcacacaggcgugcaggcacgugcacgcggacauacauaaccauacagagacacaaacccacuugcacacuccucacuagugcuagccucaaccucuccaagcaaauggggaacaaaucuguaaucaaccuuuguuugaguggcacccaccaguuucgcucaggcccuggaggugccugucauuggagaaagaggucaagcgaucuugcgugaccucagaggcaggggcagccgugugcaaagcaugugaagacagugaaguccaguaaauacagccaguucgacaucaccgaagcuuggggagaaaacucuacaagugaaaacgaagugagaggguauaaugugaugggagagaucgaucauggagaaguucucuaugccaggaagguuucgcagcucauaaauuucagagguugaagccuuagggaguggggaagaaacuagaggcacauagugauacauuugcugaagcuugaaugugcccauuccagaucagagccaagcgugcgugcuuguucuugcagauugcguccuugacccauggggcgggcagaguguggaggagacuccaguuagcacagccauuggagacgacacucagcuaggaacaggcggaagacacacuuuuuagucuaaucuuuuagaauugagaggaaacagcaaggcacgugcuacuuuggacuuaguucaggccauggaagaaggcaggucuaggaugagaauaacauaggguccagggcaucuuagaguuuguaacagcagaggagugacaccuggucuagagacacugagggguacaggagcaggcccagaccagaggccgguggaggcaggagacucgcugacggaggacugggccugagaggagggccugguccuggaugucaaauaggcugcugugagggcaccaagguggcuuggugugaguagaggggagcgugaacgagaaggaaaaauccagucaccuccuagauuccuggcccugugagggguguggugccguuuaccaggaugagacguggaguagaaagagcggguugaggaggcgggaugggguucugauuuaggaugugcugagugugcucugucggcagugauugaguagaagagucuguugggauccgggccuuggcaggagaucugcaguggagguuagucuggaaauugucggccuggaaauggcugcugacagucgcggcuguggaugugugugucuggggagaguggagugcagcgggucacaggauccaguggcucucugaugugucaggggucuccgagcugugacugucugugacucgaggagcuggcaauggggcugucccacagggagguuuauggcgcucucccaugccggagucugggcguugagaguccagguggcuccugcugcugagggccgccuuugggaucugugaaggaugcaaugcagcucuggggccugaccgcugggguccagauccagacgcugccccugaagagcugcaggcggccuuggugccucagugaucucugcaguggacacgaaauggagaucguaauggcaccagucccuugguuggugugaacacugagcgaggcaaaaacagcuuagaaccagguauggaacgcaguaaguguccaguaugcguugcucuugugaucaucguuacugucacuuucuuuguugcugccuguggcuuuccucugcuuaaaaugguggccgcaucucugcucugucccuguccuagguuuggagagagggagauggugcagggugcagggccgaggccaaagcacgccucagcugagccuauguguuuucggaagcuuuccuggaacccacacagcgauguccuccaucagccacacccuugccacccaccagccacaggggaccuggagaagauguggguggagacaggaggcaaggaagagggucugugugugugugcaugcaggcugccagaccagugugugccccggggagagguaugguggugugguaaggaaauggagaagaagugguuucagagguaagacaaaggccaggccugagguaucacagaaaucaagggaggggacaacuucaggaaggagggaguggucagcagagcucauagggauggagacugaaaauuggucaaagcauuugauaguggggaucuugcuagcgaccugccaaaucuggcugaagaauaguggcaagcaaacugucacaucagcucccugcccucccucagaaaugggggccugaauguuucugugcuuggggaagauugcacucaguggaccacagccucuugcaacuuuauuuuaaauaauuuuuuaugauggaaaguuucaaacacaaagucaacaaaauuguccgaagaacccgcgugcccgucaucugacuccagcagucaccguucuccuuccuucugucccccacccacucccaaccuccaugcaacuuuacuuacuacugcuguuuaaaaacagcuuuauugagauucaguuuagaaaccauaacguuuacccacuuagaguguaaaguugaaagauuuuuagaauauuuagaguaguguaaccaucagcaccuuuguuuuuagaauauuuucaucauccccaaaagaaauccuauacucauuggcagucacuccccauccuucccuuuucucuuguccacuagccccaggcagccucucauuugcuuucugugucuguggauuugcuucuucuggacauuucacgugaguggaauuacauggugcguggcccuuugugucuggcuucuuccacuuggcaucaugcuuccaagguucauccacgcagcgugaaucaguacuuccuucauuccguagccagguaacgucuccggguacggacgcagcacguuguguuucuccacucaucuguuggugaacauuuggauuguuuucauuuuucgacuaauauuguuuccauuuuugacuaauauuuugacuaacaggaauaacguugcuaugaguauucauguacaagucuucguguagauauguguuuccauuucuguugguauauaacugggagaauuacugggucacaugguuacucuguuuaaccuuuugaggaccugccggacugcuuucccacguggcggcaccauuuucccugcccauagcauugugggaggagcguauguuuccucuuccugcaggaguguguccacauccuggucaacacuugucaucaucuuucacucuuuuuuuuuuuuuuguagacuuuacugaaucuuauauuaauuuaaagagauugaguucugccucuuacucucaaacugugauaaaaacucagauaagaagggauguugacuguagaaaucauuuguaaagaggaauaaauuccccggugcugcuguuuuccccauagcccagcaacuucaguguugacagccuuugugcccagugccaaauucccugucauaagagggaaccuuuauggcaacuguuuaacccccuuaaaauggaugcacaugcugauguuuucuucuaggcuuaaagcugaguguuagguauauauguguuuguuuguauguauguauguauguauguauguaugaaugaaggagagagacagaguguugcucuauugccuaggcuaagugcacuaacguuaucauaguucauggcagcugcaaccucccaggcuuaagugaugcuccuaccucagccucccaaguagcugggacuacaggcaugcaccaccacgccugacuaauuuuuuauuuuuuguagaggcagagucuugcuauauugcccugguuggucucaaacuccuggacucaaggaauucuucuuccuuggccucucaaagugcugggauuacaggcacgagccacugugccuagcucaaagcuggguauucucccauucuaauaaucauuuagucauguccuaugacaauuauaccuuaacuuuuuagaagggauauauggaaagguaaaauuuccauauauucccuaaaacucauggaggcugugauucuguuucauuccugaugugugcucuguuuucuuuuuuccuguugugccucucccagguagauucgcugcuccucgaaucuggggacugugucgcaugcgugugucaugcuuugcacagagaagcuucguggauuagagaaacucuguugaauuggaucccuacagaaaguuuuuguguuuauagagcacuuuauuaguauuuguuuaaacacugaaacaauauauaauuuuuauuuauuuuuugaaguuaacauuauguuauuuauucauuuuuuuuuuuugagauggugucucuguugcucaggcuggagugcagucgugcgauaucggcucacugcaaccucugccuccuggguucaagcgauucuccugucuuagccuccugaguagcugggauuacaggugugugccaccaugcccggcuaauuuuuguauuuuuaguagagacaggguuuuaccauguuggccaggcuggucucgaacuccugaccucaagugauccacccaccucggccucccaaagugcugggauuacaggcaugagccacugugcccggcuacuauguuguuauuauuuuuuaacuuuuauuuuagguucaaggguacauguacagguuuuuuauauagguaaauugugagucacagggguuugguguacagauuauuuaguuacccagguaauaagcguaguacccgagagguaguuucucgauucugacccuccucccgcucuccacccucaggcaggcccuggugucuauuguuugcuucuuuggguccauguguacucaauauuuagcucccacuuauaagugagaacaugcaguauuugguuuucugugccuguauugguucuuuuaggauaaugaccuccaucuccguccauguugcuacaaaggaugugaucuuguucuuuuuuauagcugaauaguauuccaugguguauauguaccacauuuucuuuauccaguccaccauugauggacauuuagguuguuuccauauuuuuugcuauuguaaauagugcuaugaugaacauacacguguaugugucuuuaugguacagugauugauauuccuuuggguguauacccaauaaugggauugcuggguugaacaguaguucugcuuuaaguuauuagagaaaucaccgaacugcuuuccauaguggcugaacuauuuacauucucacuagcaguguaaaagcauuuucuuuugucuacaaccuccacagcaucuguuuuuuuuuuugacuuuuuaauaauagucuuucugacugguaugugaugguaugcaaauaugguuugcaaauauuuucuccuguagguuguauguuuacucuguugauaguuucuuuugcugugcagaagcucuuuaguguaaugaagucccauuuguuaauuuuuguuuuuguugcaauugcuuuugacaucuuggucaugaaaucuuugccagggucugugucuggagugguauuuccuuacauuaucuuacaggauguuuacaguuuuagguuuuacauguaagucuuuaaucuaucuugaguugauuuugguauaacaaaggggucuaguuucaaucuucuguguauggcuaaccaguuaucccagcaccauuuauugaauagggaguccuuucuccauugcuuguuuuuguccacuuugucaaagaucagauggcuguaaauguguggcuuuauuucugggcucucucuucuguuccauuggucugugugucuguuuuuguuauugugccauguuaccagugccaugcuguuuuuguuaguguagccuugaaguauaguuucaaguguacucacaaguauauucauaagcaugaauauuguaaugccuccagcuuuguucuuuuuugcuuuggauugcuuuggcuauucagguucuuuuuugauuccuugugaauuuuaaaauaguuuuuuuuccuaauucugcaaaaaaugucauuuauugguaguuuaauaggaauagcacugaguuuguaaauugcuuugggcaguguggccauuuuaacaauagugauucuuccuauccaugagcauagaaugguuuuccauuuguauauucaucucugauuuuuuugagcaguguuuuguaauucucauuguagagaucuuauauguuaccugguuagcuguauuucuagguauuuuauucuuuuuguggcuguuguaaaugggauugcauucuugauuuggcucucagcuuggacauuguuaguguacagaaauacuacugcuuuuuguacauugauuuuuguauucuaaaauuuuacugaagcuaucagaucuaggagcuuuugggcagagacuaugggguuuucuagguauagaaucguauugauugcaaacacuuuuauuuccucucuuccuauugaaugccuuuuauuucuuucuguugccugauugcuuuggcaaggacuuccaguacucuauugaauaggaguuuugagagugggcauccuugucuuguucugguuuucaaggggagugcuuccagcuuuuguccauucagugugcuguugauuguggguuugucauaauuggcucuuauuauuuugaaguauguuccuucagcguuacagaguaauguaaaaacauagcuuuagaaacaguauagagauacugguaaauauagauaaguuaugaaggaagcaauuaaaauacuuggccaucccacuguugagaagacuuauugaagccuaucuccucacugugcagccuccccuuugauuaagauccuuucuucccacacagccacacugggagggcuggagaaggaucucucuacuuucucugcucccaagagaccaguggcuaucugcauggggagaguccugggcucuacuucaguuccuuggggguggcaccaugguaucaccucuguguggcaagcagugugaaucugggcccuuccccaucucuugccccgcccagggcugggccucgaagguagccugggucucuucucuagguugcuagggucgcagugucuaggucugggcugggaggaagaaggacucauccagcuuggagccugagcugugguuccagcccguccuuugagccagggugcggggcacuugcccgcucagcgcucacucagggguuacuguccuguguauggccaccaggcagccgccguaccacugugcauaagcagcuguuuucuguauuuccucuaagucuuguuuucuaugcauuguauuuacauagucgagugcauauuaucuauaacauuuuguuucauguuuuuuucccacauuuaaccuuacaauguaggcuuuuccuuguauuaagaaaucuuuauaaaaaucauuucuaccuucuguacauaaugcucuauugagaucauguagcauaauuucugaaaccauccaguguuggugaaucuuuucuuuuaguuuuucuuuccuuuaggcaugguguaauuuuuaagaaaagccuguacuuuucaaacagcgacugucauauuacuuuuaaguauguuaaauuugaagauuuugaauuaaggagcauuguuccaucaccuugaauuccacaguuuaagcagacaauuguauuuuagcuuaaacauuuuuagcagagcaagaaacaaagaaguauuugccccccuccccaucuuugaugccuccgugcuauuuaaauguagaaacagucuugacugaguccuuuggacugauagcucggaguggcuggaugucuugacugaguacuuuggacggauaacucggagugacuggauguugguugugcugcaggcgagcaauaggaccacauuuuggaaaaggugaagaguguuuuacaauggauucucaccaucaguauguuuaauaucuaauugacuugauuuucuaugucauuuucucuuaaauuacucuugaaagcaaaugugcaaugggauuagaauaaauagugcauuuacuuaagaacauuaagaauauuuauuuugccgggugcgguggcucacgcuuauaaucccagcacuuugggaggccgaggugggcaucaggaguucgagaccagcccgaccaacguggugaaaccccuucucuacuaaaaauacaaacauuagcugggcaugguggcgcaugccuguaaucccagcuacuugggaggcugaggcaggagaauugcuugaacccgggagguggagguugcagugagccaagauugugccauugcacuccagccugagcaacaagagugaaacucuaucucaaaaaaaaaacaaaaacaaaaacauuauauuccuguuuguaagucagauucuuaaaguauagauuguucuuaagcaugugguuacccagagaggacacucuagcauauggcuccuggagcuggaggacugcuaggguugugaugagugugugguggggauggcagguaaaauccccacagccggugggacacaugagaggaugaacgcagagaacaugcucacagcuggauuuuagcagcauagucauucuuuugcuuauuuccauuaucggaguauugauagagcuuugagugacagugagggaaagaagagcuggugcuaguuucucauugauaaguuguagcuuuagaaugauuuguuuuagcuuuccauuguuagcauuuaaauuuuacuucccuccaccuuguuuuuuuuguguugucuaaaccaaggcuacugccaaauacauccuuugccugacuuccuugaauguuccucauagcuuaggugcuuuugugcuccacaguuaaucucggaaacauugaaagguaaaaaccaaagcaucugagcguagcacauuuucuguagcaguucuagacccacgugagacaagcagagaguucccugggguugcucguguguggaauagcgaaguggagguggcuggcuuugcagccccugaacugacugugcaggugccacaucuuugcauugcccacgacucauauauauucauuuuuucuaguuaaaaacauuucggaaauaauuaguguaauggacuuacuguuuaaaagauuggaaaguuuaauaacaguauggcuuugccaucccagaagcugucacuugaauguuuggcuaauuuuuuucuggccuuuuacucuguagauucuuuuccauaguagcuauuauauuaugcaugcacauuucaauauugcuuuuugcuuaguaucuaaccauuuuccagugucauucaacaguuuuaaaaaauacguguuuuaaaaguagcaacauacuacuuucaauaauggcuagaaaaaugagacaaaucagcaagaaacuagaagaauaaacaacacagaaaaccaacuagaucuaguagauauccacagaacacugcacccaacagcagcaggauacauguuccucucaagugcuuguggagcauucucuacaauagaccauaugcuaggccauaaaacaagccguaauacuuuugagaagauggaguuuauacaaaguguguucuuugaccacaguggcauuaaguuagaagccaguaacagaaggaaauuugaagaaaaugacaaauauguagacauuuuagaacacacccuaaauaaccagugggucaaagaagaaaucguaagggaaauuagaaauugcugugagaugaagaaaaugaaaacacaauauaucagcacuuacaggaugcaguuaaagcagugauccaagagaaauuuauaguuguaacggacuauauuaaaaaagaccucaaaucauuaacuuuccacuuuccgaaacuuagaaaaagaaggguaaaauaaagccaaaacaaacagaagggagaaaauaaugaagacuagaacagaaauaagugaaacagacuuguagcuagacugaccagagagagagagaaaacucaaguuacuaaauucaugagaaauuuuagaaauacacagcauuaaaguaauacuaugaacgacucuacaaaccaggcaguguauaugaaacagagaaacuccuagaaacacacaaauugccaaaauugacuaugaugguuaauuuugugcugacuuggcugggcuguggugcccuguuguuugguccaacuccagucuauuuguagcugcaguguagauguauuuuagaugugauuaacauuuaaaucgguggacuuugaguaaagcagguuacccuccacaauguaggugggccuccuaaucuaaucaggugaaggccaugagcuugaagagugaaguuucuugaagaaguaggaauucuucucaagacugccucacgggaaauccugaccgaguuccuagccugcuagccuacccuacauauuucagacuugccagucccuacaauugugugagccaauuccauaaaauaagucucucuuugagacugaauuaauuauuaacaauuuaaaauuaacaaugaacuaauuuucaucaauaauuuaaauaauguuaacuuguuauuaauuaguauuaauuauugaaacaauaauuucaaaaauccccacaaagaaaaucguaggacuagaugacuucacuugugaauuuuaucaaagguuuaacaaagaauuaacacucuuucuucauagacucuuucaaaaaauagaagaggagggagcacuuuucaccucauucuauguggccgauauuacucugagaccaaagugagaugaagacauaacaaggaaagaaaauuacagaacaauauuccuuaucacaauggacuuaaaaauccucagcaaaguccuaacaaacuaaaucuagcaacguauugaaaggauuaggcauuauuacaaguggaauuuauuugaggaaugcugggaugguucaacauuugaaagucaauccguguaauacacuguauuaacagaauaaaggacaaaaacuacaugaucaucucagcugauauggagaaagcauuugacaaaauccaacacccuuuuaugagaaaaacauucaacaaacuaggaauagaagagaacuuccucucuaauaaaggcuuccaugaaaauucugugacuaacaucaugcuuaguugaaaagacaaaguuuuuccccuaagaucaggaguaagauauggauaucuacuuucuccacuucuauuuuaguacugguucuagcuaaggcaguuaagcccaaaaaugaaacaaaagucauccagaauggaaaaaaauaaaacuaccucuauuuguagaugacaggaucuuguauguagaaaauccccaaggaauccacuagaaaacuaugaaagcuuauaaaccaauucagguuuguaggaugcaagaucaagauuaaaaaaucgguuacauuuucaugcacuugcaaugaaauauuuaaaaauggaacuaggaaaauccacuuacaucagaaugaauaagauacuuagacauaaauuuagcaagagaggugcaacauucgcacucugaaaacuacaaaauauuguugaaauaaauuaaagaggaucuaaauaaauggaaaggcaucccauguuuauggauuggaaaccuuaauauuguuaagguggcauucuuucucaaauugauguaaagauucagugcagucccuaucaaaagccuaaauggcuucuuagcagaaauugucgagcuuaucuuaaaauucauuugggaauuaaaagaacccggaauagccguaacagucuugaaaaaaaaaaaaaaacaaagauuaggacucacgcauucugguaucagaauuuauuacaaagcuacauuaaucaagacugugaugcugccauguggauagacauguagaucaguggaguagaauugagaggccaaagauaaaccuucauauuuauggucaauugauuucugacaaaaaugccaagagaauucaaugaggaaauuuauguuuuccaaccaguaguccugggacgguuauuagacauugaaaugcaaaaagaugaaguuccacuccugccucucuguagacacacacaaaaaagugaaucaugaccuaaauguaagagcugaaaucauaaaacucuuaaaggaaaacaugaggaaaucuucaugaccuuggguuaggccaugguuucugagauaugacaccaaaagcaaaagggacaaaggauagauaaauuggauuucaucaaaaugaaaacuuugguguuacaaauaauacucucaagaacaugaaaaaacauuccccagaaugggagaagauguuugcaaaucauauaucugaaaagagacucauaucuaguauauacaaagaacucguacaacucaguauuaagacaaaccuaauuuuaaaaugggcaaaguguuugaauagauauuucuccagagaaaauauacaaaugagcaauaaauaaaagauggcccacaucauuaaucauuagggaauacaaaucagaagccacagugugguaccgcuucacauccacaaggauggcuacuaucaaaaagaugaacaauaacaacuuaacaguuacaaaugcuggcaaggauguggagaaauuagaaugugggggccgggggauugacuguuaauggguacagaguuucuucuggggggaggcaaaauguuguaaaauuagauuguaguggugguuacccaacuuagugaauauaugaaaaaccacugcaaauaauuuaauuaugugguaugugaauuauaucucaguuaaacagguugaaaaagaaaguggaagcucauuaucccguuguaaggagauguaauuggcagcuuccuaucgacaaacauugugugguuucugcuuuuucacuguugauaaugcaugugguggcuccauaaacaaauccuugauuguguuuuagguuagucuugugaugcauucuuagaagaggcgucacugaaucaauggcugugaguguuuuuaggucuggauaacauuugcuagguuguuuuccagaaagaaaugaauacguauauucucaccaccaugugagagagugccgucuuacucuaucuuugguauuuucuuucccuuaauuauuaauaggucuuugauuggcuugacaggacaaacaucugugucugugugcuuacagauguacuucauucauggauagaugcuuuaguauucacacgcaaggcugcuuccacaugggcacgagcucaaagaugcuaagugacucagugaauugaggagccaggagcaauuaauacacucuccaguacugacaugugaguuuucaaccucaagguaccuuauucaacuggccugauuagaaagucagcaaagacaagggugugugugugugugugcgugugcgugugugcaugcauguaugugcaugcaugcacaugugugguaaaacaacaauugaacaauuggauuggaauccguggacugcaggccucgugcuuagagugugcuagugugggagaagcaagcaugugcccaacgguccccuggaccuggugugcugggaacuuuccacacagaacucugcuccucagccccuauguguguguggaccccuuugggaggcagcaguagagagcucaguuugggccauuuuauggaaaugcagugccugagucagcaucuugcaagucccugauguacuuuaugcagaggacgauguuagcauuccuuguaaacaaugauguggaaccuguauauugucauaagcuccccaagcagaaggucagcccuuucuuuggccuugagccugucuuugggaccuugcuguccguuuucuugauuccuggcuccuucucacugucucccccaucagaccacgccggccugcagucugcuccuguguuaccaauacacugguuuuggugaagcauuuuguauauuguauuauaguaucugacauuuauugaguuuucacuccaggccaaguguuauauguguguggugguggauagguuggguuagguuuuaaagugaaauuguggggagucaaaauuacccucauagucccugaagucaguaggacuugggaacucugauacucaacauccaagaauuaaccuguuuuuuuuccuugcauuuauuuauuuacuuauuuagacggagucucgcucugucacccaggcuggagugcaauggcgcgaucuuggcucacugcaagcuccaccucccagguucaugccguucuucugccucagccuccugaguagcugggacuacgggcgcccaccaccacgccuggcuaauuuuuuuuuuuuuuguauuuuuaguagagaugggguuucaccauguuagccaggauggucucgaucuccugaccucgugauccaccugccucggccucccaaagugcugggauuacaggugugagccaccgcgcccagccuuuccuugauuuuaaauccuggcuuccauuuauuuggagccaaagccaguauguaguuuaaaugaugugggauuauggggaugaauaaggggcucuccuuccuuccugccuuucuaccuuacacaaauucaccuaagcuaaauuuacaguuugauuaacuuuaccguauaucucccuaauucucacagcagccuuguaagguagacacugcugcucuuaguuuagaagaagggauauagagagguuaaguggcuuguaaggccccaccguuucaguuccagaguucuagucccuccuguucuaccucuggaccgcaggcagcuuuggaagucgcugucucagagcccgccauggaauuacuuggucaugugguuuuuaugcuugcagcugauagugaaaucaaaggauuccuuucuccauuaucuggcuuuucuuaaugauacauagccagaguucuuauucauuugaaucugguccucaaggcugagauguugggauuuuuauccuuguuaauuuggaccuuuuccuucagagaacaaguucuauuucuguuccacucaaaugcaguuucauguuuuucccaauucauuuucuuuuuuaaaaaaugaguuucucuucauuuccaguuuuaaaauuacagucauuguugaagugguucuggcucuaagaggaaauaaaccaacaaauacauaagagguauccucccacuuuuagcccuccuaauauaaaugccacauaauuuaauauccaggaacuugaguaauucaaaccagcaccuuugaaaacucuuaagacuaaacucacccaagucggccacagccagcagagggugccugcuuuguguuaggaguucuugugguugggaggcggcaccuuugggaauguccugaagacuguggauccucuucuccccagacagacgccuggccccacaccucacuuaaaguuucagaaauuucauggacucucuuuccugggucugauucuuaaucccuuuaaagccauacugaggagcauggucaagacugaucugacggaccuucauuuuucguguaguuuucuccauuccuggcugcuguugcauguuaugcauaauuuuuauuuuguuccuagaaauguuaauggacuuuaaaagcuuaauggcauuuaguuaggagauccuugugguauauucugugaucuguuguuuucuuuguauuuccaauucagugucacaaccugggaaaaauaaauuucugcucacagauugauucauugucgaggaaugccuuauucugauguuacgcgguuucuuuccuggcucaugcaugcccccauuugugcguuuauagaaaguguaaguccugugcuagucagagcaagacucugucagugaagacgauggugacuaguggcggguucaccgugucagacacugcgcuaagcaggucauuacaugaucaccuggaauucuuaaaugcccucuggcgacaccaccauacaugacuguugugacucccccagguugcccgucaaggccgugcugugaccguucucccggccccagaacucaugguuucuccaccagcuugucaccucaaagaguaaaggccagagaaagaccuguugagaauucagaugugguguugauuuuuucuuggucauauauuugcaauauuuguccuucagcuuuugcauuuguauccacgagugacagugguguguaggguuuuuugguggaguaccguuuuccucagguuuaggaauaaauguuaugcuugccucauaaaaggaaguaggaaguuuacuucauuucccauggcccccuccccgugucuucuccuccccaugguuuuccacccaucacggagccuuggguggguggcaaggggcgaucgcgguggagaugacuccuucucacuggcaguguggcauucucugaggauaggguuuagugcagugugcguuguccuucuugcuuuuuuuuuuuuuuuuuuuuuugagauggagucucgcccuguugcccaggcugaagugaaguggugugaucuuggcucacugcaaccucugccucccagguucaagcaauucuccugccucagccuccugauuagcugggauuacaggcaccugccaccacgccuggcuaauuuuuuuauuuuuaguagagaugagguuucaccauguugguuaggcuagucuugaacuccugaccuugugauccgccugccuuggccucccaaagugcugggaugacaggcgugagccacugugcccggccuccuccuugcuuuuuggcaucauuugggaggaagugcugggagcagguagcuugcuggcugccauugucuucugcuacuugcauuuccucccucuggaaauuuuacauuuucugccuagcacccaucugccuuccauuccuaucuuugagcuguuaggauccaucagcaguucuagcagguggcauucuucucaggaccacuuucuccaaauaaacaaaaguuaaucaugaucacaaccacagcgugugcucugagcagagggcagaggacagucaaggugaggugcagguccugggccucaggugggccuucccauuagguaagcagugucuuccgauccucaguagaaggagagguuucuccagguccaggauuuucagcauggcuuggaauuagucgaagccauggagaugaauugaggugugugaaaguucugcucuuggacagggcuuucucuuggccaacccagugggagggaaacgaggcagucucugauggggugagaggaaguucuucuuccucuccugagucucugcccucucuggccucuuccacacagggaugcuauuuaauucugaggacagagacagggagagaccacuggggggggguuggcccccugugccaggguggcacuggccggcagccucugcacucagaugcguguguucucucucugcacugcccggggcggguguugacugcagccacguggccccugagcacgggaaaugugaccagcaccacugaagguucaguucuguuucauuuucauuuauuucaaauuaaguagccacacguggcuugguucuggucuugggaaacacagcuuuagugugagaggaagcagagguggggacagggguguggggaugagccaggcugaguugaggcuguguggccagguggucuccagcguuuagccuuuucacacuugagaaagcuggacucccacuuuguggggugugggaguuuauauuugauaugugccuuuuaauauuuucuuuuuucuauuugcuuuucuugccaucuuuaucuucucgaaaggaaaaacaaaauggcacaggcaaggcuuuuugacccagugaaugggugaguuugcagacuuuuuauuucucaugauccaaguaaggauuuguaguuuucaugaucaaaauuaaauuuucucuuugcagauaacuaaggaaucuacuuuaccuugaaauuuuaaguaccagggaaaaaggacaugagaguuauguguuuaucaaaaguggagacacucaagugcguagcagaaggcacugggcuuuggaguccuggaaaccucgguuacauucucagccuucgugcucuggggugugugguacgcgugggcacgcacccuuucucagugccguaaacucgggccagugggaguagugaguaucuuggaggguuguuaggaaaguuaaagacuccagugugcaguuggcugucagcaaauugcagcuccuuucacuugccagagagagcaggagucucucaccaucccccaaaucgucuauacuacucuuggggaagacucuucuuuuuuaggacucacuucauaagacggcaaggacucugccauugcagucccuuggcaguagugauggaguccugagggugaggcgcguccaugcucuagcccggggacacgucacccacuuccaggaagggucugcucuaagucugucuccucucugguucagugcagggcaaugcgugccgcccccgcucagcguugccucgaguguugguguuacgcugcuggagagggagcagcucaugugaaauauggucugcccacccuucgccuguccaggggcccucccugggcucaggggccaucagcgugugguggccacagcguuuucacaaggccagcuugccuggugaagggagaggguggggaggggaggugagucuccuuuagaaagcuguuugauaucaugguuagagguuuggugguuucaguuaacuugauuuucuguucaauaggggccugggugugcugggcuuccucugagugucucaucaugcagguuuucagggugagucaucugugugucaggcacagcuggucacugauaugacuccccaagcaaugaaggcaucaguagguuucgaaaguggccuuaagaagguacaaguaauauuaccucugaugucagccaagcagaguagaguccaacauuagcaccuucucuccuguagcucacauucagagggcugggacgaagccccuguauuucagcaaauuagaaacuuugguugaacauucaggacucuaagugauauccuggaguacaugagaaaaaaugggaauucuuguuaaaaagugagucaaaaaaauuauaauccugaaguugccucuggguuacugaguucgcacagugaauucagaugcacccccacucccccgcagccccugucacaagggccguaugggcaguuugaaaauacaguuagaaaccaugaagcuucagaaaguucuuggaaaaugaccagucauuaaauggauucaaagcucgaaguuugggugacauuucucccugugauuccgucucgccccccuccuuuccgagucuaggagucuugcagcggucacuuccccaggcggcucugcugcugugcuaugggccgucugugggcuggaaccaguuagacuuccucccuguccuucuaucccauucucuuccucaaagaugcccgugucucuguagccuuugcugucgcgcugucuccugggcccuccucugaacucugaacccaugucucuguagccuuugcuguugugcugucuccuggccccuccucugaacucugaccccgugucucuguagccuuugcugucgcgcugucuccuggccccuccucugaacucugaacccaugacucuguagccuuugcuguugugcugucuccuggccccuccucugaacucugaagcgcugugcuuaugcaacuguuugcugucacuugaucacugucagcauuggauuauucuguccucaucagcuuuugaguuaaugccaggcucugagugccucauccucagcacuguuccaccuuaguggagaauuuauuaggugccagagggugccgggcaugugcuggucaccuugacacucaugguucuuuccuugaguuguccccucaccugugauggcuguagggacuuguugccuuugcgcugugauugggugaggccugggagccucagugugguggguccuccuggggccaggcuccucgcgguucugcacgcccucuuccuggggccaggcuccucgcaguucugcacgcccucguccuggggccaggcuccucgugguucugcaugcccucguggcuccccgcacagccucccugcuggggagcuuucaggauuccuccagaagcaacucagaauauacaggcagugccccaaacaguacauagcacaucucuuuaaugaacugugcccgcuggggccuggggccagggccggcauucccauccuccuuugaugaucuccauuaccaaacaauuuuggcggacagccugacaagcggagcgugagacagacucaugguaauuauggaucuuucugucggauucuggacaagggcugucaguuaaccgcucaggcucugcaauggagcccugaacaaaagaaucaggugugaacgggagccucacucugcgaggacacacagcccaguagggcagaaaguuauucuugaguauuuaccaggcuggcaaggagcaguauuuacccugcucuucguaagccacacugaccuagucugcagcaguuuuaaaguuuuuaacucaaaguaaaaacaaaacuacucaccaaaaagcaaacucacaaaaauaaacgaaugagacuagucuuggggacugaaaauuguuucaaaaucucuaaguguacagcuguucuugagauuaauguuuucagcugacagucaucaugcuuggcuuuuuuguggggggcagugacagauaggguucuucuguggucuccugaggagggccgcagggauuugcauuccggcacagguaugcucugcgcuuugcuuuuguuuugaagaaaggcauaaucucguguccauuuuaggauguuugaacauuucaaacuauuuuauaaggauugauguuuugugauuuuuauccuguucuucaaagaacaaggagaaaaucuuauuuuuaaaaaauagaagaaaaugcauucuagccugcaguuaccacauggacccaccgcaucuguggggaauccaggauauacaguucugcgccacauaaugacguuucugucaacacuggauggcguauaccacagaacugugugcgagcuggagaauuccucucaccuggugacaucauggccauuguaaugucuuagcagcaugcauuaaccacguguuugugcugaugcuggugucaacaaaccuacugcacugccggucuguaagaaaugcaguucauaauacuugaucaugauaguaaaugacuguguuacugguuuaagugcuuaguauacuauaaucguuauuuuagaauguaauacuucuaaaaaaaaaguuauuuaaaaaaaaaguuaacuguaaaacagccucaggcuggucuuucaggagguauccagaagaaggcauaguuaucagaggagacgauagcucccugugugcuguugucccugaagaccuuccagugggacaagguguggagguggaauuaaugugauauugaugauccugugauaugaaugauccugacccuguguaggccuaggcuaauguguguguuuguaucuuagcauuuaacaaaaaaguugaaaaaguaaaaaaaaaaauuaaagacagaaaaaagcuuauagaauaagaaaaugaagaaaaaauaauuuugguacagcuguacaauguaucugaguuuuaaacuaaguauuauuauaaaaaagucaaguuaaaaaguuaauaaaguaaaaaagguacauuaacuaaaguucauuuauuacugaugaaggaaauuaauaauaauaaaugucguguggccuaagugcacagugcucgugaagucuccagcugugcacuguaaugucccaggccucgcagccacucagcacucacucacugacucacccagagcaacuuccaguccugcacgccccacucaugguaaaugccuuagacagguguacaguuuuuugucuucacuacuuuaucuguaguguaccuuuucuguguuuagauauguuucgauacacaaaaacugaccuuuguguucauuugcccgcaguauucacuacaguaacacgcugcacagguuuguggcccaggagcaacaggcuauaccauauagccuaggugugcaguaggcuucgcucuagguguguguaagugcacucugugauguuaacgaugaaauagacgagugaugcauuucucagaaugugucccuguuaagcagugcauggcugcaugaucacaucuuaaugguauuuuuuuuuaucuuuaucuggaaacauuuugcuguuuucucuuucuugauauuauuuuaucauuauuaaucaguuauuucucucuuuuuuuuuuuuuugagguggagucuugcucuguugcccaggcuggagugcaguggcacaaucucagcuuacugcauccuccaccucccggguucaagcaauucuccugccucagccugcaggguagcugggauuacaggcaccugccaccaugccuggcuaauuuuuguauuuuuaguagagaugggguuucaccauguuggccaggcuggucucgaacucccgaccugaggugaucccccugccucagccucccaaaaugcugggauuacaggcgugagccaccacagcuggccaguuauuucucacuaugguagaaauggacuaaaauaauagaaugggagaauaagagauggcaucaagaaucaugugauaguggaauaaaccauaucuuuuauaugauccuugaauuuucuuacuauguuacccauaugauugcauuaucuuccaaaaaggugugaaaacaaucuggagacaccauuuuugaagucuguuuuucuuuuagcuuucauuaagcacagagaauuuagaauuuuuuauuuuucacuuguaauagcaaugacaggaaaauuggcagaggaagacauuucaccauuauuaaaugaaucagaagaugaaugcagacagauugagagcagcucucuagaugcuaaugaugauggugaaauugaucauaucagcgaauucgcagacugugcaccuucaguggaagauagcuuagaugaauuuucuuaaaaucaagcaucaacgagugaauaguauucuaaggauaugaagggaauaugguuucucauccaauuagucauucaaaaggaugggcuuuaucacacaauauuuuaugacaagaauguggaccauccccuuuuguuaaacagauaagugacaguauucuuucaucuuuuaagacguuuauggaccaaauuugguacacuuaguaaauggauaauugcuaaaagcaaucaagagauaauuggaaggaaauagaggcagagaugaaaauacccauuggcuuggucauuguaauugauguucauaaaucuaaaaaggaaaaucuucucccauuuuggagcauagaagaugacugucuucgacaaaauuguaagccaucaaaauuaucaaagagacuauguuuugacaaugaaaauaugggagaaaugacuagaaguaacgaggagcuaaaaccgauuagagaugcauuugacauuuagaaucaccguugcguuucaacaacaucagugcaagaagaacccaaagcagugacaagaggggaccuaugagagaggaauuggaaagcuggcaucacugcuuacagaugugacccaggcucagucaugacaguugaugagcagucguuugcauucaagggauauugcccauuuuagauccacuauacaggcauacuuuggaaauauuccagauuugguuccagacaacugcaagaaagggaguacugcgagaaagucacacaaauuuuuugguuucccaguccauauaaaaguuauguuuuguacuauacugucaucuauuaagugugcaauauauguuucaaacagcagcauacauaccauaauuuaaaaugcuuccuugcuaaaaaaugcugacacaaagacacaaagcauguacaugcuguugggaaaauggcacugauggacuugcucgacggagggucacuacagaccuucaguuuguaaaaaaugcaggaucugugaagcacaauagagcaaagcacaauacaacaacgugcaugaguauauauauauacacacaguccacccuugaacagcauggagguuggggcaccagcacacauauauauguauauacacaguccacccuugaacagcauggggacuggggcacuagaauauauauauauauauguauguauguauauauauacacacacacagucuacccuugaacagcauggggacuggggcacuagaauauauauauauguauguguauguauacacacacacacacaugcacacacacaguccacccuugaacagcauggaggcuagggcacuagcacacauauauauguauauacacaguccacccuugaacagcauggggaccggggcacuagaauauauauauauauguguguauguauauacacacacacacaguccacccuugaacagcauggaggcuggggcacuagcacacauauauauguacauauacaguccacccuugaacagcauggggaccggggcacuagaauauauauauauauauauguauguauguauauauaccacacacacaguccacccuugaacagcauggaggcuggggcacuagcacacauguauauguauauacacaguccacccuugaacagcauggggacugaggcacuagaauauauauauauauguauguauguauauauacacacauacacaguccacccuugaacagcauggaggcuggggcacuagcacacauauauauguauauacauaguccacccuugaacagcauggggacuggggcacuagcauacacacacacacacacacacacacacacacacacacacaguccacccuugaacagcauggggacugggacacuagaauauauauauauguauauauguauacacacacacacacacacacacacacacaguccacccuugaacagcauggaagcuggggcacuagcacacauauauauguauauacacagucuacccuugaacagcauggggacuggggcacuacaauauauauauauauagaauauauauacagaauauauauacagaauauauauacggaauauauauacacagaauauauauacggaauauacacggaauauauauacacggaauauauauacggaauauauauacacggaauauauauacggaauauauauacacggaauauauauacggaauauauauacacggaauauauauacggaauauauauacagggaauauauauacggaauauauauacagggaauauauauacggaauauauauacgcggaauauauauacggaauauauauacgcggaauauauauacggaauauauauacgcggaauauauauacggaauauauauacgcggauuauauaugcggaauauauauacgcggaauguauauacggaauauauauaugcggaauauauauauacggaauauguauacggaauauauauagaauauauagaauauauauagaauauauauagaauauauagaauaauagaauauauguauagaauauguauagaauauauguguauagaauauguauagaauauauguauauagaauauauguauauguauauguauguauguauacacacacacacacacacacacacacacacacaguccacccuugaacagcauggggccuggggcaccagcauacauauauauauauauauauuauauauauauauacacacaguccacccuugaacagcacggagccuggggcacuagcauacguauauaaauacacaguccacccuugaauagcaugggggcugggggcaccagcauacauauauauacacacaguccacagucuuacaggacuaggcaggcugcccggcaugugguucguauuagguaucagugauggagccagcuuugguuuuuuuuguuuuaacuuuguauugaggugcuuuuucauucugagcaguaaauaggaaaaaauccuguucuguauuugggugaaaagcuuagcuuuauaaagcuaucuuaaugacuucacaaggccccaagcuucaccacuccuguugguuucuuuggggaaguuucagugacuuccguggguaauuagacauggcuacucuggucacagcguuucagcugcuuagcuaugccgcuaacgucacgugucgaaguuuuuacuucaguaauaagaauuguauaguauucaagaaggauucaaaccgcguuaauauuaaagagcuuuucggauccagaaagugccugcgaaucccuucugaguguaauuuauacagcacaugucaauuaggaagagggcugaugugcgcucggccaccaguccacggaggccccuccaagccggcuucaggaagugccucuuccuguagcagucacgucgccaggccuccccgagggauccuugcugagaaaucaggcuuucuauuacuuugcuguucuaaauagaccugugucccaaauagaaaggaaaaaucaauuuaauuacuuaugaaacuuuuccuuaagggugaaugaauuaggaggaaaagaugaaguaucuguauuucagggcuugacuaggagagaaauuaauuucaguaugaagaugaggugugggccgguuggugaaagcagaacaugcuugcacacggaggugcgucacccaggaccgcaggguggagcagcuuugugcuucugggaccaaacgggaaaugagcuggaggacccguggcagcaggaaaauggcguugaacaggagccagaggacuuccgcaggugucagugcaaaagaauuaugaaggaggagagagcuaauugcaauuaauguaauuaugaagagagaaauguccuccgaagggagcugcccgccucacuuuuggcuuaugcucuccucccagccuccccgcggcauccaucucgguguaauuaaugagccuccucucccacucagaagccaggaggugguggaguuggacuggaggcugcccagcuguccuagccgggggcagaaagcaaccuuguguuuuuuccgcacaugauagaccuuugcaauaugucugcuuuuguaagaacagaauuuaaaacccaaggcagacaaagaauuuguguuuuagcuggugaggcuuuaaacguucaaccuugaaggcuguaagcacagaguagcggcaugggcugcugguccgccaggacuggagcaucggggacugugccuggaaaggggaauaaaccccuccucucuccuacuuguguauuccgccugguccaucugucugucucccauuuaaugcguauaauucagugguuuuuagugucuucacagaauugugcaacaauugccacacucuuguuccaagacauuucaucucaagaugaaacccuggucccuccagcagccacaugaccuuuccucagccccuggugaccacugaucugcuuuucgucugcauggauuugcccuuucugacauuucauguuauauguucacagcauccuacggcauguggccuuuuuugauuggcuucuuucauugaccguaauguuuuugagguucgccgguauuguagcacgcgucaguacuccgguccuuuuuauggcugaauaauauuccauauagaccacgucuuguuuauccauucaucaauggauggacauuuggguuguuugcacuucuggcuauuaugaacagugcugcuguaagcauuuaguauaguuucuaugugggcaugauuuuauuucucuugagauauaccuaggaguggaauugcugguucauaugggaauuuuaccuuuuaccuuugaagaacuguuuuccaaagugccugcuccauuuaccaucccaucagcaaaggaggaggguuguguuucuccacaucccugucagcacuuacuauuguuuguguuuuuauuuuagccauccuacuggguauaaagugguagcuuguuguguuucuguuuguauuuccuggaugauuacuaauguguuuauuuuuguuuuguuuuuucuucaucggcaauuacauuugauacugauuggauucacuuaaaaauuuuuaaacuuuaaaucuauuuuacuugcauuaaauucuaugcauuccucuuuuuuuugagacggagucuugcuccgucucccaggcuggagugcaguggcgcaaucuuggcucacugcaaucuccgccucccagguucacgccauucuccugccucagccucccaaguagcugggacuacaggcgcccgccaccaugcccggcuaauuucuuguauuuuuaguagagaugggguuucaccguguuagccaggauggucuugaucucaugaccuuguaaucugcccaccuuggccucccaaagugcugggauuauaggcgugagccaccgugcccagccuguacuccauuuuuuaaaaaauaaaacuuuucauuccaugcucuuugaucuauuauaacuugaguggaauuggucucacauuuuauacaaugaagauacuuuuauuuuaucgugauuacucuuuugccuuuuuuguugguuagaggaaaaaagaauccuuaaagaugagugugaaaauuugauuuauuuuuuaauucacaaaagcugaaaguugaacauguagaugauuuuucuuuuaagauagauaauuaaauauguauagauuaucucaauuucugucaucuugugccugagagauugaaggaaaaucuggaaauaagaggcaaccacuucaaacuuugcaacuucaugcauuuagcaacugagccacuuccaaaucuguaguuuggucaugaccuuaguucuuaaaagucagaguggaauccucaucuucuggucuccuuggauuuucaguucaguaccacaaacuuuugaaaaacuacugguggguuuuugaaaugccagauugugugccaugaucuuugcucuuaggcaguuuaaauuucgggagggauacauggcaauuuauuguauucauucacucauucauucagcgcuuauugcugggggcuguagaaacagaggugaugaaaauuagaaggccuguuugaccguugugguggaggcggcagcugacguuuauuuagcacguuguuucugaagcuuuuaaagaacuuuccuuguuauuaugucuuacuaauucaugaagaugaugcuguuaucaccccuguuuuacaagagauugaauaacuugaucaaggucucagagcuacugagggucugagccaggauccuaacccaggcugcagcugugcugacggcauuucucguuauggggaaaggugugaccaacuagcugacaucagaagccccaggggguuaaggcuguguccuggggucugcauuugucucccagccuccgaguccuucugcccuuuccucugugggccuguacaggagcaggguuccccccugguuacccucugucagggcacacacuuugcugaugcaauauuaccugccucgugccuuccuuggguuugguaguaugauccuucuguagaggcgggucgaggcacaaagaaggaaauaacucauccacggcccacagcucaaaauaaauggcagugagcuucauccugcugacuaguauuuuguacccuuuucuuuagaacuuacuuuucuacucaaugcugcagaacugggaccccaaguacuuuagaauaauuuuuaucagcggcugaaacaacagugacauucuguguaauucucacucugguuggaagaagagguuuuaggagccuugugauucugcacaguauuggcucuuaucguuucucccuuaaagguguguguacacagcuuuccaaagggagggaauggaguguugcuaccagcuuccuccguguagguucguuuucucuuccggacgggccagcauaagcuugugcaccguaggagcugcuggccucauccagccggugugacaguacccgcuugggccuguguggcugaacugaaccacguucccauccuuggcugcacagaggaugcuguguggaauagagcuggccagcacacacaggcuucucccaccaggcuguaagagguugcaggagaaaggugccccugacgagcagaggccuuggugcucccugcucccccuuguuccuucaggaggcuggugagccucagugacucuccuucuugucuaaaggguggcacugggcucacaagcaaguagaagccugaggccggccagccagauggagaguagauagagcuguaagauccaagggcacagguggccgccucacugccucauccacagaagcacugaguaggugcacaaggagggccucugggacugugcuugcgugagucccacggcugugcgggcacugggcuccuguugaugacugaguuucccaggcaguuuucauuuugaggugagucuguuucauucauucagucacagcauccucagcugcuguugcagcaagucugugcuaccuggaaugagccuggggccccuuccucuagguugguauucagaccagcgugcuugacugcauuaggaagugcauucugagcaaaccucuagagguuucuuugcaaccugauaacaccuccuccuacuuguauguuggcauuuuaugucuccaguagguuuuagggagagauuuaagcugcuccgucuuucugggauguuuguaguacaguccaguuguauaauuucaguggccugaauauugagccguggccuucuccaggaggagcaagucuucaucauaggauuugaggccgaggggucuuuagagacugccaggcccagccuccccaggccacaccguuauguggaugaggugauagagcugugugcugccucucugaagagugcugugaaucgguagaaagaaaugcuaauagguccccaguuugaauggggaaaacauuugcuguaucagcugauggacccuaaaucacccacuuucuguggguuuuguuguuuggacaugguucuuggguucuucucagucgcucugucuggacccagaugugugaagucgaauggcuaagggugguugaagucagggucauccgaguagagccauuuguucuuaguuaaaaaggcccaggccacauggggcucagugacuuagcgcugcgcauuaaagguggacgguuggacguuugagacccuucaguccuccaccgucaucuaacagguggggcaauaagggccuagaaccugcugaaccugcuggugggacagaggcaggucuauagcugcccccuccaggccaccaccaucuucguugcgcuauuucaaggccucguggaagccaugggcugcugcucccgcuugucuguguuguguucgucuguguugcacguccuaguuucuuucauacauucccucuggcccuugcaagugugaucucucccuccugucucccucccuuucucccucccucuuccucccucacgcuguugccaggagugggagguggcagagacgccugcccaaggaaccuggccagagauaucaugaggacugccuggcucuccauaucaaccuguucaguagucugccuguucuuucugaggauucuguggccaccuuuccauucuguugcuaacuuuggggaccuguuuguuuagcucuuucucaucaagagagauucagaaaaauugccagggcuuuuagaauccugcccucaccugauaaacucgccuuuuaaugccagcugugaaugagagaaggacgcucuuuguacacuugcauaaaugaggugcucugagcuacguuggguugucuaggaaacaugccuuuggagggcggcaaggacggagggcugggguauuagaggcgaacaggagagauuugcaaaacaaagcaaauaaaaacaaaccugcauaucuucaaauaaaacauuuuagcugaaagagagaaaacaagaaaucaaagccccuuaagcaggaaagauuuucauuuucauuuucagucuuaaauugacaaguaagauggcaugcagaccuuuuuccccuuuguucuacgccagagcaagacuuuguuaaagaaacaguauuagaguuucccaccaacucuugacugcucaccauuuaagagucauuuuuauacagggucaugccuuuguagucaagagccuacauucuugguaaugcccuuugagauuuucccacaugcugggugcccauggggguagagucuccuccaccaaaaccuugguugcagucaugagcuuugcucauccccccacgguggguuucucacuccggguguguauuggucgauaacccuuugagucucuggaguuggucucucuguguuccguggcaaugguuugugcucagcuugguuugggaaaucuuugaugcagcacagaagcugucuucccucuuuggucuuuguccccguggggcagaagcugcaauuucucaagaagaaagaaaugauaguugcugaaacggagccugcuccuauuguuaagaggccccgugagacagguaaagaccgugccuuucuccacagaaucaauuucaucuuguaagcacggccaaacagaaacaugcuaccgaagucagaaaaucagaaaaucagaaaaucaccggagaggcccgucacacacauuuaccuuaugcagacugaacacuaugugccgggggugagagccacacagguagaucagccugcuuccaggcacgggaguucugucugccuuucgcugaggagcagaagcccugugggaagcaggaguggagcgccacuucugagugagggucacucauuucaucugauguugggaagaaaugacagucugacccaaugagggagcacaaauuugggcuccuaaaagagucuuuguucaagagacugauugugucgcauuuugcuucucuuccauuuuugaguccugucuucacaccugacccucaaagaagacgcaacaucaagguccacccgaauaccuggaaccaccaugagcaugacaacagccggucacacucgugugguucagggagucagaggcugugagugccagacggaaccucgggaucaucugagucauccuccccauucucagggaaaccuaugccagagaaagaaguugguuuuccgagggccccaucugugauggagcugagccugaccccgucccccaugucugcucugaugcuccccuccagcccugccuccugccacaauguuuguguggggccuugaagagggcauggccugcuuuaaauguucccauguagaucugggguaugucuggcaguuauuccuacucguuuggugauagagcaaauggaggcuucagauggaagcgucugaauggaucucuuguuagcaaauuuauaucauuucauccaucugccgaccagguaucucugcacgcagggaacuuuuauucuuuugguggggagagagaaauacuaaguuggauauuggcaagcacuaagaagcacuaagaagaaagaacugagaaaggaaaagaaaguguugcagucuuuaaugcuggcucagcaaggccucacugagccggucagcagugacgggaguggugagcaccaugcgcaagggcaggcaagugagugcggagacuuccagggggcccugaggccugagccgaggcugcuggggcuggagcagccugagcaggggagggcugugcucagugucaucugagcagcaaugacccccauggggccuggaggccaguggagggacauugguuaacguggguuaacauggccuuuuuugaaaagggucgccuugggaacguacugagacuagguuguagggagaagcuggguggacuccaggagaccaguuaggucauugugcuaagccaaguuggagugaucggugguggcuuggagcaagagggugguaauaguggcuggauuugacucugguuugaaaguugagcugaugaaaggguuugcuuaugaaucagaggaacgagugagaggguaguugaagauggcuccaagguuuaugccucacuggcagggaggguagaguugccauuccugaguggcugguaggagagguucugaguuuggaaggauggcaggagcuuagucuuggaugggugccguuuguguggccuguugcacauccuaaucauucaacacucuuagucaaaaccccacgggucuuuacguuguccucccaggcagucguugauuucugcccccguuuugagguccuuguguccacuguggaaugcuggacuguccuuuagggccgauggcuggauggaggcuuuagggcccacugguucccacuuuccugccugaggucagagccagcugucaucucggagcuucauguucuuccuuuccaguguggacauggcgaugucucaucaggaaguugcaaggaacaacaggaggaugguggugguagcuuuccuagauugagguauucacgguagaugugcgcgaaugacgggugaguguggaggagaaucugaagagguagagagagcgccuuuuacgaacccuugcgucuccgggauggaugugugcauggauaaccggggacaauacaaaaccaaacacaccccacaccucugcaguucuguuauuuuucuccaguuuaccaguguaguuuuaauucuguuccuuuucucuagagaaguuccuuauaaauaaucucccucucacauuccuuguaaguguucgggauauguguuuguccugaaauacgugugugagucugcauccauccguagaaguguguaugcauaggcgcauguuuguggacagaaacagcccagcacuuccggagcuuucagcugucccuguacguggcauugggccuaccuaaccuuugcuucuuugccguagacucuccaucugcaaaauagagacaauccuugcagcuuuucuucucucugggagguuaaugauugaguguauguauagugcugggaagccuuugaaguaaaaucacaaaguacauguguauuauuuuuguagcucuaaugguauuuauauuuaaaucauuauuauuacaauaauaauacacugguuugccaauaaaacacaaaccacuucagaagaacguucuaaaaugguagcauuuucugaggccgggcagcagugucuaauuuugggccuucacagucaguuucgcgauucauguguuaugcauuuucaaagaauaaucaagagcaugcaggauugcccggggcagugaguacugaaaauguacaguugggccaguugugcuaagagagugaugggacaucugcacggacauggcuguauuucacgccaguuaggggcugucacugcagccggcgccaucuuggagcccucggagcuugacuuggugauaaugcgucaucagagcugagcaccuugugucagcuguccaguuacagcgagguguaaaguggacgagugucucagugaugacugauggguuuuuucuuucagauccaugcaaaauucauaaaccugauuuauaaccaguggaauuugugcugccggaagcagaaggcucaaaugcggagcuuuguuuuguaggaaaugucuuucuuuaagguguccugaugcuuucaucccugagcacauccaggugaugacaccagaggcucugcaugaggggagacgaggaagcagguguaccuggucuccuuucaucuugcaggaaaucccauuuagcuuauuggaguuggaccaaugaucacauuaagagcagaagucacagagcaggcuguuuguuacgaguuuuguaaauaagauguauccugcugagccccacagcacagggcacguggauguccacagggggacagauuguggccaggcacccuuggcaagcaaguucuuacugaggucagaagugacuggccugcccugugggugguugacacuuugcagccaucauaucccucacagcauguccacaucuuugaaagcauuuuccucccaggcuccgggacagcaagccuuccuggccuuggcauuccuguggacccugucccuccucaccaucauuuucggcuucugugugugccgcuuguccuccucugccugggcuguugguucucucgagcuuucuucuugaccuucuccccuuucauccugcguucuccacucuugcaugcuagugucuucauugaacuguguacuuaaagguccacaaguggcuuuuagcagguuuaggagccuccugacaugauaccaaauguuauaucucuguacguuuuucuggauaaaggaagcaucguuuuuaucaguuuuggguguggguguuggccugcaagguuaagaugucgugcucugaaaugucagcuuucuagcccagaucuguguccugagcuccacucccuuguauccaccugccuccuugccagcuccuugaagaugcugguaccacagaguccagugcuggaggcagaggcagcaugcugucccacaccugcugccuuggccauauucuuuggucaguacaucugcccagucugcugaaaccugagggccccuggauucucucucucaaccccucagcauuguugguaccagagcugacucugucccuggucacccucuccuguccuccacgucaggaccaccccguugucuccugccucuggccacccucuugccacauugcuuggauggccuuucaccaggucugauccgaggguggucucgucuuugucuuagcagccgaggucugugaccuugaccaccuggugaaguguuugcuguaaagucacucuuuuuuccuugcuucccauacugcacucucuggaaggaagucacugugugcagcccacacugaacgggugggggucauacuucacuuccuugaggggagagcauguucagaaauuauuuggaauuuuuuugcaugagagacuuuucuguuuuccacauuuaauuuauccaauuauuuauaucaauaugaauuuuaaaauacuucauauuucgaguugcagucaauauuacauuauauguuuuauugcucagauugauucaccuuugccauuggauggucuuucuguuggccccuggguuccaugacacacucucaucuguguguguguguggccauuucuccaaggagcccuaguuccuuuuauugguggauuguauuaaaaccaagaucuguaugccugguauguuccuugucaauuaucuuuuaaagaaauuauuuaaaaaaugccuuucauauuuaccuucauuuuuauaauuuccuguuuuuuuucauuuauuuuuguaggucuguaucuacuuggccuuaaacaugauuucuuuugccugaagaacuuuaacacuuuuuguagcuuuaguuugucugaaaaaacauuucacuuuguuuuugaaacauauuuuuacuggguacagaauccuggguuaccaguuuuauucccaguccuuuaacacugucauucuauugucuuuuuguccugcauaauuucggauuggaagucuuuugucauuauuaucuuugguccauggcuuaggauuugauagaauucugucaaaguuagccaaaucuaauauuaacauugacugaguauuuaccucuaucaggugcuuuguucagcuuagcugugcaugugugugauucucccaacacccuuaagagggaggcagggagggagguggcauuuuuccauguauagguaaggaagcugagaguugaucagguuaacugauuuguugaaggccacuuaacuaggagguagcagagcugugauggucugaugccagagacagucugcaucuuaaccacuuuauugaauucauccucuucagaaggucgaggaucaggucacggucacacuaguguaguuaaaaugcuguuaccacaguagcaaguccacagggcccauaggcacuagagucagacagguccacaguagcaaguccacagggcccauaggcacuagagucagacaggccccagccccagucccgcucugcuucuugcaggcugcgugacuuugaacauguccuuugccuugcucaguuuguguuuuaccucuuaaauaggugagagcugcuguuugcuuuagaucaggauuaagaaacgugaugcguguaugugaguacugcggucaacacugggaaguguuucuugguuggggugugcucauuccuaucuguugaaugaacgaauuggauuuugugcaggucagauacguugauuuccuuguucaaggcggagaguugugggcauagcacacacucgagcaucuugccucacauuucaaccccucucauuggcccccucuccugggcucaucuuuccaaagcacagcccucaugacgucacuaugucuguggcuccaugcucuggguggagagcaggagcugaggacgccgagcugagugauguggaggaugggacaaaacagccaccgaacguggcugaguaccagcguguguucagcugauucguuugggcuggagugaaaugggucaucuacccauuagggaucuaauuggaaauaauacugugcaauuuaauacagugauuucuuaacauuuuuuuagcccaaauuagcaaaaugcuucaaaauguuacaggcaagugaaguggaaauaauugaaucccaggaaaggauaaauggauuguauuggaauauuucaaggaggaauuucugaucagcuuaggaagcgaagggguuauccuugugauauuuuauugaaccacaaaauguuauuuauaacccaugucaggagcaauuaaacugauugaugauuaaggaaguuuaauaguugaauaauaagacgcggcuuuugagagcuguuuuuucucauucuggaagcguauuucgugagucuaguaacaguguuaaggacaggccauugcuaugcuguggggucauuauguggugguaauguucagcguaguguuacgugguauguuacuuauaaaaaauuaaaaauuaaaauaccaauuauguuuguuugauuuguuauugaagugguuuguuaauuuugauuuacccaaagcaggguuaauuacuacauauugauauauuugauuaaaaguacgcuaacgaugaauaagaaaggccaaacaaaauaaauuauuuuccacucacccugaauaguuucagaauuuuagcagucuuucauguuuauguaaaaaggcagcuucacacuggaaggauuugcugugauuggcagcuucuuaggcauauguaucagcagaggccguauuugcauuuugaaaacaaccuaugcuacucaccuugacacguuuucguuugugugugugugguaguauuugucuuuaugagccauuucuuauguucgggaagauuaauaaauuaaaauucuuucuuuuagaaauaagcagacauguuacaaaguaggaaacacaaaugacuaauaagcugaaaaaaccgucuaacuucacagguaaugaaaaugcaaauugaaccaauaaugcaguucuauuuuugucuaucaaaucaucacaaauuaaaaaagauaauacucagugcucuucaggugaggugaaguugacacucuuccagucuuuugcugugaaacaaccauucuggaaagcaguuugcuggccacugaacagcccagugccucccugucccgaggacauagaaggugaugugugugaaggcugagcacggggcucccuguggaggcaaauguuugcaugaguugaggcuugaaccagcccagaugcccaccgauagaggaaguuuaaagccauuggguacauugauuucugugucgcccuaaacaugauuucauaaaaaccuuuuucaguaugugaaaaugaucaggguauaaauaaaaacaauaggacauaaaacuucauauuuagucucaauucugguuuauugaaaaugugugugugugugugaauguuagggggcugaauugcuuccccagaauucaucuguugaaguccuaaccccuaauaccacagaagauguuuggagauagggucuuuaaagagguaauaaagauaaagugaggccauuagggugugcccuaaccccauggaacugauguccuaauaagaagaagagauguggggccaggcacaguggcucacgccuguaaucccagcucuuugggaggcugaggugggcacaucacuaggucaggagaucgagaccguccuggcuaacacggugaaacccugucuccacuaauggaugauuuaauuuucuuuuuuaagcuuuucuguauucuccaaauuacuuacaaguaucauguaauaaagcauuauugggagguuuccuucuuuguccguauagagagacuuagaagaagcagagagaagccacuuccuuuucaggggucaaccuggucagcucugaguugaaggcguugugcugggauguguagugcccugucaagcccgaaaguugagugcgucucguguggugugugcagaagccugugggccugugguccgccgucuguggggcgcguuccccucagcguggcaguggugguacacacaggccacugugagauggccgaggggugugagugaggagacacuaggggcuuuaggugaggcacuuccucugucuuucagauggaggcuuagauucuaaaccagcacagacuguugagcacagacuuuccgggauuuacauguuuuuuguguugcugguuaggcuggggccagauccggccugaacuaaguuccagaagggugugugggagucgggcagguaagaaacaaggaacccagggaaaggcuggggugcagccagcccuggcagcgcugggcagaggccauggcaggucccugaaggcucgccuguggaggccuugcucugaagacaguggggagccucgagaccuuucuguuagagagggacgcggucuccaccuuccagccagcugauguacccauugcaggcaccaggugugaugggccaggggaccccaugaaagcaccccucuucaccugggcauacagcuguuuggaaauaaaacaaaagucugcagagggagguuugaguagugcuguauuagucuguucccacacucuguaaagaauacuaccugagacuaggucauuauaaaggaaagagguuuaacugacucacaguucugcaggcuuaacaggaagcauggcuggaaggccuuaggaaacuuacaaucaugguggaaggcgaagggaaagcaggcaucuucuucacaaggcagcaggagagagugagugccagcaggggaaaugucggaugcuuauaagaccagcacaucucgugagaacucacugucacaagaacagcaugggggagacugccccccgauucaaucaccucccucccugaacacguggggauuacaauuggagaugagacuugggugggggcacagaaccaaaccguaucaagugccuugacuaccagucagcagauggguuggaacuggcucgggaucccagaaugaggacagcgugggccagcuaagcugaguggggccuuccagcgccagagacgccaugcugggcaggcgagaggugaggcugugccugggcugcuuaugugaggaagcggaucacaccucuugcagccacccagcacccaguuugccuccucgaggggagggacggccaucaaacagugugcauggaacacguuucuaacaauaguggacagauccauuugcagaugauggaggguggacuggagcuggggcaucagaggcaggaggcauaggauagcccccugaacuggugauggcagaacccccacagagcacccugcaucuccugcauuucucggggguugggggagugaugggguaggccugggggcuccuggaggagggugcugccuggaugggguuucugcaggucggggagcaguuacaguguugaguguggcucucaucagggagcccugagggcuuggcccaaggauugaccguuucuuuuauauuucuacauggcacccugcucuggcgguugugaccuccugggaguuucguagaaccagggagguuuauugaucagguccauucaguccucuauuugguucccuuuggggcuggagguacaagcuggcugccuguucugaguggcugugcaaaccuugugacccccagccccuucacgucucccuguggcuggggucccagggcagccuguauccucucugcaccguggcugcucaaccaucagucguuacauugggaugggacagggggcucggcauaugcauguggagaggccgccaccuuguccaccuggguguccgucucaccguuggagagcugggaguccuggccaguuccaccuguucaaugugugaugcagaguuaauucuccagcccaucuucacucagccagccuccgugucuacuuggcacaaggauuagcucuucaugcauaagcguuuuguagcagggcgucucuagcccugugcccagcgucgggacuuuucccccagcugcuggaacaguuuucuguguuccaaaggagacagcaggcuuugcuucuuuuaaaaaguugcuguucgaccuuugccuuacccguagacuuacuggauuggagggaauuagcauuucuuucuagaaaggagaaucacucuguuuacuuugaaugugcuccugccuaggccugcgguuccugaaacagagcagcagccuucucauugucugaguaccuucaugaaaugcauggagacacaagauguuuucacgacacaauacaccaugcucauucuucccgcugcuugugaagcgggaagcucuccuucuaauucaguauaaaaugaaacgggcauuggcugucgcucacugagguggcuucaguuaugagaaugugugcucccggccgucucuccugacagcucagccagacagagcguuucuuguugguuuucgcuuuccuggaugaggaacuguggggcuuuaggaucuugcccuguguuuuccguucuacccaacaaaaaacuaaaaccaaagcaaccccuaaacuacgugacugauggaugaugaguuugugaggagucugugguauggggcuggugugaggguggcacaagagaaggacacacacacuuugggucuugccuggacucagccauggagcuagacaugcaguguugugaacaguggguccugacaccgacccgcagguugguuggcggggccaggugcagguggugucaggacacaggguguggguguggcugccgcagcgggcagcauugccgccucccuaugagccuuggcccucugccucugugcugugacuuuuguggucccugguuugagaggccugcugggagucaggcuguuuccuugcugccacacuggagacagacagaccccaggagggaaagguccauuuccuggucccuugugccgguggccucucuguccccuccccuguccuucggcucgguucuggugcccaggauugccauggaccucugauucacucugauuccgcuuggucagagccggccaagcccagccgcgccuccuggcuuucugggcagccuggcacccgucaguucacucuugucgggagguuuuccuaugacuuacugucagccuggacuuggcuuuuccagacuccacguuuucuaaugaccugccaucggcauuugcuuuuuugacauuuacuuggcuucuuggcccucgaaacugacuggguucacuuagccuuuuuagcacugccuucagacaccucugaaagucuccuuuagcuuuguccacaggcuccuuuugaauucuucuggcccaaaccugcaucagcuaagagcccugguuccuuguagcagaggauggugucaaagacuaacaucucguuaguuagcaggggaaucacacagugggacugacugcuagugauggagcaggcaaaagggccugagucucuucuguuaccuccaauuuaacuaagugcuucuuaccugccuccaacaggaauguuguuauuagugcguuuuucacggucuuugguacuggccuguuauauagugccauaucagacauuauguaggagguacaguguuggacucaucuuuuuuuuuuuugagacggaguuuuugcucuguugcccaggcuggacugcagcggcacgauaugggcucacugcaaccuccgacuccuggguucaagcgauucuucugcaucagccuccugaguagcugggauuacaggcacccaccaccacgcccagcuaauuuuuguguuuuuauuagagacggguuuucgccauguuggccaggcuggucuugaacuccugaccucaaaugaucugccggccucagucccccaaagugcugggauuacaggugugaggcaucacgccuggccucuuggcgucuuuuggcccuuuggcaguguccccaaccaggcagucugcucugccacuaccacacaggcauagcugaggacaaaagauacccaguccaggccaggcgcggcgugguggcucaugccuguaaucccagcauuuuuggaggccgaggcggguggaucacgaggucaggagauugagaccauccuggcuaacacggugaaacgcugucucgacuaaaaaauacaaaaaauuagccaggcgugguggcgggugccuguagucccagcuacuugggaggcugaggcaggagaauggcgugaacccaggaggcggagcuugcagugagccagugagccgagacugugccacuacacuccagccugggagacagagcgagacaccaucucaaaaaaaaaaaaaaaaaaaaaaagauacccaguccguagcuaagaggacacaucucagagacaagaaaaaaaaaaaacaaaacccgugcccaggacuccuucauggaagauacaaacacagaucuuugaagccucauuuugaggcuuaaacucuucauuuucuugguaauuagugucagucaauuuacuuuuuauccuaggcagcuuucauauugaacucuaauuucuagacugcuuuugaguaaacagagauauucauuguaccauaauauuaagacaaucuuguuuuguaaaaaaucagucaagaacuuuggaaaauauggcaaaugaugucaagaaucauccaccuuccuuauguauuuguccucagauucaauuugaguaauugcuguagauucacaccuaaguucugccgcagccagcucaaagacaccagcaccuuagcucauagugcauuuccguguaauuuuguauucacguuacauuuagcuuuucaagcgacuccagacauuucugagaccauccuuagagcuuguauccacaugaaacaaauacagaaacuucagcaaauguucaugugguuuuagugaaguuuccagauuuccguauggcuugcaacauuucaugcuugcggccuugguuuugcauuuuguaauucccaugugaacauggcgaagaagcuuaaagucauuucuucagguaauuuguuugauggagaccaggauuugaacccagacuuuccauucaguagccguuuucuucacuccaggacgggggcacggauggcucugucaggguuugaaagggaccccaagagcagcacagaggaacucggucaguggucugagugcggcacaauugauggcgucaccagcgucagagaggcaugugagagcccuggggaauuugcuagcagagaguauuguguggguuugagugugagugugucugaguguguauuuugacagauuuauccagauugugugaguuggauuguuugguuuccugcauguuuucaaaaagucacugcagguuccugcagauuucgucaguggcaggugguugaacguacacuucacaggccucuugcaagucagcagggcugacuguggccggcccucugguccuggggggagugugcugucugggaggagaugcgggugucucuaggaucccagcggaggacagcuggcuucugcccaggaucggugcucgccaccucacugccccuccugcucugcguggcuuuaacugagaaccacaugaaucaaagacggauuuaagaaacagucacaacuguguggaaaacagcuaaacuuuaccagacaauaaagaaugugaauuagaucucacuguaaugagaaguuuuuaccuugccagugagcagagcugaaaagaaggucaaggugcugauaagggauuggugagguggaugaucuuaggcccugcuggcuguagaauaaacuuccaacaugucuuucacauauuuuaccaauaucucucaauaaaauguucugcucuuucaccugccaauuucacuugagauguuugucuuaaggaaaucucucuguguggaucacauaccuuauagagagaagaggcuuacuggggcauucuuuguaacaguaagauguuugaaacgaugccagcgucccacaguaggggugcggcuguguagacgaggggauugcaguucuguagauaauuaugcagcauccugagggauggcuucaaagagcauguuauaaaaugggagaucccuguuacaaacgucagauucuacagggcagaaaugcaacuguagucauguaacagcugaacaaaaccuauguagaaacaaauugggauaaaauuagaccaagagauauccuggcuguguuuuacauaacguaucuguggcuaauuucccucuuuauuuaguauugugaguuccuaaaauuuuuuuugugacgaugacuuuaaaagaaucagugccugggccgggugcaguggcucaugccuguaaucccagcacuuugggaggcugagguugguggaucacaaggucaggagaucgagaccauuccuggcuaacaugguguaaccccgucucuacuaaaaauacaaaaaaaaaaaaauuagcugggcgugguggugggcgccuguagucccagcugcuugggaggcugaggcaggagaauggcaugaacuugggagguggagcuugcagugagccaagaaggagcgccaccgcacuauagcccgggugacagagcaagacuccgucucaaaaaaaaaaaaaaaaaaucagugccugaucaccuuaccccauggugucuuggacaugcccuauagacccugccugggccacgcagugcucaucacacugccugcccugggucccgcagugcucaucacacugccugcccugggucccgcagugcccaaggcuggaaaggcccagggagccuucagagagcucucaggccuccacgauugugugguguucugcuuucucccggccaaguguauuggcucugaauggagcaggcccuuguuccugugccuuccccagcucccagcgagcacuacacauauuguucaggaaaguagaaaccuuggcaaguauaaaacccaagagacaggccaucuuggaagccugagaaggcucuuccuuucuuuucauccuugaaucaauggugcacagggcaauuugcaggcauaaggugggauccuucuccgggcccaggugccacuccgggcaggacauggggucuuugggcugagcaggcucuucugcauucuggggccgugcaccuccccucccggccuccaagcuguauauuggggaggacacaguguggcuggugccgugggcaagcuucuccagccuuugccucagcaguggggaggcaggcgcaggagcagggcaugggcccacagggacaccuguuaucugaaggcucucgggagcuggcuggccacuguuccuucuaugugcucugaucuuggguccagcaggagcgaugcacguuuucauggggugcugagauguucacuugugauaacagagcaccaggacuugagugugggcaacacagcugccuguuagugugagggccgggcuccugccccuccuuggcugccagcggcgucuguuugauuuucuggcaggugcacaguaauuggcugugcacuuguuggagccuugguuucaugcugcucuguguaggaaggcugggccauccgaaacacauucuuugugugaagccuacuuuaggguaggcauggagaacaagcagggcuguuugcaaaugauauagguaucugucacuuaggaagaaguuuauuuguggggcuguucugcagucaugccuuuugaguaccuucugggcauguggaggccccucuggcgcucccccaccuacagaugaccugcagagcaugcggccucugccagccaggaaggccugagaagcuggaagggaaggacccucuuuguuaaagggaggcccguauauucuuuucaguggaucauguuucuuuuuguugagaaauugaagugccauacaauugauuaaauuuuuucaagcagaaguauacugaaaaacaucccgaaaggaagcagucuuaguuugccuuggcuuugugcuauaauauacauggaccgucuguccaauuuugguuuugauacaguagccucauauccuucugugauuauauccauccaguuuggauaguuacaauguaagcaguuuuuuaccugauuugugugguccauuuucuggauguaauagagagggaggaguguuuugaaauguaucgguucuggauggaugggccagcaggggcacugagggcugaggggucgaguugccaacccgauuccuggcaaggccaugccuguugagugaccacagccagccuuucacgugggcucguuagaauugcgacaggggccacagccacgcugggcacuggugagcugcacgcccguucuugcucugagcggugggguucccagcugggauguaagcagcacccacacaggagcagaacuuuggggccgagcgucagagugauuuaucgaagaccaaggauugaugaggaaagggacuuaggcuucuguaaguggcuccaaccaaagucaccuugcuggagcggucagugaacgcuggauugucagagcagcaagcucuuccaguuagcacuuugggaugcuagcugccucaucugaacagcagaggaaccugcauuguguuuuucaguggguguauuucuugauuuuucguuguguuauuaacaguaaagugcaaggacaccuucuccacaccagcgugccauuuugccaucugaccugugggggcggggugccccgcccauucucauuuguuacggggccuugucuuguugccgacuccccugccagacggugagccauggaugugcagggccugggacuguuuuucuccuggauuccgacggcccccgucucgguaccggcugcacugucugggcucggcagagcucuguggguuuuaaagccuucggcgugcuuugucagauuguuuugcagaaugcauucgucaucuccggagcagcaaauggagaacuguguuuugagugguccuugugcuucagagggucuguuucuuguuacuugugucagugggggaaucuuggccaguuuuauuggugagcuuggugaaucuuacugaauuuauuuaguaacuaauacacacaggcagagccuugagcaggggugacaucucggcagcaggcacgacgucugccucaucccgucccuguggccgguggccuggugugggguuucgugauggugcagucauugguucuccggcaguguguuugcuaccuggaggggcagcuguggugggcccacaucuuccuccugugccucagcagugcugggccagcaggccccagguggcagcaucuccacccgccugugcccaccucguuuccacagcgcuggcuucaucacgucccucccugacaccugcccaggugcggugggcuggcuccucacaccucccgcagccauggcacucuccuggggcccugugcugaggguaccacucuaacaaacagcugucuucuagcgcuucccgucccucuacagggaagucucuggggccuccgcaucacgcuccccacaagcucuuccuccucuuuccgucugugaacuuucugccuuccuucccaucaccugcgcucuauccgauccugccgcccuccaggcuugguuggaaugccaguggcccugugcucaugcuuuccagcccggucgggcuccgugccuucugccccaucacccuguucauucuccaccuggcagguuccagcucacacagcacggcugugugagcugcgucccucuguaacagacggucgaaagcaucgggagagcccaugagucugugagucagaggagcacaugggcacggccucucuuccaggcacuaacauguucuuuguuucguccucgcuuuucuccccgucccacaguuucucacacauagaaguguuugauauuuguuaauagaagaaaucacuguuucaacaaacagcuuuucuaugaaccacaacuccuacucacagcauuauugaaacauuaaagauccacucaagccacaagaauacuaugagauuggaauuuuugcuuuuugcaaaagugaccucaucaaaacgaggacggcaaaagauacagaagguuucuuucacuuuuuaccgcaguaucuaucccacaguugauauuuucccaaguguugccugcagacuuuuuccacauggaauuugguaccaaguucuuuguacaaaaaguaggccagcugcuucacagacacuguccuguucccaggccccgaggccuccugcuuuggguuuugggguuggagacuccugacugcgggucugcuugcggguggugggaugggaaacagcuaugcuguuggugagaagagugugucgguucucaucauuugggaucacucuuggggcuggcaguugaucgcuggagcuggucugaugcugccaccucgucuagccaugcugagggcguuguccuuguccugugauaauugucugccaacgucucgcccucccaccguaugcccgcacuugugggcugcaggcggauggcccaagcuuacagccguggagcagagucgggaacugugacugugguucagucuguguaaccuugauugaguugaacguuauccauauaagaauuaaacauucccgcacuagagccauuugaucauaacguuaguuguuuuugcugaaccaaagaguuuggcgaauuuauagucuugaguuguuaugccacucucaccaaggcaggacuuuuuucuccauccuggaacccaaauguacuuaaugaaguguucaaaucucucucaccaaaguacuggaguuuccaauuuaaaacucccaaguugggaaaugcaaaagauuagauccauagagcaauuccaucuugcuuauaaaacagaacauuuuugauuaccaguuaagcuccuaauuaagugaagaggcuuauugcaggguuugugcagugugggugaugaauguggugguaacggcaauagcucccuccuuggcacuccccgucggggcuggcucuuaccgacagcguuugugcuauaggugacugcucuccauaccuugcuaccaguguccuggaauucuuugaaaugaaaggagcuguuuacauuggagggauuuuccccuuuccccaguaccaagcucuuccauguaguuuaauaugagagagaacuuaacccgcaucaagccuuuuuguuuucgagaacccccugguaauuacaagcuacgauuccauugcacccccugguaauuacaagcuaugauuccagugcacccccugguaauuacaagcuaugauuccauugcacccccugguaauuacaagcuacgauuccagugcacccccugguaauuacaaacuaugauuccagagcacccccugguaauuacaagcuacgauuccaguccucuacuccaguuccagaggcugaugucgucucacagaggugggguggggggccgugagggaaaugagccccuuaggagacccagagcuuggguggccuuguggugacgggcucuuuugcugaaugacaggagaggcacccacgcacugcguggcauggcugcgggguuguuguauuucuggaguuagaccugccuggaguuggagcugcacaagggaggcuccggcauggaugcuccuuacugagucagaggccuccaugcugugcgggguccugcugugaacccgaugaaaagcauguagacuaaucaggcagagcccugguucauggccaggcucugccacuuccuagcgcaggaccuggguguguuaccugcagccuccuuaccugcgcagcguggcauggaccccacagggggcuuuuggauggagugggaucaugcguggacgugugcgcccccacgcagaaaguccugcuguggaaacacacuagugcuuugucaguuggugggcaggcguccucacugcguggccggcgguccugagugggcaggcguccucacugcguggccggcgguccugagugggagggcguccucacugcguggccggcgguccugagugggcgggcguccucacugcguggccggcgguccugagugggcaggcguccucacuguguagccggcgguccugagugggcagccuucaucaccaggaccaucuggauuuuuagcccauccaucccacuguuucuuuaaucuucugacccuuuuuguuuucuggauguggaaagaggggccaagaauuucugcucuuuguuucccuaaaacagcuuuucgcauauugcagaguagcaauuaugucuccaugugguuuucuccugaccaagcuaaauauccuccauuucaaaaacuuagcuuuguuuaccuacccaccauucauccacccgucuacccauauccaucuguccacucguccaucucuccauccacguggacugguggagucucaggcuggacguggugacugugcagugcuauccccaccuuguagcaccggcccugcccacuggaugccagcagcaccccccacccuaaucauucugacccccaaaugcccugaaaguuucucaaaacauucacaaggggaguaccaccacccgugggaucuucugcucuagggguauuuaucugaggaagagacaggccuuauuuaaacuguucuaaguggcuuaaacauuguuuuuuucuguugcagaaauaacugcucauugugaaaauugacauucccuuuuacucucugcccuucugcagaaaauagugcaaauuucccgccccacuccccccaccuugcaggaguguucagacauuccuguguguggcaucccuggaugaugccccucuguguagauuucuguagaugcagugcuagacuuuuccauguaaauggagcuguugauaaaggggggcuuauuuuacaaauugguuguuuuccuuaauacuauagcagggcagcauuuucaaagaagguuaguuaaaucaucccccaaagccuuucuguggucuaagaaggcaagcgagaugguuuuuaacucagugucuguuuuuaugugccaugacuucacauuuuguugugguccacuugggccugcugaucuucugcccugggcugugggagccucuucugccuccuccagguucccuugggguuagccugugcacucgccaucccaccaccuugcgggcucuuuggggucaggacugacacauuucucaacuugguguccccagaguauaggggacggggcugccccuuguagggagguguggugacugauguaggggaagaaagggccaaaugcagucccagaacacugugauacaugcugguguuaauguuuauaauuaaaugagaaaaguaaaagauacaaucauauuucagauggaaacgcgcugguuuaaguuucauuauuuuuaauuauguguuugcaaaaaugucacuguagaaaguccccacaguggcccaucucugucauggcucccaggcugucaagguccuuccuggcugggaggaagcugagguuguauacaucuccccucgcccuccccacagcccagggaugccugugaauuacccaccuccuggaauccagcugcuuugaggcagcuugggcaugucuucaugacccaggaagaaaucucuaagcccagaucucccaaggccccggggccugagagccgcccccugccugacccccacccccagggccacagccauggcugucauuucauuaggccccacccuccguugauuggcaucugguucugcuuccugucucugcuuucaccuguguauugaucauuuuuuccuuucaaucgcguuucuuccuuugaacccugggauugcuuggaauuaccaugucuguguuuuccuuucucauuugugaucuuaccugaaaaaucuuuuuuucgauuggugucagugcugucaucucugcuguccuauggagugacacauguuuugggagauaaaccuguccuccuuguuguggcuugcccggcugugagcaucccaaugcuggucaaugcaggccccagccauggggcuucccaggucgugccucguuccaguuugcucccuucucguucucccuccuugccucauggguggcagcaugccuggcggacaguguguaccguugagugggaaggucuuggguuaaaaucugucauggguguuggccaucuccgagucuugauucagagaccauucucuccccacaguggacucugguuuuguauaucagcaucuaacagauagaagccagggaaaaccugcugaucuugccugcaguuccgccugggccauacacccagggacagggcuccucuggguggccuuggaccuucccaggcuaucuccccaggggccagacacaccagcccguggguauuuucugcagcuuguccuggcccucaccccgcugucacagccuggaguccagagugcccugugccacucugugugccuuugccaaagugggggaugcuuucucuggcgggggauauuuaucucauucuaacaauaaggguaauuccaauucuccuggcguuuagaagacaaaucaccacgggggcucucugaguuaaaugccauuacuucauuaccuugaagaguaacaaauggcccauugugagaaaugacaccuagaauaggccacugacauuuccucagauaaaauaacaagccagcuaaacagaccaagagagcgaggcuccugccuggcucacgcggcgccuggcucugcgagucggagcugccacagcccagcugcaucugugcacucaggcagaggcugucaaggucugggaggccuuaguucccuguuuacucuuauuaucucugaggaaaugucuccaugcuuggaaggcccuugaaagaggauacgucgaugggaaacuucucagaggaagccugcugaugauugcugcugauucaguucccugagaagaggaaauaaaaucagacccacucuaggccagcagaacguugaguugauucugcccaaacuguuuucccagggaggaagugaugccagggggaggccacuuacccuccugucuauuugcuuggcuuuugcugccgguccuuccaguaggaaaggcguuacgagggggcuggacuuggagucgaggcaggccuguccugcucacucccaccauugccucacaaagcacacugaucagcgcguggaggcuuaguuucugcaucugugaaccggcagaaauaacaccucccaccuugggcugccgugggaaauugggagacagggccuuucccugggagucccugugggggcuucaucagagggugugcucaggucaacccgggcuccugcgccagcagaguuuugagaccagacaccuugccacuugcuggagggagagccugcagcccggcagggagccgguggguggacagaaccaccaggagagugcuggugucaugggcacacccggcugggaggagggucaggggacagagccauggccagccagcagcacuugucauccuagccccgcauucgaggaauggggaacugggaccugccuuuuagggugaaaacaugggccaagagagugagggccugguugcacccgguaugcuguggacaaugguguccuucacaagcccgggucccaggaggaacccauccauuuccccaugccacugggugacuccgacaccuaacauugauguuuccaaucuuuaaagucgcuuguuuuccccuuuaauucaugagcaucuugagggcgucaggucucucacucaugucugugccuggugccugguguauagggacagaucccgcccacgggaccggcucucuguguccacauuaccccuugguggagacagcccagggucuaccagccgaggcaugcagagacgcggcguggccuggccguaggggugcggcucagucgugaagaggagugaggcauugacacgggcugccgcauggaugacucuggagaacauugugcucagugagaaggagccagucacagagggccgcagagccugauuccagcagugugaaauguccagaauaggcaacuccauagagacagaggcagguucgugguugccaggcgugggguggggaguggggagcggcugcugaaggguccaggguuucuuuccguggugaugcaaaggcucuggaacuagcggugacgcuugugacccuacucaagaccacucugucgcacacgcuaaagaguggauuuuauggcggaugaauuaucucuccguuuacaaaacccagaaccaaaucaaagcaauacccauggagugacugaggguccacccccagcaccccagagagaggagugaugugcgaacuggcuggaauccgcccacccucccacguucccgcaggucccgccauguuggauguguccagggcuguugccucccuguccaggcccucgagcgcccagcugcucacuccugcuggagggucagacacggaggcgcucuugcccuuuuauccugcugguucuggggugaaccaagaaccgugggagguggcgugucaccucgucucuuccagucacacacuucagugugaguuagcaauugugcagggcugcgacuggggaagcagcgcgaugggauaggacuguacacgacacgaaugugaggugggccucuggguccucagggagcacuuagggaccuggguucugggaccaguagguggggcugcaucuggcaccccccuccccauguguaccaggcugcucggcauagccacggcccugccccucuuuaccccgcuguuguccggggcucaaggguggugacagcagaguggugacagcugaaaugagcacgcacauucacagugcgcaggagagggccuggcgcgucagcagaccccggucaacaccagcggcagcaucauccguaucaggauugugauguuuaucugcuucaaccuuucuacauauauucuggguugaaauguuucuuuucuuaaagaacguuuuccuugcgaagaugccaugcaaauaaaacuaaaguaaaaaaaaauuaaaaauagggaagauaauuuuuaaaacauuuaugaguauuuugcuggaugacaacaguuuuguaaggaucuaaaauuaguuuguucaaauaucugauaagccauuucaauuaggcaucuguuuugcauuuuaaaaacuuuuagauuguguuuucucauucgguuuuuuguacuuuaagaaggaaauuauuuagagcgccauugucuguucuaucuuugacgcacaucugugguacggcuuucugggguuuugaucauagcauggaaguauuuacccagugcaguuuuggaaacucuaacuuuggaaagagguuuuuagaggaauuauugccaaaugaauauguaaauauaucagaagcagaguuuucaaaaucuuaggaaaaaacuuucagaucuguuaggauuaaguaauauauucuauuuucucucuuauuagaaugugaaaugccugagaagcaauaguuuauaauguauuaauuauguuaauuaauuggagaagauucagaauauuaauuaucugcaacuaauuagguguuaagauugagaagcauuaagugaugagguggaaggcugcaugagucauuuagcuagacugaugagaguggguggagggagcuggaugcaggcucagcucuguuccuccgugggcccccucgugggucgaggucccguguggcuaagucuccuugucuuuugcaugcucggcgccgcccagaggcagaggagguggacacgguggacgucuccggcgugcccgcagaggugcugugcaacaucgaggccgacaccuacuggugcaugagcaagcugcuggauggcauucaggugagcgcccgcgcccacgggacacagcccacgcccacagccccugcggugaagagagccugaggccuuaggcugcuccugagucucaguguggccaugcagucccuccugaagccucacuuuucuacaucuggaauagcacagaccccuccggguugacgaggggugagacacaguguaugugccccucguucugggcacggucacguguccugcugagggcccagugggaaggcgaggugcagagucugauccccugcugccugcagacuguagccaccaccaccaaauagggcacaggcucacgguagcuauguguguguggcuagcugugcuaagagggauccuccuuaaagggccucagaucgggggccacagcuccuggccucugacaccaggcugugagcccucgccugcaguauugguggccagggcuccaggugcguggggcgcugcagcugugccugcucccagagagcaacacgagcuggugggaguccccugcaccacaguggggacccugcgggucucugcaucagcuaggguuaguggcugagauuucuguagaaaagccacaggucucccagugacggccaauccuauggcaugguguaggggcagauucccacacaguaccugggaaggaccuuguugguaggugagucaggaaugaggacuggagccagcugauacuacagaggaacagcugagggggauggaugggcccuggagugggugugggcgucuuaguuuauuugaggccaguacauccuuucuagacacucgcuuccugugaggugcugugcuccacacccgggcauaguggcgaguaagggugaggccugcuccggaagcucacucgggguggaggguagacgggugaguauggcaugaggggacagaaggcacucgaccccaaagacccaaaggugggaagaaguagauuacaggggacagugaauuuugcugacagagcaggacuugucagauagaggagggucaaagcccagagcgcgguuugggucgguaaucguuuucugagggaccaaacaccaagaucaucacggguguucgcauguagauggcucucugcugagagcuggggccucccgggagggucugcauguucugccagcaucccuguuaucccagcucaaaggggggcccucaucugagagacacagagaugggguugucacuugacaucugcauugccuagcagggcuuggcuuuuccugagccauugcgguaaagguuguuccugauaccacuaagugaagaggucucagcucaucuacuugauucagaaucaucagaauauggcuuuuauagccuguggucuaagguuuagacuccaaguuuaauuugaauauauuagcuaaaagguuccguugaggaaagacgugugguuuuugcuguuacuuuucaugauguaggaaugaaaaaggagaaaguagaagccuguugugcgguuggagaauggaaaccucguaucuauuggcugguccagacuccucgugacuuacuuuguuccuugcaaagaaaaaugugcccacuagagauauauuuuggcccaagcaccaauuugucauuuccccuccuuuacuaauauuuucauacauuuuauucuuucugcuagaucuuucggcuuuuugcccccuuagaaaaaggauugaaucauaauguaaaacuuuauaaauuucaaaugucgcuucucugauggugagugaugggacuugugccauuuaaauacaagauuaucugcccucuauuuguaaauaaaaucugcuguacaaugaaaucgaugcuggcuuuuucauuuuucaccugagauuuguggucugaugcaaugguuuauuggcagggccgaugagugugagggaucaugcuuuccuggcgcguguguuuauagcacaucaccgucccguggcagccguugaucuucucucacgugccacgauggauuccacaugauccucccaggagcaagaguugagggaugucaguucccaccauccaggggacuuggcagcucagcugugauuccuguagauaaggccguccgagcagagcuccucuagcgacuaguguuuacaagcacugccgcuguuuuaaguucagagaaguaugaggcuauguacucacuuaaaaccacggcaacacgcagaccggcgugucagcucccggacgaccuggccgcuucugccucuuagcuccuuuuccuacucuuggucuuacugucuccauuucauucuuuuggaacugcucgaaccaucuuccuuaagcacccucuucaccacaucaucgcccugauugaaacccuuggggaagcucucucuugguuuucugaagugcaggcucucagcccggccuccaccaguuguucccagcguucuuucaagggcguguuuguucaucggcucuguggcagccguccacgccguugcugcagaggcuuuauuggagccgcugagccagaacugugugcugggggcucuuccucaccaggaagagggucuucaagggccuccuagccccacaguuucugugauugguaggcaguccccaugggaaugaaugugaggaacuaacauugucuucgccgugacggugcuucuuggcgugggcauucccgggacagguuggagcucgguuacacccagcacacaaggcugagacuaagagagaugaagcccauugcccaggugacguggcuuguauuaaaacccacguugacggcucugggaucuuuccuagcugaaauacauagaagugagucccauuugcagggaaguucuagagggcagaaaccacaucuauuuuuuuuaccuuuggauguccuggauggucauaacuauguuuuuggcucacuuuggagccucaauuugagauuccguauucuacuuguuuucaguaauuaguuaacuuugucauuuuggccgagauguaugaagcaccugccuucucucugcaggugcucagagaggcggaagacuuuggggugagucagcaucaccccucuguccccaagaagcucagagccuggugggauggagcagggggaguggacagcugauggaggcgaggacagaaugcugggagaggaggcucuuagcccccaguaagauggcaaacuaggaaaaagaacaaaccacuuuucucccgacaaaucccuggaaacguuaggugauuggucuguucucgcacugcuuaaagaagugccugagacuggguaauuuauagagaaagagguuuaauuagcucacaguuccacaagcuguacaggaaucauagcugaggaggcuucaggaaacuuucaauuauggcagaaagugaaguggaagcuggugugucguacagggcuggagguggagggagggguugggggaggugccacacacuuuuaaacaaccagaucucaugacccagcgacgcagcgcuagcagggauggugcuaacccauuagaaaccgcccccaggauccggucaccuccagccaggccacgccuccagcacaggggauuacaauucaacaugagauuuggguggggacacagauccaaaccguauuagcgguauugaccaaagauuguuuaacacgcauugugggacuccuuaacagcaaagagagguccuccaggagcgaacagcgcugacuccacuggcuggagggaauugucaggccagcucauggcuaggagugcaggcucuccugcccuggcgaggugugaucacagaagccaguccugcucagggagaucaggugcugcccagagcagggacacgggcucugccauugacaugcccaggccugugugccuugggacucugcacuacaaacauuauugaagagcuugaagagcuuuuguuuguguggguuaauucucuugauaacugccauguuggaaauucaaauagagaaaauuaaaaauauuuaguaauuuauuuaacaacaacaaugaaaaucccauuacauauuauuauaaguaacauuuuuaugauagauuacuauuuuucgaaacaaaaauguuuagugagaagaaaggcauuguuuuacauuuuuguaaaucuccuuaaugucuaacuuaauagaagaauucuuguaucuacuucuacauucaauuuguugugguauuuuuuguuuuagcugaagaaugugaagaaaauccagcauuacauagauacauaguuggaaaaggaagcguguuuuuuguuuguuuguuuguuuguuuuuuggagaugaagucuccuccaggcuggagggcaguggugcgaucucaguucacugcaaccuccgccucccagguucaagcgauucuccgccucagccucccgaguagcuggaauuacaggcacacgccaccaugcccggguaauuuuuguauuuuuguuagagacaggguuucacuguguuggccaggcuggucucaaacuccugaccucaagugaucugcccgccucagccucccaaagugcugcgauuacagguaugagccaccgcgcccggccaggaaguguuuuaauagccuuuucagguaauuuuggauucuuuuuucauucauacuauacuauuacucaacaaaugguaguuucuuaaaggguaguugugauaugaaaucugaaaccucaucagugaauguuuuacacucaguuacauuaaaguugguggccuaucuugcacuuugauaggaucuuuuacccauauauuggcucuguaacaucauucauuggcgauuuggaaaauauuggcugacugaggugugcagaucuuuuaaauguugauaaguuucaucguaugaucaaauuuguuaguauauuaccaccgucucauaagaagcagcugucaggcccaggguggcagauaaaagucuuccaaaauucagauuuuuaauuuaaaagcucagauauuaucauuggcaacaaacacaguuccuuguuucuuuugaagugacaggccaacuucauucauuuuugagaaaauaucuuccagagacccgcguuugaauaacugauuugucugcuaguccuucuuucauguaaacgugauguuucuugaagaaaguguucgguucagcucacagcugaagccagcgcaccaagugcucuccuugacgacgcuucuguuucuggauuugccccucaggcuuuccguguucuuccacguguuggucagggcugagccugagcgcaguguuaauaguaagaugagugaccuuuccugccguauccagggcguccugaagugaaacagccuuuugcuuucacaccaugagcgugugguauugggaacacagugacgguugaguguggugagggcacugcccugccugcugccagcaugcccgcaauuuuacccaccacugccuguguacugccagcacaaaugucagcaccgugaggaaggugaaucaugccuucauguuacuaugacagcaguuucaauauaacagaccccuugaaaggucuagggacccccaggaguuggcuggcuaccgucugagaacuucugcccaggagggaugaucuccugccacaggccuguggcauucccaugggaagaggcaucugcagaugaccucacagcagacgaaguacaaaccaagcagagaaggagugcgccgggaauaaauguuagcgauugcucucguuaggaggauuuguacccagagaccugagacacuagaacagcgauuugaaaggaaccagacaauguguaacuuuaaaauauuaaggagaaugaaacaguuuaaaauaaagacucugaagaaagaacucacagauuuauuuauauuuauuuauuugagauggagucucgcucuguugcacaggucggaguacaguggugugauacuggcucacugcaaccuccaucucccggguucaagugauucuccugucucagccuccugaguggcuaggacuacaggugcccaccaccacacccagcuaauuuuuguauuuuuaguagagacgggguuucaccauguuggccaggauggucucgaucucuugaccuugugaucccccugccuuggccucccaaagugcugggauuacccaggugugagccacugugcccggcuagaaaucacagauuuuaaauggaaccaaacagaacuucuagcaucgaaauuagagucacugaaauuuaaaacucauuagacaaaagagaagagagaguuaguuagaauugaauguagugcugagaaaauuaccaacugggcaacacagagagauacugaaaauaugggcagauuaagacauggaaagauagaauuuaaaaaauagaacuagaaagagaaauguacuagaggaaagccaauauuuguaaagcuguggcugggaauuuuucagcauugaugagauguuguuacuaauaucuaauaaaucuccagaaagaugaguugaaacuaauuaccuauggagacaugagagugaagccacugaauaagaaagagaagagaaagucucauaggaaagaagaaaggccagaaaaaaguagaauaaugugucucauguucugaagaaaaauagcucuccaaugagauuagauuuaaaaacagaauccagcuauaugcuacuuacaagacaccgaaaccacaaggagacagguagaaaggaaaugcaacagaagaauauuaaccaaaguaauaguuagguagcucuguagcccauauguagcuguguaauagccguggagcuauuaaaugagauagauuuuuaaggcagaaagcauuccuagagacaaagaguaucacugccaguggauacauuuaccagggaagaguuaaucuugaaugcaugaccuugacccuguauuucugcacauguacauaaguaugaugggagagggguggugguugucaaugccugacaugguccugagugcuucguuguaauauuaguucauuuucccucacagcaaccauaaggcacuuccaauuuuguggcuaguuaguugcagcauugggguuuagacccacacaguccaguaccagcuuuccugccucucagugauuaguaggugauacgguuaggcuuuguguccccacccaaaucucaccuugaauuguaaucuccauaaucccccacaugucaaggcagagaccagguggagcugauuggaucaugggggcggucucccccauucuguucucuugauagugagugaguucucuugagaucugacuguuuuauaaggggcucuucccccacuuugcucaguacuucuccucccugcugcccugcaaagaacgugccucuuccucuuugucuuccaccaugauucugaguuuccugaggccuccccagccaugcugaacugugagucaguuaaaccucuugucuuuaugaguugcccagucucgggcaguucuuuauagcaguaugaaaguggacuaauacaguagaucgagcagauaagaauuaggaagaucugggaggacguguacugcacaguuugggcaaauggacauaccuagacccccauauccagcacacagagaauauucauucuuuuccagugugcacagaagaucuguaagaauggcaauaccagcaguuacuagggagccagauagaccaaggucugggugggggauuagcagauugagaagagcauucuagacuaagcugggacuccauggugugggaucacucagagugcuuagggagcaggagugugggcuggagcuugaggcugggaagcuggguugauguuugacagcucuggaaagucuguccuuguggccugcaccagguacuugggccugaucacucaucucugguggauugaugcccuuccugcuaaguguuuaagagacagucuuuuuuuuuuuuuuuugagauggagucuuacucugucaccaggcuggagugcaguggcaugaucuuggcacacugcaaccucugccucccggguucaagcaauucuccugccucagcuucccgaguagcugggacuacaggcacccgccuccacgcccggcuaauuuuuauauuuuuaguagagacgggguuucaccauguuggccaggaugguguugaucuccuggccucaugauccacccgccucggccucccaaagugcugggauuacaggcgugagccacugcgcccggccaagagacagucuuuuuagucaggggcauuugguguugggggaaaaggcaaaacagcuacauuuccagaugugcuggucuuaggggagauggucuguccagcgaguaaugccuggaaagccacugcuggccuaccggucgugugaacaacgaaucgaugucauuggcacugcccugagggacgucuaagcuuguggagggaugugggauguauuuggaugaaggaggggauucaggagccuaaacuaggugguggcgggacaggcauuggcgggcaggugcaagagcacugagggcagcuguagaccuuguuggccaugcagagcaagugcccaguguggagcgguggcagcgguggggcgcccuccugccucauuagggcugcuuagaaaugucuggggugcuuuucagugguugcugucacugggagaugccgcugcguggacagcuccgccugggaagaaccuuuguggcaccgcaguaagaagcauuauguaggaaugcugcacuuguagucaucgggucugggcucaacauuuuccaccugcgugaccguguuagugacuccaguuggauggguucaucuugagagugaaugagguugugagacaaguccuguauuuuguggugcaauggguggcuuggaucuggcacggcagaccaucuggucagagguuuccacagugcaggagggugcccaggcuggcuugugggcagacagcugugagguggggcagggguggguuucccucaaggugggacaccacuaagugcaggagugaugaccuugagccucccauuuaagcgucauggggacuaauccucaauguugaggacagaauuucuguguuuucuuccugaguugugugguagcuuugauuguaaguacuuuuaaaaauucagauaaguuuaauuuggagaaauaauuucuuucuugucuuuauuuuucacuuucuuuccugauugggcuuucugcccauuugccugaguuucacucugugugugucuuguucucugggugaugugaguugggugggugugcacagguugaccguguguggguuuccgggguucuggcuuucuggaguaaccugggaugugagguuggagggaggguccuuuguggcucccccaaccagcuggcagaguagcuggugccagaaugagaagaccagguuuuuuuuuuuuuuauauuuuauuuuuuuucuaccaagugcacuaugaagguuccagccagauacuuaauuaaaaaaaaaauaauuuggugggcuguuucuuucagugguuucauggauguguccuuuuaaugcuauuugguauuaguagcuauguuucggggaugauuuuuaguguagaucacagaaacacaccugggccgauuccagcugagggaacacuucuuuaagaaggauugcuuuaacacagcauguuggcuucggggccugaagauaacuggcuuugagugugugcuuucugggcaguggaagcugcugaccuagugcuauuucagccccucccucucucuggggguuuaaacuugguauccagugagaaguuccaggcugggcugggcacgguggcucaugccuguaaucccagcacuuugggaggccgaaguggguggaucaccugaggucaggaguucaagaccagccuggccaacaugguaaaacccugucucuauuaaaaauacaaaaauuagccgggcaugguggcgcgcgccuguaaucccaucuacuugggaggcugaggcaggagaauugcuugaaccugggagacagagguugcagugagccgagaucgagccacugcccuccagccggggcgacagaaccagacuccaucucaaaaaaaaaaaaaaaaaaaaaaaaaaaaaaaaaaaaaaaagagaaguuccaggcuggaugaggcccucucaggcuuuuaggggauuauucuugcacuuuugccagucuuuucauuucacuaacagcacucaugccaagguugucgguucgcuauuacuucuugaauuacagcuuccauauuugccuacccugaagucauacugcuacucuuagguucacuacugaacaggacaauuucuuugaguagaaaagaaccauugccuuuuauaauuagucauuuacauuuccuuuccuuggggaagaauuauugaauuccaagaacuguuugguggcauggagguaauaggaauauuggggaaagugacuaaauuaucucagaacuugucagagaaaaggccagaaacgcaguggcgucaugacuccuuuagagaaaggucaggaaacggccaggcccaugacucgggguggaguggacucugccugugagcagguauugcccuucagguggggcuggcgugaguugaccauugauguuaauaccagggaggcgacaggguaguugggggaagcccuguccugcacacuaagcuggggagauguguggcuucuuacagugcuugcucccagagggggccagccaaaggcaguugaggggggagccuccgccaugaguucaggagccucugccaugagcucaggcagcuggaacuuagaauggacuaagccccggggauguuguuaucugaaagagaauaacaaaggaaggacuggucugaugcccaggaaguuggcagagagaaagcgcacuccagcugagcucugauuuggcauuuguuguauacgucaagaagcagagucuucaccuggacggggcaguggagcgcuugguggaggccuggggugggggaaugaaugccuggagcgccgaguccguuuagaugugucaaauccacaccugccccagaugccggcucaacugugccccuguggggaagaaucucagauacaugauuucagagccccagucaauaaaauugaggacuccugccaagauuuuagaaagguuuauuaaacagaaaagaauguguuagucacugggcucugacagaagguucauuaagaaugaaucauugagcagcaagcaauuuaaaaaugaaaauuaaaaaauucaauuuacaguagcuuugaaaacccuaagaauccgugucguugccugaaugaauaguugauuccuuuuaauuacuaaguaauacuccaccgugugaaucuaucacaguuuauccauccuccuguugguggcagccgaggcuguuucuggucuugggcuguugugaauaacauuucugugaacacucauguccacaucuucuucuaguggccuguuaaguucuggcuguuccacgucagaaugcgauuucuccaacacugcguuccccacagggucuucauuuauuccgauucugauagcaauccuuugucaagacagauauuuugagaauguuugcuucuguggcuugucacuucauuucauuaacaaugucuucuaugagccaacaguuucaacuuugauaaaaucgaauuuaucauuuuuuuucuuuugugguaauaguuuucuguguccugccuaccuccacaaugccaacauauacccauguuaugauugauaauuuuaguuuuuugguuuuaggucuacaaccuagcuugacuuaauuucuguauaugguguaaggaagaugucaggcuucauuuuuuccucuacagauauccuggugaacauaaugccauuuguugaaaacaguuuuguccuauuucacuuuugcugaaaauuagaugauuguauaggugugugucuguuucgggacacacuguuuugucccauugacguacaaauggaucuuaauccaguucacacugucuucauuacugcagauuuucauggguuggguaaggccaguccucuuuguucuuuuaaaaaauuaaguauuuuugguccuuugcauuuuuauauaaaguuugcuuuugccacuuccuacaaaaaaaaaaaaagccuguugagauuuugaaugagaauauguggaauuguaugucaguuucccucauacugacaauauuagcaauauugagucuucuuacccgugagcguaguguauuucuuaauuuauuuagauauucuuuaauuuauccucacaaacauuuugcaguuuuugguauaggguuuugcucauacuuugucaaauuuguuucugaauauuuuguuuuuuucugacguuccuucaaauggcauagcuuuguugguauuuuuugcuacugauuuguaguaaaucaauuuuggauugauaugcuagggguauauacaaauacaguugauuuuugcaagcggacagcuuuccagggacugcuguagcauaacaaaugacucccaaacccucugacuggaggcagccaugccuuugugcucucgggcucugugggucaggaucucugucagggcaugguguggacggcugauuugcgcaccaugaugucuggaaucucaggugguggcuggaagcaucuagacucccguucauuuaagagccuggcgcccugggccuacgugacucuaagaguaggacuuuggguuggaucgcccacuccuggccucuccacgcgcugauuguccucguggcaugguggccuugggauagucagaccucuugcuggaugguacaaggcucccagugagacucuguccucaaacaagguggaagcugcauuuuucaugacugagccucagaagucacacacuguacucagaagucaugcccccuguacgcuuuugguggaagcagucacaagucuauucuaauucaaagagggagaaauuagucuccaucucucgaugccggaguggcauuggucaccuccugaaagagcaugugggacaggagagaauguggccacuuuuggaaaauacccuacuuguaucuaguaaucuugcuagagucacuuauuauugcuaggagcuuguuaguagaugccuuaggauuuucuguacacgaugauguuaucagcaaauaaagagacucuucuuucuuugcaagacaaaugguuuuuauagguauaccuuggagauauugcauguuugauuccaaaccaccacaauaaagcaacuauccuaauaaaacuagccacacaaguuuuuugcuuucucaaugcauauaaaaguuauauuauacuuuaauuuauuaacauacaauagcauuguaucuaaaaaguguacauaccggaauucaaaacuacuuuauugcuagaaaaugcgaaugaucaucugagccuucagcaaguuguaaucuuuuucccagcggaggguguuuucucgucuugacagcugcagacugaucaggguggugguugccgaaguugggguggcuguggcaauuuguuaaauuaagacagcaauuugaaguuugccaugucaguggagucuucuuuuccugaaagaguucccuguagcuugcagagcuacucgauggcauuuuauccacaguaggacuucuuucaaaaccccggucaguucucccaagcccugccacugcuuuaucaacuaggcuuauggaguguucugaauccuuuguugucauuucaacaauguucacagcaucuucaucaggaauagcuucugucucaagaaaccacuuucuuggaguccagucauucugggaaaagaaaagaaaaaaaaaaagaaaccacuuuuuuuuccucauuugugagaagcaccuucucauccauuuaaauuuuccugugagauugcaguaauucaagcacauuuucagacuguuucuaauucuguugucuauuuccaccauaucuguaguuacuuccuccacugaaguauugaaccccucaaagucauucacgaauguuagaaucaacuucuaacuugcaguuaauguugguuuuuugaccucuucccaugaaucacaaauguucuuaauggcaucuagaaaagcagguccuuuccacaggguuuucagugggcuuugcccaguucaucagagaaaucacuucuauggcagcuauagccuuaucaaguauauuucucaaauaaugacuugaaaguugaaauaacuccuugauccauggucugcagaacgaauauggcaucagcaggcaugaacacaacuuucaucuuccugcaugucuccaucagagcucuugggggaccaggugcauuguccaugagcaggaauauuuugaacaaaaucuuucuuucugagcaguaggucucaacagugggcuucaaauacuugguaaacccugcuguaaacaaaugugcugucauccagguuuuguuguuccauuuauagagcacaggcagaguacugagcaugcuucuuaaggguccuaggauuuucagaaugguaaaugagccuuggcuuuaacuuaaagucaccagcugcuuuagccucuaacaagagagucagcugguccuucgaagcuuugaagugaggcauugacuccuccucucuagccaugaaaguuguagauggugucuucuuccaguagaaggcuguuucaucuacauggaaaaucuguuguuuagaguagccaccuucgucaguuaucuuggcuagaucuucuggagaacuugcuacagcuucuccaucagcacuugcugccucaccuuguacuuuuaugcuauggagacggcuucuuuccuuaaaccugaugaacugaccucugcuagcuuccacccuuucuucuguaacuuccucacuucucucagccuucauagaauuaaagagaauuagggucuugcucuggauuaggcuuuggcuuaggagaauguguagcuguuuggaucuucuauccagaccgcugaaacuuuguccacaucagcaagaagccuguuuugccuucuuaacauucguguguucacuggaguaacacuuuuaauuuccuucaagaacuuuuccuuugcauucacaaccuggcuguuuggcaaaaaaaaaaggccuacuuuuggcuugucucagcuuuuugcaugccuuccucaccaagcguaaucuuucuggcuuuugauuuaaagugagagaaugugcgacucuuucuuuauuugaacacuugacuuaacccauuguaggguucuuacuuggccuaauaucaaucuuguugugucucagaaaauaggaaggcccgaggagagggagagagauggggaacugccggucagcggggcaguuggaacacacacaaaacauuuauuaaguuugcugucuuaaauggcaugguuugugguacccuaaaacaauuaugauaguaacaucaaagaucacucaucacagauccccauaaaagaucauaaugaaaaaguuugaaauauuaagagaauugccaaaaugugacagagucacacacacacacacacacacacacacaauaaauaaauauauauauauuauuuuuuauuuuuugacagagucucacuguguugcccgggcuggagugcagugaugcgaucucagcucacugcaaccucugucucccaggcuuaagugauucucccaccgcagucuccugagaagcuggaacuguaggugcuugccaccacaccuggauaauuuuuauauuuuuggguagagaugggguuuugccauguuuuccagacuggucuugaacuccugggcucaagcgagcugcccauguuggccucccaaagugcugggauuacagaugugcgccaccgcgcccggccgcaaaauguaaguuuuauuuaaaaugaacucuuauagauaguuuauucuugcaacuugcuuucuuaacuuuuuaguguauguuuagaccacauauauauucaucuaaucuguccaaccuaauuauuuauacgguugggguuuagguugccauuuuccuauuuacuuucaucuuuucuuauuuguucuuuuuucccuaccuucuuuggaugaauugauuauuuuuuucaauuaauggaguuugguuuuuuuagagcaguuuuagcuuuccagaaaaauugagcaggagguuagagaggccccaugugcuccucagcguccuccuucagccccagccucccugugauuaguaucucacaucacugacuucaguguggcauauguguuacaauugaggagccaauaucgauacauuauugucaacuaaaguccacaguuuacaccaguuguaggccguggguuuugaaaggugugcagugacaugaguccaccaagaaagugucgcacagugucguccccugcccugaacacccucgugccccgccuguucauccccuuccacccaaccccugggcuuuuuacugucuccauaguuucaccuuugccagaaugugacuuaguugaaauccugcaguuggaaccuuuucaucccacugcuccugcugcgguggcuucucuccccguuggcuugcuggcugucucccucccgcgccggcguucgugacggcucugcuccucgccgugugcgucuggaagugaccauggauggccuccuccugcuggugugccgcuuuacucugcugguuggcccgugucugaagacaagggacagucacguuuccagugguuuacagaggcacugguuccucuggccuggcuggguugggagccuucagccuuaaaccacuguuugauggcugacacaucauggaaggugcggaauuagggggagguuggguuugcacucuauaugggcauugucuuagguucuuuuagacacaguaacucaguaccgccugugcccuugugauggagcccuuccucucuccauuucacagaugggaacacagaagaucagagaaaugaaccuggcagguaggaaagcaggggguuugguuaaacaaggcugcauagaaucugacacguuugugcucugagggugcuuucugagaacaugcugccgagccccguccuuggcccugcccuucccuccucuuggcagagacuguagugaagacgucaaggggauccguuuaaccagugccucucagcugggagggauagcgaaugugauagauggcacaaucaagauucagaauggguucagcugccugcagugccagccgggaaccaaucaaaugaaugagcuaauaggaacaaauggcaaguccuacguucaggugcaugagccgagcagucagcucagcagaaggcaguguggacaguugggguucacuuugucuuccgugggaagcgcguguagucacuuugccuggauuacggcaguugccucgugaaugauaccccuccauccucauuuggcucauuccauuguuucuacaucaucuuuccguggugcaaaucucuuaccugcaguggccuccauuugcauuucauuaccugcguuugagagcauugccugggucucaccgcugacuccgacguggccuuccagccucggaacggucuccucuugccucagccgcagcuugcucgcugcccuccagcugcccuggccuccauuucauuucugggaugugacaugcucccucgggccgccggggcucugcugcauggugccugaacccucucucucaucucugcucagaccucacacccuccaaguggucuuccaggaccagcccugguucugugcuaugaugguguggccacccagguccucguuagcagucaaugugcacuugccuggcgagugaugaacauuggcucagcugucagacugucaucccugugaacagaaggguccugucugccuguccacuuuucucccugucugugucaggggaucccaagacgaccccacagagccacacucguggcugugauucuucacagugcaaggaugcagaggagacuccaucaagggguaaaguccagaggaagcgguauaagcuuccaagcccccuccuggcggagucacacaggacacgcuggaucccuccagugcggggcugggacgacccguccgaaacguugccugcuggggaagcacauuagagacucagcaccgaggauguuacuggggacugggcaugcggacacucucugcuuggcaugugcccaaaugcagccucccaggaggagagcaggugcccagggugaaccacccugcacaguguaggcccgccgagucauccagaucagucagggaaucgugggaacucuccugaaacccacauucuaggcaccggccggggaccggccuugcaagcaggacucuccggggauagcauucccaggccugcguguuugacuccuucgcacacaucgauacucaggacuugauuuucuggcacguaggaggcuuucagaguugaacagaugaaagaacuaguaucugaugugguucugccuuccgcuggacugaugcguuaauggcuuuaauguauuaauggcugacaguggagugcagcugugacaggaggcuuccuagcucuguccuugcguggucagagcccagcuucuguguucagggcugguggccaggggcccccgagaggauguggaagggagucuuaagaguugaaggaaauggaagucucucaggccauugcuugcagaaaagacuucccgagguguuucagaggcaggucaaggccugggcguggaaggcacauuugguuucaauguggggaagacacuauguuacggugaaauuagccuggaaagaagaggcuggacuuuguggggagguggaucccugguccagguggaagagcacuuugucagagaggcaggagggagucuaacuucuccgugagcuggcagguuugacucuggguacuuccaggugagcugauaggaauuuauauuucgacucuucucuaaaaugcucccuaagaaaauuuuauucuacuuuucuuccaaaaagugcagaaaguguuauuuguuaucgggaagagugugauguuguaauggcaacagguguaaggcaagcugagcguauuuuuaaaaauuuauauucacagacuucaccuucugugaaacauuucacaacagaucguugucuucagcccuuccucucuucccucugaugcauauguuuuauaaauuauauccuuuuuuaaagauaccagaucucaauuggaaaggacaugcauacuuacuuuuuaugaagggaauaauguuaauauuauuacuaaugacauuuuuauaaguguagaggauucuugcuuaguuccuguuuugcugcccagguacguguucaccagcacaggugaucugggugccaggugugggaggcggggugcugggcuggggugucccgagggcaaaucugguuucugggccuuaagcagacagagccugugaucuacccaggggccuuggugcagccugcgggcagcugcugggagggccugggcggucagugccucccugggacaggcugcugcgagggccaugggacauucuuuucucccuccuuuccucagccaccuggcucuggauuccuuggccacggugucugccuccuuagagugcccuugaaggcuuccuggccccagagcggggccuucugcaggcugggcucaccucccgagccaggagccaggagggcccagaccgaccccccugugucuuagccuuggcgccucgcccucgggggguggggccgggcgucccugcuacagccuucugaaggcuggccuucuccgccccuagccugaagccagaaugccgaggccauagcugucagucuuugcaggucuuucaaaaugcaaacauuuucucuuucaaaaugcagaccuuuucguuauuggcucucaggugucauucuuuuuuuuuaauuguuuggauuucugagaauccgucuucccuaccuggguuuugaacaaauugagaaauaaaacaaaacugugccagauggaggcaaagaauaacuuuuauuucugcuaacugagagccuaaaauccugucuuagugggagagccaccgaauggcugacugaucccaggacccaucaggcucacccaccccaucagagccaguguugagggccgggcccugcccaccugcuguggagccucuugagaagugcaaggggcugaacccaccuucgccucuccccguuuuggccuccauggggcgagcauuucugcggcuagagcaaguccaggagaggcagcagcugcgcuccaagcugacuccaggucugucuguuauucacauaaccaucagggaccuggacagccagggacguggccucucuuggaguggaagagaucgcagucccucaggacagaccaauggggugguuagaaugugcuccccauggcuccggaauuugucggaauaggacauucauuaaauaaucuuaggaccucuguguacuggaggcugccacaccacucucagguuuacuucucacccuuaauucugugcagcuauauuguucaaccgggcucaucagaauuccuccacgagguuaaauuacaugauguaaacuugcaacacacagugugcccuaaauuuuaacaucagugugcuccuguuauccaaucucuggggagaaauuaagucuuaaaggcuaaccauugcaaguucaggaccaaagaugaugacagucaaaggaauucaagucuggagccaaaauuucuuacuccuguuaaauuucaaauauacgaaagcucacaauuuguccuuagcuguugcugcggcucccucucagccggacaggugccugggucucacugacaccaucgcagcuccuucagggccuaaaaguccugcccauuaaacaccguauuuuggacagccaaauucaggaggccuccaagcuucucccugaaucagcccacgacaucuaggaaacauaucauccccaggcccgggagcagucacuccagagauccucuccccggagcccaucccuccugcuacacaaggucaccggagggccuuggcgucauucuaagugaagguggcaaacggaguuuucgugguucugcccucagagaugugacaguuuggaauccagagccugucacuugaaauccaccugggagaaaucccucagcaagccggcaggucugacucggcucauuuuccauuucuagggaaagaaaaauccuuagggccucguaggcauuuuuuguguucugugccacaguggcugccaugccugcucuuguuaggagaugucaugugugcucugcgugugugcacgcacuuugugugugugugugugugugagagagaaacguagagagugcuggcugcguguguucacauuugacuuuccagacuugggaaugcugcuggcccgaaggcagucgcucagcuccacguuugucuuaccuggggucaccuccuggguucuggagcuggggguucugugagugcuguuuccacgucacuggggccucccgagggcugacacccuugcugugugcccugucacccuuccuccaccugcggauucugugaacucuguggccgcguccccucacagcacagggaggccugccugguugaccaccucgaggaaccucucuguacuggaggcugccacaccacucucugguuuacuucucacccuuaauucugugcuugaaccguuuuccaguccugagccuauggaaaaggaguaucaguaucaagcccagaucagucuuucgacuucccuccugggcucugaaugccgggugccacguggacagcugcccguguagaccugccccgcugccacgcaaagcagcaccucccuccugccagguggugccugcagaccccugcccccucaggcgcacaggcagcagaucaucccccacugucggaaaggcugcccugaugcugccugcuacgagccagcaccugccugguggcccgagcccacuuggugagcugcaguugccugugcccagcaccuccuguuuggaccaagacugcauuaccugugcccuuacugaggccaguggccugccuggcuuccccuagcugagacucauggggccauccccagugucacucccugagggcagagcugccacaggcagucaucucccagugcuggccgggccagaggcccugugugcucacuaaagaguuggaagcguaggccagaacccacaggagccccaggcacagugcccguuguuucgcugccucccgauucuccuuucuccacgggugguucauggauuagcaaccuuaguuccaccugcaacccugguuccccuugccauguaaggccacacauccacagguuacagggaguggaaccuuggcaucuuuggggcugguuauuauucugccuuccacauucacugcuguuggguauagauuuaagucuguuaaccacgagucugguugaaacccuccuucugaaaaugcccccgaccaccggcugaggcccaaagggcagccuccauagggaaugcccuucccuuguugaugggagcugccucuucauguuccugcugugggaugaggcagcacccccuagugucaugugugugcucccuuagguggugacagcaggaguaauggaccugucacugccccgguaccugcugugucuugaaaucucuuccacauuccacuuguuuguuucccugaguccuagaaggcaguguuauuacucucauguuauugguaaugaaacggaagcccagagagguuauguuacuugccaaggucacacagcuccugaguccuagagcuggggccccauuccugggcuguuugacuugaaacugcccaggcccccuucccuuugaugcuaugcagaccuuccuauguuagugucugaacuucaccugaguucacccaacuauaucucugagaguaaagucacauguccacuguuuucacccaugcagugacugugucauuagcauuuggacuguggccacgaugauggugcugucagcaccgggcaccuuugccguugguucccggcagggcugagugcuuaggguccagguggccagcgagguggucaguucccacagacgguucuggucaaugagcuaugcccauggaugccuguuuuucaauuuagauguaagugucuuacauuuacaaauagaaauguaccauucaguguucccugagaugcacgugcuuaucaccugacaucgggaaauacuggccuuucccuucucaaaauagcagucagcggcgcugugcugugcagggugcauccacuuguguguuucucgagauaaaaucucuguuugugaauucguccuauuauaaagcuguucacuuuaucccagcugccuuuuucccuuuuggaaaguuuguuuuauuuuauaugcauaugauucacauuauucuuuuuuccuuaggacaacuacaccuuugcccaaccugggauucaaaugaaagugaaaauguuagaagaacucgugagccggauugaugguaagccagcuucccgcgcagccccucucugugggcggggggagguggcccucagcccucggugggacagggagcuguccucauccgccggcagcauccuggccugcucaggaucccucaugggcauccuucugagacagcugcuggugcgugagcugcucuuauuucuucuuauuaaggggauaucaucagaauucaguacauucacuuugcaggacaguagugagugugcacccaaagcaggcagugcucacuccuuauuaagccuggugauugucauaaucuaggugacggaugguuguuuauggugguccuucgguacucuguucccugccucugugcaucauuuuucuaucaaggaugcuagaauaauuucuccauggaaucuaacuaauuacugagucuggaaauaacaucuuuaauauuauagaaaaauuauaguaugugcucaggcaauuuuagauugugcuuucauguuuaagugggggcuuugaaauacuuuuugccuucaucuuuaaaauaauccccccugcgaugugcugacugucauauuacaauagcagaguuuaauuaaauggaagcugagagauaaugcuugcccguuccaggcauauucuccugauaguuuguuaaauuaaugaacagagcauuaacuaagugaugccaagcagaaccgggcauguauuugugauaccagcuggucagugaugagguguggaaaagagacaugcucuuucacaaagagucccaugcgcgcuuggcaaauuauuucacagaauguggagacaaauugcacuuuguuggaaacuuagcccuggccacgugccuugcagggcccugcccgcugagcguugccggucacugugccuuuuccccucccugcgccuuuagcacagaaggccguaacagcagucuucacgggaagggcgcucgguuugggaaacugcugagugauauucuaaaauggacuccuacaaauuacaaacuccauuuuguuccuugauugaaucugauuuuuaacucugugucucauggugauuaccuaauuuccauauuaugaaguugucugcaguucuucugauaauacuuucaguguuacguuuagcugcuuuucaacccaucaucuguuaaaaauaccguuuuugccuccgucagugcguucaugugcgcucaccgcacgcuccaccgcgcggucuuguuugggugcggcuggguucuuuucccugccagcacuuucacaagcauuccccagccucacugaguucucugaaguaugauuugcaguagaugugaauuacacguuccucugaaguaugauuugcaguagaugugaauuacacguucugagcagguuccuccuuuuccgcuugugucccuuggaaggcguauuucguguuuucguggagguuagaaaguugugguuagugcucguuuguuccggugcugcaguuugggaaauacuugaauugauuuucucuggugcugugguucagaaagaagcacauugcggauucgcuggaugauuguuuaagagagcagcagcgauaaccaaaggaaccccaacgaaaucuguacuuuuuaguaaaucauauuuuuauuuucagcgcagucucugaguaggccauuuucauauggcaauuuuuuguuuaaaggaucagugcuucacaacagagaaagauguguguugccguugagagguuaaacugucuaacuuguuccuguucuucuaaugaaaccuuaaggaauuucuaucauggccucauaauaagaauacccaggcugcuaaagcaguaaauagacagaauuucucgcguuugagcucucagacuggugggcgccaucaucccugagcaaacuugggagaagcaucugcaggucucggccacgugaagcucccccucaccuguuucaucacuugccuccuagagaaaggauuuguggguuggaacuuuuugcagggauuguaaagauuuuauuaagggcagaggauauucuaggaagaaaaaauugcuuaaagaaaaaaaaagcuucucaggccgggcgcgguggcucacgccuguaaucccagcaccuugggaggccgaggcaggcggaucacgaggucaggagaucgagaccauccugguuaacauggugaaacccugucucuacuaaaaauacaaaauauuagccgggcgugguggcaggcgccuggagucccagcugcuugggaggcugagucagaagacuggcgugaacccgggaggcggagcucgcagugagccgagaucgugccacugcacuccagccugggugacagagcgagacuccaucucaaaaacaaaaaccaagccucucccucuuuucugcguuuuaggagaaggacagcauuuauuucagaaaauuuugauaauucagugaaggaaaacaucuucauggacucguugauuaagaauggagagguuuugagggcauugcccagaugggaauaguucagaaaagagccgaauugcucugcaaagucaagcggaaguuucagcagugguggcgcgaggauaagggcucaucaggagcgagcagagagcuggaggagggggaggucuuggggauggagggaagccuggugaggggugagagggcagaucggaagaggggcugcaucacucuuguuuucuugugguaaggaguugugaaagaaucucucaaaagcacuucugaguaguuucuuccuaucuugaguaguacugugacccuucuuugucaucccuaaaccuuuaguaaaagucugccguggagacacgaaggugcugagaaugaagagagagggcugugucuguaauggaagccgcguggaaaggaggaugggcggcagccuucgagggugugugcugggcagggaguaaagcgacaggcaagcccgcagauggggaacucccugggaagcccccuguauccuucgggacagacauuguaugaguucccacagaaucagagagggugacuggagccacugaauuuggagugaaagaaaaaggugagaguaggaggaacgugcguuuucagucguggcaggcuagauaauuucaaccacauuucccacuggauaagaccuuuuuguuuuuuuaaauuaagccaacaaagcaaaaagaaaaaaaaaaaaggaaagaaaaauaaaugucuuaaaagcauugaauugcuaucuacaaaauaaggacuuccugggccagagugaagcuaggaccuggcuagguaugcccagcucuaaagccaccaguguucuggguguguguuuccugaugcagaagaaaaaucaucccaaagcugguugugguuugggcgccucauguagugccugcauccaacccgauuagucaggauagggaucugagaaaugcccauacaguuugugagacccagaauagugacacgugagggcaaaguggacgugauacucccucauaaaaucuagguuccaaccugagaggaucaggguuguuugaaccucaguuaugaugauucuauacuggaguuccccagaaugcuagugagaagcaaaacaaaaucuugucuggaggaaguuacaacugaaauuguauuuuuuucuuucuuucuuuuuuuuuuuuuuuuuuuaauaacuccaaacaccuuuuucaaauaaagugacccacacacaugaacccgggaggcggagguugcagugagccgagaucgcgccauuguacucccgcccgggcaacaagagugaaacucuaucucaaaaaagaaaaaaaaaaaaaaaaaaaguugggugauguuuuugugaccagaaauaugccauugaaacuuaccucuuguuucugucaaucacccugugguaaaauugguuucauuauaugucguuuugcuucaggucagcuucugagaaccuguggaugauuguaaguggguauuugguggcuagugcugccgagcuccacaggcaccagccuagaaaggacuucagagauaagagcauaaaucuggaguuuuaacccaaauuuaauucuuuuauauaaucuuuuggaauauuuuaagggcuuggcauuuuucuucaggaagaauaauuuuucugaaaaauucucgaaacaaggcucauggcuaaguggaauuaaauaacuaaaaguuaaauauaagucuuaaaguuuauuuuguuuuauguuagaauagggcauguguccagcaacuccacaaaaaauagaauuaggaugucgccuaaucuguauuauccugccuuguguuacuuaaaauuuaauaagcauuuguaggcucaaagaggguaugcuguucuuucuaaaauuaucuagcuaauguguucucaauauuucuauuaauugucaaucuguucccuacuuagcaaaggauuuuguauauaaaaucaacaguucgcaccaauuauuuaguaauuuacugcuguaauaauaaauguaccuuuacucuccaacugauagaauuucagcguauaaagcacacgaugagauuuccacuccguauuacaucgagaacgcuuacaccuacuugaaauuccacauuuuugcagugaauccuaaugacguccccuguacauuuuguuuuuacaucugucacgucugauguuaaccucugaaaucacaugaucccuguuuguccccaagauagaauggccagaggagugggcuucagcccuagccuuuccaaaggcuggagucagagccccucugugugaauucuggggccagccccaccugguacucagugucaugcaucuuuugugacauagaugacgucuguauaaaugagauauuugcuacauuuuuugauuaaaaaaaccauagagaacuuuuuucaguauuuuaaaagaauauuugaaaccucagcagauguguccauuugauuauguccauucuugauuuuuucagauuuaagaguagaucauaaacaacugcauuucagaucagagaauugucccauugggggugacacuggcacuaaaagggaggcucuuggauuguuucuggugccacagugguggugccagggcaccguuggaugaggggagugggaagagcuguucccuggggccccgguucuggugggcuccacccucacguuguucugaggggacuuaaggcugggaggcccucaugggucaggaggagcugcuggcaaaaccugauaguugcuaagcugaucugaacuuagcuugcaaggagcagcagcccagaggccuucccagcaacagcaucgaagcugucgccagggccgccuaggggauguaggaugggccacagccaugugccuucugaguuuucuccugcaaacugugccuuugccucucuuuaguaaaaaauggaaacaacugcaucucucuaccuucuaaccccacggaaccuccaagggcuaggggcgccaaacugagcaaauaaaaauagagaacgucuaguuaaacuucaauuucauauaaacagugaacaauuuuuuaauauaaguaugcccugagcaguguuuggcacacacugaaauucagaguucacugauucuucuguauuuaucugguaauccuccaggggugaguucugaguggggugaaguggaauucagacccaggcuugagcucuagguuacccuuugcuccccgagguuacagaugacaagaauguggccuuaaauguaauguguuauuugaaauuaaaguauacgcacacacacccuacacacacaugccuguacacacauacccuacgcacacaugccuguacacacgcacccuacgcacacaugccuguacacacgcacccuacgcacacaugccuguacacacacacccgccagauacauauacacacacccuacacacacaugccuguauacacacacccuacgcacacaugccuguauacacacacccuacgcacacaugccucuauacacacacccaccagauacauauacacacaccuacagaugcaccccuguauacacacacaccccuacacacaugccuguauacacacacccuacacacaugccuguauacacacacucuacacacacaugccuguacacacacaccguacacacacaugccuauacacacacacccuacacacacaugccuguacacacccuacgcacacaugccuguacgcacacacccuacgcacacaugccuguauacacacacccaccagauacauauacacacacccuacacacgcaugccuguauacacacacccuacgcacgcaugccuguauacacacacccuacgcacgcaugccuguauacacacccuacgcacacaugccuguauacacacacccuacgcacgcaugccuguauacacacaccuacagaugcaccccuauauacacacaccccuacacacaugccuguauacacacacacccucauauacacacaccccuucacagaugccuauacacacaucugcuauauacacauacacacuccuauacacacaccccugcacacaugccuauauauauacuccucauacauacacacaccccuacacacaccccuauauacacgcaucugccauauacacauauacacacacuccuauacacacaccccugcacacaauccucauacauacacaaccccucauacacacaccccuauauacaugcgucugccacauacacauauacauacacuccuauauacacacaccccugcacacaacccuuauacauacacacaugccuguauacacacccagcccuacacauaccccuauauacacacuccugccauauacacauacacacccugcacacaugccuauacacacacacuacuucacauaugccuauacacacaccugccauauacacaggcaggcuccuguacacacaccccugcacaugugccuguauacacagauaccccucaugcauacacaccugccauauacacauacacaccucuguauacacacucagaugccuauauacacacacaccuacacacaugccuauauacacacauaccccucauacauacacacaccugccauauacacauacacacaccuacauacacaucucuauauacacacucagaugccuauauacacacacacuccuacacaaaugccuguacacacaccugccauguauagauacacccacacuacuguacauacacacaccccuguauaagugccuauauacacacaccccuauauauacauaccugccauauacacauacaccuacauacauaucccuauauacacauacccuuacaucuguacacaccugucauauaugcauacacauacaugccuuuauacacacacaucccuauacauauagacaggccuauacacacccaccauauacacacaccugccacauacauauacaugcaugccuguauacauacacaccuuuguauucacacacucuuacacacgugucuauacacaaacacaugccuguauauacacauaccacuauacacacgugccuauacacaccugcuauauauccacaccccucauauauacacacaugccuauacacagaaacaccacuauacacacacccccuacacacaugccuauacacauauacacucacuccuguauacagguacccccuacacacaugccuauacaccuacaccccucauauauacacacaccuccacacaugucuguacacacauaccccuaugcacgcaccaauacacauauauacacauaccccuauaacacacacccuuauacacacaugccuauacacccaccauauacacacgcauaccuacacacaccuagacauaccuaccugccugccuguaacacacaccuucccauauucacacauacccuccuacacacauaugcauauaaacauacacgcaaaccuauacacacacacaccucuguauacucacauacccccuacaaacaugccuguacacacacacacacacccacacacacacccauauacauauacacauacacaccuacacagauacaccuacaugccuauauacacacauccucauauacauguacacucccguauacacacacacaccuacacacauauccaauauacacacacagccuuauauacacacucuccauauacacaccccccauacacauacacagcuacacacagaugccuauacagacacccccauauacacacacaccuccuacacacaucuauacacagacacacacccauaugcacacacacacacccuuauauauacacaccccuacacaugccuauacacacaccuacacacagucccguauacacaggugccuauacaugcacaaacacaccccuauacacaugccuuuacacacacacacauguauuuagacacacccacuuuagauauguuuaaucucauuggcauggucacuguguuugaggcuauuuauguuuccauauucuuggggaauguguuguugcuggucgcacauuuccgucgcuugaugugucagaggagggucacccugucuccuccaggagagguuauuguugguggccaaggacuucgauugagcuauaaauaaacuuuucucauuugacuuuucacagugcaggcaucgcagugaggcugcuuacccagugauugcuuugaagugaagcugcccuucauuaguuuuggucaauuucuggcccauuucugccaucuuauuauucucugaaaggcuggcuuaggacuucuugacugaucuggugaauguauucacaaucggguggagguugaccgcccuguaguuggcuggaucuuggcggugaccccggguggugagaccuuaggcugugagccugcguccacagcacaucuucuguggccgucucaggccacccaggccggauggcggccacccaggaugguggccccguugaucugacccuguaggagcugcugacuucugccuuucagcuccuuaaucagcuuugcguuuucuccccccgcucuaguggcgguugcaccccagacccuccaguccucguucuccagcccuaggccaugugacaccacagccaggacucucaggccucugccuuggcgcuuccuuuguuccugacuguuccuuugucuaaaacccuuucuugcccuucugccgccuucccugacaggcugcuuuucauuugugcccaaccacaccaguucuuggugcugcucagagguaggaggaaguauugcuggguugagccaagggugaguagcaugaaacaagugucacacaggagcuugggcuucagagagcuuggagcuggggacaauaacgcauaagcaggaaacagccagaugccagcccaagaaggacucugugccaugugcucgauggugcgguacaccugcugggaggggucugcagguggccccuucuucaggccagagacaaaaaggcgcuaucagaaucccagaaaaaugucacugucacauugaccucgacccaggggucccaaagcuccugggucccugaagaguuuucuucugugauguuccuccugguuuggggccaucaugaguacuucugaauuggguugguagugugccacagcuggcucgcugugccuagggcacugggcaggcacagaacauguguccugcaccucugcagagcgucuccagcaggguggccugggaaccacgcagaugaaaaggcagcugcuuccgacagugacugauaagugucacagagcuacaggugcauuguaagagcacaugggagaggcagaggagcccuugggaaggcuuuccugccccagagauaaaauggcuuguguuugcuuggacccauaauaacauaccacaggcugguggcuuaaagcacaguuuacuuuaucaugguuuuggaugccacaaguccaagaugaugguucuagcugcuuugguuucuggugagggcuguccccuaggguuggguugcaaaaggcugccuucuugcucacauguagauauagcccuuccugggugggugccuguggggguagcggugguggggagggguggcagugggagagagagcaagcaggagcucucugccaucucuuauagggacacuaauccugugggaucagggucccacccucacaaucgcauuuaaucuuaaucacuuccuuagaagccccaucuccagauacagccacacuguguguuagggcuucaacauagcaauuuuggggaaacacuaacauucagcuuggaagugugggguuuagaccaagauacaguucauggaagaaaugaucaucauuaucauucauuagcaggaagcaugacucuugucuugggcagguggagcagaagaaucaaguuucaaauauuucacauuuuccaaaucaaaauaaugccaugagggaaggaagaggggacucuucauuucucuuugaaaucgagucuuugaagcuuuauaaucaagggcaccaaaaaacaccagcaaauuuggauuuuguccauugaaauggccguuaaggacuuacuccagaaugcugguucaugauagauggcuauugacgaaaugagauccuuccaauguuuguuauguuuguucuguguggagcucucagugugcuguggguugaggaugugagcaucuuggggucaggugcccuuuucucagcccucuccauucauuuucuagccuggagggagcagaugcagauagcuguggguguggccuugauaacuggcacuugccaacucuccccagguguagaguucccucauagaguuggccuggagacccugccugggaccugaaccaggacagggccuucucacaccucccuuggauccacauuucaggaccagucuuuguggaggcugauuuguaaggcagccucuguguccaguguaucugcccaccugcugugcagagcauccuaacccugaccugguccguaucugcaggaaggauaggacaacgaugggcugcagcaaggggcaaggcugcaucuggaaggcagccugucccugcccagggugcuuccugaugaucucagggcggccagugcuggccccuuggagugaggccuggguacaggcauugagagaggcaggagagccuucugucccuucuuccagguagagcaaacaagcuggugccuguaaacugguagaaaccucaggaacaggcugaccucccaccgggaaguuagaaggaaauuaguucccuauguuuugguggcugagugacagcgaaaaugccaggccaggagcaacaaugggagauuuugguuuggggacuaguuuguggguuagaggaggaaaggacuuauuagaaauaauucucgaacauuucuggcuuauucuaaucuacucuucagcucuguggaguaacagcuuggaguuuggaagcuggcagaauuggguugacuuucuggcuguguuguauacuggaggauuggcuuugugaggaauguccccacucuagcccuuguuuccccaugcaugacgggucaugggaguaaaguacuuacaggagugccuggcacacuuaagucucaugcaguguuaguacccauuauugucauuaucaucaccaucagcaucaucaucaccaucaucaugauugucaucaccagcaucauaaacaccaucaucaccaccaucaugucaucaucaccaucauuaugucaucaccaccaucaucaucaccaucaccaucaucauuucaucaccaucaccaucauuuccaucaucaccaucauugugucaucaccaccaucaucaucaccaucaccaucauuucugucaucaccaucgucaucacuaucaccaucauuucaucaccaucaucaccaccaucaucuucaccaucaccaucaucaucauugccaucaucaccaucauuacgucaucaccagcaucaucaucaccaucaccaucauucugucaucaccaucaucauuacuaucaccaucauuucaucaccgucaucauuaccaucaucaccaucaucaucacuaucaccagcaucauuucaucaccaucaccaccaccaucaucaucacuaucaccaucauuuccucaccaucaucaccaucaacaaacuguacagcaggauggguccaugguggggcugaguguuggaaguuuagucugaaggccucugcuucucccacguuggaccuuguugagcugccaagggcccuguccaugccugcuccugaggcagccucuucuguccagcccccagggagguugguuggaguggaagacacuggcugagucugagucaggggcaccgaggugacaguggccauuguuauuagucauaucuuacacuuucaccuauaaggaagaaaaugccaacaaaacgcgguacuggagaaugguuccaccugugugggaaacggcuuuauguaccugaacauuuucccuuuccuguguuuuuaauucagguuaaaugugauuuuaaucaaauuucucugaaaguugucuugacuaccucguaagguuaaaauugacuuauucuuuuaagauagaauucaguuacagcuaggaaacuagauucagcuuuauuaccacccugguggaaauauuuuuauuaccccuacaaaguaagcagccgagaagcagaggauaaaucagcagcgcagccaggccggggaacaggcagcguggcucccucccccuggcucucguccucauuaggcuccagaagggcagagcugagcguuugaaaugauagugauauuucaucugagacguaaggacaugacaauuggcaaggcacaugcguaauugcuguuaugugcgaccuaagguguguguggacuuucugggaggcgugcugugugugcuggcaagggcugcauuccugugcuccugguuuccugguucaggcagagucuugguccccuucugcuuagcaggucuucacaguugaacauggcuguuuauucugugacccaggugacucugcuuaucauugucuguuggaaucauuuuggugaaccugucugcagccuggguuccaggcuaccccaggcaggaauuugcucucuuguuggauggauguccugaguuucuuaagucaagcugauuuaaugugcuuuccauugaaacucuaaauggauauuuuguugcauuuuugggaagagggaugcauauagaacaacaacaacaacaacaaaucaaagaaauagaaguuucauguaaacccaaaaauaauauauuaggaauauacaccuggguucuaguucagccucggucccugacucuggccuugggcugcugcggggaaugaugauaauagcagcuagcauugauucagugccugcaguguacugggcacuguucucagcucuuuaucuguaucauugugcugacuuuucauaacagccccaucaacugcauaaaugggccccauccccguacucagaguccugccuaucacugaucucagcuuccccgcaggcuggaugaucuccagguugcuuccagcgcugcccauccuggguuggugcacaggagagagcccucccaguuccucccuaccuacuugggcagccuugggguguccugugggcucaggggacuugccugucucugcuccaggguuuccuugggagccgcagccugcagcugugccuguggucgggcccucuaccuccacuccccgcgcuuccuccugggacuccugaccagcaucuugugccuuauggugccccgcccaccucaugacccugagaacugggagauuagaaggucgaaugugcccuuuugaagugaggaguggucguugcuucuuuuuuggcuucgaccacaugccuacauuuucaucccgauguuccccauaaccaaugcccaguuucuagagcggccucagcaaauguuggggaacuaagggauaaaguguuuaauggagcagccugcacguuagggcuccagcagccuguguggcuucacauugcuucaacauagcucaugggugacacuccccugcuuaaagaggauguuuggaguggggauuuaaagcaguuucucuguuguuacuuuugucuccagauguuuaugauuuucuuuggguuuucuucuuagcuuuuguuuucccugaggaucucaaauccucauccuacugcccuuuaauucauagaauagaaaaucugcauguguggaaaagcucuguaauuuuaccagugcagccuaugcugcugcuacauccccuguaaaagugacagaauacaauguuacguaucuaguauaaaugaugaggaugcuugcugacucccuugcuuacaucugagauuugucuugccucaaaguaaauccuuucccaccccgcucugccuugguggccuuguccccaccccgcccccagcugauucugcacacccuucccuguacacucaccugugggccccucggguugacuggccucucccagcaaucgaccaucgugcugggaggagaggcuguguuuccucuuuggaagagccuugaucuggagcgacaaucuucacauuuauuuuccaccaccccaaaguuguuaagguggucaaaggaggugaugccugccagggugcuuugaaauguuugguuccgcugugaaaagcuggcaaaagucugaacagaagauuccaugagucagaggguccuggggcucacauccccccagcccuccugccccugagccauuaaaacccagacuagcccagcacuggugcguucuucucuguccccguccugaaccugccaggcuuucccugagguccccaggcaccaggggauuauugucaggccccucacugucguccugggcccucggaaucaugccucugugcccagaguggugcuuuggaagagggguauggccuugucacugggguccuucauggcccucaccuguuucucuacucuguuucuuucuaagcccugcugccuucccggcucuuccugcauuccuuccaauuucagcucauuuuaagguauuccuccugaacaaguagagagagauucauuuucuuaaaacugagggacagcuuucaucccacuuuuggacuguggccuucagguaggaccacacuucagcccccugcaggacaaaaggaguagcuuauucuuucagagcucgugcugauguguaguuggcucaugaccgcggaggacauucugcccuacguuagaagacgggacauuaacaguuguuccgagagcucauccuuccaggccuguacuuagcacagaaucauaaaaaacuugcuguucggagcagaggguccucugagauccucuggccacccccacccagucugucguauggcuuuuggaaagccaucgugcuccaguuacagccgagcugggguggaccgggagagggcucccugcaucuggcccuccagccucccgccccgugcgcgaguggagcuggacauagcacuugcuguggagcugcugggcacugccucuuccacugcaucugucccagucgcuuccuucccaggaucuuugaggugcugggagugggaacagccaaauugcgguuagcauuuuucuuuuuagcugcucaaguguggaguguguuuaccaccaggaagugguggugaccaugcuguguguaaugaaaugcaaacacgugaggccucccuggcucaugauccagccacuuuucuccuugugaugauaucuuugugacucuccacaccgagacugauguuugggguuuauugcuaaacugagaauaguuaauuaaauuguaaguagagacauacaaauaaagugauucuccuugaccuuagcaagaaagagcugucgugguuucgaauauaggccgucagacugguuuugaagugauucccaaagucguugcugaucaugguuacaaguagcuagagagacugugucuuuucucuucuucauuuuaaggaaccagugucccucuuaaaaucaggcuaggaggccgcauugcagguggaaacgcauugccuuuccgggccagggcuugcuggggaugaggacaguuuauuuugauggggucauuuuccuuuccacaccauaagccauugguccugaaauaaaaggcauuggucccagcauuggagggcacaucccgucuuucuacuccucucuacccccucgucucucuagacccuggacugugaguaccuucugggucaacccuucaggguaagggacauucccacucuucucagacccacagucaccuaggccucccucugcagucagaggucugugucgcugcacacggccaguccucccacucugcugugccuggaucuccccauccagagacccucgguuugacccucugccgagcggaagcucuggugaucugggggugggcgcuggacccaggcaguggggcguguggggaugugcagggauggcuguggggucuagcugcugauuacagaccacacuccuguguccccgccaugccccucuuuggggaugcacagugcugccagucucugaugggggcucaucaggugcauccgggcuaccccuggcuuucugcagcgguggcccgggcuuuugcuuucucaggccccugugaggaccacuccuccaucugcuucccagguccucccaucuggcuuucuccccuccuugugugcauugaguguugacucuucugugguuuuugugaggugcugggacggggagaggugaauacagguguccagagcccucugaugacucccauagccgcaggccucagucugcgcugccccagacuagacccagggccccaucaguccccgcuggacaugccgugagugugcuuuuguauugagguggcucccgcucgcagccaugucagggcccggggguaggggcagcucccuccagugcucagcgcucacugcucguuaagccuacugucccuaugccccaccaagcagccccauccuucaccucacuuacuucucacggcagcuuguuagguccgaacuaacaguaucuccgccugaccaacagggaugcugaggcugagaggggacucuuguccgagucacgcaggugaaacuuggagucaggauuggagcuugggucugucgucucuggaccuguugccugcugccccucagccagggcuccagcgcggccugugugugggguggguguggugggggggacugcuccagucucuagcuguugccaugugggggccucccccagccauauucugccagggagccucuugauguccuugggacacgcccagcuaccaacagagccucccucucccuucugagcugccugggugacugagggccccaaggggcuuauguucacuggcccuguccucccuggcaccugugcacacaccugcacagagcagaaggaauuuggacccauagguucaccucuuguaacucguguacauggcccagguguuccugaugccccaccugcgggacaaacuggacgcagcaggguguuuugggggcacagagccaccgucggagucacacaucgcacacacccagcaagugauagugugugaccggacauggugcugaagguggccuaugucagccaugggcuuggugauuuugagagccaggaugcgguuccuggcgcaggugccugggggcgccuagaggagugcgagacucccgagggucccucugccuaagcugccuggggagggcggcucgcuuuauuuaauucacacgcucaaagcauuucaggaacaaugaaugccuucggcccucuguuuaaaugacugaauuauagaggugugagggggccacgcccaccccguuuuacacuuggcgccucccuucuaauuucgaggaaaccugcaauucagcuggaaucuguaauuuucuacuugaucuugcucuagcuguucucccaucauagcucugugagcacagagagcuccagaaggaauuguuucuugucuugcgaccacacacauauaauuguucugguugaacacguuuuacugugcgguguccaugcgggcugcucccggacagcagcagccaggaagccagggcccagcauccaagaggcagaccugcaggaugagagauccaacaucccuggccaccagccgccucgugguggucucagccaggaggagaagggagccuccauccucgaagcagccuggcgucuggagcauuucggggucuuggccuuacgcugcccuauguagccuggagccaggccagccgaggagccugggcuucuccucauguccaucugucucuuccucuuuaaucccuggggaaugcagccucugcuuaucugccacucaggccccugcagcccccuaccuggucuccuuggcguccacuggcccuccacacuccacgugccccccugggauggcagagccacuaaggauggaaguagggguuccugaagagucagcagcaugcacuucccugguucugucccggcacgcuuccugugaguccagcccuccagucaugccagggugccugguuguuaagauuguagaagcuuuuacagugggcacuggcgcccugaacuccugagugcacccccuuuguuucagcccugggaacuuuggugggcaaaaguucccaggaagccccugucacacuuggugaccugucaggcagccuggcaggguagcccagacccugcugugggugccaucauccuggcgggcacgugcuuggucuucaucccccaccuccccgcuacaugagugguuaccuacagcuggcuggcccucccccaaggaacccucauguggcccagggaagcugccuucaugauacucacuguuaaguguuuugaauacaguccuugccccagucagcuugcucaggugucccuggagaacgagccccuccauuggcucauccugaggacugggcugggaagggcaguaugugcuuguaggacaccgagcucuuugcccgauagugucagugggagguuccagaacucugccgucccgaagcucuuccacuuaggauccaggagcccaccaagcuccuguccuuuguccgcugcacgaguccuuccugugucugcccugcuguccucucagguggagccggucucacauugcugcgcuuccagucacagccguauucguuucagaagcugcugccgcggaugucaucgugucucugccugccuggguggcaugcggagggggcuaccggccugccuccugcagagcugcugcguggcuguugugcuccucagaguccugggccagguucuugcccucuggggcccggcgagccucccacugcucucagguuugacgcaccugucccaguguccgcugaugguuuugucugacgcgcucaggccugcgauggucgccgauggcggcuuuuucuaacucuaguuuuccuccauuuguuaguugguuuucuggccgugaggaaaagcuuuucuucuccuguuuauugggacuuggggauucucacuuuauuaccaguuacaagucuuuccugucauuaaugguguugaugcucuacauuucccaagcuuggugcgggagaccuuuuaaggauuuuuuccaugggaagaaggcaguaauagaguugcucuagaguggaaaauugcauuuuguaugaaagucacaugggcgcaugggagggcuaaggagacgguccaugcagggagauaggagaagacaggagggccacacaugaccagguaguaagcccaaggcugcggucuccgggcucaggugaggggucgccuucuucucugagaugggguugggagaugugggagcugcccucccugaguguugggggaaccuggagcugggcguugggcaggcgccaugaugggguuggcggcagaaugcuggcgaggaggugggcucugggcacacccagcggcuucugagacacacaugcgcucugcccucccucggauccugugugccaugggaaugccagguggggagggagugagguggggacacucaggcuuugugugacccaucagaaaacggaggaaauugugauuugcucccagucuaaggcguuacgagaagugagaauuuuucagggaucugugguuacauuucagugcuagaaaagugaaaagaacucauuucugucagaaugggguaaggggccucuuaguucuuuguauguaauggugaugaauaaaacuucccuugaaauuuauccuuugauaaaggaaucucauuuuuaaacaccuuccaucuauuauuuaaaagguuuggagcucagugcccaaguaacuuuguccugcucucuugguagccgcgaacgucccuuuaauacguuccauuccugcaugcugccuguggacaccucugcagugguggggcugcuuauggauauggagguggagcagaaguaguuuguaaugggcagucacauucccaggaagcucugguguggacaggugccccagagauugcucaggcaccucguucugggcacugaggccugugccaggcgugggggcccagagcgaccugacucuggccguuccugcuuccccugcgucaguguggcugcuggcacuucuguucuuccuauccauggaaggggcgcccauggaggggcggaguuuucccuguguuucgucugcagcggaguuucugcguguucugcuggaugcguguggaucugugccguuggucuguucugggcgcacaugcaagcccaucacgucucauucuaguuuuuguccuugauuuguuguuucagugacaucagucacugcaugaagaguacaggugcccccauuuuaaugcaaucugaggagacagacauuggcuagacugcuuuuaauuuaagccuccucuucucugccugccguucggcucggcuguccugccucuuggaaccaguccgucuguccgucccacucucuccccugcuugggcugacgacacacauucaugugagucagucacuguugguggcuguuuagugaauggccacuugggccacgucgcugagcaccaugaggcauuaagaacaucaggcuuaggcucuaaagaugcgugagcugggacacuggcuugguagcacucccccaccaccgugucuccugcucaccggucgucaucgccaugaggaguggguccugguggugggcggggccaaggcugcugaaaauggaggcgacugggauccugggugggacgaguggaaacacgggauccucagggcccucgccugucacucacauuuuucuggaggaauucaguauguggcauacuuaagcaguucuccuuuccuuccccucauccuccuccugucuuagccagacguuccugucagcauagcacucacugugggguccugacagcccccgugcuccuuggagucaguuacucagcaagucuuauccagccccuguaguguuggaggcucuggugcaggagacagugagcaaggccagccacagccccucuucacucccgcgccucccagcuggccuggcgcccacauccagcacagggagggagcacggagccugcguuuguucacuuuccgaguggccucccagugcgcuggguggagcgggcagcaccccuccacuguccagcggucccagcaccugcucgugccuccuacucccucccagccugguggcuuccggaucaggacaugaacacccucacacuucagcaagcaucugugaaacguccacugugugcugggaccugaguggacagugaugagcuagacaagguccuucuuagggaacucuucucugaugagauggcagauugggaggacagacgggagccgucacuggcuguaguuucugugacagcgagcgugaaggacugaguugaagaaguguccagagaaagcugugcagagguugggacaucggugcugagucucguauagguguuugggggcagaggaagcagugugggugugcagggagggaggauggggcagcagaaucagcagugggggcugugggcaggcagggguagugauauggggcaugugggauagagacguugugggcaguggugugagcagucgggggugugcagggaaggacgugguuuggaaagugcuuuucccggaagguaugcuaggaugauccauccuacccauccaucccucacuggcugacccauuuaacccuccauccuuccccucugccuuaacccuccauccuucgcuucucccuuaacccuccauccucuccucucucuuaacucuucauccuuccccucucccuuaacccuccauccucuccucucccuuaacucuccauccuccccucucccuuaacccuccaucaugcccucucccuuaacccuccauccuccccucucccuuagcccuccauccuccccucucccuuaacccuccauccuuccccgcugccuugauccauccccccacccaugucucagccaucaguccauccaucgauccauccauccauucauggaaaacuuuuacugggucuugcucuuugggccuagggauggaaaggaauggaaagauuucaugucgucaugagcuugcauucuuaugggaggaacagccuugcaaaccaccaaggccacuaaugugcugccccugccucacacaaccuacaggucacccagucagcugaccagcagccgguggugggaggcucugggaucagggucacagcucagacucucaguggcaggauucucagccauacagugcgucgggagagagggacucuauccggggaagcucugcgucuucaaccucgcuguagacuuggguugcaucagcaauuucuuacugcagaugggaugacucguuuaucugaguaauuugugcuguuuucacugggaguuucuuauuucucuguuuccuucuccauuuaaaacaaggguccugccuguugguguggcacugucugucaaccagagcuuucuuguuccucuccugauucucugccaugccuggguuuccaagcuggaguuugggggaauccugagccaucuccuccuugccuugcugcaaaggagagugcagugcagucgguggcuuuccuucugccaagacaaaugcagugaaugaaugugguggacaggcccuaggugacugccaugggucaucaccugccuuggugucauccccucuccuggaguucaguuagagucugaacuuaauucuaaucgauggaacaugggauuguaggauaucaauccuguaauuauauaauuacaggauuauauaauaauccuguaauuauuauauaagacucccccuuagcaagcaggagcuagagauuucccuuugcuucugaaguaaggggcuggccagagaagcccacauggcaggggcuuauaggcagccuccagcccacagcuggcucaguccuguagcugccaaggagugaauccugccugcaaccugaaugaaccaggacacagguucuuccccagucaggccuccugaugaggaugcaggccugauggcagcuuugugaagcccugagcagggaaccuagcagaacuccaccuguagccuggagcccugagcagggaaccuagcagaacuccaccuguagccuggagcccugagcagggaaccuagcagaacccuaccuguagccuggagcccugagcagggaaccuagcagaaccccaccuguagccuggagcccugagcagggaaccuagcagaaccccaccuguagccuggagcccugagcagggaaccuagcagaacuccaccuguauccuggagcccugagcagggaaccuagcagaacuccaccuguagccuggagcccugagcagggaaccuagcagaaccucaccugucgccuggagcccugagcagggaaccuagcagaaccucaccugucaccugucaccugagcagggaaccuagcagaaccccaccugucaccuggaguccugagcagggaaccaggcagaaccucaccucgagccuggagcccugagcagggaaccuagcagaaccucaccugucgccuggagcucugagcagggacucuagcagaaccccaccuguagccugggcccauagagacugugacccauacagacucauaaauauauguuguuuuaagcugcuaaguuuaugguaauugguuacagagcaacagaaaacuaauaaaaugaacaaaggacaaauaaucccacagagucccugucucccucccgccccagugcugggguucagggccugcuccucucacuucaaugcagcucugacguuccugggucaggaacugccacccgcuugccaccccgcccacuguuggcaggcacugcuggcuguggcaguguagacagggcugaguggcuuacagugagggucucagaagggucccaccaccccuuccacuccacaggcugggcauuuucccucaaauagagaaaagaauacaaucaggauuaauaaaaaaucacagccccacaguucauuuacacuugaucagggaaaugagcaccaaauguuggacauuuuuccuguuuccggucaacauugauguuaaugaucuccaaacaaagaugcuuucagguuuggugacagccuguacacccagugcucuaguucauguuuucagggagcugacucacucugcugcuugaaucaacugaaagcuggaaaaaaauaugugaaacaaugguuuuuaagauacaggacauaaggcagccgggccaucccugggagggaggaaaaguacagggugagcuccaugauugcaugaaagcauugccuggagagagucucuggagcauggugucaggaggcaccugcaggucucccugaguuuagacagaacagggagucuggggaagccacggcaucuggggguucuuagggcugaggcugggagaggagaaagcaacucagaaccaaaguucuggugacagagcgagacucugucucaaaaaaaaaaacaccaaaacaaacaaacaaaaacaccaaagcucugcacggguuccuuucagguauuaagcugaauacugaucaaugcacggaugugagguuggggaagaaccgcuugaaaugaugacagagaacaagccucagagcccuuacaggguggaaacugugucuguucuccaaagcaagaacggaaaacuuuagaaguccccggcaucagguaggggacuuagaaggguuuuccuucaguagugguaguauagaaaccugaacgaaauacuacucuggccccaaagcuuaaaaacaggaucccacacaauuaaucuguucccaaaugacuuaauugcaucccagcaaaaauucaaagauauuuauaggaauaaaaaaauaucagguuuccaacaagauaaaagugacaauaucuagcuuucaaaggcauugucagccaugcacagaaauggaaaagaucgcagauaaugagaacaaaagucaaucauaacugacccagaaaugguacagauguuagacucguuaguuaggcagagucauuaaagcagguauuauaacuguauuucauauguuaaaaaucuggagaaauagauaaagacauggaaguagagacauggaaguuauaaaaaugauccacauugaacuuacagagaggaaagaccaugucuuaaaugaaaagcauacugugugggauuaucagcagauuagacuuuguacaagaaaagauucaugaaccugccaacacagcaauagaaacuauucaaaaugaaagagaaaaaaaugaacagagucagugaacugugggacaauuuaaguagcuuuauauaccuguaaucugugguccccuaaagggaggaaacagaaaaaauauuggaagaaauaauacucaguuaaaaaaaaucauauggaaccuauaaaccuguagaauugagaaugugaaugaaugccaaccgagcagaaaacaugaagaaaaccagaacaaggcaugucauaauccaauugcccaaaacuacuaauauaaagaaaacaucagaagcauccagaggagaagagacacccugcauuacaaagguaagcaugacaacagcagucucauuggaagcaucaagccuggagacaagggagcagccuguuuggacuauucaaagaacagcaaaccagagaaaccuguuaaccagcaaaaguaucuuucagagauggaggugaaauacgugcuguuucagacauauaaaagcuaaaggaauucgacaccaggagaccgggauaccugcaugacaagcaauagguaaacuugcagguggaaggaauaugguccuagaugaccguguggaccugcacaaagauugaggagugcccaaaguggcaagucuaggaaugcauugaaacacguuuucuuguuauugaaauaucuucaaaaacaaccaaaugguuaaagcagaaacaauaacaguguacuguggguuuucuaacacaugccgcggugcgaugaagaugacaggagcguaggcgucggcagggagagauggaaguacaucgugguaaggcccucacgcugugcugccugugaagccggguaaucguaucuggagggaaacugugguaaggcagggacacauaccaucacccuuacagucaccgcuaacauaaccagacagagcuauggcuaauaagcuaacagaggagauaaaguagauuauauaaaauacucaauuaauauaaaagaaggccaaaaaaaggaaaaguggaacaaagaacagaugggacaguugggccacacuaauaguaguauggcagguucuaacucagccauaucaguagguguguucaaugcaaaugaucuagacacuuuaauuaaaaggcagaucguguuagauuggauuaaaaucaacacccaacuguguccuucacucgaggguucuuugggcugagggugggagaggagaaagcaacuccgagagaaccaaagcucugcagggguuccuuucagguacuaggcugaauauaguuuccauacuuuagggcaugguugcucaaacccauagucccagcacuuugggagacugacacaggaggauuacuugggccugggaguuuggaaccagccugggcaacauggugagaccccgucucuuaaaaaaaaauuagcugggcauaguguaguggcagacgugugccugugggccuagccacgcgggaggcugaguugggaggauugcuugggcccaggaagucaaggcugcagugagccaugaucacgcugcagccugggugacagagcaacacccuguccccugucucaaaagaaaaaaaagagaaaagcccacaaauaugaagaagcaaauaguuuaaaaauaaaauggugggaaaagauauuucaugcuaacaccaaucuaaagaaaacgguaaugucuauauuaauggcaaacaguagauuucagaauagagaauauuaucaaguaucaagaggaucauuucauaugauagagugggucaguuaaucaauuggacauaauuuuaaguguuuaugcguccaauaagacuguaucaaaauacacagcaaaaucagauaaaaaugcaacaagaaauggacagagacacagucacugaaggagauuuugagcuccucucuucaggaaguguuagaacaaguagaaaaucagguuauaagaagcuugaaaacacugucaacaaacuugacuuaauugauuuuuauagaaaauuccaagagugcacauucuuuuuaauuuugcacauggaacauuuaccaagauagaccauauuuugggccauuaaaaaaguuucaauaaaucuuaagggauucaagaaauaugaaguauuuuuuguuuucucuuagcacaauggaauuaaauuagcaaucuuuagcaagauaccugggaaauccucaaauauuucuaaaugaauuaacccacuuuuaaguaacccauguaucauagaagaaacaaaagggaaaugagaagguauuuugaagugaaugacaauaaaauccaacacuucaaaauuugugggaugcaaaagagcaguacuuagaaacguauaguacuucccuuagagggaaaccuauagcacuaagcaguacuuagaggucaacguauaguacugagugugugagaagaggcuguauuuacagggaaacauauaguacugagugugugcgaagaggcugugcuuagagggaaacguauaguauagagugcguggcaauauggccaugcuuagagggaaucauauaguacugagugugucagacgaggcugugcuaagagggaauuggauaguaccgagugugugagaagaggcugugcuuagagggaaacguauagugcugagugugugagaagauggcagugcuuagagggaaacguauaguguuguagagaagugcagacugguauccaucaugagcauaaauguaaggauccugaacagauuuuaguaaaucaaauccaacaguacacaucccgaugauguaggguuuauccuagaaugugagguugauuuucagucaauguaauucuuauuauuaacauauuuaaaaagaagaacaaacccauaaaaaucacaucuauauaugcagaaaaaucauuugacacaauccaauauccacucucaauggaaacucucaguaaacaagaacagaaaggaacuuuugaagcuggauaaagagcauguucgauguuuaaacccauagcugacauaauaggaaagggagggugucaauggaaagcuuuccccccaaaucggaaaccugggacaguguuccuucuuuucacuucuguccgguguguauacgggagauucugguggcagaaagacaaaaacguacauucauuuauucguacauacauagaaauguaaguggcaucuagaccaaaaaggaagaaguaaaacucucugcuuuugcagacaacaugaucaucuuuuuugaaagucugauggcauuuacaaaaaagcuacuagaaagaacaagaguuuagcaaggguucaggauacaggaucuacauacaaaaauaaacuuuauuuuuguauauuaacagugagaaaugagaaauugaaauugaaugagcaauacaauuuauaauagcaugaaaaugugaaauauuuagggaaaacacuaugauaaaauauguaauaggccuguacacugaaaacuacaaaacaaugcugagagaaaugaaagaugaccuaaucauguucagagaucagaagacucaagaguauuaaaugucagcucucaccaaacugaucauacauucuacucaauugcaaucaagaucccacaugcuuuucuauagaaauugacaagcugauuuuuaaauucauauggaaauacaaacucccuagaauggcuaaaacaacacagaaaaagaugaacaaaguugaaggacuuuguucacuuuuuucuuuuuuuguguguucacauuagcugauuucaagaauuauaaagcuucaguaaucaagacagcauguuguugccauugagauaagaaaagagaucaguggaauagaagagagugcugagaaauggaaccgugcauaugugcaaugauuuccaaaaagguacaaaagaaauucaguggcaaagcauauauuuguuaugcguauaaucguuacauauguugagcaaaugaagaaguuccaauugaaaauucacaucagaggaaggaguuugaauucauauuuugugccauguuaaaaaguuaccucaaaaugaaucagagaccuauguuuuguuuuuuaaauuuauuuuuauuuauuuaacuuuuuauuucuauagguuuuuggggaacaggugguauuuggugacaugaguaaguucuuuaguggugauuggugagauuuugguguacccaucucccgagcaguauauacugaacccauuucgggguccuuuauccuucacccccuucccacccuuuuccccugaguccccaaaguccacugugucauucuuaugccuuugaauccucauggcuuagccugguuggggugggagacuagucuucuaagugaaguuaacucagagaccuauguuugaaaccuaaaauuauaaaacuucugcaaggaaacacagagcgucuuugugugaccuuaagcuaggcaagcaagauuucuuggaauaauggccaaacccucacacauuaaagaaaauuuggacaaauaaaucggaccuuaccaaaauuagaaucuguuuuucagaugauacuauuaauauaauaaaaagacaagcuaaagacugggcgagccuuccagaagugcgggcugcgacagagccuagggccaggccugccuucuggacucucccugucuuguccagcccacuccuccccccugggcagcuuugaacugcggguucccuggccguggagcacagucagggccccuggagcuucaggcacccagggaagcggcuccgucaucugcauuuuuaaaggaaguaaaucagauuuguuguugccuucucauauggaaaugacccuguuuuggaggggugugcugaguagcucgugugcacgucugugaggugaaaaugauuuaauaccuuguugcuucagugccauguagcucuagaagaaguuguauuuuagauuauguuacugucaaaaaaauagaccucaauaccucucuagagaugaaaagauugcgugcuguggcgucagauaaacaccauuucuuuacaaccugccaggaggauuuauuucauucugcacucauguuuacugagauucugagagugaguggucgcguuccugucccucggucccugucccccacggcccagguucugagagugaguggucgcauuccugucccucggucccugucccccacggcccagguucugagagcgaguggucgcauuccugucccucggucccugucccccacggcccagguucugagagcgaguggucgcauuccugucccucggucccugucccccacggcccagguucugagagugaguggucgcguuccugucccucggucccugucccccacggcccaggaaugaaucugguaugaccucuucugucucgccugccugugcauacuuagcugugucuugggucugaccugucuucagccccauccuuguguugagcaugugagaagacagcaguugugugacacgacguugacauuaaaugaacgguggagaaguuaucuugagggaauguguuugcaguuuggccucugccuugcagucugguuggaucucagcccucaggaccauuuaaugguggugggagcauucuguuuguccccaaaugugggacaccaccgcacgauccugacacuaacaucccagaguuggugucagacucuaugagcuaagggcucaguccuuaacaagagcacccucacuucagacuccagcugcaccucagugguccccaggccaccugcaccucugcccagcuggcuguaaauucagugguguccaugacuucagguuugauuauucauuagaauggcucaugggacucaagaaagccagugauuaugauuccaguuuuauguacagguuagggggaccagccaaauguggagaaucaugggacgaaaucugcaagagucccggggaugcaaagcuuccauaccccuccccauggggcccggggacacagcgcuuccauaccccuucccaugggcccagggacacagcgcuuccauaccccuucccauggggcccagggacacagcgcuuccauaccccuucccguggggcccgggaacacagcgcuuccauaccccucccaauggggccagggugcuaacucuccugccauagccauguguucgccaacaagaaagccccucagagcuuggugaccgggguuucuauugagguucauugcauaggccagaugacugaacgggggccgccugauggagcucagugcccaaccucccuccucuucccucccuucccuucacccaggcucaccugacucuacaaccugaggccuuaaugugcucucugguguccagcccagacucggcugcugcccgaaggagaagaccugccggcagccucgaucuuggccaaggcuccuggcugccgcuucuggggcggggauggcaggagcccugccuguuugccugcagggauuugccagcgaguguccugugccgggaaaguggagcuguggguccaugauucugcugcucuuccuugagccccaucucucucuccuguucccuuccagcucaggcgcgcugucccaucggaggccuuggugagcggccacagugcucugucuugagcugucagccccagacugcuucccccagaguggccugggccggggcugcugcucguccugggucucaacccuucccacccucugcccaccauuggcagugagcgguucuugguguucuggcuggugagcgugacuggacccugcuuguuggggaccuggcuuuucuagcugucagcgacauaaaccaaaccaugcaaaugagaaaggaggugggcucagaguggggggccucuuggugcggaggggcccugcucacugucaguggcucuugcuuuuguucuuuuuaucuuuuuaacugauuagagaauugaaaucuucccccagaaucaaagccuauucauggcugucccagccaaagcgugauguauuugugucuguucucggcuuugugcgggggguugaaagguuuucuuugucaggugucuaagugugagccauuaugcugcucuucgggugauaaaucugagugucugguccugcauaaacaguguguguuuuaugccaagucaaugggauacguguuuuuuccauuuuagccuaaauccugggacacaaugugcuugcauaauuuauuuuuauuuuuaaucaagaagacaagauguuucagcagaauuuucggucuguggaucugcuguuuaaagugcugggaaaaguguucaacaaauauugugguuguuucuccagcuugccaauaugacacaucucuuccuggugacuuuacaacaauaacguugccuugcccugccacauaagggcuuuaugaaaaaaccuuuucagccugaaauaugacaauaauuacaccugccugcucauucauuguauguauacucuuauuuccagugaaauggaaauuucaaauucagaauuauugccaaccaaauuaccuuuaucagugaaagagcaucugcucgcaauuacuuauaaaauaagaaaaaugaauccuuucggcauguacauuugcagcuuugauguguauaaaugggaaguaaugccuggaguuuagcagcccauccuucaccgugcccagacgggaggaggcuuucccgcuggggaugcacgucccggcggggugaggcccuggcuggccacgcccgcacccuucaugacgugcugccagagaagccacggagucgugcuaagugaccacuuccgugugaagaaggacacuccccggugccuucuggauggaugucccaugggcuccagaaucaagccagcuuagccaggcuguguugggugacucagcggagcgcuugccauggagucccuugcuguggccaccauggucucgugcugugccugccaucaccucugggugggcguggguuuugccuuuucacuccuuucaggaguucaagguccugugucaggcagaaggccaggcacucaggacacagagagcuuguaauucgggugcagugcacagcuuggagcccgaaggcuggauugccuugucuguuuccuacaggcugcugagcccccggcgggcagaaacaggccuugucuuccuuguagcuuugcuuucagaggcaacccugggaaguggaggcccuggucaaucuuuccuuaaggaaccaaugaaagaggagccucuugcccuggaacggccuugccugugccugugagguuaacgcuguguccgguuuucugguuaguuccuugugaccgggugcucuugcagauguacugggcuuugcccugaggaggguggguggcucugcccagggcgcaggugcccagagaugcaaggguggguccaugcucagcucuggugguguggggucguuucaaggggacagagugguggcaauccucaggcccaucuuggcucgccugccuccuugugugcaccuuuggacagguccccucaccugccucaccucacaggugaggggccgggguccccagggugugaggugugugccccccuucaggagcugugcagugggaguucggugcagguuagccggccauugcacucuggcuggaacgggcuccuucuccucaagucagcgucccucagggaggggcugagggcuugguggccucugugcuuuccaccccugagucccugcaaguggggcaggaaggguuaauuuguacucuguuuaguuaccacaaugacagguguuccagaaauauguguuuaaauuuucaagucuguuucuugccaguuuguguuggaaagaugucaccugcuucccaggcccgugguagaguugucuguuuucccagguggggacaugccgagccccggcacaggugggcugcugcugcucuaggcaggugacagacuggccggugagccacggcuccucuucugcgugugacucuguggugugcaccuuccccagcagucaccucauccucauccauggcagcggcugcccugggugccaggcugccugguuaacaaaugugugccccgcacacaucacauguguggugggccauggccugccuuggugcuggucucuguuuccggacaaagucccugcccucgaggaagucacagucuagaggauaagacccucuggcaagucccacccacaccaggucccccagacuggguccagggccuggcccugugagugcuugguugagaggccucaucauacacuggauuugugccuggagugagaggagagagggaguggccgcgaacacacacccaaagggaagaacacccaggcucuguagcccugucuaaagcucgccugaagccuccuguguaaaaugugggcacagcacucguguccuggugauuagccugugacugucccacugcugccuugguacacuggggcccugcccuggcagcauuggagaaccuucagagcagcggccagacagggaugugcaguguggccgugugucccaggaggccccaggcugcugacuucagcuuaucuccacggcagagcuucauucacgccagugcaaggcggcacccacuugcugcagcccagacguccacgcagagcugugggcugggaguggccagugaaaccaggugccaccugccaggccaggcaccugcccuggaacguuccuuucacacugccgucccaggcugcccuguguggccccuccuuccucaggcgcuuuguuucaagcagugauuuuccucuggggcugucgcugucguccuggcugcucuuccccaaguagccaacugcuccuucauggaagcucauucuuuuuucugugcaaaagagccuuguugaguaaauggagucauuuucuaaacagcugguuuuaaguguucagacuugaauuccacgugucagugcgcugggggcagcagagucugguagcagcuuggguggacuuccacccuccgaggggcaugggcagaggucaggccuggaugguggagcccccucagggcuucguagaacuuucuaucaguuuaguuuuguagcugcagauuaacuucagguuagaaaugauucuguaaguucuuugaaaagaacgucauguucuaggguguggcuggaaaacuccucgcuauugcuguguugagaaauagaaguagaggaggacggccaggcugggaauguguccaucuuccgguuaccuguuugcucucuguacucauucguucaucacagucaccugacagacacucauggaugcucaguuguguguacugggggccggggaaacaaaggcgacacagaccuggacccacaccugaccagcucacaccccagggugggcaggcacccugagcacuuaugccccuuucgugauaaaugcuuccauagagguguguauagaacgaagaagagggggaggcucacagcuugggguguuucuggaagcauccaggaguuuugacgucuggguagccucgcacugagcagagacaggugcccugguggaaggcugccaugagggugagcccggggcgcggggaagccugcgugguagcauggguguuguuggucaccuggugccaccgcaggaggcauggcauugcaggggaaggcagcggugaaggccgaggagggagugggggucuggugccuuucuuaggcacucugacuucauucugggggccagugucucuucaucuguggggauccugagacaccuccuggcacccccuuuggucucucugucccccgagggaugagcagccgugggauuaaauucugcgggggcuucagccucaggggccccucggcagcaccguuuuguucucuccacuugccgcgcugcccuuuacuuauuagagacuaugggaaccauuuuuugguagugaaauuaguuuuauuuuaaaaauaaaugucuuuaauaaagcggcaguggauuagaaggaagcuguuaagugagcaacacgcuggcgcugccucuggaccugcacugcagcccuccccucccucaguguggagcucuuggaguggguguccugcgugagccacugggaccuguccuuccugucucugugagccuguguggugccgcguccuugugugaccugcccucugaggcguucccagugcagagaugucacuggcacgucagcaucuucucuagagucucugacaucccaccuggaagagucugacugagagucgagaugagaaucuguauuuaacagcuccugugcucccguggugaugaugaagaggagggggaggaggaagaugaagacacgaugauguccagcccuguuugggaaucccugaggucacugccaagcccacugcacccuggcaucaggccuuccuugcccugcaagcgggccccugcguucccugugccccggcugucucugggccuggcuccucaaacguuucuagcccaacaccuuucagaagugcuccaaggcaggggaggcaaucccuggccuaugugccggggacuuuggacgacggagcucgaacaggcccagugcaaagaugaaauugcauugaaaucgcaguuuuauccuaacaacugaugacgauaauugacuuuauggcauauuaugcauugguuuugguuuuaauacacaaauaacauuuucagucgcucagaauaaacuguccuugcugcucgcgugugacgcucuuugcuugcagccgacucuggcacugaugcgucaggcucccugaguccugaggcaccagcguucccagccacucguccacccaaauguuccaccucugaagcucuccugggggcaggggagacaggugggcuugcuaaugaagaagugugggcaucuguggccguguguguagucugcgccagaccucuucauaaagcaaaaagccaaccaacccccugcuguagcaacugaguaucugaggugagcagaugccaucuggaggagcugcccugcaggcugcucugcugccagggacccccacccccgccugccuccggggccugccuggccugcuuguaccugcucucucugcaggccuggagcccuuagugcucaaguuuguuaccgcagaggcagcgcacaguggugggggugugggugccucuggguccaggcagccuccuggagggcaguccugugggucgugggcaaggcuguccagccucccuggugacuuccucccaggcuggccccuggggcucagaacagccuuugcuguucugcuccacccaguucugcaguuuccacaauuaauuauucacugucguguuggaauggagcguguauugcugcaucuaccccacagugugaagcaggccucauccugcaggcauccccugacacccagcccuacaggagccccgccccagcacguuugcccuggucagcugaggacagcagugguuuaggggaggagggugacagugagggcagagacagugaagggaccagcucccgccacagcagggucccaucaugggaccagagcugcccaugcuuuuccagggccagcuuaguggagccugcuuggaaaccagccccuguccuuaggugagggcagcucccggucccacggcccugaaguccaggccggcacccgcaugucuuaguagagcuccugguccgucagguggacggcauugcaggauggacccuccuguuccucuucccccugcuucucgcuuguugcugaaauauugcaaguuaccagggacuugaguaaaacaaaccaguaaacagaacacuagcuuuucucugguauuuguuuauuugccauuucuagaacuuucuuugagggaauggcgaucccugugaaguguuucggggucacuucucagggcaagccaggauuagguaagcguggagagaagggagguguaacuuggaagcaggguaaggaagugagcugcagaaagaaggcucucagcagcccucaggugcaccugcguuuuaaaaaccaaggauccacuauccggcucaauugggcaauaauuaguaaugauuauuuguuuuuauaaagcagcacccauucuucuaggcccuuuagaguaggaccucaugggcagaauguuggaaagaggagcauaggcaccaugaucacugggauuuugccuccaggagugacaccgccaggacucagcagggggugaggcagggagcacggggucugagcugaggcugcaaagcugccgcccaccacagcuugaugagaggggagcgcauguggcuggugugagcgugugcuucugggagugaugcuugguaaagccuggcucuuuccagaggcccagcugugucagggguguccccauccugcagucgagggguguccuucaccuggccugcaggccuugugucccacuugcgcacucaacgguuggguccaggcauagguggagcauuucccuggacaagauugggccccuccugaggagcuggcaagcucaucuccucucucuaagccccuccugggacaccagccugggucuguggagcuucuguggagcggggaaagagcgccuaucuguggagccccacggugugggugucgacucaagcccccccaucuuccuggguguuagggcgugaagcacccgaacauguccaugauuauaaucaucacuucagcagcaccaccaucuuucgcuuuccuguaggaagggagagcuguagucucucauuaauagaaucaguucuuugcuccuuggggguuguugcuugggauucccuguuggagugggguucugaggcgggcgcaggcccuugggggacaagugaccuggcugccagugccuccauagggcuccccugacagccuuggggccuguguuuguuuugugcagagcaagugcaccggcaccuggaccaacacgaagugagauaccugcaguuugccuuccgcuggaugaacaaccugcugaugagggaggugccccugcguuguaccauccgccugugggacaccuaccaggugagcucuccuucgcacccuccgccaugggggugccaggagcccgggccguuuccugucgccuucugcccugggccugugugcugcauucgauuuuuucuuccaagcgcucucuccauugaaaugcggucuuuaaaaaguauacuccuggccgggcgcgguggcucaugccuguaauccuagcacuuugggaggccaagguggguggauugccugagcucaggaguucgagaccaaucaugggcaacauggcaaaaccccgucucuacuaaaaacagaaaaaauuagccaagugugguggcccacaccuguauucuuagcuacucagaggcugaggcaugagaauugcuugaacccgggaggcggagguugcagggagccaagcuugcgccacugcacuccagccuggguggcagagcgagacuccaucucaaaaaauaaauaaauaaaaauaaaagaguauacuccuggcaugcuuuuuaucugagaagauguaaaacagggaaaagaacuucaggccguucucuuuguggcugaguuucauucugccugcguggugacagcagccuugagcucucugggaauucacauccugagcagugugcuaggaggaugcgagggaugcuggugacucugcugugaguuugagcugcuucugccaaaaaacucacgcucaggacucacaccuugucuauauuuugaguuacauauaauaaagauuuuuuaaaaaaucacagauucaguguguaugaaauuuucuacucuucaccaauucugaugaaauucaauucuucaggagguugaguuuucuggaacaagccaccucucuucccuugagugucccaucacuuauucuagcaccuuuucauuuuguucgagauguuugcugaagcggaggcggugcugugggggguuuacgcgccagccuuucaucaucaguuacaaauagcaggcaccauuaugugggauuaggaaucaaaucucuacagagugcuaaagaaagaagcguauggcugguuuucaucccggcaccucaagagccaggcuuucuaccacagugagcacagcccuucaucggcugcacguucaggauuugcaggggggcagcugcccuuggagguugaugcugggggacggacguuucuggaaaggggagcucuuggcgggaggcuuuuucuaaggcggcauaggucccaggcacugcguugggucccaacauuggugccuugcccauggagguggggaaggcugggcaucacagagcagcuagggagggccugggggucauucugaccagcugcucccacagggccucaggcugcgugcguucuucccacaggacagggugccugcugggccuccgugcucuccagucucucauucugagccuguuuuugugugagucaucuagaacagugccccaaagcuuuguuccugacaccgguugcuggucagugugccccuuggugggugugaguguuuuguggcucugaaguccuguauucugacuuugcuuuuccuuugcgccgcuugucuggucuaaugaucucacuacggaaauuaucaccagucagcagacugucauucguguccgcgacuuggguuuuguucuuccaaguguuuggcagcuacagaauuucuggccagcagcauuugcugggacauaaagccuuaccuugggcuguuuuguuaaaguagcugucagucuagugcuauugaucggcucucuguaacaugacaggaaacaaaacuuaauauccuguaaauugcgaaugcuguccguuuuugugauugguuaggcuguuugagacccagaccucccucauuaaacacaguuccuuguaauacuguccccauuacgaauaaauuagguauuaagucaaucgcauuuuugaggagccagaaaauggaucggcuugcccaugguucugcaccaccuacuuaaaacuccuaauagguauuaaaacuuuaagcacaauuguggcaucuuuauugaguuaauuuucuugaaauuaaauuuugucaugaauugacucauuuguaccagggacucauucuugaacugauaguacccugguuauaaaccucuucauaucuuaagaaucggggguauuucuauuuuacagggccaaguaaccaugaaauuguauugcaucuuuuggcaaugaaaauacauaguaaucauaggaaagcaaucgggugauuacucuccccuaaacugggggguuuauuagcugagccauuacagguuuuaguuacucuuuaaccccuuacaagguagcuuaaaguccucuugggacacgugucaauaaaagguuguuuauaagcaccuacaccuucccaggcccugaacuagauaguauauaaaaaugaaugaggggcauugucaugagggugacaaaaggcuuggaagaggagccaaugaugcagagauagcccagauggaagagaauggcccugcucccccaggggucgcgugcucccucauggaugcgugcauuucaggaaaaaaaaaaaaaaaaaaaaaaagaaauaccugggccugggucauuuguaaagaaaagagguuuaauuggcacaugguuccaaagaggcuguacggaagguauagugcuggcaucugcucggcuucugaggaggccucaggaaacuugcaaucauggcagaaggugaagaggaagcaggcgugucuuccauggcuggagcaggagcaaggcgucggggaggugccacagccuuuuuuuuuuuuuuuuuuuuuuuuuuugagacagagucucacucuguuguccaggcuggagugcaguggugcgaucucggcccacugcaagcuccgccucccagguucaugccauucuccugccucagccucuugaguagcugggacuacaggugcccgccaccacgcccggcuaauuuuuuuguauuuuuaguagagaugagguuucaccguguuagccaggauggucucgaucuccugaccuugugauccaccugccucggccucccaaagugcugggauuacaggugugagccaccacgccuggccggugcccagacuuuuaaacaacccgaucucaggagagcucacucacuagcaugagaacggcguggagaaggguggugguaaaccacucgggagagucugaccuccugaucucaucaccaccuccaacauuggggauuacaauuagacaugagauuugguggggacacagauccaaacccugcgucagcaguggucaucaauggcugagagcaggugcaugggggugaauucagccaggaugagggggucgucgagcaaguggggucagagggcaucgguaagucugagaaguguggcucugauggggagagggaagcucggaugggggguggguggaaccuggggagggugaucccacagugggcgaucccugggugcaugaggcugcuggggaggugaggaugcagggcggcggcugacuugauggggggcccugugggagguuaccccgugcgggacgugacucagcagcagaggagcagcugggguaggccguggaaugaaaaagaacaacagguucugacaggacauucaaagccagguucuuuucucuaaaucccggugacuucuuccucuuggggaacauucagggcucugaguauggugagugagcagcagccaagccggccuccugggccugggagguuccauuuccaguuuggugaaggccaccucucguuugagauccucggcugccuucagggcugcggguacaccugaaacgguuacuuacgcugcuuuagaauggcuccucacacacauccugugcagguggcgggggacucgcugguaaacgggcgaacaucuccacacuuuacguuuccuauccccuagugacuugaugcuuuuuuucuaaggaaagggaacauuuauuuuuggcaggugaguauugcaagaugacuucauuuggcuuaaggccuuuauuaaauuccuuucuagugauauccaagaggccacuugaauguuaaucauugcacuucuaccacccauaucccaaaguguaucuuuaaucaucacugcccgcgcuccucacgcagggcuggcuguaaauugcaggggaugaaagauggugcuugucucccugggcuucggaucuggucauuccucuaccauuugcuuccucucccgagggucagagccgccucacaccgcacucaggguggacuccugcugagggcgcguccucccacuucacacccaagggcaggugcugcggagggacuggagugugagaaucuguggccaggacacuucuauacauggaggcucuagauugccuacuggucaccaaacagaucuggguccuuuaaggaaaagguuuauuugaguauuucacggaagcccugguggguccauguucucugcggcguccugggcucggauggagggcguuucugcccuaguucugugcuuagcugugcaucccugggcgagccgaguuuccgauccuugccucgagaggcugcugcuaggacugaggaagguuuuucgagugaggauuggcagacguuuucuguaaagggcuagauaguaaauauuuucaggcuugugggccauauggacuuuuucacaacuucucugcuguugaagcacagaagcagccacagacguggacagcgggcguggccgugucccugugagacuugccuaccgaggcaccagcgagcugugguuugcuugcccgcccuaaccuauagcaagugccuggcccugcaccaagcacagagcaggcaucaggcaagauugucuccccagcccuuaucaccgguguuuuguccacugugugcuguucacauucugggcuuuguugccaggcagucauuguucucugagaguuuuuauagaagauggaacugggagucuaggagcauaagcaccuugcccagggccacuucccuuucauacugugucacaguggcuucuauuucugccccccccaugaggcacuuugggcuccagggcccuguugaggcaccgugcgaaugggguuccagucucucaguuaccaggcugugcauggcuggagcagagaccgggagccagggcugccacugccaguccacaucucuguccuggccagagcccccaucagugcgcuguggcagugggggcgccauggcucccggucuguggaauugcuaccuugccagccuguaugagagagagagagagagaggaagagagaggagagagagagagaauaugaaugaaugagaaugaagaugaugcggggacauugggacucagcaucacagccuucugauuuccaugcgggaggagcuaucugauuguguuccuccugcacccugugggucuggcagucuggcagugccauuucugagauacagccccacauuccaggacaccagucgugccagccaggggcauggggcagaggucagggccagagccuccaagcauguugaaugccaacugccugaugggacccccaucuguccacugcugagaggggccacacagaccccugcgggccuugaggcacaucucccagagguagcuuugaucaagaagcagccuguucugcugccgcuggugcaucaucauggcaccugauccuuguucaguaucuuaggugaaaugucuucauuuuauuuucuucagcauggccagugcaagccucgccaucccuggggagggugcgucagaaggucgcuggagguggggccugcacuuugcagaugucccugauaucucucaggacagagcuugauccugggcaccuugggccccgaaucacucagcccacgugcaguuaucagcgccugcuccggguugggcccuguucucagcccucaggcauagcaacgggaaaggugggccugcugucgagggcucuuuucucagagagggauccugacagcaaaccagcagcaucucucaggcaccuuucaggugaugaggccauguggugggaggccacaagagccggcccucaggcaggguguccauggcaggggguccugaauugagaucugugcugcaugauggggccccagguucuaguaggaggauucuggcuuggagugccugggccaggacagagcaggcgaaggguguggggagcagcaggugggccggggcgacgggcacgaggucagggccaggaugcggcuguccccgggcuugcuggagaggcucagcacaccugcagugcuccaggugagagacauagcauggucaggaaaagcuguuguggggacugagcgagugagggcccuaucuaaggcagcagccccugccaccugcaauuucgcagcccagcugguggccagcagucagcaagagugcgauacaggugcccaggugugcugaggacguagggaagaugggguguguucaucuuuccaggggaggaggaggcuuccuggggagacaugugagcagggucugggggcugaguugcagcugaacaggaggguggaagggugcaaagaggguccucccauagggcauagagcagguguccaggaaaugagugagagguggguugcaccaaggaagagcauuccaaggcucugagggcaggggggcgcagugugcucuaugugaggugcaguugaguguggcugcaccagaguauuuggaugccagggcagguccgaggcugccagacucagguggggccaugugggaggcucugugugccuugcucagacauugcauuuuaucuggggcaggugcuggggaggagccugucugagcggggcaggugcuggggaggagccugucugagcagggcagggcuccgccuuuuaccauggguccucauagcagcccaggcagcugggcacugggguggaagggcaucgcugaggccgugcugccuggcauuuggcccacccacauuccaucagggcagaguagggggccgauugcugugucugucucaggcccugcccuucccugcacccuucugcucugugccucuguccggugccgugcuauccugagagccucccucuggccccuuuugcuagagauuuaugcuggauguaaacgauuacuggcuggccacucacuuccuccaccaucuggguguccucagcccugccuuuccccaggaguccuuuggaccugcugucccagcuccuuugaaaggcugccucgggucuccacuugcccuugccaagccugggugaggguggacagcgugcuccaaguaccgcaccugcugggugcucugccucgugugccaggcgacagcccuuggggcucuccugaaugucccaggugccacagcauggauucugugggucaggugcagugaaacugaugaucggguuaaccuaaugaagcugaagaagcuggucuccguacauuguacuuucucaugagcccauuaagauuugaggucguaagcuuuccaugccugcccgcccacaggaaguaggcauagaucacugucagcuggggagggauuucaaaaugagacuauucagcaggacguggcucacugcugcuacuuugcagggaggagcuggaagagggguguaucuauuccuucggagugacagugaagucaguguccuggggauuuaaugcuguauuuaaagacaugucuggaaaguccuuagcgacuuuaagcuugcuuucuucauguaucaaucauguugcuuuuuauuggggcucgagaacucuacaggagaugguuucuucccccugcaggccuggcgugcuccagcaccuuugggcaggcgugugaaggcccugaggucuggucugggcgccuccaggaaagaaugacucuccaagugggcgcucgggaccccugucagccuccauggcccuucacauggggcggucucuccucuuuguggacaaaaugcagaguugugcuuggagcaagaaaagugauuuguauaauguuuugggcgcugacucguacauuuaugauagauaagaccuuuguucuuucugaaaaguuacguggugaggauugugaacuguggcugcguggcaccuggcugcacacgcggcuguguguucacugucccucggacucugcgggaaaacgugaugcagagccacggucacggcugcgcuccuccgcgguuuggaagucccauuaaugcgacuucucucugagaagucaaccugggccuccucacucugcagacguccagcucccucccggaagcggucaugcagaggugucaggcggcacuguuguaaucgauagugggugaccagucugaauaaauuuccuuguacuugcuccaaaguagacaagaguccuuagccaccuccagaguuugaauugaaugguaaugacauuucuuaaggagagauuaaagaguucuuuuuuaauaguaaaaacaugcagcagaacgggcaguguuguuagcggguuagcguuuugaugacucuuuucucccauuguguucauuucuugcucacuagucccuuacugaggcccuacugugugcuaggccuugaaccagaacagucaauaaaaaagaaaccgcccacccugugggguaccugcugugaucuccaaccacagcaaccugugaguggaccaguuacugcuguucacccaggaagcugcugcuguacggauugguguggggcuugguuuuggucccagaguccaugcuccuucagguggcugcagccuugucuccacguccuccccacaccuggcacugcacccccacagcacccccagcauccgauuuuuggaggcuagugaagaaagcagcaggucuuaguggggauggcccuggguggaggugagaagaccuaggccaaggagguucccggcugugggcccuggugauggggagacagguccagggucccucauauggacucgcugaugcucccugggccucugggugaugugagguguggucuaccugugggugucuguguguguggguacaaaggccuugccccacaaggaggguguccaaguccaaguaccuuacaggaugccgggagggcccccgagugggacgguggacuguuucugacaggucacggcucgguaguggaguggucccugcaccccacugugcaggcuucccucugagaugugcugcuuugcccucgugggggcaucuguagguccugucgcuucccuagaggagagccacgggccugugggucccuggcagucuaggaaugcuuugggccccagagucccugaaccucccuuagcgacugguugggauuugugcugggggagcgcccagggacacccuuugagugagggugugguagaggccagcuggggaggguugcucacaccuggcccugugaagguguggccacgggagagaagccagggacacagugccacucacauuugagagcugggcccuggcaugggcauuggacuuggucuuugugggacugggaucuguggguagaaagaauagggcugaacacgaaacauaccuuucugccagagcugcugcugugauggcgccugggcccccugaagccuccuccccgcacuuguccagguuuuaacugaagaggagccagagagccguugacaucugaguugaucaucuccagggaccccucuaucccagagcccuggauccccccagaugccagaccaaggcugcgggaacagcaguaugccaggugcagggccugugcaggcagccugggagcuuguuccccaggaguguaagaaaggcuggcgggucugccccacuccaggccacaaagaguguacuuucuuuggggcauuuuugguaagcuuucagaugauguauucauuaauauuuuaucugcagugugaccuuaagcaacuugucuaacugcuuuaggccuguugugggacgaagccccagaggagggcuugguuucguuugcugugaggauuuguguuucuccugaucuuagcuuguucuuagugcgaggguguggcggaggagggcucggggaccuucccugcuugcauguagcaauucugugauauaccaaggccagcccuacccucuugcuagaaaugcauggccugggaagauuucugacaagauuagaaagaaaggaauacacauagccuauuaaugaaggcugcauauuaaauacgaaucauacauuuuuaggaaaauuauugaauuguaucuuuguggccggugauugaaaucauaguccuaaagaguugaguagaucaccugugcagggcagcgugcugggcgcugaaggagaggggcacagaggagaaguucuugccuucaaggcaccaaaccuucagcacagcugguugcuggaaauagauggagacagccccgagcggagcagcaaaggagaggacccagagaggaguaguccuggggcugucgggaagcaccggcugccccaacccugggcaaguggcugaggccuacugccccagguuggccccaccagugauggugaccaagaggucaggccugcaguuugaugggacuuugagaaugaacacucaguugaccucauccuugaugguggaagaagcuugccccauccuguguggaggguucagagcuggggucuuucagagccugucgggugcccuggcaaggccucgaggcugugcauucuccaggcuccugccgucugccucuacuccuugccuuugcucgagcugugcccuguuuucugcugcagacucugcucccaucucuuuguggagcugcccacaggacuucuccaaaguuuagaguugacagcccggaagccaagggcagccccucagucuuuccccagaccauguggcuggaugucaucuuugcaaguugguguuccuuaaaugaaaggaacaagaaaaaagccagaacagggucccaauggaggcugaggugccuuccagucugccccgggcugccccagcuccacugcuguugcugcauuugcgguuccugggacucagcucucuggguguaguugagagaggagccccaggcugggcccugcugcugagagguguguguggacccgucuuaugugugaggugugguuuugggguuucacagugcgguaaggcuccccucagagcacccccuuagcacuuaccgggucagcccaagcccagggucacccaugguugcugucagguagggaaaggguggcauccagccugaggucgggagguggaggacgcgucaccuuccaggacaggguggucaggccccagcacauccaguuacuacgucacuugccgagacggugcucaggagucucuggucagaguuccugguuacagaggccuccuuggcaggcagaggacaaggaguaaagggugaagggcacagcagccuugccuuccagauguucacaguggcugccacugggccagaggagcauggggcagacagagccaugggaagcacuuacaguucccugaggccaggccucucccgccagcuccugucccucucuccuuuccucugccguccccugugcaggccccuccugcauugcuucuccuagugaacggagcuugcuguguuccugugcagggugggauggggacaggcugacuuacuguugcccagcucuggggggagguggggcaccugccgcaccguaaucaggagcaauguaggggugaggggcccugcacgggacccuuuggacaucgcagcccccaugcuggggcacaccugacugcccgcaugcacccuggauuuauagguuccucuuuuaaggucugguguagcgugguaaugaccuucauuuuuauguguucuggaagaaauccaaaaaggaaacguuaaccugagaauugcuuucaggagcuuggccuccuguguccccagcauggagaguauucuccagguuuccaguccaauuuucugugaccuuucguuaauggccgggaagaggaggccggcgcuccaccuggguccccaguguggcacucacagcucugccggguacacguugugcucuuccuuuccaggcccuacaugaccaggcuugugauauucagacgguuuccugggccaaccuucggcuuugcgccacuguuccaguauugacauuuuccgauauuaaccucccagcuccugggcgaaccucuugguacuuaaugguugagcaugcggaagugugggaaagaagaagcgggcaugggcgcuggguucacguccacaucagggucccccugggcagcgggaccuuugcacagauggcgcugcucugaguaaaccugcaggugaaugcacuucucagcgggccuccuucacuuccuguuuucuaaaguguuaauuuuuaaaguuucaucaugagaguacaugcauauugcugaaacuuuacagagaugaaagaaggaaaaccuccccuuugaauauauccaacccaacauaaauggcccccaguggagcagguguuagugucucuuuuccauccuuuucuacgaguuuuuuuguaaaacauaacacaaaucaaauaguacauaaauuucucuuuggcucugucacacugcccagucauaaugcuuucuguguuaguuuggaguuuuuguagcuaauguuugcuuaauauucuggccuguggauagaucauagucuacuuaaauguggugcgugauuuuucaguguauuugugacugagagaugauauauuugugcuuaaagcuuuuucuguauuuagaaauagucccguaaaagagguguucaggaaaggggcugcagggugaacgggucccccuguguuuggggaacuugguggccacagccaagugacccuggggcccacugaguugguuugcccugcagccagcaguuuugugagagggggcauuuccuuuuuucagagaagucucgcccuugucccccaggcuugagugcaguggcucgaucucagcccacugcaaccucugccuccuggguucaaacgauucuccugccucugccucccaaguagcuaggauuaaggcgccugccaccacgccuggcuaauuuuuguauuuuuuaguagagacgggguuucacccuguuggccaggcuggucucaaacuccugaccucaagugauccgcccgccucggccccccagggugcugggauuacagacaugagccaccgcgccuggccgagagggggcauuucuuuaccgucaccaucacugggcauuuucauuaaccucguucuuccucaucugguuaagcaguagacagaaacacccugauucuauuuuuauuuccauggcugcuauuuaauuccaaaaguuucccguguuuuuagcagcuggcugugcucuguuuuuuagguaaccuuuuaguucacccauggugucuuucugggacauuuuaagcuugagagcauccguucagaguguucacugcagccagcauuugcuugggaccgcgugugaggccucuccaggcgccgcuugggcccugacucuaggagcuugccuucugcacaaaguacaggguggccacaggagacagcuacuaagagcagccagggauggguggggcccggagucagauugcaggccauggcgggggcucgggaagggucuugugagggcagaaccuuggggugggugggaugagggugaagugcgcaucgguggagguggggggauggugaggacagccugggaggagccuguggucugucugccaugcccuggacagguggacuggguuccccucugacccuggguggcagcuucugcucacagugucucuggaugaggagggcggccacaccaaugcgguggagggagcaggggguggcgggggcagucgcggggaccuuugcagccgccugggaauagcagcgcucccuuugcuaaggagacccugucugggcggcggcucuggggcuuccccagggggcuuccguggguucugcccuguggccuggcaggucaugugggaggcugggucauugcagggggaccucuccucccucggggcuguagauuguagcaaaggagcugagggagugggagcagggaggaguucccaccucagcuucagcagaacauuccaguaauguuguugucucuaaauacguaaacccuccagguuccagacauagagcaaauuucccuagaauuguauuuaucagagaagguaccugguuauagauaauuaacuacaauuuaaauuuuaaauauuuguaagauuuuuuuauacucucaaaugcacacauuuggaaaauacugucuuuccguccuuaaagaacagucuaguuccggaauuacgguccucagccgugcucucuggauccuccuggacuugcuucaaugcggacccugggugcggcagggguggcuucgggagccgggagcuagaacauucuuugaucucaaaacgcccuuccgguggaggcccuggugauucuccuggagggcugggccagccaugcuuuucagguccccucaaggggccgggccccugccaggcuguggagcucuguuggaggagacccucuguggcaggagcagugagcccuggccgcuugccuggggugggggcagccggcaccucccugcagccccaggacugcuccucuccagcuccccucccuccuccuuuccuuccucucgcgcuccucugcucccgcuguguucugucaugaguggagaagacuccuucucugcuuuguauucagggauucaguuuguuucagcggugcucuccuggccaccugcuguuccagaaucuuacccugaaaggcggucacugugcggaggugaacagaagcagagugcauugccacuagcacaucucacaguguuugcuuucucggccucuggggaaucugugaguguggacagaaagcacagagcgggcgggaugccuccucuucagcgguaaggcaggguggggcaggcucucacugggccuccugcccccagcaagguguccgcagguccucugucacucugaacauggguucauuuggagagcagcagacagcacagggaagccaguucuggaguuagagugggauguuuuucugaacacguauuuagagcaauuugcuuucauuuugaauacuugaguccaucaggaaauauugaaucauuccauaguccagaggccgggccagcgcccuccugaugagggugcccaucggccaugcggccuguguggccuccugguaccagccagggaggccccugggaggggcaggcacagcgggcgagccuggggaugccugggagggacccucaaggugaggaggugggaggcugggaagaaagaugggcuugauccauuuagaaggagacagccugauggaugggcccccuggggagcauuguguacagagagaggacccugagacccucccacaguggggaggggacucgccugaggucacacagcacggugugcccaggccauugccugccaguguugcaccaagcuucuccggggauggcccugugcuugcggcagccacaucacagcccuccugcucugaggggcagcggcuggaggcucugccuguccugagcaggacuccugucggccacacacagcacugcucaggcucugcuggggcagccaggauagcaggaggacggccucccacaguacccccgggcaucuuccuguccuuccaggccacugcuccccaaucagugacaccaagcccaccacacgguggugcccgucuguguuggcacaucacugccacauggcuggcccucugugguacccgguauccccguguugauggucuuggggucuugguguaaaccuggaugccacgcagcugugacaugcugggcugcuggcugggccuccucacaccugcacacuggccucccucuucuuuaccuguguggucauugucaugucucugucauuugacuugggcaccuucacugugugugagugcugccccaagcaucgugcccaccaccagcccagggccucacugcuuccugcccaccaccagcccagggccucacugcuuccugcccaccaccagcccagggccucacugcuuccugcguguccccuccggccuggagggcuccucugccacuuucugccuccuccuguucugcucucuuccuugccugccugcaggugggguggacgugucuuuguuucucacguccgcaguggagaaggugagggguugccagggccccuccugagaggcagagccugggggcuuugcuaucccagucccccuugguagggcacccccuccucuggaggccacaguuaccugcaggaccagcaagcaggguggccugucccagggccgccucgucaggcgcacucagaggccucaggagugcugcuccccagugcccuugaaggagauggagggcgcuucucucccagucggggcagcaguuugccaggccugugaggaucaggagagcagaaaggccaagcccucagagacgccagcgaggagggaggccucugugcacagcaggagguugagagguugguuugagguaaacuugugacauauugucgggcucaucuuuggcugagaaacaucauuaguaauuuugcugagucagcugacaacaucacauucacuggcguuggcugagcccuucugcgcuccaggcgcugguuuggauucccgcgugcugccuuguggacucagacauauaccagcgcauuuaaucuuccaggaacaacaagaggagguucugugagccucaccccaagccaucguuaagaaauggaguugaaccaaggacacgggaaugcuccagaagugguagcuguuacuguggggcuaucacuucucuguuguacagaggaggaaacaggcugagagaggcccugacucaucagucauccggcuucgaagggacagacucagugugagagcugcaguucccucccugagcaauggccagcgcugcucagagucucuggguagcagccagugcccgagcucugggcaugcaucccugacucaagagccccccagcacccauggcugcuaggagaggaggaaggacgugcagggacccacaaugcagugaaagagggaugcuguuucaggaaaaaagcaagauguuggugagagcacgugguggauccugaagucucucuuggccaaguuagaaacgaguggacuugccacugcuuguguuggaagagcugguggagacgaugagcagccauccuugggcuucauuuucuucugccucgaggcaccacucgaggugagggguccugguuuugccuggccguuccuccccaucgucuguguccacucccggcccacuucccacucugcccugcuuccugccugcaugacuuacucuccacagagcuggcuccagcaucugcuugggcgccuuucuguggccucgccauguccaucugcuggugcggccaagagccuucccagcggcagcucauugcuauuccagccacgcggcuccucuuccuucucaggcccuucgaauccugggcacucauuucccccuugcugaugcauuaagagaagaaagaugcuuugcugcugauugaagucaaguagcagggccgguggugggcgccugggagguggccagugagggcuguuccugggcaggucgggcugaugauuguguacacguagaaguuguggggcaagggcgaggggcucauccaguucccucaagucucccuacuucccguuguuaacuuguaaacagcagaaaugucgugguguguagggcacagaccguggggugugggugcaguuggcacucucacccuuaaagcacgggcugggacucacagcccagguccagcauggcccugggucagaguccugaccaccccugcgcagcuggguggcagugggcggggaccuggccucuuagccgcuucuuucuugccuccgagguggaggaggugagggggucucgagggcacuggcaggagcagguugugacacugcauggguacuugcucccuccugggauguuggggucuaccccaaagcccacaccugccaggcuggcccuugugcccugcuuggggcucugccccuacugcucccacaagucuuucucuuuuguugccauucucuuuaucccugugugagauauaggagaacgauggagucaggugaguguuuugcugccaagcccagagcugaugcucggguuggagcaggugggugguuaauugcaccagcgcgucucuggcaaacugaugccggaguggucagcuggacaggggaagagauggauggauggguggauggcuggaagaaaacuagccccaguaguuuacuguguuaauacacacccaaaucagagaucauauugagaauuuugauuagggguauguacauuugugauauacagcaaagaucgauaaggcaagaauuuggagcccgacccuaugcuguuagcuggggucauggagggguaaggugcagccccugcccucagggaaucucagcacuagguagguguggggaggcagagaggugcagccaggcagagcagccagcauggagagggagggagugggcaggcgcaccuaggaggcuggggaggagcuguucuggccccuuggggccaggaggaaaaggccauuuaaaagccucugucugcugcugggagcugggaugaguagggcauagaugugaucccugccuacauucagccauaauugggucugaguuccugggcagugagauacgccacggaggguugaugagauacgccacugagggucggugagauacgccacugaggguuggugagauacgccauugaggguccuugccauuuggcuccaugggaaggaaggugccguccagggagcaggacuccccaucauugggacuguuggacugagcagggcucccgucaucaggcuucauuacuugcuugaguuaggugucccgugcacacaucagcgacugcccuugucuugggucuguuugagcagucugggucggguaacgguggcccaaaaaagucucucaggaagaguguguguggguggugggccgggccgggcuggguaacgcuccacacugcugcuccccagccgugguguagacugcucgccuuccuccgcaugaccugggugcccuuggggcucuguauguaaaguucugcuugcuguuuaaaggaaucuccuccggccgggugcuuguuagugauugacagcguuugaguuugaguugguuuugaaggcacagggcugccugugagcugacgguugauuugacuucaccauggagcccugagcgauauccuucagaaugagccugcgcauuuucagcagaugaggccaccccccuuccugaugcagaagccagagagaagcugccguuugucuugugccccgugccauccgucaccaacuccucccucagaucucugucucagaucccucuccaccccgucugugcacagccaccauccugucuccuuguuggucuucucaccgcugccugagccgugcagcuggcugggucuuaaggacacagauguggccacacucaugucaaccccagggauucagaggacccaggccuucuguccuagaacaugguccuaugacaggggaccuuagcagaccagcaggaacugucugagcagcaucugggguggauacagcucgcuccaccucagguuuccuagggugguggucuucagaguggggucacggcauuuuacccggggaagcugcagggacagacacagaauggaaggggccuggagcagaggagaugcaggggugucugacaugggaggugcuggcgggcugcagucacagggagggguccagcagccgccuccuacacugccuuucccugccuugcugccuaggcccagccacucaggagagaacccgugaggucagcccaccuggcaggugccugacccugccuuagccccgggucuguggcauucuggccugggagucaggcugaaugcaguguuguuggauuccgaggcuguuuugaugucaaguuuggucauuuuaggaagucgguagguggguuucagccagaaucgccccuuccucagucagguugaggcugccgcaaaugagcgcugggcagcuggcugggguucucuccuuguuccccucccagucagucccaagcuccuccuuccacgggagcagaaguucuugccucccaccccauggucccuuaggccaccgucccgccuuccccugcacuuugcagcaggauuuuacaaguuuccuuccaggugcagggaaccaggguggcucgaacccagauggacagugcuacacuuucuuuccgggagccgugggcacaucccucacuucacuaagccaaguggaaauguguauuaguuuguucugacacugcuaauaaagacauaccugagacuggguaauugauacagaaaaagagguuuaaugaagucacaguuccacauggcuggggaggccucacaaucaucauggaagacgaaggaggagcaaaagcgcgucuuacauagcggcaggcaagagggcgugugcagggagccgcccuuuauaaaaccgucagaucucaugagacuuacucacuaucgcgagaauagcacaggaaaaccauucccgugauucagugaccucccacugggucccucccauaacacguggggauuaugggagcuacaauucaagaugaaauuuggguugggacacagucagaccacaucaaaaugguuaccccugccccauggggguuuauaaggugaaaugcaacuacacuuguaaagggaccugcugggcaguugaugggugaagauccugggcuuguggucaggcaggccccacgaggaucucagcugcgucauugcuacuguguggcaccagcgcagggccucgaccccccuugggcugcccuaggugcagcaaggauugcaggccaagggacuggcacagcaaggacugcccagcagaucugagcuccgguggccacuguugucucagcaagcaacaggcuagcuucacgccacacccugcgugcggacuccugugucuggcccagacagcuggagcucccugcccuuagugggucuuugugucucaaagguggcucugaggggcuggccuccuccccaugccgugcaggccuggagcugcuuguuacugacuugacuuucuucucggacuccuaugauccugucccucucccugccccccagcuuaugauuccacccgcccgacagaagccaucacagggccagugcucugcagccaggccagcccugcgagaacgaguucagcccucagccccaccguccuuccucuucccggcuccuuguggugguuaugaccacccagucuaguccagcauuagagcccuccuuccccucaccuuagcucuugccuccccucccuugucuacucuucucugaucccucugcccucucuucugcuugcuccaggccacuguccccugguuccgaguuacacauuaucauguaccugugauucccuguuagcaaggaggcagggcucagagagauguccagguggacaggcugggucccuggagagccacaguggcucugccccaccaggcucgcugaggcccaggccuuggugggguugguccguaggucccagcgcucagaacagcuucugacccagccguguugcucugugacuguugguugaauaagguggcauaagugaaauggaaugacuaaggagcaugaauggggcccgcuggacccaggugaaggagacagaucuugagcagugguggggcccuggggaaccucuccccauaccccucccucaguugagggugaagaaggaccagucaucaucacacaagaacugcggaguguccagguccugcgcuggacacucuacacguccccugucauccugggcacuccacacaccccugucauccugagagcugcugcguucaguaagcguugugauggccaccuuacagaugagaacaucaaggcucggccaggguaggugcucuuguccaaagccauccagcugguaaguagcaaagcgcugggggacaggccaugccgugugggcgccuccacugucuggcaccuggauuuucugccaggguccuacugggcaucuugaacacacuggugugggugcgcacgcgucuggugugggagcccuuucuugacgcuguaagagagcagugagaacuagaaggugcagacaggagggcguugcacuggcagcguccccccggccucucacaccagcgcccacucucacuucacuuuucagaagccauagcuuugcgccuucuuuccacgggagucauuugagcugcauguaaaaguuuuaaaguuuucuccugagcacuaaauugggagcguguauguguguuuccacccccaaugugagcaagucugugucugucacccaaagauacuuguuuaauugaaggauuccuuaaauuauuuuaaggaaugaagaauuaccgaucuccugaaaggcaguuuuuuaagcucccaccuccaaguguguaagccucaaaggucccucucucugucaugagcuaauuggaaugaaaugcaggugccguuucugccugagcuccagcagcaucccugcgcuuucaggucugagccagcacauguuucuggcauuuagacuuuacgguaacagcagggaucuuaugauuauuacuaaagaugguuuuggaagaggaccaucugugacuauaaaagugcacaguuucaguuaugcaaacgagugcugugguguuuguguguuucacagaagaugagcuccaggccaagcuucucuguuccaggguacaggaggcugcaggagcgucgcacagccgcccgaucugcagggaacugcccaugacauggccguccuccugucagaagaggacucugggggcucgagauccuggagaaaaggccucauuuggacaggacuguggcaguuuauguccugauuguuggugcauguuuuaugcacguguuggcuccguuuaucauuaaaaccaggaugccagaagccagugcucugcguacuuccagcaggcagaucaggccucccuucagccucugcggccccugcuaaggguuucugacuuuuuuuuuuuuuuuuuuuuugagauggagucuugcucuguugcccaggcuggagugcaauggcaugaucucggcucacugcaaccucugccuccuggguucaagcgauucuucugccucagccucccaaguaguugggauuacaggcgcccaccaccaugcccagcuaauucguuguuuuuuguuguuguuguuguuuugguuuuuucugagauggagucucgcucuguagcccaggcuagagugcaguggcacaaucucggcucacugcaaccuccgcuucccggguucaaacgauucuccuaccucagccucccgaguagcugggauuacagaugccugccaccacgcccaccuaauuuuuuguguuuuuaauagagacgggguuuugcuguguuggucaggcuggucuugaacuccugaccucaggugauccgacugccucugacuuucuuuuugggagaaguuggugaugguucagcagacaaauaauugccaaauuacauaggaggaaaaugcugccagaaagggcacacaauuuagcggagucaguccagcagcaggugccuuuggaggcuccccuggugucccaugugucugagguugcuucccuuccauuagcgccaugccgcucgacucccaucaucggggcgguugcagaagacagguggucauuuauauuuuauugucaggggccuugucuuugccuacugaagauauauuugcagccccuggaaugacacuugggaucauucaagguaaccaccggaaccgcucgcaugcgaccuccuggaaagguugagccacgcugucuuccucggugcccucaccacgguccuggaaagguugagccacgcugucuuccucggugcccucaccaccguccuggaaagguugagccacgcugucuuccucggugcccucaccacgguccuggaaagguugagccacgcugucuuccucggugcccucaccacgguccuggaaacguuaagccacgcugucuuccucggugcccucaccaccguucucuguaaaggugcucagaugcuuuccuuggggcagauacggggccuggcuugcucucccagagaugcccaggugugcagggccucuuccuccuccccucacucucuccucugccuuggucguggucccugcuugguucccugguucugguagucccucgagaggggauguccuuuccugcucguccucagccaccagcacuuggcagagcccuugcuacacgagcagcucucacagaagcuucgagcgcagauccaaggguggcuuccgaucccucaccgcagcuuccccacacaguccuaaacauauuugcagcguuuuguuuugucucuucuguagccuuagacaagcugggcuccagcauaugccccuuuucaccugacuccuuccacucuccauagucaucuagagauuuagccaggauuuugcauugucggugguuugugucuuuguguaguggagugguuugucaucguaaaggauucuuuccuuaaaaguguucaucuauuuccucccagucuugagguuagaaagugugacaagggugugguggcucaugccuguaaucccggcacuuugggaggcugaggccagcggaucacuugagguccagaguucgagaccagccuggccaacauggcaaaaccccguuucuacuaaaaauacaaacguuagccaggcgugguggugcaugccagugaucccagcuacuccggaggcugaggcaggaggauugcuugaaccugggaggcagagguugcagugagcccagaucgcucugcugcacuccagccugggcgacagagcaagacuccaucucaaaaaaaaaaaaaaaaaaaaagacaaugugacaaugucaguccuccgcccccuuuguugcugucagucagaacgcggauuguuuucccaggguuccggcaguguggacccuggaccagcagccucagcaucaccuggaaacuugcuagaaaagcacauucucaggcccuacccaggccuccugaaucggaagcucugggugucccggcagucugugugcuccugggaauuuggacaccugcuugugucugaggucugagguccauucucuguggggugagggaggaugagggcugggccugcuggcuuuacagucagcucggaagcagcacguggcugucuggacaaagccuuugguguugcuuccuuuguccugaaccaauguccguguguuccuuucuguuuuauuccagaauacggugcauggugguuccucuagcgugagugccguagugauuucuacagugcauggugcuuccucuagcgugagugccguagugacuucuauuccugucacgacauaaaaugcagccauaggugcagcuucguguggaaaagacuaggaacacgaggcaaaucccuggucgaccuuaggaagugggugaggggagaagccugggggcccacagaacucugcacaaacugcguaucugugagccaaaccauuguuauuuuaagucauuaaguuuggggugacuuguuuaauccagaugaaccugcaggcugcccagguuaucuaugaguggugggugguggcaaagagcagccauuccaagcagaggaagaagacuggcucauaggaccgcacuccacagccccccaggccaccaugugcaacgaguuaguugguacugcaucugggaaaaagccugaaggugagaaacagcagcgagcgcaggaacauggaaacagggagaaggugccacuguggugaccccagaggaaggaggccaucugaaggcaggcacgguggagaaacaggaugggcaguucugggugcaggagcagcaggacucgguggaggauggacagaaggaggagucuaggccaagggccucaccccuggcugaagaaucgcuggggcucaggagccacagaugcucggaucccgccuccaggguucccaaucucaugggacacugguagucaaaccaccccggauggcucugaugcgcagccaaggcugugcgugacucuggggccagggcuaguggcugucacuaagggccacccagcaggagcggucugaggguaggugaagagguucccuuaggauuuggggagauggaaguuaggcccggccucguccuggagccccguggguggaagggaggccucgucugggugauggagaggacagccugcagagagaccggcgggggugugcaccagggcauacugagccuggccauugugguacaaggccuggguacuaccagccucgugccugcuggggguccgggaauguuuggggagcacuguguugagggugagccugggugccccuccagucacaccugaggaggugaagaaugucaggacugggcugucacucgcguggaguauccauguccuagagcugccaugugucacacacugagggcuuauaggccugagaguucuggaauuggggugugggcagggcugguucgcucuggaagcuucgagggagaaucugccccaugcuuccccuucccgccuccauguguuaccagucauccucggcauuccugacucauggcagccucacuccagucuuugccucugucgcuacguagccuucucccauuguguggcuguguccacguuuuccucuucugugaggacacccaucguuggaucagggccccccuacuccaguguggccuccucugaacugcaucuucaggugcccuguuuuccucuucugugaggacacccgucauuggaucagggcccccccuacuccaguguggccuccucugaacugcaucuccagaugccguuuuccagggaggccacguucacaggaaccaccaggaccggggcuugagggacacggauccacucgcuguggacaggcccucguggagcagggcugaugcguugccguugccggggagccgcugccggcacccgugcucucucuguggugaacuggcccuccucucccgcucagcaguuuaacaggccagugcaagcugcucaguucccgggcagcggugccgggcggucaugccgcucuaagccaggcagguuuguccacaggaggccacuugugguucagcaaacacagaauuagaaaaccagaaucccuguugcacgucucugcagauggagcuguucagcucaguaugguuaaugucagggaggauuaacugguucagucugauccauuuaccugaugguauuuuauuuuaaguacagaggugguaguacauuuucagaaaacauuauuccuuuucuuacugcugcgaaugcacugucauuaaacguggcuuuaaggccaagcugggccuggcccugcccagccgugcucagcacugcccccucguccuccucagggccuggcagggcucuguggugacugucgccaucaccguaacgcaggaccagaugauuuggaaggaauccuaggggcaucuggguauucauaaacgcugagauugucccucuaagugucuccugucuaccaucuuacucaggaucgcuggcccauuacggugucaggaaugugcugcuuuuaauuaaauuucacgaagaauaaauguuaacucuccaagugucuuuaguuucuucucuguaguugacaguccuuuugagaaauggauuguacacuuuaaucauugucauuauaaagaggcaguuucuaagggauguaucaagguuuuuaaaaauuuguuuauuauuuauuuuauuuuauuuauuuauuuuuugagacggagucucacucugucacccaggcuggagugcaguggcacgaucucggcccacuguaaccuccgccucccggguucaagcgauucucaaccuuccgagcgauucucagccucccaaguagcugggauuacaggugcgugccaacacgcccggcuaauuuuuuuguauuuuuauuagagacaggguuucaccguguuagccaggauggucucaaucuucugaccucaugauccgcccacguuggccucccaaagugcugggaugcaagcgugagccaccaugcccggccuaaggcuuuuuuaagcaagaggaaucucaauuauaaauuaagguuauuuuuuaguucuuuuugguuccucacuaacauuagugaaaagcgaaguuccgagaguucagucucacaggugggcucugugcaggugguagccuuucuccacggggcagggcucacgacccuccugccagccuccccuguggcuggacacuccuggaccugcuucuguuggggggcaggccuggcucccugccccuccccugccugcccuugggggagaguuaagaaacaaguauuagugaagauuucauuguguuuuugcugugggucuccacgaggacuuagcaggccucggaguugggacuggguuggauugagggagaccugcgugagucacauccucaguuuccccaucugacuugaggaagcugcaaaguucuaaggucuagaagcagcugguuuuuaguguuguguuuuguuucaagugagugacuucaggugaggagaugcggguuccuuggccacgucgugaauccugcucugaguuccucaguucccccuguguccagcugugcguggggugggaaggaaggaggaucgggagaaaugcagugucccccugggaauacacugagugaguggaccuugggcacacuggacccaugccuagcagacaacuggacauguagauccaggaaaagagcccuccucugagucacgccacccugugcgucaugggagauaaagacuuguauuaaacaagcugguggaaagaaacacauuuaucgaggaucguuagggaaggugauugaugucaucaaaacacuuugcauugcaacaugccaacagcauuuugggaacuaagcugcuggggacuagauaaaccaaggcauauggguacagcucacaggcguuucuuaaaaagcugguuuuguugaaaaggaaaugcaucuuaaaauucacacaaacaauggcaaagccaccuggugcucacgcaggaggauguggugcugccugaauccugaaguggguggcacccacgagggggguuccucggaaugcugguggcgugugccgggacguacgugcgggacuagagggcacaugaggggaugcucgagucaggggaggucgggagggagggagggccaagcuuuggcugcccaagggugcacaguauaucauggcucagccccgcgaagagacgcuccucuugagggcaccugucccucuguuugcaucccuuggugagggaccaagcgugugcggagggaggcugggaagcacagccuggcuguguguccacuauaagguauucccguggaaggcaaagcacagcguuaacagagugcuggccagcucugucccacaguucccuguaccuuggcacgcagcagcucgggaggcagcacuugcccaggcagccagccucuuugaaacucaucuaccuugggcaucggggaaacccuaggucccccaugaacuuugcucgacccccuggcauaccuguaccucugcucuccucccuuggcccauuccacaucuguauuuuaaugcagcucuaacacuggugucuggauaggucacugcaaauccugucucgaaugggccgugccuauuaaaaggguuugacuccccacagacucuguugccuguaccuggcuugguuugcccgauaccaguccuuuuaaaaaaacucauuuuggccaggcgcgguggcucacgccuguaaucccagcacuuugggaggcugagacgggcggaucauuugaggucaggaguuugagaccacccuggccaacaugguaaaacccuaucucuacuaaaaauacaaaaauuagcagagugugguggcacgugccuauaaacccagcuacucaggaggcugaggcacgagaaucacuugaacccgggagguggagguugcagugagccgagauggugccacugcacuccagccugggcaacagagugagacucugucucaagaaaagcccccauuuuaaccacucugucucuucuuccaggccuuuagaggcagaagagaaccauuguaaauuccagcacaagcucuuucaggcauuguuuauaguuuaauaaauccugccaccucuauucaucccgguaaugaaggggcgacugcucaggagaaaagccagggugcacaaagagaugggcauuagcauauaaaaggacagaggugggccuuccacccuuugcaacgaugcuccuuguacauccacagagaauucccuucugaucagugcacagugaguaaaggcgccggcuccaaagaugccugcucagaguggcugggcgugucugccccaggcuguccuguuguuucggguucaucauggugggagguggugucagggaucagaacaggcagagaugccuggggauggaugccacagccucaggaagggaccaucgucauguauuuaauaacuugaaacagauuaagaccacgagugugcgugcacacacacacacuugcgcuugcauacgugcacucacagaacugugcuuugcucagcacuuucccagcugaauggcccucuucaggugccugaaggccucuggaacacacacuugucugucugucgaccaccuguucaugcacgaugcuuugagugccucugaacauucggacuccauguguucuaguucugcaugcuggacauaacagacugacaagcaccauccccugcucuggaggagccuuccauugagaggggucagggaguagacauaccuccaccagaguccgcgaaagcgcucggcagggagagcuggggagaggggcuccccugucuggccacgggcagugucuagucaccuggcuuguuuucuucuuuggcaaaccagcagcagagaccuugugggcagaagucuccacucuggccggacccuugacugggguagccacccauccauggcaccacugucgaggggagaggagccguugcccccagggcucuucccucccucucugccggcaucauuggguagaaagcaggcauccuugacacugcuagccaucaggagagccaguguuaccaaaggccaucaggagagccggugucaccaaaggaagucauguuucuuucucugaaguccgugugucagucccacaggaugugagacgucagaagaugaagauagcucuucugguggggacuuugauguuacgacuugcagcaccacagagcaccugcuuuucauauaaguucuuucuguggaccugaaauaauccaaaaucaucucaucaaguggaauaugccauaugauauuuaaauaccuguaauuucucuaaaacccuggggccagaaacucuagugguugcucuauucauggauucauguugcaguaaaaugugauaauugaugaauaucuguggaaauggauaugauuguguccuuuuaaaugagcuaacaauuucacgccgaaaucucagcagugcuauuguuuagaauaaaaggagacaugcaaaugaggccagggugcagauugugguagaacaaugcuggcagccucuuuauuggacccauuaauuaauuccccaucagccaguuucccugggaaugaacuggaaaaauaauuaaaaugauacaugagguaaggaguuuagaaauucaaaaggugaaggcgagaauuaguuuaauacguaauuagacauauuauuugugacucuacguuuuuuuaaauguggcucacugaggcaguaggguccuauuuuuaguccuggauaguuaauaaauaucacuuggggcuguuuuucaacccacaauggcucauaaauuuucuuaauaacauuaaguggcuaauuauauuguacauuguuaaaauaacuucuauugcaaaaucuaauaauaccacaaaaguuugcaaaagcaaguuuuuagaggaauucauuugacucaauuuccaagugagaucuggcacacguagaccaaacugaaaaauguauagcaaagaaucugcagguucacauauauuuuuguugcaaacaugauccaaacaaucucaaaacccaacuucguuuuagugugaguggugcagauggaacgucguaccucccagaguucagacugagugcuggcuccauggcucuugggaguggcggaaucuuaacggaacgugcuuccacugcuguguccucucggugaggccucggcccuagccucaguguugcauaugucaggauggacgaacgugagucuuggcauggugcaagugcaucugaauugcaugucucuguccuugcuggagcaaaacccuguuguuuggauggagcggagcugaccugacgguuccaggcuguucccuguuguuugguuggacgcuguucccuguuuggauggaguggagcugacuugacgguucccggcuguucccuguuguuugguuggagcggggcugaccugacgguccuggcuguucccgguuguuugguuggagcggagcugaccugacgguccuggcuguucccuauuguuugguuggagcagagcugacuugacgguucccggcuguucccuguuguuugguuggagcggggcugaccugacgguuccaggcuguucccuguuguuugguuggagcggagcugacuugacgguuccagcgcuguccccuguuguuugguuggagcagagcugaccugacggucccagcgcuguccccuguuugguuggagcggagcugaccugacggucccagcgcuguccccuguuguuugguuggagcggagcugaccugaugguuccaggcuguucccuguuguuugguuggacgcuguccccuguuguuugguuggagcggagcugacuugaugguucgagacuguucccuguuguuugguuggagcagggcugaccugacgguccuggcuguucccuguuguuugguuggacgcuguccccuguuguuugguuggagcggagcugaccugacgguuccaggcuguucccuguuguuugguuggacgcuguccccuguuguuugguuggagcggagcugacuugaugguuccaggcuguucccuguuguuugguuggagcggggcugaccugacgguccuggcuguucccuguuguuugguuggagcggagcugaccugacgguuccagguuguucccuguuguuugguuggacgcuguccccuguuguuugguuggagcggagcugaccugacgguuccaggcuguucccuguuguuugguuggagcggagcugaccugacuguuccaggcuguucccuguuguuugguuggacgcuguccccuguuguuugguuggagcggagcugaccugacgguuccaggcuguccccuguuguuuggcuggagcggggcugaccugacgguuccaggcuguucccuguuguuuggcuggagcggggcugaccugacgguuccaggcuguucccuguuguuuggcuggagcggggcugaccugacgguuccaggcuguucccuguuguuuggcuggagcggggcugaccugacgguuccaggcuguucccuguuguuuggcuggagcggggcugaccugacgguuccaggcuguucccuguuguuuggcuggagcggggcugaccugacgguuccaggcuguucccuguuguuugguuggagcggagcugaccugacggucccggcgcuguucguguaaguuguuucuguuucccuguuauuuugaauauacuuaaauggcccaauaauuccauuucugugaaccuaagaguauaaacauuucauaagauuauugaacuuaaagugauaggccuggcuggaaauauuuuaccccauaccugugcuuauuucuuuuuaaugagcaacugaaaaguaauuuuaguaaccaaccucccauaccuuuggagaacaaauaaaaccacaguaauuuccacguauuaagagcccacaugcgccuaucacugucauccacagucugcaccuguuagcuuguuuaagccucccaggagcuugcacagaguauggccagauacccgccuuacagccugugcugcuguggccaaggaaaagagguuuugugccuggggcagucagaccuuccagugggagugacucuuggcugcucccugcccguccucaguugcuuuuugguggaagugcaggccccucucuccccacucugcccucccagccaccugagccacugagcuucugcagcagcacaagcccuuucagucuuccugagucggccccacucuggggugggcucccgcuuuuaggcucuuugcuuucacaaucaaaguuacaacgggaagcccuucacucggggccggcgggaaaggauccagcccugcuacuuccauucuuuccuuuuaaacaagacucuguccauuaaucauccucugguuugaucugucaauccagaaacccuugcuaaugcuuuauggcugugguuuguugcgguucugggaaagaggaaaagaaaugagccaguccuaauaaaugaaaguuauuuccucauuugaauuucugaguccugagagucaauaugaugcagacaucaaucuuguuauucucggaguggagagacaguuucugauugugccucucccuggguugugaugauaaaacgugugguguguuuggcugggcucagucauggccucuccugagacccccugccuuuuuauauugcagauaacacacauggcuuaaugcuggaaacaggccuguguucccuuggucuuuacgaguguuauucuagaaaacuucauguuucuaaggugguuucauuugucaugaauacucagaugcgguuuucucuagcagcccuccgagugugcucggaaaggugaggcccccgaggcagaggcauggccaggacgcuggugggcuucuuugggaauuaggaggaaaaagaggaguggggcagagccuggagaggcugcccuccuggggugcaggccgguggaggauguggagcugcccagcuggcagguggcagaauugggacugaagcucaguccccacucguccaggccacagcuucuccuuuggggccacucugccucauucaccaucucuccagcaccaagcaauugugugauucuuacaaugugccugucgugcuucuggucgcagccuccuuggcuuugcagcagugcagugccugggccugcauuuggcagaaguggaguucccagucccauccguggaguggccuuccccugagagcuugccugguauguuucagaugcaggggcuucugucucuccaugccuuaugcacuuggccacaccccuguuagcaccccugccauuucccagggccacuguugcaggcacccaggaaggugccugaccuggcucuacaucccacacccugugcagggggccuagcaugcuggcagccugcuaagagcuggauagguauguggugagcacauggcaccccgauccgauuuacuugguguccugucgggcacacuugugaauacccgccaggccuguguguggguggagacagaaccugcccucuggccaucgaggcugugccucuuggccauacaugucauggucuuguucaucagaccugcccugccugucugcugggagggcccgcauggagccucuugcccagcugcagacaagggagggugaccggccccacacuccuauaugaaggauggauagcucugggcagcuuuuugguucuggggucagauuugaauguaaaacugaaaaguccuaaauuuauuaaaggcuuucuuuuggggcuggaauaugcaauagauuuucuaucccucucaauucccucuuaaaauuuaauacugccauaaaaaugauggauaacaaauuauuccaggaaaaaugguacugaaagacucuucuaacuguugaagcagaaguacagacuuggcgaagaaauagacaugacccagaaaacucacgaggaaagaggaaaucguguacuuuguggaaaccauauccacguaauguuguuccaggcuguagaaagcaacuauuguuauuccagauacugaagcacagagucuauuuugugccgcuggcgguuucauuaacauaguaacacucugccuuucuagaauugggugagcagccuucccuguuuggaacacugcagagggagacugaaccccacaauugauaucagaaggccccguguggaugccucuucagggugccuuccacagagcucugccagcaugcugaggcugcggggaaaaaccaugaagccucauaaauauauacaaugauuguguguacccauaaucauuagaaauaaaaauuuaaaaaaacacauaaaaccacaagggcucugauugcugggucuaggacuuccccacuccgacagugaugguagcagaaacaaggccugacagccagaccccagggcaggcagcagggaggaaaacagauuuaaaaaucgcaccagacacucauuuucuacagaagucugcgugucguuaauacaugggcaaacagcccuuuguuccuuaguaggccuuaaagacaccaccccaugggagcuuucuaaaaaagauaguauuaaaagacuaugauucaggcugggcacauuagcacacaccuguaaucucagcacuuuggaaggucgaggagggcagaucacuugagucuaggaguuugagaccagccugggcaacauagcaagaccugaucucucuacaaaaauuagcugaguaugguggcauacaccucuggucucagcuacucgggaggaucagucgggccccggagguugaggcugcagugagcuaugaucgcaccacuguacucuagccugggugacagugagacccagucucaaaagcaaaacaaaacaccccacaaaguauauaauucagacuuaacauccugacucuuguuuuuacuccaaggcaaugaagcaaugauguggacgaugcguguccuaauccggagcgccucccaggcuaggaauccaagccagguuauggcuuaaauggagaccgauggagcugcuagcugagaucgcccacauuggccucugcagacucccuuguuuucccuaaugugugucaacacaucuauuaaggggaaaggacugcucgguaucaaugauuuccacuuggaaaugucaccaugacaacugaggaggugcuggaagcaggcacuuuguuaauucugucuuaacccaucccaggcaacuucaaaacuuuuucucuggagagaaauaggcuuauuuaggaaaggcgucucucauugauccucagcuacauccacugaagugaauaauuuacuucuuuggcagguuuagaaaauuagaugcauacaaucuaauaucccuucuuuguacauuuucaugugaaaucuuuuggagugcuuuuugauagccacccccucggggaccuggaaguggcacugucugaauucuguucugucgguucugugagggacagaugcuccaugucauccugagagccauccuaccgccuuccugcccaguccucuucacuggcaccuccauuggccaacagaucaagucugcacaccgcagccuggcugcgaggguccuuuucauccagccucauucaucaguguucuugugagcaucuacucuggguuaggcccagaccuccuggguuaaucagauugaacaaagggguguaauagagaaccaaagggccaggugcgguggcucacgccuguaaucccaccacuuugggaggccaaggcaggcagaucacgaggucaggagauugagaccauccuggcuagcacagugaaacccugucucuacuaaaaauacaaaaaauuagccacgcauguuggcgggcgccuguagucccagcugcucgguaggcugaggcaggagaauggcgugaaccagggaggcggagcuugcagugagacgagaucacaccacugcaguccagccugggcgacagagcgagauuccgucucaaaaaaaaaaaaaagagaaccaaaguacuaaacugggaguuuguggggacauagaucccugcuuugcuucuuguguguguugggggaggcuuuguagggugcugagcuuucaauaucauauaucacaugauccugagaacucccagagaugcugauagagcaucaaaaacagacuuucagccaggugagggggcccaugccuguaaucccagcaucuugggaggcugaagugguaggauugcuugaggccaggaguucaagaccguccugggcauauagcaaaaucccaucccucaguguuaaagggugaccacuauaaaugaguagaaauauaauauacaacuucuaaauuaguagagggaaaaagagagaggaagaaaaccuugaucaauacaauagaaggcauaaaaggagaagaaauauuuuuaaaaagcaguaaaaguaaaaaucaugaauaagauauuuuaaauaaauauugagauaguuauuuaaauaaauguaaauggccuaaauuugccaguuaaaagacagugauuuuugaaaacuaaaauccaacuaugugguauucaugauugacacacacacacacacacauauggacacagaaaguuuugaauuuuauaaauggaaagaaauacaauaggaaaaucaugacuaaagaaaguugcaauagcuacacugauaucagacaaaauugauuuuaagccaaaauguauuaguguuaggagaucucuacaggaugauaaaauaaauaagucacuagggauauauggcaguucugaacguauaugcaccuaagaagcuuggccuuacgguauauuagguaaauguugccagaauuacaaggacagauugacaaaucuguaaucauugugguagauuuuaucuuaccuuucucauuaguugauaagccaacaaacaaaaagugagaaggcauagaagauuacaacaguacaaaaacaagcuuaauugaacgguuguauauagaagucugcaccggaaaacagagaauaacgugaagcauuuguaaaaauugagcacauggaaggccauagcaauucucaacaaauuccagcaaauugggacugauguauauauauguauauguguguguguguguauauauauauauguguguguauauauauauauauauauacacacacacacacacacacacacacacauauauauauauauauguuuucccauggugcauuuaaaauagaaaccaguaauacaaagagaacaacaauaccaaauccccugcauuuggacauuuuaaaaugcacuuuuuaaauaauugaacaguguuuugguaggugauuagguauuuauuaaauaaaucuggcagauuggaguucugcaggccagggaaacuaugugaggacugguuuaucuccugcauuuccuuccacuuguucucccucccauuuuucuuguuuguucuccucccugaccuccauuauuggucuccgcauuugugauaguucguuugcuuugacugcauguaacaggugggggaaaacaaacaacaacagcaacagcaacagcaacaaaaaacaguuaaaaaagaauaucaucucccugugacaagaguguagagguagacaucugugggacugugagaucauugguggcacacaucuugaugcucugauccucuuaaugugcuaccucauaguccauaagggcagcuugaguuccagccgucaugucaguaucccagcuagcaggaaagaggaagugguaaagaagggcaucaugccuucuucacugaaggaugcauccugaguauugccuguacuucugccugcguauuauuggcaaaauguaaucacauggcuguucuuagcugaaaaggagacugggcacaugaccacuuguuccuggugccaauggcucagcuaaaaauuguggauucucuuauugaagaagaaggggagaaagaguauuuggucggaagcuggcagacuuggccacaucauuccacuggccauuccccaacucucugugugcauucacuacucuuguacauacuaucuccucugccuagacaucuuuuccucuuucccuggugaguguggacucuuucugaugacucagucuucaccaguaugugaguucuggcuugggaugugacuuacuuguggcuaagggcaguuugucccuuuaaccugugaucccagguugcuguggcuccagaguugucugcaguacuuaucuuuccccaaggccugguagcaagcccucccgcccuauuggaagugguuucuuauugcuucgguucugcuggggggucugaaaggucuguguucaaguuccggcucuaugcccggugaccuuuaguugcacauugaguauuuauggugcucuuucuaugugccuggagcuguuguaaggagcccagcaaugaggugcucacacucugguggggagugagacaagugaagaggcagucgcacugcagagcaccgaaggcugcgguggcagaagcacggggaccaugggaucagugagcagggccauugggcuuagucugaggggucagagaaggcuuucugggauaaagcucauuuuguggcuuauuuuccugaaccugugucuucauuuuuaaaaugggauaggaaugccugugcgccaugauuugaaaagguuaaaaggauuugcacagaacuuggcccacagucuguacucaguaccucacgguuuucuuuuucugcucuccuaauuugcgcuccuuccuggaaugguugucucaguguugccuugccuugcccagcagcaucuuguauuuagcacuugaaauuuacagaacuuggucauacaugcccaucuguuacagcaguguucuggaucuccaugccaggcccauccacggaguugcuguguuuggucccccuagacacccuugaggggguagaaagugugauuucagguuuuguggaugagcaggcuaucacuugguaaaaguauguggcagugccguggagagaaacagggagaagccugcucuccuggcucugagcucacuucucuucccucugcccuuggucuuugugucaccucucucccuggauggacgugaguauguuucaaucuauacuguaagauuuuugcuuucaaaauaaauguagaaaaagggugagaauugcaaucguguaugcaagugugcccccuccccuccccggagagcuaagacaggugagaauggcuggcauggaacagcuccaugccccccgcucccuuaccuguaagacacugcuggugguaggauccacuucaugagaccauugugaggaguaaaccaaauggaauagugaauguaacgcgcuuagcacaguuguggcacgcagugccgugucacaggccagagcuguggcguguaguugcuaucagugugauucuuaccaucgagguuuagggaaccuaccaccccauauacaauccuuuuguugcacccuuuuuugcugaucauccagugucugcugcacuaccuguggugacagugaacccauuacucacaaggcagccucuuccauuauuaauugguucuaguuaagaaggcuuuccuuacauucaucuaaggucuaucacaugguaggaaugcucccacggagacugguuuucuccucaggagcugcuguaguaugauagagaguauugggguggaaaggcucacagaaggacguggaccgauuccaucaguuuacagagcucucagcuacaguguccucaacugugcagagcuucucucuuugcccucucuaaacacccuguauauauacgaacaagagagcgcuacuuuacguggcuuggggcuuguugucauugaguggguaagugagaauguagagcagacuuuuuuuuuuuuuuuuuuuugagacaaggucuuacucugucacccaggcuggugugcaguggcacgaucuuggcucacugcaacuuccaccucccagguucaagcaauucuccugucucagccuuccuaguuacugggauuacagucaccugccagcaugcccagcuaacuuuuguauuuuuaguagagaugggguuucaccauauuggccaggcugguguugaacuccugaccucaggugauccacuugccuuggccucccaaaguacugggauuacagacuugagccaccgugcccagccgggacagacaucuugauaaagaaaaauugaaguuucauuucuaguagguuggugaaauagcuaccuucccauggaaaagaaauaaaacugcuagaaaauagcauuuauaauagcacagggaagggguaaauggaaguaaacucuuguaagguucuuauauuuaaguggugcaaaguaacugaagauaaauucagaugagguaaggauguauucuauaaacccuagagcgaccacuagcaaaauaaaacauagguauaaaauccuaguagagaagauaaaauggaguacugcaagauauuugauugauccgaaagagucuggacauguaggaaaaaagaggaguacagaagagaacaucaaaagcaacagcaauauaguagacuuacacuuaaucauauuaacaguuauguuagauauaaauggauuaaauacuucaauuaaaagauagauuguaagagugaauagacaagcaagauccaacuaugugcuguuugcagaugaagcacuuuacguguaauaacauggauagaaaaaaugauuuaaaaaagguguaucaaugcaaauacuagucaguagaaggcuggcuacauuaauaucaaauuagggagacugcaagacauacuuuggcauacuaccacagcuaaagaaggacuuuuuucuuuuuuaaugauaaaagaucuguuaaccaaaaacguauaaacuacccuaaauguguuaacaggacuucuaauuacaugaagcacaaauggacagacuugaagggaguagauaaacuaguuauaaccagagauuuuuacuuuuguuucucagucauugauggcaugaagagaccaaaaaucaguaaaaguauauuugauuuaaauaaaauuaugaaguagcuugcuugaucucauugacauuuauagaauacuacauucaacaauggcagauacccaacaacauucuuugcaaguacucaguaacgaaucaccaugauuuccugggccguaagacaaggaucaaaguuauauggaguauguuaucuaacucuaauagaauuaaguuagaaauuaaucagaaagauaaaaaucucaaaaauuuugaaacuuaagcagcaugcuuuuaaauaauccgcgauucaaagaagucaaagggaaaagagauuuuuuuuuaaccgaauggauuauaaaaauguaaccuuugaauuuguggguuauagcuaaagcagugcuuggggagcuaaccauauaccuguaaaaauauauauauauauauaugaaugaaaagaagaaggacuuaaaaucaggaauuuuaguuuuuaccuucagaagccaguaaaagaagaggaaauuaaacccaaaggaaguagagggaaggaaaugaaaaugaaaagaacagaaaucagugaaauagaaaaugggcaagcaauggaggagaucaacaaaaucaaaaaaucaguaacauugaaacaucuuggccgggcaugguggcucacgccuguaaucccagcacuuugggaggccgagguggguggaucacgaggucaggagaucgagaccagccugaccaacauggagaaacccugucucuacuaaaaauacaauauuagcugggcgugauggcgcaugccuguaaucccagcuacuagggaggcugaggcaggagaauugcuugaaccugggaggcgaagguugcggugagccgaaauugugccauugcacuccagccugggcaacaagagcgaaacuccgucucaaaaaaaaaaaaaaaaaaaaaaugacaguacacacugaguagcauuuguucuaggcuugcaagguugcuuuacccuuccaaaaucuacccaugugacugaccacguuaacagaauaaaggggaaaaccauaugaccaugucaauagaugcagaaauagcauuugacaaaauucagcacccgccgugguagaaacgcuccauaaacuaggaguagaagggcacuuccguguugaaagacacucauagagucucacaucuuaccucauaauuaguggugaaguuaucaaaugcuuuucccccuaaggugagaaccaggcaagaauucugcucucacuacuucuauucaguauugcucuggggaguuuagccggggccuccagucacgaaagugaaauaaaagacaugaggauugacaaggaaaaagcucaauuguccuuuggauuauauagauagaaaaaauuuaagaaucuaccagaaaaaguggaugcaggauacaagguuaauacagaaaaaucaaauguauuucuguauauuagcaauaaacaauuagaaaauaaaauuuagaaguugauaucauuuuauaacaacauuaaaaauccuaaaaauacuuagggauaaauuuaaaacuacucaagaucuuuacacuaaaaacugcaagacagugcugagagaaauagaaaaagaucuaaacauauggugagauauaccauguuuuaugaguacaaagacuuaacacuguuaaaauauuaauugacggccaggcauggucgcucaugcuuguaaucccagcacuuugggaggccgaggcggguggaucaccugaggucaggaguucaagaccagccuggccaagguggugaaaccccgucucuacuaaaaauacaaaaauuagccaggcguggugacgcaugccuguagucccagcugcuugggaggcugaggcagaagaaucgcuugaacccaggagguggagguugcagugagccaagaucacgccacugcacuccagccugggcgacagagcaaggcuccaucucaaaaauaaaaaaaaaauuaacuguccgcaaacugauuuuuaaagucagugaaauccuaaucagauuccuacuaaccuuuauuauagacacaaaucaauuuauucuaaaauuuauguggaaaugcaaaggauucaaguuaauaaaauuuacagaguuuuuuaaaagaacaacuaaguuugagaacuucuugauuuuaggacuuccuacagagcggcaguuaucaggacagcguggcauugacauaaggauagauaauagaauaauagaaucgaguagagaucugaauagucaaaggacagacagggaggguauauuuauaauacauacaucugacaaaguacccauauccaggauauauaaaaacuccuauagcuaacauuacaaauagcccacuuuaaaaguggacagaagguucagauagacacugcacagcagaagauauucugauggccaacaaacacuugaaaaaguacucaaccuuauuagucaucaaggaaauucaaauuaaaaccacaaacaagguacuacuacacgcccuccuuaauggcuaaaaaugaaagaacugacaacacuaagugcugacaaguauguggcucagccagaagccccaggcacagcugaugggaauguuaagugguaccaccacuuuggaaaacuggcacuuucuuauaaaacuaaacaaacuccauuccuagguaugugcaugagaacugaacauuuauguccacaaaaaaguacuuguaccagaauguucauagcagcuuuauucauaccagccaaaaccuggaaacaaugcaaauauaugucagcaagggaauggauuaacaaauucauaccgagcagugcucuucaaugacaacguggaugaaucucagaaacauuuuaaccagcaagagaaaacugcaagagaaaacauaccgccugauuucacuuacgcuaaguucuagaacugacgaaaacuaaucaagaguaauagaaaucaaaauggugguuuccucugguuagcccuggguagugcgggauugcuggcagaaggacauuuauauaucuugauagggauguggauuccacugguauauucaauugcaagacucagcaaauaguuugcuuagaucucuguguuuuaaauuauacauccgaaaaaaacuauuaaaaucauguaaaauguugaaaucuagaaauacuuagaagacacacacacacacacacacacacacacacacacgagucaaaacaugaacccaaaguaaguggcauccucguccuguuuuccaaaucugguuaaccugagcuuccgugggcgagaccaucucaaguacuugggacaaaaggaaauggucacgguucuccccagguagugaggcugaggggagaacccucuaaauaaagccgucagcucagagggcgccguccucagugaggcugcguugggagcaacuccugcccagccccaggggaggcuccuuacccuugugcugagcucugugaaucugucugugagugaggcuuuggcagaccguuugcuuaagggugaaagauaaauugucaucuuagggagguaggguaguaagaaccaucccacacacuggugggaagauauucaaauggccaucaaacacuugaagaaguacucaacauuacucaucaaggguauauuaaaaccacagugagauacuacugcacgcccaccagaauggcugacaacgaaaggauugacaacucuaaaugcuagcaaauguguagcgcagccagaagccccaggcaugcggaaaugcaaaggauucaaguuaauaaaauuuacaaaauuuugugaauuuuguaagaggcaaaauaggagugauaguauuuggauuuaccaguguacacugugaaaaucaacugcaaaaaagaauuuggcuucaccggggagaguugaugaggugcauucucuacgauccagguauuccacacuuaagucauacgcagucaggcugcccugucuaguaugguggccauuagccacaugcaguuguuuaaaugaauagauugaaacaugacauuucucagucacacucgucacaguugagguacugcagacccaucuguggccggcggcuacaguauugggcagcacagauguagacauucccaucauugcagaauucuucccgaggugccacuugagagcacugauucuccaggggugacgacuggaccggcagcuuccgcaucagcaggauguugcugggugcaucaacagguugcugcauuucuguuagaaaugcagauucaugagucucauuccugagugaucugcggggucagagaugcaggaggcggggcccagcaggcugugcuuaacgagcccuccaggugguucuggagcacgcagcaguugagagccacugcucuagggggacucuugaaaaugugcacgcggauuccugcaguccugauuuuuaauagcaagaaaggagcagaaccuaaguauucagcaacagaauggauaaacuguggaguauuguuggggaaaugaaaauuaauaauagucugcagcuacacgaaguaaugugaauguaugaaaagucccugaugaauacauaguuuaugcuuaucuuuaucuaaaauucaaaaccagaagaaaacaaguaugguacaaagauagagaaaagugaggaaaugauaaaugcacaauuaaggacaguguuuaccuugaaaggauuagaaucucauggaaauggcuggcuucaggggaaguuaccaauccagagguucauuuucuccuuaaacaauagaugguaacucuaagcguucuuggacuauuggcauucuuuuacuuucauauuaaaaaaauauuuugaggccaggcaugguggcucacaccuguaaucccagcacuuugggaggcuaaggcaggcggaucgccugaaggucaggaguuugagaccagccuggccaacaugaugaaacuccgucucuacugaaaauacaaaaauuagccggauaugguggcgugugccuguaauuccagcaacacagaggcugaggcaugagaauugcuugaacccaggaggcggagguugcagugagcugagaucaugccacugcacuuuagccugggugauagagcaagacucugucuuauaaauauauacauauauugauauuaacucaauauuuaaaccauuuaaaacuauaaaaauaucaguuuuugguugaucaugaauuuuuuccagaaaguaacauagagcaccaaaaauauuccuuuaucuauggauuagauaaauauuuuauccaugcagucuuacaguugccaauuuuugcuugaauuuuccaucuuagcauuuauuauuaggcauggaaggauuagaaguaaaaugcugggcagagcucucccaaucaaacuugagcuauaggcaaaauaggagugauaguauucagauuaaaaaaugacuaaggaaaauugcauuaaguuaauuacauagagccauuuuauugugguaaaacaauauuaaauauauaugucagaagucgucaagauaagaaaacagaaagccaaaaucugaucgaaagauuacaguugcaauagagaacuuuaauucuuucuuaucagugugugaguuaucaaguagaaaaaaaagggccaaggauucaaauaauauaguuuuauggucaaauuaauauuuguucaccgggaauccagagaugggagaauagcuagacuuuuuagaagaaaucacacuaccaucuacauucaugcacacagaugcacuugcuguccacccauacguacaugugcacugaugaaugugcagaccagauuaaauugugauguaaacaguuaaguuaaaaccaugugcuuagauuaagcauuugaagcaugccagugcccacuagaaucaagaauuuaguagaaugugugaaaugucaguugacuguggugucaggacguguccauugggcacuguagcccagcgcucuucugggagcgcuguggcucccauguguaccauuuucuaccguaaauuaaaacuguagccauggcuggccgagcgcgguggcucaugccuguaaucccagcacuuugggaggcugaggugggcggaucaucugaggucgggaguuugagaucagccuggagaaaccccgucucuacuaaaaacacaaaauuagccgggcgugguggcaggcgccuguaaucccagcuagucaggaggcugaggcaggagaaucgcuugaaccugggaggcggagguugcggugagcugagaucgcgccauugcacuccagccugggcgacaagagugaaaccccaucucaaacaaacaaacaaacaaacaaacuaaaaacaaaccguagccuuaaucuggguaaaggguccaggggcauugcuuuguguuguuucuuacaacuacauaugaagcuacaauuauuucgggauaaaaguuuaauaaaguguucuccucccccuauauacuaacaguguauacgcgauaguauuuuaucauagguaauauuaucuaaugcccaacagcagagagccgucagccuauggggacuuuccucguacggugagaggaaaggagggcagacagccgggaggggagcacagugcggcagcagggcggacacagggacccagcaagaaugagcacagacgggugguucacacacucuagcaaguagcauaugccuggacaacuguuggcccaggagccauccaaaagauuaguuggagaaaagaaaaaaugcuguaucuacaggccuguucaucguagcacuguuugcaguagcaaaagauagauauccaucaaugugaaacuggcugaauaagcuguucuacaccugccaccccgcaacuggaguucugcacggggcugaaaggaaugugggugcuccgucugcagcuagugagcucuugguugccucacuguuuacuggaggugcaaggugcagaacugugugugucauaucccaucacuuaccuguugauugguuggcagaguaugagcguacacgcauacgcgcaugcacacaaacuuuccuauuugcuuauauuacaaaccaaacaaaauuaaagaauaaaccagaaaccaaugaaaaaggguuauagucuauauggggaagaugagauacaaagggucagaucugaagccugacuucucuucucugaauguaccuuguuuuauaguuuuuuacuuugaaucauguauugcuuuacauaauuauaaagccaaacuaagcccaaaucagaaagcuauucuuaaaaagcaagaacaaaaucaaaugaaaagagaaccuaaacuaugugucaagucgguacuuuaaucacacagagaaaaaugacuucaaacagacuuugaagcaauuugaauguacagccccaguaggauauaucuuaagcaaaaaagaauugcaaaaguucucaaacuucagauuguugguaauauuauuagugcuguuugaaacuaugacuuauauaccuacuuacugaaauacauauuugcacauauaucuauuaagacaaagcagauaaguaauuaugauaauguuagaggaaccacaaauucuaacaaauucuaacauaaaagagaaucaagcauaaaauuaaagaaguaaaacacccauaagcuuaaauaugaauuaagguucaauauagccaggcgugguggcucaugccuguaaucccagcacuuuagaaggcugaggcgggcggaucacgaggucagaagaucaagaccauccugguuaacacagugaaaccccaucucuacuaaaaauacaaaauuagccaggcgugguggcgggcgccuguaguuccagcuacuugggaggcugaggcaggagaauggcgagaacccgggaggcagagguugcagugagccaagauugcgccacugcacuccagccugggcaacagagcaagacuccaucucaaauaaaaaauaauaauaauaauaauaaauuuaaaaaagauucaauaugaacuguugguggauucugcccuuugaaaaaauaaccucuuaucuucuggcugugaccacugaaaauuauuggacccaguuaucaaccccaguggaaaugagcacccugcggaguccuuaagccguuucccaugaaaagaaaccaaggcuccuuagagaaauguuugaugccagaaaauguuuaagaugaaucuggaacaucuagucguacagaaagcaaggaacuucucauagacucuugggucaugccaagagcccaauuuaaagggacccucucuagccaaaaauaggaaaacaaagcaucagaaagaauuaugauggcaguuuauuagaacauaccaagaauguuaaagucuaugaauucauaauaacuucuaaguaaagcccuuacuaguucacccgugaagguugcuagggcaccaacugguauauaaaaggaaagagucaagaaaguauucuauuuuccugcuaaucaaauuuuuuuuuuugacggcaaguuauuccuuauggaagaacuguggcuguaaauggagaggcagugaaagaauugcagugucacccuaaugaaaugagucaagccagugcucaccaguagcauucagaaccacgagagggagcuugcaggggacuuggugauggaugguucugccugguaacaccuggaccugccgaucaauugcagcaucaccaggaaggagaccccagacauuucacaccuucugaugcggugaaaugugaaggccacagcuccaacagcgaagcguucucgcacacacacagaucccaucugcauaggauccagccuuuagaccgcaguccugcuugcagggaguaccagggaagggggaaacggauggaacucagcaggggaauaaacuagccagaacuagagugugaaacaucccacauggccaugaccagauugcuuccacaaaagcaggacagagaagcaagaaagaggagggaauucgagauuuuaaaugaguaagagaguuggcucucagaugcauuguguaugugucauuuggagacugaugagaacaaagugacagcagaaagacacaugauugggaggcaugcaggaucacauuaaggaaucaugguuaauuguuuugauguaauaauaggcuugugauuaugugucuaaguuguugucucugagagaagcugugaaaugugaugucugggauuugcuuuagaauaaccuagcagcaugcaggcagagcgggggucgguaauaaaugaaauggcauuggccaaauauugaucauuguggaucuugagugauggaugcagggcugucuuucuacuaugcuuuuuacuuuggggaauucuugaaaagucuuauuugaaaaugguuuuacacaucacaccacacguagacguacacacaguccaugcacacagacaugugcgcacaaaggcggaaagccuggccugggugagcucgugugggaggagugaggccggcagggugggaggugucacucuagucaccagagugggaagcuggaggugacaaggggacaguuugacugucuuaaagauccugucuuguuucuuauuguugugcagaaccuguauaauuuuccuuguuuuagaucguaagaaauucuucucacuguuccauuuucuguaaaaucuaagaauucccugguuaaugguuauugggugaauguggauucuuuuuguucaaauugguucaauaagacuuuuauucacaagucuuauucacagcccaacuuacaaggggacagguugaaguguuugcucaagguugguggugggagguccuuguaaaugcucagucaucagugauaagcagaggucagaacagcccagugugaagccuccggggaugugaacaguccggaacuuuggcguggcauucgcucacccucuggaugucuguaucauuuccccgggccccgccgugcgcagcggucccgugcuaggucuguggggucccagaggggugggggggcgguccucaucucuagaagcuuauaccccagcaaagugguucuccagcuccaccucaccugggaaucaucuugggagccugugaaagaugaagauuccggggcuugccacccauucaugcuaggaaaggccagcauccgccagcucaugucuccacccggcacacacugagcugggcaggaaugacaaggauauaggcacaggagacccagucccagcccagggagcgcucagacagacggggcgucuuggaggugcauagacauuucugccuggaugccacuccaggguggaugugcucguccccuacugccacucugccccguguuccagcagccgaguaacuucgggaaaucccagucagugcugucagaaacgcaacaugcaugcccuuuacuguccuguuuagaaaaugagcaccuguguccccuccagguggaugcugggccugcagaagcucuccuggggguguccggugguggguccugguagccacagccucugcuuccucagcguccccuucguuugcuugcuccaggucugggucgguugcaguugacaguagcggggaggggguggcugcguguugauagagacaggcacuagaagucaucuuugggggaguggccucgcagaggggguggcugcuuguugauagagacgggcacgagaaaucgucuuugguggggaguggccucgcggaggggguggcugcuuguugauagagacgggcacgagaagucgucuuuggggggaguggccucgcagagggguuguugauagagacaggcaggagaagucgucuuuggggggguguggccucacggaggggguggcugcguguugauagagacaggcacgagaaguugucuuugguggggaguggccucgcagaggggguggcugcuuguugauagagacaggcaugagaagucgucuuuggggggaguggccucgcagaggggguggcugcuuguugauagagacaggcacgagaagucaucuuugguggggaguggccucggggagggggugacugcuuguugauagagacgggcacgagaaguugguggggaguggccucgcggaggggguggcugcguguugauagagacaggcaggagaagucaucuuugguggggaguggccucgcagagguuguggcugcuuguugauagagacaggcacgagaagucgucuuuggguggcugcguguugauagagacaggcacuagaagucgucuuuggggggaguggccucgcagagggguuguugauagagacaggcacgagaagucgucuuugguggggaguggccucgcggaggggguggcugcguguugauagagacaggcacgagaagucgucuuugcuggggaguggccucguggaggggguggcugcuuguugauagagacaggcaggagaagucgucuuuggggggguguggccuugcggaggggguggcugcguguugauagagacaggcacgauaagucgucuuucggggaguggccucgcugagcuucuucucagguccugugcaccuggcaggcugcuucagccuucacaaagcagugcucuugaacugaggaccucacaggucugggucucagagguccugagaccuuuagaguuuauccagcuggacucuuccuuuuuccagcugaggaaacugagcuucauuugcaccuaagcugccugucuguuuugaggaauuuucaguuuaguguucacagugagacagguauuaacacaccguaggcuucaccauucucuuaaucaccuguuuuggguacagagcucugugauauggugauaugcacucagugucaucucuaauucuuaccaucauuuguacuggaaagcguguacucguguacuggacaucaugauugccgucuuacagaugagcuguuggaagcugaggcagggacuucaguuuguccugcaccauacagggaccauauggggugggaguugugggccaggccugaguucagugccccugcucuuuccacaagaacagaagagggcacgcuguguaccugugucucagcugugcacuggagggaugucggagcagggcgccuuacccuggccucaggagucccuguggggaagcgaguaccuagagggaugcacugugcguggguguccugauagauugcagggggaauacagccccagagcacaggacagagagguauggagggagcccgcagcagcccagagugucucagugaagagggacaggacucaccauaagggauggggccuuggguuggugguggcggaagaaggcacuucccaggcugggagagcaggaaugagucccaggagagagugaacgaggaugcccaggaguggaaacuggaguggaggggcuuggugggcaccuugcaugcaugcccugggagcagacugcaggcugcacacuggugugcacaggggugagcccguguguaugucuguguggcugaugcagaccugugagccucagccuguggacaugcccaccggcgggccucacaagucauugcagggcuggggacagaacgugggucgcucacugagagcugccccacacuuacuccuucucugaccccuaugcucuuuuagcuaaguucagucuacagagagaguugaggcuuugacguauuaacuggugugaugucauuucuugcuucaaagaaaaaauaaucagggcucacagugguucucuucccuuugaauuugccaagaacauccuugacaaaaauuaagaaaacagcgaaguucaucaguuuggacaggauagcaaaaguaccuuuagaguggugcucacagaccacaugguguuacagcauuuucuagaaaugcugagucaucagacauggaauguugagauuugggaaaugggaggaggagcaucgaggguggcugagguuagcagcagaaaguuaauccuucuugcaacuuaguggcagcucuggcccccacagucuacuugagcuuguauaauucaugaaguuuugacagagcagcauugaaaggaugucuuugauuucauccauaaaggagauaggcgugugcaggcggugcgguacuugugacgggagcuugugaagugagccgccucccugaugugucuuggcggccagcaggcccugugauccugcgccgagucuccuguggucuccucuaagcaccugcuggugaccuuggaucucuccucaggcccuugcuaaaauauguaaaucaaggucauuuuuuuugaguuugauucuuagcuaguuuuugcuggugugcauuuuucugguuuaaggauccuugccucccugcagggccagcagcagcaaaggaugagagagagcagguugggggagggggcugccuuguucacucucccaacucucagcugcccaucggaaaggcuggcuagaccauuccucaucugugagcccuaggaguucccggcuucccagugcauguugauuuuucauuaauaaauugaauauuuaaaccagucaauugguauauaaaaggaccuaggaacacagcccugggaaacgccuuucaaauuugaacaugaaaacgaucugucaucacugagcacaucauugaugacagaugcagucaucacuguaaugguuaauuuauacgucaacuuggcggaaucaccauugccagauauuuggucaaacauuauucuggaugucucuccgaagguguuuuuugguugagguuguuacagaaacaccagggguucugucuggguccugcugcucacugcacagaaagccaauccccaagacaacaauuauucccaaggaagaaggcuuuaauugggugcugcagcccaggaggugggaacucagucuuaaaugcaucucccugacugacuaaaacauagcagggacgaaaaguaaugauguaugggaaaacagggagggguaaggaagcagucaagaugaaugaggggcuuggcaucuagcugucuggaugcuauaagcugguaguuucaguucuuugauacuuuuugagaggcugguaucucauuguccggaucuggugaguuucaguccuuugauacuuuuugagaagcuggcaaguccuuuccugaggaaggaacucagauaaaacaaauguuaaguuuuaagcuuuaagaucagaagggucaguuucuaaguuugucaaaaaaauggucugugggacgauuggguggguuucaaggcuaacauuuaagucaggggacuuugcauaaagcgaagggugacccuccauaaugugcgugggucucaucccauccguugaaggccuucauagacagagacuggccucucccaagcaagaaggaaugcugccugcuuuuggguggacuuaaacugcagcucuucccugagucucuagccugccuccuaccccaccagauuuuguucucaucaagccucuacaauggcaugagccaagucccuaagauaaaugcccucugucuauuuauauacauguauauguacauacguccugucgguucuguuucucuggagaaccaugacugauacaucaaccaaagaauaaauauccauugggaauuuuaaaaguucaguauaguuuaugucuuucucuuauacuauauggcuuuaaaaggcuuauuucaguuagagaguguucauacauuggaccagaaucccaggaccaagggacagacccuguagaucauucccuuccccugaucagcccccgaggcuguagagaggagaacccguccugugacucacuagauuugauuggcugugaccuuugucuuuaaccaguuggaauguucucaagaccuggacagacacaugccgauaagaaucuggcaaaagagaacauggguggcauagagcuaauggaugagucacugaggccggcuggguagcaacaggcucauuuaggcuuuaggauuuggcugugccaugaaaugugauguacagcucuuacuacagcccaugccguaaacguggggauguuggcgugaauuuuaaaauggcugugcucugcauuaugggcugguaauugugaaacacaguggucuggugaugaauauuucaaaggaaaucauagcaaagauuuugcuugugcagcugaaguuggugcacuugaaucuuagcaaagaaugggaaacaauuucugucauuugaauggccucaaaaccacaucuauguaaauacgcauaugcggggaaaucucgugaggccagaaggccauuuguuuuuauuucgugccaaaaauuauaaggaaaaucgaacaaugcaauuaaaggugaaauauuguuccuuuuaucacaguuucuccauuauaaaaaauagaaggaaaauuguuucuuugccuuaguuccuacauuuuaaaaaguuuauaucauauauaaguaauuugcauuuaaucuuagucauuuugaacuuucauuuugucauuuuauaagcaaaacuaaauccgccacagaacguguagugcaguguuaagagaacucaugugguaaggcaucaggauuuccccgucucccaacugggaacugaaggagaggagcagcucggcucuguccugcuguccaucccuuugagcuucucucaaacuccagggcccuggccccugaggaaacucauggcaguucuuaagggaacaauccugcagggagacccuugagaggaagguuacagggcugucaggagcugccccaggccuaugcaccuuucccagugaggggaugcugagcggguugagucugagugacagcagagggggcagaaccagaacccuuucccagggcugggcuggaggcuggcccuguccacuccuggcugaccccaaggcugagucauauggaugagaggugcugcuacauagaugagucuguugguaacuagaaaagaccacuucagauuaguccuuggucuuuuugcuuuuuuuaauuauaaaaaauguuaaauauacagaaacauguagauaauagucuaaugaaugccuuugaacuuauuacccagcuuuagcaagucaaaaagauuuguuucauuuuuaaaaagcuucagaucuguugucuauuucuuguuuagaaacacauuucacauguacuacggaagccucuucucuuccuuuccucuccuuggcagucugugguuucgccuaaacuuuguauucaucaucuuuuuaguucuugcccaucuggaaacuaggaacuggccucucaccugauccacugcgcugaaugccccagauuuuuucucuuguggauucuuuggaggauuuugaaguagaauacauucuggauacgaauccuuugucagucacauacccacuacaaauaccuuuuuccaguuugugauugagaaaucuuaauuauagugucuuuugucauacagaaguuuaaaauuuggggguaguuaacuucaucaguuuuuaaaauuuauccuuuguuggccgggcacgguggcucaugccuguaaucccagcacuuuggggggccgagggaggcagaucacuugaggccaggaguuugagaccagccuggccaacauggcaaaaccccaucucuacuaaaaauacaaaaauuagccggguguaguggcgcaugccuguaagcccagcuacuugggaggcugaggcaggagaauugcuugaaccugggagguggagguugcagugagccgagauugugccacagcacuccagccuggguggcagagcgagacucugucucaaaaaaaauaaaaauaaauaaauaaauaaaguauauccuuuguguccugaaguguuguuuuuaggcgccacuuucucccccacccucaguucgcguguggugugcaacagaguccaguuucauucuuccacguggauagccaguuguuuucucuguaccauugauggaacguuccauccuuugccuucuggcuggcacugcugugccugucauggaugauuguguguccacaucaguaugggcauggccacguggccuccacaugaguaugggcguggccccguguccucuguuccacugcucuuucuguccggggccuaggccacguggccuccauuagucccacaaaaugucuugcugucugauacagucuucaccuugucguuuugucuuugcaguugucaugcuaguuuuggcccuuugcucuucaauaucaacuuuggaauaugcuuuaauucuacaaaaauccuggauaaaugauagggaguuuuuauuagaagugcauugaauuggguugggcacggugacucaugccuguaaucccagcauuuugggaggccgaggcagguggaucacgaggucaggagaucgagaccagccuggccaacauggugaaaccccaucucuacuaaaaauacaaaaauuagccgggcgugguggugggcaccuguuaucccagcuacuugggaggcugagacagaauugcuugaacuugggaggcggagcuugcagugagcugagauugcaccacugcacuccagccugggcgagagagcaagaguccaucucaaaaaaaaaagaaagaaaaagaaaagaaaugcauugaacauaucaauuaaaaggaagauaauugacaucuuuuccauuuugaaucuuuuugugugugaaccugguauaucucucuguuagguuuucuuuuaugucuuucagguaacuuuuacaucauuuccaaaagugucuugcauauauuuguguaauauauuccuguguucuucugucccucucacucagcaaaaauucugcaggggugggcucccugugcccagagguugccuaccugccuuugccuuugacuggucagaauacccuuucaucuguuuaccuggaaguaggaggggcucugagugcuagguauccccugggaguggugggggccccugcuacugugcagcuguccuuuggagcagcucucauggcaugcuggcugcuuuauuagauacaauuuacuggacguaguaaagaaaaaaaaaagaaaaagaaaaaaaaucaggauugggagauuucagcugucuaauccaauugcaauaggaucaggacuuguuaauggucauuuccaaggcacgugggcucuuccgugaaauguuuuucccuuaacuagagagauguguuauuuuuaaagaugguguuggcucuaagaagaguauuucuccuugaccuccagaacccccuguccccagaguccuacccuuuucccagggugagcguuuuaagaggagauucuucucauggacuuguuuuucacaggggugauggggcagcauggggcguguccaaacacagcccugaccucacuuauggcuguucugacacccugaugcugccacccccagguggccugugcauuguggggccgcaccacaggaacuggacacucuucccuguguacugcacagcagaagccaugcuccccaaccccaugcaccaggcugcccuggggaagggccaggcaaggcauccccccgacuccauguaccagguugcccuggggaagggccaggugaggcaucuccccgacuccaugcaccaggcugcccuggggaagggccaggugaggcauccccccgacuccauguguuaggcugcccuggggacaggucagaugacucgcaucauggguggcuuggggucuggagguuccucccuguugcccguuaacuuugcugacaguccugcccucgcugggcugagacggggacaccagggagucaugcagccauuagucgcacagugucucuggcaaacagcugugcucugagcuccgacugggaccuccugugaggacaggagccagggucucuggagagccugcaggcguagggggcagucaggugcuguuguugacucagcgagcuugcacacaguagccccaaacccugacugcgggggcuccugaagaugaauuucccauccuagccaguggggcuaauccagggaaaaccccucuuuacucagacccugacacaggggucccaaugccaaggcugcugcagaggugaaaguuccacccucagaaagccaggaguccugagcgcuuacccugugcugugcugggugucaccguguggaagugcagacccugcucuucagagccuuagauggcagcugggaggaaaagggcauacacagagggaagggccuggcugaggcgcugucuauucacauuaccagauaagaagccugggagggagcuuggaggguuuucaggaaggcaugagaggcugggguuggaggagccagggagaguuggguuuaggggcggucaagaaugguuuggccuaccggaaggcaugagcaggggcaaagacagugagcagccucgucccugcuuucuuucuuuuuucuuuuguuguuuuuuuuuuuugaaacggaguuucgcucuuguugcccaggcuggagugcaauggcgcgaucucagcucacugcagccucugccucccggguucaagcaauucuccugccucagccucccgaguagcugggacuacaggcaugugccaccacacccagcuaauuuuguauuuuuaguagagaugggguuucucuguguuggccaggcuggucuugaacuccugaccucaggugguccaccugccucagccucccaaagugcugagauuacaggcgugagcuaccgcaccuggccucgucccugcuuucuaaaguuagaagacaucaggguggcucugccaggucucacauggcccauucuguguuccacaccacccuccagggugccucacacagccacuccagcucuccacuguuuucucgucuauagagagaggugcaacgugcugaccuucagagcccuuccagcccugguguuugacacgggccccaaacagugagggccucgagcaccagagaaacgagguggggcggccuggggcuguguggacugggcugcaggccugagaguggguagaugcugacagacagagccaagauugcaggucaaaggcaguguuugcaaugaaaacucuagggggcugaaacccagcuggguggcuuccagggugcugccuggcccaucccugcagcugcaggccgguccuggcuuguucuuaguacuucacacagugccaugcaggggugaggcgucagggcacaggggugaggugucagggcacaggaaugaggcuguggagugcaagggugaggccucagggcacaagagugaggcuguggagugcaggggugaggcauggggaauaggaaugaggccuuugggcacagggguaagccuggagaguagggguaaggccugagagcacaggaguaaggcuguggggugcaggggcaaggccuggagagcagggaugaagcccuggggcacaggggugaggccucgggggacgggugauaugguuuggcuguguccccacccaaaucucaucuugaacucccacauguugugggagguaauagaaucaugggggcaggucuuucccaugcuguucucaugauggugaauaagucuccugagauccgaugguuuuaaaaagaggugcuccucugcacacgcucucuccuuuuuuggccugccaccauccacguaagacgugacuugcuccucuuuuccuuccgccaugauuguaagggcuccccagccauguggaacuguaaauccgauuaaaccucuuucuuuuguaaauugcccagucucagguaugucuuuaucagccacgugaaaacggacucauacaaggggugaggugggccccuccuccccuucccgcaguaggcugccgucuucaaagcagaguccugucuaccaacagcucgccucagagggaucgcuuggucucugguuaggcaguuagagccucggcugaaugagcuuugggcuucugugagcuugccaggaucugcuuaaaagaaccauauuucucuuccauugcaaaguguggaaacgugcccgauuugcauggcacucccgggagcccuuggguauugugcuucaguguggccccagcagacuuauuguugagucaucagucaaagcugcuguuucuuucauuagcgauuaagagaggggaauauugaagugaucugaaauaaaaauugucaaaguguucuuuuguuguauuaaucagaaccauauucaucauucgagggaauccuaaaauauuccugacucgcucguuaaaugacaccugaguguuuccucugcagacuggcagugugaggaagacuggaagugucccccugccccccaaaccagagaagaagcagggacaggcuuggggcauuguuucaccaggagugcuggaugcugggccggccucuagagccugucacugcccuggucgggcuagguauguccuuccagcuucuccgucucucuagaccuuggccggguccgagaccugugggaguuucccaaugcagcgaccagcugccucagccaugccuguggggcgaggcggccaaggccccaggaggaaaggagcaguuuccccagcauccucgguacucagacgggacaugcuugguuuccaaggccaguggguuccaggguuugauuguguguugggguuuuucucaagugcuagggcuguaacagaccggcgccagcaggaacaggcccagcacuggaggccaaugugaaggggucacaggacagugggggcaccgaguuagguggauggggccucauaugccuugaggggaacugggggcuucaucuuccuugacgggagauggggagccucugacuguuaggauccgcccacuacaucguacccauugcacauggcacauggcagacagcugcccuugcuccagugacguccagaauuuaccuggugcaggguagcugagcacuccacucccaauccagaauauuccacacaaugaugguauuuccucaucuagucuuuuuggcuuucugcugggagaagaagggagagcuuacgguuucgcaggugaccagcucaagaccuuuguuucaggguagggggaggaaaccguuuccgucccccaacccccacuugccguugcugcagaacaguccugaguaucugcugaagguucaucgcugaggauccuuucucagucucuggcgccuuccuuuaccuccccaaaguagcccggagccuggagaacggggagaucuugauuuucaggacaggccugguggcauggaggugggggaugccagaaguggccuugcgcuacgcaccucccugugagucagccagugcucaucccacagccccgggggcuucuccacgccacagccuccuccugcuugacccaccccaggcgugugccucucacugaaggggauggagcccccgguccugagugggcucuggccaaggccaggugcccagggcuggccuguggccacugcucacgccucccuguuuucccacugagugcugggugauauuuauugucuggauuaugccucauuaaagcagaagcccauuuuccauagaugauaugaguuuuuuauuuauuaaauuaguuuuaagauaauuuaccaagucauccaagacaaauaauccacuuaagugaugccguaaagcucuguuuucccccagugcuguguuucugggaaagcaugcccucuccuaaguucugcucccugguuggagacaucuugugagcggcagaauuuacaguccagccuuacuaauucagaguaggauuggguaggagggcuggcugggggcugaccuuugcacucccugguuaaauaaaaggcuguuaagcaaauucagaguguaaacaggauuccuuggagaacccaucauucuggaacuucccagaguacuccuggagaccuuuccuucucaguauuugcaaugcuaauuaccaaucacgugcuacucagggcugguucccucagggccucacauaccugaagguuuuuguuuguucaggucaccuaagguauuuaaaaggaaagacacacauuucuuccccccucucccaaacccucacccucaccccagaaagagguacguugcucuagguacauucucagugccgagcuuccaugcacccagccugucccuuuccccaggcuccugguaacccaaggugguggauuuggggguguguguguaauuucguucgguuuccauuccuacucuuagucuuggggcugggauuagaaugaagaaggggucacagagggaaagcugacacaggggacacacuggaccaugacaguguggcaugugccgcggagacauggccagggcuccugggaagaagggguggagacagcccacugccugggagaaagggggaagauccugaagaaugaauggguuuaucuaggggaacaaacccaggagcauucccucguggggcagcagaaugccuaagacagccaaggcugcaaaggguuggaauaccagaugcaggguggguagggaccggauguccggucugcucugccucauuucuacuugauccugaaggcaguggguauuuaaaaauaaaauggugacaugauaggagcccgcugaauuagaaagggcauccuaguuacagugcagagagggcugacgugcccagagaaugggauauaggagucgcaguggcauuuaaacucaguugaaauauuuggucaauuuuaauuccaacacaaacauguaacauuuuaauggcuguauauguuuuaauggguauugaggacuaagcucugauuuuuuuuuaucuugcccaaauuccuguuuaacgggucuggagagucaggcccuacaaaccauacauaaauucucaucagauggguuuuaauuaaccguauauaucaugacuuacuuuccagccugacuuugggauaacauuauaugacaaagaagaaauucaaaauauuuuaccccaaaacguguuuuuuuugccauauuuggaaauggcaaagcuguccuuugugggggaaaauuugcgucuguaaagaaucuuggcugggcacgguggcucacgccuguaaucucagcacuuugggaggcagaggcaggcggaucaugaggucaggaguuugagaccagccuggccaauauggugcaacccugucucugcuaaaaauauaaaaaauuagcuaggugugguggugugugccuguagucccagcuacuugggaggcugaggcaggagaauugcuugaaugcaggaggcagggagguugcagucagccgagaucaugcaacugcacuccagccugggugacagagugagacucugucucaaaaacaaaaaagaaucucuauuaacauagcuagauuuuuuucuuccaggcccucccaauccuaaagagauuaagaguccagcaccuuuuaaagauucaauagauggccaggcaugguggcccacacuuguaaucccagcacuuugggagggcaaggcaaguggaucaccugaggucaggaguuuaagaccagccugaccaacauggcgaaaccccaucucuacugaaaauacaaaaauuagcugggcaugauggcacaugccuguaaucccagcuaccccagaggcugaggcaggagaaucgcuugaacccaggaggcagagguugcagugaacugagaucacaccauugcacuccagccugggcgacagagaaagacucugucucaaaaaaaaaaaaaaaaaagauucaauaggaaacauuucucucuauugucucuaagagcagccacuauaagacuucaaaagaaccuuggucuccacagucuuuuaucuuaaccuggacauuuccuuucuauuaucccagaucuuuagacaaacucaaccaguugucaacuagaacauguauaaauucaccuaucgccugggaacaaccccccgaccguugcugcugccaccuuucacuuguccccccuuucuggaccaaaccaguguauuucuuaaauguauuugauugaugucucaugacucccuaaaauguacaaaaucaagcugcacccugacccccuugggcacaugcucucaggaccuccugagggcuguaucaucggccauggucacucauauuuggcucagaauaaaucucuuuaaauauuuuacagaguuugauucuuuucgucaauaauaucauaaaaaaaaaaccuagcucaucaaaccuauacuacaaagccacaguagcaacauauuuaagauucuugaaaugaguggauuuaaaaaaaaaauaauagggcagagccuccucuuuccggugguguggugaaugugguguccgaaagacccuccuguuuuugguaugaauacaccaaauaaugcuggugugcuuuuaagaaacauaaccacaaaggugagacuaucagagaccagaaaucucgagaaaauacaaaucuagagaguuaggggagcaacaucaaagcuggucuuuacccagggguaucugccaguugauuuuaaugagccacuggcaggagucaaaaccuggggacuguuuuguucagggacugaacaguuguuuguguuugucuuucuuagccuuggccagguuaaaggagaaagaaagaacccuccccuuccucagaauuuccaacuacaauccuacauucacauggauugggggagcccccguucauguuacuuauuugaccuaaaaaaauugcaagcuaaaaauuugguuuaauguagucugggauaacaaggcccucaggcucuagagaagcaaauauagguuucccacccccccacuccccaaagaaaagccucaaagaauuccaauagauauacauucuaaggagcauaaugacaggagaagucacugaaguacaaggaagcaagccacugggggcaagaaucagcagugaaaacagacugcagaaagagaucuacagagauuuuagaauuaucugcgacaugcuauaaaaauaagcuuauacauuuuaaauaauacaaagaaagguauugaauggaagaaggaggaguaacuaucaauuuacaaggcagaauugaagaaauaaccaagguucaaauguaauagauaagugaaacaaauugugacaaaguugaagagauuauuaaugaacuagaagagauauuugaggaaaguacuugucccagaaagacaaagagauggaagauauaaaaagagaggcuaaaggaaauggaggauagaaugaaaagaccccaacucuauaugaucugaguugugagaaaauaaagagaaugggugcaaauggauguuugauaggagauaauggaugaccauuuccaaaacugaugaaaacuacuuauuccccagauucagaaagaccaauaucucuagcagaauaaauaucacaaggaaaccgcaaaacauccaagacaaagaaguuauucacaagcagccagagaggaaaguuagauugcuuaugaaggaaugacaaauagauugauagcauucaauagcggaggcuagaagaugauagaguaucaucuuuuaaaauaauaaccaacuuagaacaauauauccagcaaacuaucuuucaagaaugagaauaaagacauuuuuagacaaaugaacucugagaggguuuacaaccaaaagacccuaaaacccucucauuaaaggagcuucuaaagguugaauuuaaagaaggauaauaauuuccaaagaaaggucuaggugcaagaagaaauaaugaggaaaaaaaaaggguaaagucaugaauaacucuaaacaaacauauaugaaagaacaagaagaagaucuccauuuauaacuuucggaggcugagguggguggaucacaggguuaagagaucgagaccauccuggccaacauguugaaaccucgucucuacaaccugggaggagguuucagugagccgagaucaugccccugcacuccagucuggcgacagagcgagacuccaucucaaaaaacacaacaaaacaaaaaacaaaagucacaauggaacugaaauucuggaaaccaugaguacauagcuagggaagauuaggucaguguguggugcugguaugacuagaauuaaaauauucuuaauuuuuuguacuguuugggaggaggauaaagauaacaauucauuuuagaucauuaaguuaaauauacauguuaaaauuuguagaggggcuauuaaaauaauagaaacaauucauuaacuuccagauucauugggguuagggcauuagaauguagagggaaguagauuaguccacauguaggccagaaagacaaaugcuagaaaaaguagaacaguuggaaaccucgaaaugagagcaugugaauuaaccugaauguaucaggagucacagccagcagggaccaagaucuuugguuagaaagcauggcuggaguuuaaaaacccagugcugugcuaguuaugagagaaauauaaggaaauaaagaauagaggggaacccaacaacuaccaacaagcagaaaucgagguuuuuaggacccuauuuucaauaucaucaaaaauaugaaccuguuagggaaaaucuaaaaacagauauaauagaccuguagugagaaaacuauaaaacacuggugaagagaaagaagaucugauuaaacgaagagcuauaucauggucaugagucagaagacugauuaagagcuaugcuauggucaugagucagaaaucccagcaagcuuuucuguaaaaauugacaaaacagguucuaaaacuuacacagaaaugcagaagauauggaauagccagagcagccuugaaaaagaagaagacacaagugaggacuagcacuagcugaaguuuagucuuucagcaaauugcuggaacaauuggauauccaugugcauacaaaugaacuuccauacuuuuuaccauauacaaaaauuaacucaaaauggauuauagaucuaaaguaaaacuuuauaaaccuucuagaagaaaaccuuuaugcccuugaguuaggcaaugauuuuuuagauaagacaccaacagcaugaucuguaaaagaacaaaguacuagguugacccucaccaaaauuuaaaacccacgaucuucaaaagucacuauuaagaggacgaaaagaggaggcauggggagaaaacauuugcaaagcauguauuugauaaaagguuuauaucaaaacuaguggcaguuuuuucaaaagguaaauauacuccuaccauaugauccagcuguucuauuccuaaguauuuauccaagcaaaaugaaagccuauguccauucaaagaugaguacacaaauguucauggcaucucucugcauaguagccccaagcuagaaacaauucaguccaucaacagaugaauggauaaacaaacugugguauauccaagcagugggugcugcucagcauguauagaaaugaucuauucguccgugcagugucauggaugaaucuaagguaaucacccuguguggaaaagccagaccaaaaccaaauguguauuauaugauucccuuuauuugaaaauauuggaaauguaagcuaauguauagugacacaaguaagucagugauauucugggacugggagggcucaaagggaggauuuacaaaugggcacaaagaaaccuuuggagccauagauauguccacuaccucgguugugaugguguuuucacagcuauaugcguauaucaaaacuuaucaaauuauaaacuugaaauauguaaacauguuuuguuuuguuuuuuguuuuuugagacggagucuugcucugucacccaagcuggagugcaguggcucgaucucggcucacugcaagcuccgccucccagguucaugccauucuccugccucagccugccgaguagcugggacuacaggcacccgccaccaugcccagcuaauuuuuuguauuuuuaguagagucgggguuucaccguguuagccaggauggucuugaucuccugaccuugugauccgcccgcuucggccuuucaaagugcuggaauuacaggcgugagccacugcacccggccugaaauauauaaaguuuaucguaugagaguuauaccucaggagagcuguuuaagauacauuaccgaacaaaaacugauagguaguuuuagucauauuagacuccuuccuccugacuagagacuucagagcaaaagcccugcgugagguuagaggucauaaguauuuguacuguuuaguacaccaggaagagaaaacaauuuugaauuuguaugcuccugauaacauagcuuccaaacacagaaaacaaagauuggcagaaccauaaggagaaagacauacacucacugucauaaugggaguuuugaagcauaccugucaguuauugauagauuauaagcagacaaaaaaaaccagucaggauuuauaggaaacucgaacaacgcuguugaugaacuuuauuuaguggauguaugcagggcacuguauccaggaacucuuagaauaugcacccucuucauguucuguggucuggccccagcucgcuggucauuccugugggucguucaguccuugguguuuauuucuggcccgaaucacuagccacucucugggcuuguccaggugccucccugacaucuccaccaggauccccaagugucuuaaacuuggcaguuccaaagaauaacucauggccuucccaccaaaacagucuccuacagccuuuuccauaaaccuuuccccaucuuaggaacuggcaacuucgcccuuccaguuguugaggcccauagugucagaguggcucuugguuccuuucucuccuaccccagaucugucauacgcguugguguguuuuuucugcacaaccuucaaaauacaucucgaaugugucuucccacaagcuugccugcuccgucuuggcccaagucacuagccccucuugaauuucugaugaccgugguccccuaaccugccuccugguucuccugguuccaccucuccccacccugccaugugccauccauucucagagugacagucggagggaugcuuuugaagccugcauuuuucccugcucagagccccgaggaucuguaccccagauguuccugccauugcuugccucugcucgccucguucugcgguagcugugcuggucuccucgcuuuuggaacauuccaagcagcuucuaaccacagggucucuguguuuccugcugcuuuuaccuggaauauuucucugccaugugucuaaaugccuuuucuggccaggcacgguggcucacacuuguaaucccagcacuucgggaggcugaggcgaguggaucaccggaggucaggaguucgagaccagccuggccaacauggugaaaccccgucucuacuaaaaauacaaaauuagccaggugugguggcgcacgucuguaaucccagcuacucgggagacugagacaggaacauugcuugaaaccaggagguggagguugcagugagccaagaucacacuacuacccuccagccugggcaacagagcgaaauuccaucucaauaaagaaaauaauaauaauaaacgccuuuuuucucuuuggauguuugcucauuugucaccuuaggcgauugaccguuguacugaaguggcaucccucucuucacacacaaacccccuugcuguuccucgucccagucuuugccuuguuuucuccauagcacaucaccaucuaaugcacugugcauuggauuuguuuacuuaaugaaccacugacaguaguccuauagauguugcaugggcaaggcagagaagguagcaccccaagaacuggaguuuggggaacccucagucuuugcaguuggccgugcgugcuugaacuaacaccauagccccaaggugugcaagccccgagccucggugugggagggccucugggagcugacagugguccuggguuuccgggaugaguaagggguagauaucucaagaagggggagcagggaagccuuguuugaugacagugaggagagacauggguggugauuugaggggcgugagccguguccuuccgcguccguggcuuccgaguagcaucauuucccuguucauuucccagggagacccggaccggguuguggucccaggcccagugccugaucuccggcuugacugggcucagccuuguuuccucaucuguggagugggaggaggccucccucacgcgcccuuugugaggaguagacucugugucuggcauggcaccagcacacguugaauuugucucuuauccuuuuuggcuauugucugcgcaagagagaagaaugaacaaccgcuucugaggcugucugaagcuuggucugcuguucacaugcuguuuaucaggcugcuggaacuuaaagagaaaaugguguuuguuuuaauggaaugaggauuuugaaauuaaggcauuaaguaaaagugagucaacacaagcuuugguuuccucugaacccugacuagauaaacccugacugucgcagauaaccucgcagugauguuaaugggucacgcguuacaauuucucucuugguuauuuuuucucuuuuagucugaaccggacggcuuuucucauuuccacuuguacgugugcgcugcuuuucucgugagauggaggaaggaaauacuagaagaaaaagauuuucaaguaaguaaaugucuuuucaaaagaacccaaguuugauuuucuacuaggagagagguuuauuacauuuuaguucacaggguuauuuguggaagaguuuugagaagcgcugccugcauuucgccgcugaccuccugcugguugaaagcucguccagcugaggagaugagccuggcaguggucacguggucacagcaguggaaacgcugcccacguuaugaguuauuagauguggcugugugacaagcucccugcagaaccuucccuggggcagcgugccccucagcagcacgaccccugcagugugcggcuugugaccucuggucccuggaacccucuuuacagcacguggacugugaugcuuuagggacagggcugggcaagaaaucacacagccuggggugccuuccagccaggccacuggaagcucugugacugggggcacauuguucagccucacuaagcuagucccuggcgacuuagcaggagagcccuccucgcaugccacgcgucagaggcacgcccugcuaggcuccgugcuugaccugugggacucccuguggacuaguguccagccccugacccaccccacguguuccucugugaggcgucccgggcacacuguggacuguuggccccuucauggggugauacccacuguuccccaaggugcgggcugggaaguccuucugcccaguguucacccagcagagggcucugggugcagcaaggaagaccccagcagugggaaacagaccaggcucugcaccagcuggcuggggucagccacacuucaccgcucucccuucucgaggcucucgucucucagauaaagggacggaccuagguccccagggcagugcucugcgcagcuggcagccuguuguuccccagcucugugcuuggcagaggcuccaagcaucccuauuccuuccgagggccuugggaggagccagggaccuccugccgccccgcuucaucucggccccaggagagaccagacaggugagggccauaccgaggccaagagcugccaacagauccuggcccagcagauggaacccagcccggguguucgcagguggaugggacaagacgcuccuucugcuaacuuagcuccugccuuuuugucaguguggggcucgguugugcccugcggggagcauugaggcggugauuggcaucucaaucucagacacacgccugccuugccucucccagccauggucuguaagugaguagggugcaccuggccugccccuccgcccggcugaugcaaggcugcuggggcuggggccuccuggcccaucuggcccacucgucacuuugcacaggggaauguggaggcgauaagaggggccaugacuugcugugucaccaaguaagauggaaugaauggggccuagacugcggucuccuggccagccuccugcuguccuccacaguaggcucuccaucugugcagagagcagugcuggcugggcaggcagcaggcacccacuggccuggccacuuaccuguagggagaagggcccagccucucuggugcacagcggccacuccugguaggacggugcccagagugcuugguucccaccggccagcacacacaacuguaugcugccucccggagagccucccaggggacuugcucuccaaaugaaggcggcuggcugccgagagucagucacugggcuggccauggagcuuggauguuccugccucgguggugucugugacuggcuggcuggggagcucuguucccuggaggcccugggcagacauugcugcccuccugggucagccaugccugguggugggagguggggugggagaggacucggggugugccugaagcugcagggcacugugcucaggcccaugcuaacaacagaccaugucucaucgucuccagaaaucacccugggccccacucugggcagacucuaagccacacauaugcgaggaauggacccugagcacauucugguuggggagagagaacaguaaagaaaugauugaccuucagcaaaaggcugugccuccauugacgacuccauuucuucugucugcucccaaauagggacagugucacaagguggcucgaggcagaccagacacacacuggccgugggagcuugugggcgggguuucuuccuguugugaauacgugcagaagugucacuccggcccuggaggcugaagcaggccaugagccccucagggugaaggacaggagauagggacagcuguggaugccaggguaccugagcuaggucugggggaggugggucaugagagggugguguugggugggcagugggccuccuaccacccugucaugugguggucccauccaggggccacuggcaggggcagacuuggaccaagaaacggaauugauggcagccuugacagaugcaagugacaaggugcccucauuccucacccugccgcagcucauugggcuuuucugugagggauacauuguguuugcuguugggccggagacauugcucugcugcuauuagagggugcagcgugggcagcugauuaaaauguuuggccagccuucucugagcccggccuacuuaacuugagaugaagggaggacaggagucaggcaaagccacacggccagggugugggguguggggugugggguguggggugcagggugugggguggagugcacacucugagagccuguggggccccugugacuugaguggggaaccgggaggaggcgcuggcagaggagccaugagauugauuuucuuccuuuagaggaagaggaaguugguucuuugaugccauagggguuggauggagagaaugcugugagugagggguuggauggagagaaugcugugagugccacaauguguugugggcacugaacccaaugggaaaggaggugagaaacagaaguuacaaaccugaggaguccuggugagcacggggaaugugugugugcaguugugacauuuuaggaagacgcuuccgcauccaugggaggccaccugagcgaguagggcccagaacaugauuccccaacaguggaacguugguggaaagcggcuuuaaaagcccucauuuguugcagccuugugauuugucccuugggaaaugauguguggcuuuaagucauuuuuccacaggaacagaauccuuuucugauucccagaagaaaggcagagacccuccuguuguuaaacagcagagccaagcaguucaggggccagggagggggcgaugggucacgcugccccuuaauucccgaaaacuugggcaggcggggaaggugagggcgcugccuguguccuagguccccuuggccuuugagccucaugcgggcaugguuugcuuccuugccaucugugagccaccuccagggccugcugggcagggcucggggagcagggagugguggggcggggcggggcggggugaggugagguggggcggagaggggcacagcugggauuggugcugcacucugggccuccuggccccuggauggcggcaccuucuggagugaacguuggcccuguccugagcgcugggccccaggaggugugugcuucucuggaggauugccacuuugccaccuccccugccagagcuugcugguccucaggaagggugguugcccucaggcacaugccccaugccaucugcauugcuaauccgcaggcuauauguauguggcuccacagcccugcccugggcguuuccuaaugccccccaccaccccacccccggcuccacauguugauguccaguggggccucuccgcugagcccugccccgccccuuuagccacugagauucaagccucagcccucacagcauggacugugccuuccaucugccacucucccaccagacuuucguagggucuugggggugaaaggagcaugcuuguguggaaaguugugugucccgcggugcccgcuuggugcccucuaccccguccuugcccucugugggucauuucacaguaagaggacacuggggcccagcaggggugaggcgagcagggacccugcuuucccuugggauccgcuguccccucuguuaggaaccugccacccgccccugcugauugggccugcagacccuccucaggcacacguggcacggugagugcuagaaaggccagcuccagcaugucaugacccacgcggaaaccuucuguggcccccacugcugggacacgagcgcaaaaccagaacugagccauguccugugcccauucugaccggcuggggguguaguuuaagugccugaugucggcauuacugggaucuuuuccugauuaauaagcacggcauuguaaaauuagaaaauaagcuaucccggaacaucuucauuuauccauuuuaccccccaagucuaaaccucucaguuuggcuucccaggggacuggggguccaacugcuaaacgcccugcaggccgcccucuccccgccggcccccauccucgccagcuuccccuccuuggagccccacugcccucacccugggcuuggcugagagggggccgcccacgcgggaucgauugugcucugccagcuuccaggagugcccaccagaagugggaaugccuugugaggcuggaagcuccaccaccugccaggagcugggaccguuguuuuuaauuuuaaaguaagcaagcugcuuagacacaguggggacggcaguuggcagaguuguuuuucuaaguagaaaaagcaguuaauuuuauggugaacagaguguggcaccuccaugaagucaggaaccuccucugaggaggccucggcagcugagaggucuguaaaugucugaucagugagugcgccacugccugauguugaugcguggacagccucguugggagaagcagcuuccuccagcaugguggcugccugccuugggaggcuggugcaggcggcgaggaggcaccagagcggcaucguggaaggcuggggcccuugcucuggaagcaugcuccgggcagucuguggccgccuggcccugggcccugcaucucugugggagccccagcugcuggaugggcugcaugggaaggaccagcaggugccagcccgagcugcccagccugggagccuucaccuuuguccccuuuggcucugggacugaguugugugaaucugccagcugcucaguggggaagccaaacacacacaggugugugcagugccuagguugaggggcucagucuggcuuugugaccgugggcuucacagccucagcuggucuguucauuccuucauugaaugccccuggaacccucgcccugagccaggcccugugcugucagguucugcucucaaggggcagggcgagucgggaggggcaggugcaugaagggacugcucugcgggggucggcaggugggcagggaccagggaauagaagugauagaugggggagaggggagccaguuggggagcgaggcaaagagaggaugggguggccuucccguaacaguggauuuguaacagccugcucugcaaugugaagugauuuggugaacuuggcgccgcggguggauuggcagcuagaauauaagcagccaugagcaauaugaaaagacgagcagggacggggcaggauggcgcauggaggaagcaggaaaaauuguguccucggauuucaagaagaaaacacuggguagagcagggagucacuccacaccguggcaucgagcagggagagucaccccacaccguggcaucgagcagggagagucaccccacaccguggcaucgagcagggagagucaccccacaccguggcaucgagcagggagagucaccccacaccguggcaucgagcagggagagucaccccacaccguggcaucgagcagggagagucaccccacaccguggcaucgagcagggagagucaccccacaccguggcaucgagcagggagagucaccccacaccguggcaucgagcagggagagucaccccacaccuuggccuucucccaacaagggucuggcagcggccgcaggagcgaggaaagcaggacgcucccgggagcacaggagcccagcgccagcuucgucggaaaccuccuuguagaggcugugaucugugcacuuuccugucuuuguauuaaacuugaauuuaaaacuguauaaaacauacaaagauauucagugaagcaaccauaggaggaaaguuuaagcauauuuaguuggauuaaaaauaaggcgggggcugagcacgauggcucuugccuguaaucccagcacuuugggaggcagaggcgggcggaucaccugagguuaggaguucgagaccagccugaccaacauagugaaaccuugucucuaccaaaaauacaaaaauuagcugggcaugcuggugggcgccuauaaucccagcuacuggggaagcugagguaagagaaucacuugaaccugggaggcugagguugcagugagccgagaugacaccacugcacuccagccggggcgacagagugagacuccgucucaaaaaaaauacauaaaaaauaagguggauugugaaucugaauggcauaaaaaaggagugguuugggaguucuggguggaauuuguaccaacaaagaaugcaucuucuuucuaaguauuuauggaauacuuacaaaaaguaaucacccaaccuaggccauaaacauuuccaaaauaaaaaaacagcaaugacauaaacuuuguucacugagcauaauacuuuaaaauuagaucauaauaaaguuaaaaugaaaaaccaagcauuuggauguuaaagaacccccuucaaaauaaugugggucacaguggaaaugacccuguaauuacagaaggauguucaaaagcacaaggaaugugccagugcugggcuugcaaacagauucaaagaugcaaugcuuuuauuaauuaaaaauauuaaaacaaguaaacuaagccuuuaaccaagaaguuaaaaauagaaaaauaaagacaacuuaugauaaagacaauaaaagaaugaaugaguaaaagcaaaugaauagauuagaagacaggguuuuuauguagaauuccuaaguacaucuuagaggggcaguuggaaauguuagugaaauaggcagaccuccagcaaggaggaccgagauagauggcugaaaacauaguccuccucuguguuaggaaagaggaauuuacacacacacacacacacacacauacauuuaaaaaaugcuaaacuugccucaagauaagcuuuaaaaaaagcccaaccuggccaggugcgguggcucacgccuguaaucccagcacuuuggaaggccgaggcgcgugaucaugaggucaggagacugagaccauccuggccaacgugguggaaccccaucucuacuaaaaauacaaaaauuagccaggugugguggcgcaugccuguaaucccagcuacuugggaggcugaggcaggagaaucguuugaaccagggaggcagagguugcagugagccgagaccacaccacugcaguccagccuugcgacagcaagacuccaucucaaaauaaaauaaaauaaaacuugaauagacuuauaauuugggaguaaauccaaacauugccaaaagucuugguuuuaaauaugauucuaaggccagaaaaugucuuccuaguaaauuuguucaguuucaaaaauccuuaugcugugugaccugccccgcuggaaagaagcagcaggcuuggcacuccgucucacagagcuggccacccggacacauggcucccagcacccugucucagcugaaucaucagugacuucugugcaggaucccacaucugccaguuucucucuccacauauauggagugucuuaguccauuccugcuguuauaacaaacuaccuuagacuggguaauuuuuuuuuuuuuuuugagacgaagucucacacugucacccgggcugguguacaguggggcgaucucggcucgcugcagccuccaccuccuggguucaagugauucuccugccucagccuccugaguagcugggacuacaggcacguggcagcacgcccggcuaauuuuuguauuuuuaguagagacaggguuucacuauguuggccaggcuggucucgaacuccugaccucguaauccgcccgccucagccucccaaaaugcugggauuacaggcaugagccaucgugccaggccuagacuggguaauuuauaaacaauggaaauguauuucucacuguucuggagacuggaaguucaagaucaaggcgucggccucuggugucuguccagggcgccucguuacugcauccuuaugugguggaagguaggagggcaagagggcugggcgcucccaucagccuccuucacggcacccaucccauucaugaggccugccuucaucaauauuauaaaauaaaaaauaucccauaaaaauaccacuggaauguagccaugcuccuggaugccagccuagaguuagccucagagaucaggccagcacaccuguaacucuguccggcuugcacuauuaauaaaaauauccuaucaauaaaccagaggcccucaaucccaugauaccuuaagagauucaguagcuuuuccugaguuuaaugaaaagaaaaaaacuucugcccuuaaguagaacuaaaauuaauacuuuauuaacaugcuaagaacauuuuaaaucaacaaccaccaguaccuagggaaaugcuagagacagccccacugagaucaggacgauuucuucuguuuuuguaacaugaugaacaaauguucagcgaaggcuccuuguccucuccccauacagucugcaugcacacacacacgcacacacaacauggauauuaacaaaaugcuuuuuaaguucaugggcucuugagaagaguaagccagcccuagaacuaguguuugcccugaaggugucugcugcuuccugcucugggaccagguccccaguguaagcagccuggcagagggcaggguagaaggccuggggcuggagcagguggaugugagucagagacccuuugccuacgucaggaccccugaacccaagcaagugaaccaggacagacagacaaaauggcccuuguagguucaugcuugccugaggcuuagcucugaagggaagaggaauaaaagcaggucuccucugaaaauuccugaccccagcucacccuuucacucauuuaggucuagaaguuacuuuacuuuuaugucugaaaaacccuaugcuaacaaguuaacuuaauauggccagagagccccaggugccuagcccaagaaaaugccaguucacucuagaguggcacguuuuaagcacaacauagaaguuggaaauauccgucuaccagaaacaucauaaacaaaauucaaaggcaguugacaaaguucuucauucacaacguagcuuauauccuuaauaugcagagaacucacacaaauaacuaauaaaaagaaaauguccucauagaaaauggaugaggacaaucggaacagucagaaacccacaugagaauuuauguagcuauccagaaaauguaaguguuucuuccaaucauuaguaaagaaucgaaaauggaagcaaaugcucucucaaauaagcaccgcuuuuagcgaggggccuccuggaaguggaugaaguuggcguaaagcaggcaugcuguuucauucugaugaggggugugauacacagcguuucugcagagcuauuaauaauuuauaucaagagccuuuccucgauccaguaauucuccuuguuuauaauuauggaaaaacaaauuggcagcagccugcauauccagcucucgggguacaguuaccuaaguuaugguacauggcugguuauaauguuucauaacuaccaaaaauuacaucuucaaguaauauuuacugaaacgagcaaauguuuucauugcguuucuauguggaggaaaagcaugaccugaaauuguauauaucgacauauguaauacagauaaaaaugaucccagauuugcuucuauuccacgcguggacagaaagaccgaacagaaacaaaccacggugcuagccugacuuaguuuucauuaguagaguuauggauauuuuauuuucuuguuugaaaaaaaauuuuuuuuuuuuuguauuuugcauguucuuuucaauauguguaaacaugguuuucucacuaggguuaauucccacguuaaggaugguuguggggauucggcugcuuugugagguucguggcuuggagcuggagcucagaaugcugggcucuggguucucugcccuucuucuaggaugucgcacugcgcccgccccucggguguccugccgugccugccccucagguguccccaccgcauccagccuugagguguccugccauguccaucccucagauguccccucagcucgcugacaugcacaugugcaaacacaucacucaacacagagcacacaggcccauggcccucaaggcaagaggcgugcccugcucgucugguggagacuuaguuagcagaugcuucccugguaacacaugaggggcacuggggaugaggagcuggggaugagagugugagagggucagaggggcugugggaagagagagguggguggacucugcaggucaccccagcuccuaggcugcacaaagugccauugaggcuggcugugcauucccuuuggcugagccaccaugacgagguuucccgaacugcccuguacugccuguagaugacauaagggccacauuucauucaugggccugggcuucuuuccaggguccucagugucccaucacagaggagggggugaguguggucauuucugaguaaccugugaggaucugugugcacaguggaccaaauuccaguccgugaccuuugagccccuccaagcuggccaccugguccccugggcccagccccuacuuggagguggucucagcccauguauggccaccugaugagucuggaagucacccacugccccuuaggaggccgcccuaaaugcuacuagccucagacuucagggaucuuugauaaggagauaagcaauaaagacaucacagguucucuugggcaucugugauuuacagaguaggaaagacaacagcagcaaaagcccugugcucugcagagacccaggcaggcuucacugcgcagaagcagcggcgaggcaucccuccucacccguccccuggccucggaagcuggugccagggugugcccagccucucuggcuguagaccccuggagucccuuucauuugcuucaugagaggccucaaagcaaauacuccuuagcucgagccuuggccuauuuggacuuuggggucucaggguaauuaaagguugcuuuaaagaucaauggcagcuuuagaauuauaccuggaaggaggcggagagaagaugggguuugcacauggagauuuaucauuucuaguuuuuucuuaccugaaagaaccacauuauuaaugacgaugaggucucagccccuccaggaggcugagggguguucccgugagguuccgucugccaagacuuuggggcagguggguggaaucgcuuugcuuuacuccuggccacccagcccuucccuuuggccugaaaacagagagcaccagcugcuucccgggugacgcuuccuccauucucuccaggaggguguagacuccugcuggaggccccucaccugugaagcccccuugcugugcuuacuggggguuucaggccgugguuuugcacccagccgagcaccuggcgcguggucggaauggaagggcuguuucccggcuggcaggauguuugugcacccaguccugauagacaugcuuuucugcaugcuuucauuuggaguuccagcauccuuuugggccaguccauugcugucuugagucacuagugaacucacacccaggacccauuuagugaguccgucaggccucaaccugcccauuggcucacagaauggcccguggcagugggccaugucucugucaaaugggacugaucuugcaaugcugcauuagccuucgacaggcuaauggcuucaugcagguuucucuuucauccuguguucacuggaagcagcaaaugucaugaaaugccaaaguagagaucguugucuccgucuuuauuguuucaagacauuuuaaagacaaaauugggucaauugaaaaguaaucucugaagugaauugugccuuugugugcggguugcugcaugugugaaagugugggguuugcagggucaugcgugcugugagaucagguuuguguugcugugugggguuuguguugcugugugggguuuguguggccaugugguauuagcucuuuggaccauucuugagcagaagcucuugggggcccacaugccugccucccauguucugaugcaacaccgugaaacaggaaagaggacaccauugacaacggcugggcacauggcagguccauggugggugcgcuuacugccggauuaggccuccccgaagagggguccuugugugggagcggcagagagagaaggggacucuugggucagcgggggagggcacgccugagcugagcauuugaaucccugcugcugcggugggggugggcgcugcccuuguguuuuagcaagaacugcaggguaaaugcaggaagguuggggaugggguggugaugugcaggguucagagggaagggcgccgugggagcugggaccugggcucagcugugaggagggagcagagcuuuccuugugggagagcuggguaagaggacagcaaaccccugagugaagcagggcugagagccgccuggaggacaggcugcccacgccaggcccucgagccagccuaggggcgcauguccugggacgcauugggaccuugccucuucuugaccugggccuggcaugggcaugcagguggaagcucuauggggaggggaccugccugugccucugugcacgucauuuucggagcuaacacaugccugguguggaguuggcaaaucagcugggcacggggugcugcccucucagccacagguggcaccgaggggcauggaggaggcaagcuggucccagaggcagggcuuggggagugggccgcagggcgagggggacagacggggggcuucuauccuggaggagcguugggccuucaggagcagugaggggcccgcgggggaagcaggugaugaguuugggcuccaccgagguccgccagucugagcacagcuggugugaggacacugaggcagcagugccgcagggccacugggaggacaggcgggcagaggccuggaggggacagaggacaaagauggugccugcagagauugggccaggcgggaguggagacauagaggcugaaggagcgugggugggacaagcccuguaaaggagggaggggcaggggcuugcagaggguggcggggaggcagccuucaugcugagggugagcacagggaccagguguggccagcacagugaccacacuccugccccaggcccauggggcagcgcccuccagagacccaggcaaggggcgacaucucugccccauugaguccccgaguccccaggcuccggcaagaucugccgccagcauggccaaaugcaccccccuggguuccuccucacacuucagggagggcgaccguccccggagagcccaugggauucccagugucuuccagaacacauucuuuuguuccccggggcggggcuuucucagaagccggcacagcuaagaggcgugcccuggagaccugggggagcagggaggccugacacacccagagcaucuucuguuccuaguccucacacggugacaccagcagguaacuucuuuauacuucgaaaagcucccuauuaaauuauaccccucauuaugauaaugcaguagaauuggaagguucaaaucauuucuggggaaagugggguuugggcugcagaguuuaauagcuuucuuccuggaggaaaugaugaaagguugggaagaugaagugugaguuaagaugaaggaacaggauuguugggagagacucuggggugacuugcagggaucuuuaagucuaaaacaaguaaugagaucuuucuuucuguggcucaacuaaggcaagagaaauuugggccacucugcaagaacuucccagcaucucuuugaugucccuugccaagggcccccuaccggcugcuguggagagggacccgcaugcggcaggccaaccccagccugagcccagcuggggcuccuggagcagccaacaucgggugucccaggauggucaaguacaggugacucuccugguguccagauagucaguugccagagggcagugcccacucagagcacgugggaacacaaaggaaggugaugauguuuccuuuuuuuguuuuuuguuuuuuuuugagacagagucucgcucugucggccagguuggagugcaguggcacgaucuuggcucacugcagccuccgccucccagguucaagugagucuuccgucucagccucccgaguagcugggacuacaggcacacgcuaccacgcccgucuaauuuuugaauuuuuaguagagacgggguuucaccauguuggccaggcuagucuugaacuccugaccucagguaauccgccugccuuggccucccaaagugcugggauuacaggcaugagccaccgugcccggccagaugaagauguuuuuuaagaaagagggagccuuuucaggccaccagaagacagggacgccaugauccccuuccccugugguuccugagcccuuuccuguaaacagcauuggagguggcccacgcuucccucuuguaacuggguggaggccagcaugcggccagcaguacguaggccccgccggggcccacaggauccugucucugcagccuggugggugggcugcucuccccauccacaugucaucugcucccugagcgcaucucacucuagcagcuccagcacuacaccgccagugagcucaggccuuccaaugagggcggagggagugaccccuggcgcugucuucucuggaaacaggagugagcauuaggaagcgguaggcuggaggccucaaggacuggcagggugucaccugcugggaugggaagcccagggacccugugguuccaggaagccaugucaagggcagaggguggcccuuuugcccugccucuacugggggcacccagggaaaucccuccacugacccagaagggugggcgggacugugagugggaggaguucuggaacaucucugaacuucucguccagaaaggggagauggcagcgucuggcucacuguacuucuagggcugcuggagggucaggugagaugauggacggaggagaggcucagagcuaccgauuuuucacacgcauaggcacgggugcacacaauacacgcaauauccacauacacacgugugcgugcacacccacccacccucggggucucaggaaaccaggcaggggaaaaauuaauucuggucuuuuuugaucccuggaaaacacucuuucucucuuugcaaauggaaaauucuugguuagugauaaagaaaacuacuccuugccccauguggaauuggcauggauuuuuuugucuuuaucuuuuuuuuucuuuuucucuuuuuuuuuuuuuuuugagacagagucuugcucugucacccaggcugaagugcagugacgcgaucuuggcucacugcaaccuccgccucccggguucaagcuauucuccugccucagccccacgaguagcugggauuacaggugugugcuaccacgcccagcugauuuuuuuuuuuuuuuuuuguauuuuuaguagagacggccaggcuggucucgaaccccugaccucaggugauccacccaccccggcuuccccaagugccgggaugacaggugugagccaccaccacgcccagccuggauuucuuuugacgugggccuccuaggcuuucauuauugcagcgagagucuucauuugaggggcucuugccugcaccuguggccagcuugcucuuccacugccgucggggaaggcggccccguuccuguguggagagagaacauccgccucgucauuguucacugagagaaugugaguggcaggcacugagcacuuuucccagguagcaggaggagcuggggccacagggagugggcuuccacgcaucagggcucacagaugugcugcucuuggcgccugcuuuuguggcaagugccuuauguugguucucuucagggcaaguggucuucgccuucucaccugagccauccuggcccagccuugaggagcccccugaggugaggguuuccggccucucccacccacccauccucuccuccaccccacccguccuucccuccaccccacccauccccccauccucccuccaccccacccauccccccuccacccaacccaucaccccccuccaccccacccaucaccccccuccacccacccaucugcuccacauuuuccccagcuccucaccuauuucagcagggagccccaugguggagaaucaggaguggcuaggggagggaggaggagcugguccuucuguguuccgucccuggcuuccggugcccccagcaggcucccugaguggcaucuuccagggagaggucugggcagcuugcugaucccaggugugcugugaucauuuuuccuuuaagaacuuaacucaugaaggcacuuugcaaagaagagaaauggaguccugcacgaggcugcagaaaaucgauuuucguuccaugacucugcucacagcuauccguguguuuauuaaaucaucccucucugugauggauaccacuuucucuggggaaagagcagcuggaacccaagcccgguggcccugcuugacccaguggccaugaccguggcuaagccacggacagucacguggacuccgggcaagcaccuggcgacgguguaacuggcuguguacugcguccgaggcagaugggccccagagucccaucaagauccccggcucuucaugaagucacacuuggcaauaugcaugaggcaggcaaagaaacaggaccgucagcagagugaagagaagcguuacuuuauuuacagugugugcgugugggccuugcuguccauggguagccgggugcaugucuacgaugccagcucaccaggauacguaggccucucguuuuuugccguuuaucauggugagugccgucaccucuuggugaagacucuuggcccuucuggaguuacuagguccugucacugaugagcuucagcagaucuccuaggaacacauguuccacuaaugauucagugugaauaguaauaaaaguuaagaggcuguuggcccgggcaugguggcucacaccuguaaucccagcacuuugggaggccaaggccggcagaucacgaggucgagagaucaagaccaucccagccaacauggugaaacccugucucuacuaaaaauacaaaaauuagcugggcgugguagcacgugccuguaaucccagcuacuugggaggcugaggcaggagaaucacuugaaccugggaggcggagguugcagugagccgagauugugccacugcacugcagccuggugacagagugagacuccgucucaguaaacaaacaaaaaaacaaaaaaccguaagaggcuguuaacuuuugaguuucguggcacucacgaaguggguggugacccuaggauccugaggguuauggcauacaaaucuagccauuuuccugucaccuuacauuccuagaggaaggcucagcagaggguguuugaaacugaaagaugagaggggcaggccuggggcuguucccaaguauuaaugccccaagccuacaccuuuuuaaaaaacaaaaauuuuuauuuaaucaaagcuauguguuauauauuagaggaaauuuugagagacuuugaccaaaaaagagcagcccuccaucccagccuccucacaccgccagaggcgccgcucagccuuucagguugcugugucuacuguuuucuuguuuuuuccucucucucugucucucucaaugcuguucuuaauuucugagguuuagaaaugcauuuguacagcggaagagggaagcugagaauuaggcuuccuuacccuguggucccagcacacggccaugcccucgugcccggcccuuccuucugaggcuccugggguggugugccuggacuugucaccuggguggggcugugucagcgucacugccgcugagucaccacgugcacugugccugucaucccuuucugggacagcaugucacuuuccuuggugucaccaaucaucucccuuaggagucugugaaccacccacucccucccuccccaccagacagguuaccggagcgggcgugucuggaggagcaggcagagcaggugcuguacaccucguguccucugggacccaucccuucuaggccccuccucaggacacccccuccugccgggcuccccccaagcgcagcccccuucccaaacccacguuugccucacugucuuccuuguccgguagagcacaccccucagcacuucucugugugaaugagccuggcagggaccuaccuugagaucuacaugucuggauaccgcugccuucuggccucucucuggauggaggguggaggguggagguggaagccacuuccucgcaggcuucgcgggaauuugcucuccucucuuacaguguccagcauugcuucugagagauucgcugccaugugacucuaggccuguguuugcaccuuuucguuccuuccccaacaccucugcccugagugugguggugacaugucuuuuccucaucuugcuggagcagucugugggacccugcggucugcaaaacucaagguuuucaucucuaagauuuuucugugggaaauguccugagaauuaaauucccugccauauuuguuuccggaguaccuacuagaaggugggcuuccuggauagccccuuauuuccgaccuuaucuuugcauugcuauaaaggaacacccuggccuggguaauuuauaaaggaaagagguguauuuggcucaggguuuagcaggcuguacgagcauggcugcagcaucugcucagcuucuggggaggcuucaggaagcuuuuccuuauggugagaggcacggggagccggcgugucacguggcgagagagggagcaagaggggaggggugccacgcucuuuacaccaccagcucuguccugaacuaacagagcaagagcucacucacuaccacagggaagggaccaagccauucgugagggaaccaccuccaugacccagaugccucccaccaggccccacugccaacaccagcugucacauuccaccaugagauugagagggcauggacauucaaacuguaucacuguccuuguacucagcaagugccacauguaagaccuugcuguaaccucgugcaucccuggagggcaguguccucagccagguggaguccggguucuuccagaaaugcagaaauggugaaccugccugcucugcugcagaaaccaagcucguuaaucggccaguagugaacguugcaccaccugguugagcugacgcuucugugggcagcagaaggaaauaugagcucugcggcugcuccagccacaggaguguucccccugcccccugugggcuccaugugaucugugacuccaugugggggcaacaagccagcuucuaccccugcugcuggagcaagaagaguagauggccucugcccaugcgaugggacccuggccaccuggggaagcaagggcaugucaaggccauuccugcugacagugggggucagagccuggcguuggucaucuugccucacucugcagugacaggccccuucucagcagaagggagcaucugcccaucagugcacagugacccuggcucucucgcagaggccccuggggucugcagccuccuugagagcgaucccacaugggagccagaagugagugcacagucccggggcgcccgccccguccaagcccagcugugcuuggggcuuaucccagccugucuguggagccacucgaguucguggcagcaccucccaaacucucugugcugaaggccaguuuagauuuucucccaguucauuucagacugauaaacuuuggucaaguacgguaaugguggcauggcaagggugcagugugcggccaguuucuuagcaccucccucgguuucugcacauacauccuugagggccaugaucaaacaagcugugagacgccagagccccggaccccagcuuuaggagccuaccuuuaggaccccaccuuuaggagcccccauuuggugcuggaagagauggggucugccuggauuccccccgagucuuggucgucaggccuggcgguugcaccccauguuccugagcccucuucuggccccgugccaccccguucuucugggacugucacaggagcuggcucugccugccccuacuccugcuuccuuccgauccaccuuccagaaugcagccagagagagcuuucuagaaugugcgcuugaucccuucaugcuucugccuguagcccuucagcagccagcucugccgugggaccaugggcacaugcccgcugcuaccuggcugcuuaccugcccggccuuagucccugcaccgccccgcccugcugucucuggccugcaacccaaacugacuccugccuccgaccccacaggacaugagcugccuccuugccuggguccugcuucuccccagugcgaguggccuuucuuccucuucccuggccguguugggaguccuguccuggcuccugaccucucauugucugccacgguugcugugccuugucccgggggaggcugugauggccccaccuuguacagcagguugggaggugcagguuccugcucccacaucacguuggcuugaaggcgggcuguuugcuggggaugcaggaaacucccgaguguccgcggaaacgccaugugaucuaaauggcaccuugaaacauaaacugagccauuggauuucaguucgaaccagggccuugaacucccugggguggacauggaguucauuuggagauuucagccucgccgaagggcucacuuggaugugagcucaugacagaacagccaccaccgucucagggagccaagugugcucauugagauauggaaaaaaaggaacuccaaaaauugaaguaggcaaauguuuaggcgacgccuguaaaauguaacagccuauccacuucauucaguguucaacuuuguauucauauaaacuuuggcauuugagcauaaauuguggauuagaauuuguuuucucagcgguucccaagugugcacagggacaucuuagaaaccauagccaguuuucaguuaaaugaauugcagcugauaauuccaaagcaaaacuauacagcucuuuccauguuuuuauaaggaaaaauagacguaguguggagucuggcugcauuuuaauaugcuugggguggggccucugaaguacuggggacaaggacugagaggaacgugagccacccugcggaggcagccccaguaccagagcgggaggcugauuccaaggauuugccagccccaggugaaagggccgccuguggggggugcugguuuugauuuucacucccaaugccguugugaaauucugggugauuccagcugugcagcagaguugacauacugcuuaagaugggacuguggcuuuucgacauucguuuuuaggacugucgucuguccccugugggaacuuggcaggucccuucugccugggacuuaccggcggcuccuggaacccuugccuggagcucucccuuguuggcugucaggaaacaggagggccauggagcuuuggcggugacacuugugguguggcccugugccugcgcgaggcagcuuugccauacgucaugccaauacuucauugauccagcagcggcuucaggcuggcagcacgaucaacacggccccgggcauccucgcgagcuccaaacauccuuccgugggcugucucucucucucucucuccauuccuuccagaguagaaauucucuugacugggugaagguuggcauuucaaccucaggacuuaauacccuuucucgugggccuggagcagguccccuguguccacuccaguuauuccagaaggugcccugcccaugccucccucauaagaaagcugccugccuguggggcagagggcaggggacuuugcuggcgucucuucccuugcacguuucugccugugaauuagucuugccauuaaagaaaaaaguuacacccccauucaaaucauuaauugaaaagcccuuauuaucccauuggugguguuugauaucuaaggcagauaaacucggagaagcucauccgcucagucccugaagaaaugugauuacauccugggucuuauuaaaacaucucccucucagcugucacauuuucccacuuugcagccuuuucaggacacgcgaaagaaucuuguauggaaacaaaugacgccggccugagggugggccaggguggaaggaaggcggguucugcuggagcagcacugguugguagcccaccgccccucgccagcuccuggccaggacaggccucacucagggcuggaucagccaguguugacaggcagcgaaacuuggagagacagagucacuuuugugugcagcuagggcugagagugccugagcuuuuuauguaaaccuuggguguaaaaggaaucaaaaagcaacuggcagccugggaguguccugugggacccucccugccccacccacccacgaggcugcguccucuugucaaaucuggggucagccagcuucacuaccaaaccccuggacuuuguuugcagaaagaauuccucgugcuguguggcuggcauccuuucugcucauguccuggguuucugaugugacaaccgagcacccccaaauugagaugggggguucagcagggagacagccuccaggguccucugccuggcagggcauguugcaccacaggggaggcugauacagaguuucccugcccagcucucccggagccuuggcugauuccagccugggcugugccuuugcccaccaccuccaugccugaagggcuggccacuuacccgcucccucaggccucagccagccucaucgggaccccucuugcaccuguggccagacucagacccccgccccaguccccagcugggaaggggacacuggcuguggcucugcugccgagugucuuccucagggauaagcaggauggggccucuucccugacaagaguggugcagagcccaccugugggcagccggccuucccagaacccccuggcaggccggcgcagggcucggcgcugcuucccgucaucccaguuaaucccacgguccuucgaugagggucugcgguggguccauuuccuucuucgcugauuccuucauuuagcagccauguaucaagcacggguccuggaccaggugacacucugggcauggaggucccaggcauuguggccuggcagggaggauggagugagagugaaccagaaaauaagcacaagcacagccugggguucaugcgagaaggcagcagucgggguagggggagaagugggguggucaacacuuggugccuugggcacugcagagaguuccacucggggggcgcaggugccagagccaggcccuggauugauggcaguaguggggcauggcccaaggcaaggaugaggggccucgaggccgggucccacagggcugguagccaugguggggaggaguugaaggugauucugcaauacuucggcuucuaaaucgcccagagauccuggugccuagauuaguacuuguugaaggaaugaaagucgaggggaagugaccaaaaagcucuaggcagggcgugugcggagagugcuguguucauucgcccagcgcuuguucacugagcacgcgccacgugccaggaccacccggacacacguggugaggucacuguggagugcuguguucauucgcccagcgcuuguucacugagcacgugccaugugccaggaccacccggacacacguggugaggucacuguggccgaguagaugggccagggacaccgguugaggaggcagugcuaguugcucggguaggaguuugcagauuccagggagagggcaguggaaaaggaaaggaaugaguggcugagguuccuagaaccucacguacggagggaagugaggcacgaugguguggaaggccuuggauacucgggggccaaggcccaggcucccuccaccacguccccugaggccucccagugccagcugcggugggggcccuugcccacugucugcccaucugccuucuucagccuccuaggagcagugaggguccuggcccccgccccagguccccacagccccuuugguggacuuggcuacuuggcguuggccccaggauucagccggucuccccccaaccucaagauccuggggcuggcuaccacugaccuggguggucucuccuacagcacccagcuccacgcuucgaccaaagcuguaggacguugggaggaguagguugguuguccucaguuugugugugaaauaacaguguaaaugugggguguaaaaugcccuggcauccagccuuccugagggaggcuuguuucagugauggccagacccggggacgggggaccaggaggugaggcuguggacccaguuccuuggagccaacccugggccauguggcaccaagagcccgggcaaucagggguccugggcuugagcccccucgucccuagggauucugaguggccuuucagcacucacccacccugagcuugugcaugccccgugggaccaggacugcugaggugagcaaggacaguggacgucacugccugugcccccaggacaccuguggcccucagagcgggagcugccucaucaggaccccucuugcacccuguugcaucgguagggugguggcagauguguacucgcccccucuccagagcccccagaccugucccggugucccaucucacgguaggucuccucccagucgccccggggcugugggugucgccagcccaugcugugcagguggcgagugugagcaaaccuggucccgggcccuggcuacgucuucacucggcgcgggcaaagaagaaaguaaaauaagauaaaaagaagaaaguggaagcucuugaggaggucuucgugccgucucgugauccacuuccaguccaggaagcccuggaucuguacgguguguucauuucguuacccuaauuaguuugaggauuuucagggcaaacaugguaggauuucucaguucaacuuugggguguuuguuuuuugagauaaagcacacagaagaaguugcauugaucuuuuaauuccucaugcaaagaaaaaauauuugcucuucucugauuuagugugucugauucucacugaggcuggaggggguggugggguccagucagaguggacacuggagcaugguggcgucccggcccugucaucacugcccccucacugcccaaagaggggacauguacugccccuuagcgaggagccgaggacauccugcaccucccugcaccccugcuuuccuucucccuuggggcagcuuuccuaggucucccugacugcaggggugcuggauaccucugcccaaagccccacauucugugccccuuggagcccugaagcugccccugccccuagcagccucuccaccacugucccugcaggccugccuagccagcuucaccggccacacugggcuacacccaagccuggccccugaagcaggcgguaucuucauggcugcuuaccacuggggaagaagggugggcgcaagugggaaaaucgucaugaaaaugggccucccacgagguuggagugaggaguguggggucccugccaguggggagucgggaguggagaguagggaguggggaguggggagcggggagccgggaguggggagugggaaggaaacugucucagacaggaaguuugcaucucugaaaggggcuggcccugccuucgccucccucuucagggcucagcaucuccauccgugugauguuacuggcacccccucucagaguuguugcaaaugccggagaaacacaggugcucuguggagugucaucgucagugccacugucaccuaauaggauuccuagucccccuggcguccagaggcuccggcacucauggagauaccuugugagccgcaguccucgugggaucguccagguagcggcaccucacagcugucucacggcccaucacuuugucgaggaagaaguggccagagcuacuguuuauaaaagcgacagcaucugugccccagccucuuugcagugugcucugugcccccagcuaaggaugcacagaccccaccccaaggcacuuucggccucugggggacagggaggaccguggacagugauggaccugcaggcuggggaggagcgagcaguaggacacacagaccccaccccaaggugcucuuggccucugggggacagggagggccguggacagugaugaccugcaggcuggggagaagcgagcaguauguccuucuggagaagugaagcugugugucccggcacagcuucccagccagccucccuagugaaccuugccucuucccuccccugagcuguaggaggcagguuuuggcaaaggccguccuuggagagcccccuuggugggucuuaggguguuugccaaaucugcgugcuuugcaauugacaagcaucuuagucucuccgggcugguauaacaaaauagcauagauggugggcuuagaaacagcagucauuuauuucucagaucuaggggcggggaggccauaaucaaggcaccggcagacccggcaucuggugagggcccgcuccugguucauagacagcacccucugccauguccucacacgguggaacagggaggggccucucggcgucuccuucauagaggaaccaaucccuuccccgagggcucccgcucauggccaaucacuucccaaagaccccgcuuccuaauacuaccaccuuggcgugaggauuuuaaccgauggauugggggaaacacaaacguuccagccguagcacguuauuuggccgaaacccagaauaccaggaggccagcccucgcucugcagccgucuccccugagggcccagccuggauucaggccuuuuggcuuggccaaagcccuucugagucccacccugagccuuugcgggagggugacgucaugugcuuuauugcuuuguuuaugugcuucagucaccguuccgcuccugcagcgaccagucaggcacagaacacugaggccgccaaagacuggcccuugguuccaguugcccgcacggaacugugugucuggggcccaguugcugaggaaguaccucagaggacaccgcugacacaagccacaggugcugacguggccgcaccucccagggcuccuuagcaggugugcaccucgagacagguguucacccaaacaugagccguggagggcucccugcuggguaggcccggggucugcauugucaggggcuggucggggcggccucaaaggggcucuggucuccacccagcuccugcguucccuccuguacauugagcagagcaccuccagggggcuuugggucggcucccccuccuguguucucaugagaggcugcuggagcguggcccacugggacaggagagggaccgccauuccugggugagucuaggacacucaccuuccaagcccccugcuuccagccacuuaggaggaggcgcgguguccuggccggggagguugugagugucugcccagggcgccugggcugagcugcgcucgcuaagacccaaguucaggaguggcggcaggagaagccccgcucucacugccucaccgcccugcuuaugucuccagauaaucccguuguaauaaacuuaauuccugccaguccgugagaaccagccuguggaccuguugcgaaguccacaucaugugacugcuccuauuacacugucagucuugauuaagaucccacucugaaaugucaagcuguggucuugucugcgcucccugauucauucauaucuuuuuauaaucauuaucagaugacaccucugucacuuuggagauguguagcuaggagcacuggugacacccacagugaagcccagcaauuuuugaagugauuucuccucauugggagccacagaccuaauguugagcaaaaacugagcuguguguauuuagaaaucaauugaaaacaucacauugcucaggcucugaaugcgcgugcugagucugccuauucuucucgguggcccaggcugcuccgcuuauuuuaagauagagcucaucgguugugaaaaugcuacugugggccgggcgugguggcucacgccuguaaucccagcacuuugggaggcugaggugggcggaucacgaggucaggagaucgagaccacagugaaaccccgucucuacuaaaaauacaaaaaauuagccgggugugguggcgggcaccuguagucccagcuacuggggaggcugaggcaggagaauggugugaacccaggaggcagaacuugcauugagaucgugccacugcacuccagccugggugacagagugagacucugucucaaaaaaaaaaaaaaaagaaagaaagaaagaaagaaaaugcuacuguguggcacccauuucaggagacaaggcucguuuauccggaagcuggccuugcuuggcagccagccaggccugcaggggaugccugccccugccuuugcuccuucugcaggcccugaaagccuggcccuggcggcuugggccuggggguugucccuggggcucaguugcugcccuggcuucugcagccugugagcauuccccaugcuggggcggcuuaucacaaagugcaacuugccccuaccccaaaaaaaccugccucccacaaucggcagcacacagccuugggcaggugcuggaguuggaagggucuggcauacagacuccggagcccugacucuaggaccgcucuggcuuguuagcauguauguuaguccauuuucauacugcuuuaaagaaauacccgagacuggguaauuuauaaagaaaaagagguuuaaugaacucacaguuccacauggcuggggaggccucauaaacauggaggacggcgaaggaggagcaaagucacauguuacaugguagcaggcaagcgagcaugugcaggguuacugcccuuuauaaaaccaucagaucucgugagacuuacugucacggggacagccugggaaagacccaccuccaugauucagugaccuccugccgggccccucccaugacauguggggauugugggagcuacaauucaagaugagauuuggguggggacacagccaaaccauauuagccugcaaccuugaucaggucacucuguccuuccucgcccagucccagaagcagacagguucccaucgguaguccugagaguugccaccuugcuuuuugccuuccccuuacgcacgcauuuauaauccucggaccagcucucccacagagggcaguuguccccagaucagagcugaacuugcuuggagccacacagcugguauguggcacugugaguggaacccagggcagccgacuccacgucugggcuuccagcuucgucggcugcccugacuuuccuccaugucuuccggaaggcccucccaacugccucacucugaagcagggcaccaugauucuguaaggaaaugagauuugagccacacgccuguuugugccacacaccugcucuuuccuacguugcuuguaguguuuucccagaaaggugggaagaaggaagaagggaaggagagaaggagggagagaacaaagaaggaaaugacguggauaauaucuuaaacacuacaguuuuuuaauaucaaauuccacuaguuccaaaauagaacuuagcuggauaauauucugaguuguggcuggaauuucuguucuaccaaaugguugucuggcaugaaacguauuuggauuuuuauggaucaauuuuaucaguaacagugcuaguuggacauaagcaacaucagccuccugugugcugggcccacuaguaggcacugagaauucuucccacaucugccacagcucuggccccuguggcucuuugccaaggucagcuccucauaggacuagcucccuccagguucccaguaggaagaugggaccuguggagccuacuuucaagccuaccccagaagcuguuuacuuucccauccauccacccacacacccauccauucacccacccacccauucacccaccaacccauccauccauucacccacccacccacccacucauccaccccauccacccacccauucuuccauccauccauccacccacccauccauucauucagccacccacccauccauccacccacccacccauucuuccauccauccgcccacccauucuuccauccauccugccacccacccauccauucacccacccacccacccauccauucacccacccacccacccauccauucacccgcccacccacccaucccuucacccacuaugcauccauccaccuacccauccauccaccuacccauccauccacccacccacccaucuauccaccuacccauucacccacccauccauccacccaucauccauccaucugcacauccauccauucaccugcccaccauccauccauccauccauccaucuacucacccaccuaucuacccacccacccccauccaucuacccaucccccauucauguauccacccacccaccccauccauuuauccacacauauguauaccacccaccccccauucauccuucuauccacccacccacccacucauccauccauccuccuacccucccauccacccauccauucauccacccauccauccauccacccauccacccacccacccgaccacccaccauucagcauuuauuuggacacauacucuguugcucucagucaagcacuguggaguucugagccuuugcccucagaggaggcagacucugguccugugagggccugcuggaaucaugcacaggccuugaaggugacugccugguggagacauuaagaaccacccaacuccccagaggaagguacugggaagagagugccccaccuaagccuuggccucaaaaggaccuuuucuccuggaagcccccgucucucucucucccagaaggggaaucauccagguggaucgguacccuggagccaccccuguccccaccucugcccuuaagaguuugagccagacucaguggagcagacucugaggucuacaaaucgacggagaccugacagcaacuuuugugccuguaaguccauaaaucucuggccugaguacuuggcagugacccuuuaacauuccugaaaacaaagaaaaggugucccaauagcagaggauuugcagccaggauuuuacuggaauuaggaaguagaagcccugccgcgcuggcuagcuaaugaguuuugaaccgcuuccaggaauaagugugaguuuagaauaucaccaucagugcaguggcccuacaccuuccggggaauggugcuccaccuggaaugauacuuaggcacugccucacgugcagaaagccugugacugaacaacagaaacuggguccugggaaaugcagaguucuuuccagugggcagcccugccugcaggguccccugagcucucugauggacacccagcugacccuaagcucucugacgggugccuaguagcucugcaugcaucgcguguacccagcugagcuguugaugcuccaagguccugucagaggcagcuguuugagcauuggucccuggaguugccagaggugcaugaggagggcugggcccggaggugaagguugacaacuacagcccuccgcuucuccugcagagauagaaacaccggaaacacguggagaggugugcacuuacggcaggcccgcugccuucuucugcuccagcauccuguguccugcugggcuggccguggugccuggccacacuccgaaucaagccuuuaguuggugauguccaaaggccccuccuccagcacucugcaccccugguucagcccgaugucccuagacggugucaggggauccuguaccugaagacaugggagacaaaccauucccaaacaccagggaaagggugucccaaaauaucacugucucucuagagaaaggaaccccugcacacaccccaccugagccaccgugcucacuucucaucgcugucagagccgugcacuugggcugccaagaccugugaggaccagcggguuucuaguggccgcagccgcccguuucccuuuccagagcuccucucucccagaggacggcguccaaccggaaagguccuuuguguuuggaaagggcccuuuucuggcacaggcuacagcauaaagaugaagaagugagaccacuucuaccauacuccagaacccaccagccccacuuuggggggcccugaggccuugggucgccacgcaaggcggucugugugacugcaccagcgucccuccuuggccccugugcuuacugagccccugucugccuggcgugcacacaguauacaagcacauacgcgcaugcacuuagggcacacucaggggcucuccagagucagugcccaccaccuggaggcgcgucgguguuacugucuccagucagcacuggcgggacuucacgggugcagcccgugaaggugccugcuggcugagauccugggacugggugcagcccgugaaggugccugcuggcugagauccugggacugggugcagcccgugaaggugccugcuggcugagauccugggacugggugcagcccgugaaggugccugcuggcugagauccugggacugggugcagcccgugaaggugccugcuggcugagauccugggacugggugcagcccgugaaggugccugcuggcugagauccugggucuuggggucuggaggcggcugagccguuuggugccgcuggaccagagccauguagauguugacuguaaucggaacuaccuugguaaugguggcagacguuaauaagcgcgcaccacgugccggcugcagcguuuuucugugcaucuccccuuauucucacagcagccuggcaagggcagggcuguucacaccuguuuacaucuggggcaggugaggugccaggagguggaugaccuagaccuagcccuggauccccaccugcgucuucugccaaagguuggcccagguggauugggaaggugcugguuccucuguggagaggcucggcgucauccuuuacgugcccaggugacugccagggccauuuucucagguagugacccgucuggcugguguuggagggagucgagagggccgcugcucuguggaaggaggacccugaguggagagguccucggcccagaguccuucuuagccagcaccuuugaccucuuaggacugucaucacagguguggugacaaccagaaaugccccaacugagaaucauugacugagggucacuagccugaaagauugaauugccuuuaagacaugauauuacaaaagcaucgucauaugaaguggugaucaaauaauacgcagccagaaggcagggaaagggcuguccuggaggcaugcuaggcaguucguuaggagagguauucuuguuuuagaguuuuuuauguuuaugguauuugccagcuuuuaaauuucauaguuuguucugauuuuuuucuaaguaagcaccuaccugcacucccaguuuugaacucaggucuuacguucuuuuucuuucuaagagaagguuuccacauuguguaaccuucagggcuuacacagccugggucggccucagcccauuugagagucagcggaguggauuaucugaaaaguagggguugacuaggaggccacgguguggggacgcacuggauugcuggccugucccaugcuguuccuuaaagcagggguugacugggggcugcggcacggggaugcacuggauugcuggccuguuccgugcugucccuuaaagcagggguugaccaggaggccauggcgcagagaugcacuggauugcuggccugucccgugcuguuccuuaaagcagggguugacugggggccgcggcgcggggaugugcuggauugcuggucuguuugugcugucccuuaaaacagggguugacugggggccgcggcgcggggacgcacuggauugcuggccuguucccugccgucccuuucacccagggcuccucgcuguguucucgugcugcuggcuugccugauaaccuccaaacccguucacgcuaguccuuggguggaauuguuaaaaggguugaugaacucucucucuccccagcucagaguccugccaucagguugaagccuuugauuacaguugcuagauagaauugaugaagagacagcagaagagacguuagaaaaaaaucuauaagcuuuauucccgaagagagaaagcccagacccguggcuccuuugggccaggccaagaaagcauuggcaacuguuaucucuaauguccucaccacccauggcacaacucaaucuccaccccaggcagccggcaccgaugccgcucuguaaucauccagagauaaucaaauuggauuagcuuucagagugggcugcaggaauugauuuagacuguguuacaggacaggcagcgagaugguucuuccugauaugugguccaugacucgguggcccuuucuugauggggcggugggaaggcuuugccugccgggacacaggaggucuccucaucuggaggaugggacgccagggcugggggaucuucccacagaccuuguucccuccucugucgucuagcugcagaggcggcucugacacaggucaagaggcuaggagagggcugucugcccacccggaaaccuccacccuuuuggaugacacacauucauucauuaauucacccguucauuugaaaaauaccacagcccaccggcuggcccaugagaguggcaguuacauggagauugcacugacaugguuggggagagugggaagacacagcgucaggugagagggaagggccgcugcgcagaaggaaggcagccagccgcccagccugaguccagaagggcgagggaggagcagcggcuccagccaggucaggccucggcggguggcgggcacuguccaucacggggccaacaaggagacaagggagggcuccgccaccugcagagggcuaaggagcaauacuaaaccaacucggagucggucugcuuuugcuauaaucaguugccaagcacaggcaaugccagagauuaaauauuccuccccguaaaagguguuuuguucucguaaaaaccauuucugugacuccuguuaccuuuuaauaacagauguguaaggcucaaguggguguguuuugcugacuugaccuugaguggauccugcugccggccugguauauagcaugugguggucugucggagggcuccccagggggcugcgguccuccaacacacacacguucugcacccaccuccugggacaucgugaggacccaggggucacacauagugcccucagagaggccuuggggcauaggugcgcccugcuguuuccauccgggcugcauuuggccuucuuccauccauacguuggucgcacacagagcauuugcguuucuggcaguucugauguggugggacagggccgggcugggagugagccccgccgcagggcuccuggucuguccuuaaggguaggagcggguccagcagugagcacagguggccuggcugcacugucugcggggagcugugcccaguggccaggagggaggaugggacucagagccagcggggagcuaggcugucgguccugggcagaggccggaggcccagccuggggaaggaugggaaguggaggccacugagggcuuggcaugaagcugggacccucuagucugugaggcugugcugcuccugggagggcuggggaagcuccccaccaggcuccuccuuccuccuaggacagugccagggaagagacucucacaggcccuugaucccagaggugccucagggugggauggagaccagagucaaagcacaaaacaaagcuggucugaacugaugaaaaaugaagcaucucaacagaggcaaaauaaauuuuaaaaaaccagccccgagaggccaccaccccaucggacaggugggauucccguggauaaagugcccccggcaggugugcuccugccauagugacaacgucuggggaaaaccugucacagagagaggcaccucccaacacagggaccucugcagccgcuggacgaggaauuccagagaaacccaaaagauguaaaaaaaaaaaaaaacagaagcagagaagagagacuauauggcacgagaaaagaacaguuggauuuuaaaaauagaaauccuaaaaaggaggaugugccuaagagaguuuggugaucuugguugagagaacaaaugcccacucggaaucgcuugagacccuggaguugggugcgucucaagggccugaacagaguccccucccuggagucccucccccgggguuccuuuccuggggucccucucucuugggcuccucuccuggggcccuucucccaggauuccucuccuggggucccucccuccccuggguuccucuccugggguccguuccucuccuggggucccucccuccccugaguuccucuccuggggucccucccuccccuggguccucuccuggggucccucccuccucuggguucuucuccuggggucccucucuccccuggguuccucuccuggggucuuucacuuggggauuucucuugcagugccugccugugcuucagggacccaguaccugacccagccuugccaccuccuggcugugcucccgccuagccacagcuucccaugugucccuucaugcagguucuagggggccacggcuucccaugugucccuucaugccgguucuagggggccacggcuucccaugugucccuucaugcagguuaugggugugaguggacgaguaggcagagauaagggagagaguaagugugggaguggaggaaggaagcuggcauuugucacuggccgccgagugauuggugcccguuguugguccaguccccuggggcuggggucacauggcucgggggcccuuccagagcugcagucagggcuggaccgcagauguguccgugacaugucgugguugggggacaggcucugcuggccuguggaggugagcucacggcccggcggcggcaggaaucacggacgcucacaucugcuccguggcauccugugcggccuccauuuauuucccucaaauggcuuucaaaaccuucuaaaaauaggagcuuaaugagacguuuagcaaaaugccacacaguauuuaucccugcacuuggcugcauuguuaguucuuccaaagaaaaagcucucccguguauacagcgugccacccccacggccacaggccaggcuggcugccgagaaggcuggaggaggugggcgggacagaguugugaugggaccacucccccgcccaggugggcagcuuugugaggacuaguggggaagggacacgaccaaggccaccagcccugccccgggagcucacagaggccggaaggauggcagagccggcagggcugcagggagguacccgcaguggcgagucagggaggaagguucuggaagaaggggcuggcacuggggccgagauggcugaggcucuuggguuuuuagaggcuuguucuuuggaggaugugauguccucuugggaagguuuccugaugaugugucuuacucguuguggacuggggugauugucaccuccaccuuaaugggaugccuugggccuuuuggccuagcccucaucucuggucucucugggguaugaaucccauccucagccucagaugaaccccuucagagaggaggggccuccucucccauagcagaaaccccacagcacugacuccucaggggcagcggggcugggccugugcaccaggagcagaugggccaggggcugggauuagccccucuggucuuacuguuccugucuauaaaaugaguggacugcauuucuccaagccuguuagaguccaugaggaaaggauagcgaagggccccacgcggcacggggcacagucacuggugcacuguaaacgccccugagaucaguggcagccacaguccggagcaccgccacgcccauucaggcaaagcaggaaccaaauacugccaaccagaagucagauuuggagggcacuggggagugggcggcccuccuggcugcacucacagugggguggcgagggcuccaggcagcuuggagccggccucugaggccccccgaguucaucuuuuggacaucucaaaaguccgcaaacacgugacccaggacucacccugugugcucccaucucugcuccaggagugucccaguuccgucuagaacagcucucgagcccgcguacaccugaggcggucuggguggccgggcuugcuggguggcaccggagucccugugccacgguacuucugccgagccgccucugcaccugggugccugggccuucucgccgagcugucugcucguuggcuugcccacuugugggccacaagcacgugugccacagcuccacaagagccuggcaugggcuggugggcugcagcgcuagcucaaggccaguacgcggucuccccagcccccuucugagccagacccuucucugugggucaccaagugccccacucccacccccagcaucguccccugcacccacggggcucccgugcgugugacccucccuugggaccagauagcuagagaccuccgcccccaccacccugcugaaugauggugccauucucuuccuuccgugggaacucuguggcccucacguggcgugcauguggcuguguggccagcacagaggccuugugcuucugccucaggcaccuggcgugacugauggccuugcucuuccugcugugaugcuggggccauggggucucagagaggaugugggauccgcuguggccccucagaggcugaggggccugugagcugcguggggagcaacccgcuccgcuuaaaggaaagggaccuagaccugcuggguucgugcagauuccugcgagccuggcugugcgggcccagagccucaccagacuguugaucugaacacacuuuuaaacgcugcguggugugggguucugugugacacucagcgcccacccguguacucuccaccuucccgggugaggcaggccagcggcuucccggcgcacucacgcagaaccgaccuuuccagaucgcagccccacugcaugccuuccuccugcccucccaggcagcagaaaaaucaaugugagaacgcagacuugaacaacucgggaaauugaauaauuuucacaauguauauuacaaggaaaaagaucauuuugcuagugaaucuaugaaaucaacuugaaaaucaauauugcuacauguuuaaagguagccuuggaagcuugguccauggcugggagaggcucugguaccugggcucccucguggccccucuccagggggccucacuggggguccugagcacugggcugugcuggcugcugagccagggcuucuuccuguggggcucagggagguuccaugagucauuuccccugaagcucuuucagaccuguguggucaccagugaccuuacucuccuggaagcccugcgucugcucugggguugaagaagaccccugggggaacggagagcauaaagccaccaugccggccugucgggaaagagcagcgucacccaggggacggggaggaccccuucgcgguguggacguggcagugcagcccagugaccugcacuuuucaagcugauggggccagcaaugucaccucuggggucucagcuucugaagauagaagggcccacugcagagggccgugugcauaggagcgugugcggccguggucugggccuuacucugcugguggcagcccgugugaggguuccucugggcugucugccugccuggaccucacccacucuccugcguguaucugacuagaacccgguccuagggcuccacgguucucuuuuuauucugaagaccuauugcuuccugguuaagugcucugagauaaauuguuacuaauguugggaagcagaucuuuuuguccucagguuggguugaccaauacaagguuauaucucucagucaugcguucaaaacaauggguucaaaaauccagacugggucagcgcaguggauuccucuucccugggugagaaaccaccgcagccuccuacgggguucccccccuggccccugggggcaccgugucagaucagcgcaagcucaggguccccaggccgaaguggguuccuccucugcuuguggcuggcgggcgucgguggcuggucauggcaucucagcugcuccccgcuuccaugggauggugaccccucagcccacaggcacauucacuagagaguuucuggccggccacaaccccccacguagcugguccugacgaggcugucgcaguugcgcucucugucgcuucuaagucccaaagccacacuuagggccacucuugguggcucuccuugcuuaugagauggaacuaguauuuacugagugugcuuggcccauuuauauuugucaucucauuuaacucucgugaugagaaagguggcguuuucccauuuuacaggcccgggcacggggccucugagagagaaagcaucggccguggcggcagagcagaggagggacgggguccagaugucugugacccuucgggggagacgcaggaugccagggugggucacgggaagcuugcuggaagggagacccccugagagcguuagcugugggagaaaagcacucgggcuaauuggaacgaggauugacugaauaggacaagaaaaggaaaaaaaaaaucacagccgauuucauucugauauuaaaggagguccgaggcaggcaguuccaggcuggaacagcagccucggugcuuucagaaacacaguuuccuuucugucuucucugcugucuguggcuuccauucucagaggcaccucguggccugagauggcugcugaaacuccagccauugcauccauaguccagccuggcagcaggaggauaaaaggcaccuuucccugccaagacagcuuccucuauaagcuucuccugaauuccacccacugcuuccaaaugcagcucacguucaugaacugagucauguggucauaucugacuucaagggagcccgggaaaugcaguauuuuagcagggcuugugccuccuuucaugaagaaaauuaaaguucuguuccuaaagacggggaggguggcugaauggcuguugagugguacuuggcagccccugccauggugcuccaagcagaggaaacagcaugggcggugacccaggggccaggagaggcugcaggcagaaaggcgugagagaagggggcccggucugccugggggagguggguucgagggggaaagagguaaggaggcggccaugcagguggacgggcaagggaaaagggaggagcuguggccgucgugcaagcgaaagaugagagauaccacccaggagugagccgggaagcaggugcguuugcaggaugccuaggaggugugccuagaacccgcaggguguggugacagauugcaauggcugggggagggggcacagggcaaggucagagaagaaggagaagaaacuggggacgaugucugcauuuguuuauugggugacuggccgagugcugucgccagagaucaagguaaagacccacaagggcaaaggcagcuugacaggggugacgaugagucccguguggaggcggggaguggacagagccugugggagguccggggacacuggacuggccuguggcucugaagguccgcagaagucacucuugggcaugggagggugggcagagaguaggaggaggugugaguggcugugagagaguaggaggagaugugaguagcugugacugcgaguggaugaggagggccaggaagagggcgcguggcuggcgggagcaggggagcuccgggaccuccugggccuccagcacugucuccaggccaugacuucuccuuccugcuguugaggaacagacauguccccggagcagggcgguccugugugccccugucacccuccccuccagcccaccuccucacacucugcgcuuuugagagcuguuccuaguguccugguauggcccugccacgcgcugagugagucugagccaugagugaccugcucacccucugagcucugugucgugacguuuggcuugguuucaucucugacugaccguagcugcagccuuuacuugucacgcgcgggacacugucauggccuggaaaugcccccccgcuugaaauuacgacucuuugacugcaguuuucccccuuccuuaaacaucaccuaguauggggcuggcaaugugcagacacuguccaucccagccccaaacccgacagcgugccaggcuggcucccugaagcccucaggaagcugggggaccccagcagugccuguccugucagccugcccuggagcagguagcgguugccuuuagcaggcaaugugcccggagcuguccgaguucagacggcagcucuguuaggcagggagugauggcggcugcucugggacaugugcccaagguccgggaugccagaaacacagcccacacggcugcucuuccccuccccacucucagcggcccccuccuggugauuucugcuuuaggagcagaagcagccuggcagaccuggccuuguccucuggcguuuucacucgggaucgcugugggaagagccuuguagauaagcaccugacugagggugccuccucuagaagugggcguccuucccugcugcccgcugggcauuucuugagcggcaucuccagggaugacguggccacagcaucuuggccccaaacaccgcaaggcaggaagucuucacgggcugaaaaagacgaagggcugcgccaggauuugcaguguccucuguguguugaucagaagucucagccgugugccuagggaugaaauggaagggcagcgugauggggacgcuccaugccgagcccauguuuucagcacugaaaggcgcuuuucucuuuagaauuccuuuuuuggaaaaaaaaaaaaugaaaugaauuacaaggacaguauacaucgcugugccaugagagacuccucggaaggcggauguauugaggugucaccuucccagggcuguccucccggcgggcuggccagcucuggcagcugccacccugucccggcuggcugucacugucuuuuuauuuuuagcccugguuugguccagaacgucacaagauuuucaaacuaauaacuggauugucaaagaaaucggcuaucagagccugcacuccgggcucccaggauggucugggagugggagagagggagggaggugggagccgcccuggggaugcccggccacuguggaccagugaccauguugggcagaugguugcaucgucacugacagaacucaaaggcaugagggccggcgaggacgcguaacacuugacaucacagcagccugcaaaggggcaaaggaagccccucuucccagacaccacggccguucucccacggucuccugugcucacaagacagaggaugggcuggcgccagcgcagacccccacccgagugcccacccucaggggcgguggugcggacgggcgcagccugaccuuucugugcggagcuaccuucuugucuucuguguaucaggugguauucuguauucuuugaucuccuaguuaaaagggcauugagugugauagaaagguuaaaaauaagguaaauaaggaugaacuuuucauaggcaguuuuccuaccaggaccucuacggcccuccuacgucuguggugugugcccagcgucguguuaugugugacaccggguucaucaagugccucccacucagccccucccccugcuggugagcccccuccccacguggaguuuccuguccucccagauggcugaaggcagggcuucuuaucucuuggagaagcuggucaguguugaccgcccacagaaaacccauaccccaugguuucacaggcucugcggaaggugacagguagugucugggcugggaccaaucaggggcuggacuaucugacagcaguucaggcuccuggcuuccacgugaagaugucauucuaaguuucagggccaaguagggacacauuuaguggggacagccccuguaacccucuccgagagacaggguuguaugguagucagguccaguggcucgagagggcagcccugcugaugggggaggcggcagcccugccacgggccggcugcuugacccugagcugucgcuaggcuucuugagcggccgucuccucccucggacaugguggguguggaggacaccucacaguuguuagaucgaugccuagcuugaggcuggccggagugaacaccaggaugggcagccucacagaggcgaccagaagagggaccuggggcaggcuggggaggugagggugggccugaggcugucagaacuccccucccugcacccuucuccuguccacuccugggggugucccucucuacccucacagcacagucucccuccccgggcugggucacacugucaccugauggauccguguaagugcacuugccugcguagccauccggcagcccuccccuucuccggccccucagcugcuacccgggagccacugcugcccgcgccgaccacccgaugcucagcagggucugcaugcugcacccauuugccgucuccuucugucguccuggccacagccccauggucuucagucccaugaaccuuggaggcuuccaaggcaccgggcugcuugugcaucaguguggguugcaccugguaccauucccauccagagggacagaugucagcacugggcccuauggaggggcaguggccaggcacugggugcccccggugugcaggugaugcaggaugcagaguggccaucugggggugcaaggcgccuccugugggggugauucgucuccuugcagugcuccuguguuggcucuuuucacguaggaauuauuucagcaucugggagagcagcaugcagagucaccguggcacacgugcuguaguccgcggcuccucccaccuggagagagaaaccacuccgggcaugugaagcccugugggacagagcugcacuauccugcaccucucagccgcuuucccgaucucuuuuugguguucgugauucaaguucgugacugcagacucugacaccgcacacguuaucucucauuauuuggcggcuuggaacuuguguguuuguggugugugcacguguccgucuagaugaacugaagcuguggcuggggucugcuguagguguccuugccgcugcacgggccaggaugugguucucccaccuugccuacccauucugcaccuggccucgcaggacggcgggugcgcugugguggcccuucccacacgugcgucccauggcuccucgcuucagagcgugccgucgugagcuccguguggccgugcaguugcccuuuccgguucugguuccacagcucgcugacccucgcuccgagucugcuggugaggcgguguggcucagcucccagccucaccuucucuucccaagggcuggguagggccggugcccagaugguggcccaggacaguggggaucugucuggaggcccagcugugaguugggggcaucuauacaagucacccaccccccaagcccucauucuuucuuuacugagaugccaguuaccccugccaugcugggugugaggcagggguaacugggggacuccaggcaggugcucgguggcuggaugggcgucguggcucuuaacugggucuucccugugcugcccgucacccuccagccggcaggcgugccugggcuuccccuacggccauccuugcacccccaccccugcaucugugagggcgcgucucacccagcaccacggccuuccaggacgccgcagcuccaggagucaggcugaggcucuggcucguguggguucugcacccagccccucccugaccugggguccaguauggccucgaccagcacucagcguuugcaugcuucugcaguugacauacuagaaacuuagcaggaucagcucuacgugacccagacgcuuaagcacauugagagcugcaacaauaaagugcuuaagaaagucccagguagaggaguuuguaaaggaggguucuuuagcacugucauucgucuuggaugagaguggagcacuucuucuuaggaacacaaaaaaagaagaaaggggagaggagaggcacugagggcggagagaggcagcaguccuggguagggggcaguuccccccccaaucugaaaagcccugggauacccagccccgacagguucuucacacauggaucacggcccacccucugcacagccccgugggcaggcugugcccgcccucccaguccugugugugggaggagggccgggagcccaacugccagacccagcauggggccucugcugcguccugcucaggacccccugcagaggacacaccacacagcucugguuucuucggccagguggcccguccuguggaagggacagggcagcggagccucacaucucaggaagauagcaucauuggugucaccauccugccucagccagaggcaccugcacagggucccgcagccaccagccagggcaggaccugcguccagaaaggaggcaaggcaggcgcagguccccuccccaggccacacacacacacaccacaguuaccacauaaauacacaucacaugcacucaccauguacacacacacacaccauguauacacagacaccacacacaacacacaccauguaugcacacagauaacaccucaccauauauacacacacacacaccauguauacacacacaccauguauacacagacaccacacacaacacacaccauguauacacacagauaacaccucaccauauauacacacacacaccaguuacuguguacacacaucacacacaccaugugugcggauacuacacacacaacacacaccacgcacacacaccauacaccauguaugcacacagacaccacacacaaaauauaccauguaugcacgcagacaacacacaccauguauacacacacuacacaccccacacacaccauguauacauacacacacauguauacacacacaccauguauucacacaaagcacauacacucauguauacacacagacacaccacacaccacacucucaccauguauacacacagacaccauacaaacacacagcauguauacacacagacaccacacccacaugccauguaaacacacagacaacacauacacgacaugcauacucaccauguuuacacacagcacacacacgauguauacucacauuacacacacacuacacacacaccacaguuauguacacguaucacaccauguguacauacacuauacacacacaccacacaugcaccacauaccacguauauacacaguacacacaugcacauagacacgccaugcaccacacaccacauauacacacgcacacuacacaaacacugcacaccauucaucauguauacacacuaaacacccacaccacacacucacacagacccuacacaugcaccacauacacccacagcacacaacccccacacacgcaccacacuccacauacagacacaacauccucacauagugcacccaccauacaugcacacauccuccacaccacacacaugugccacauacaugugucacaugcacaucacaaaacuacacagcacacauacaaaccauacaggugacucacacacaccccacacacacacugcacaccauauacacacaugugcaucacacaccacacacacaggacuugcauacacucagcacgugagguggaggagggugggggaagggcaggggaggccgggccgcccaaccccuuccuugguuuccccgccgcuccuucuccuucacacagccuggguugugcuucccgugcagacacucagugcugggaaucacguguggacaggacguggacaccgccugaucgaggagccagggugggguggagcuggagcacguggucaggauacagggugggugcccagcagaguucucagguuccgugugaggggcccucccuugccgcucacuggggauccggggccaggcucugccgucccccuggaaucauguggcccauugauccuacccgccugggagaagggaacguccugguccuggucagcggguggaggucuucacagggccgccgguagcugacgcagcugcagccccaagcacagggccagggcauccugcaggccacguggacaccugggcuccggggcagugggaggucuaggccugcgccuccccagccccguccucucuaccucaccccggaccacaugcuggauugaauaugaaaguacaggggucuucgcuggagccgugccaugacucacuauuuuuaaaugucugaaauuugaaucuuugaaucauuugcaccuugaccuguucucuuacuaaguuuuccaugacaccugacacgaccaagccacggggaccgagauggcaaagggaaggaguaucccaugggaaaaugauaaaaacgggcaggagaucccaggcgggucauucccuggcaccccaugcccuccccccagcuacccuccucuucaggacccgcaggcgcuguggagcccagcaagccccaggaaccuccuagccagucuuccacccuccugcgguuuaggagggaccccgggggccuuggcugcucccugagccuuucucaguucuagaaaaacugagguuuccagggugcugggaagaaggggggcagcccaccugccacagcacaugcuggucaggcccugccucccagcuggcccuggggacaccaggugaccauggagguguaccucccugcuggggagggagcacugccaggagaaaccucuagaaagagacggugccuggauugucuuuuagaaauugaaaucauguuuucaauacaugcccuugugaaaaaaaaaauggaaaacagaaauugaaagacgacaacuggaggacagcuauuuucccucccaggcuggcgacugucgggggcgguccaucuccugcccacccugcugccgugagucucuugguauggggggcacugggcuucccgccuggcugccaccucugcuucucaguaaccuuuacacucacaggaguugccagcaucguuauguuuuuuucaaccacagauuuuuuaacugcuaaauaaauaaacauuucguuacauggauagaccaaaauugccuucaacacacuagcagaguuggcuuuuuuucccucucaccuguuacugugaaaaaguuuaaaauacagagaggcagaaagcaugauucagggacaaccaccuaguuuuaacagcuggcagcauuugcuguguuugcuugagugaccuggagcaaggggcugagugucucgucuugggugcacaccuggaaaugaguggcagaggcagcgccuggacccugugugccagccagguggcuccugggaaagcccuucugcgcaagugugugccgugggcuuguggacccgacagugugagcuugagcucucuagcguccgcgaauacccaggggcccuucgagcauccucagcuguugcccagaugucccuggggauaacugagccagccccagagugagcugccggcgcucuugcauuuuucggggugguagcaagccccgucuucuggcaccgcugagcgccuuugcauuguguaaggacugcagggccuccucgcuccggacaccucuccuguuccuguauuuugccaguuccuuuaaggauuuugaccuguuugucucuuucaagagcucuuuccauaugaaugccagcauuuccuccuuucuaauaaaaaugacaaguguuucuuccauuuuuucauuuaucuuuugccuuuauguguauauaaauauaugagagcuaccggguguuaguuuucauuugaaagguuuuuuuuuuuuuuuaagguuuuguguauugaacuuaccggucuuguauuccuccuggacugggagucauaguucccaaggcuuucccgccucugaggggugaaggacucagcauguuucaccuggugcugucauguuuucacuuugugcguucaaucucagguccccguggcauugacugaggcccccguggaguugccauggcguguggugugaggggagagacgacucucacuucuccaguacccuugaccgagccuccugcauagcccagggacauguagccauuggccucggcagcuucgagguuuucuuucuuccuuuggcugugaacaacagugcacagaugagcaccuuucuauagucaucuucccccaagccucaagauuguccuccaggcagagucagaggagugggacuguggacccggugcagggagagucgugggaaugggacugcggacccggugcagggagagucgugggaaugggacugcggacccggugcagggagagucgugggaaugggacugcggacccggugcagggagagucgggggagugggacugcggacccagugcagggagagucgggggagugggacuguggacccggugcagggagagucgggggagugggacugcggacccgguguaggcacuuccucguggucuugauauguaggcccuccccucgagcaggauuuaaagcacacaccaugugucugaaaguuucagaauuacagaccacaccaugcccacgcccaaucugcgaaccccaccucaggugggaacccugcucccuagaaauacccuuuggccccggagaccaaaggagacggggcaaguggagcugggccugggccaggugggcacugaccaggcaggcgugccaguggccagggugggcagguuugccuccccugugguuccuuuuccaacaagcacugcccccccgcccggccccuggcugccccacccagacagagggacaggaggaccauggccaucgaaggcuugggaggcccacccugagcaaacagccccucuuugucuggcauccagggcagaggccauggguccccucccaaugccugcacucauccucauccucucuggggaccccauuugucuugcuugcccucuccccauaauuccugcucacaauagucucugaaccuuuaaaugccauucuuaggaggcugaaaccaaaggucccugguugcagugucgagacaggcagggccuccuggagcacaggugcaucugaaggugguagggucggugugugcgauucaguccucacggagucuugaaaggugaccuggaguuacacagaaggcagacgggugagguugcaaugggaaagggacagccaugguugcugugggagccugaacagccaggagagggcagaggguaggagggaagggcgguggagggaagcaaggaaagcacaggccucugugcaggagccugggacaggcacugccucugaggggugggcacagcacggugcugccagugcuaccagugccugcaugcagccggggcucauggcaucuggaucucaagccacccgguccugacaccugcaccacggggucguuuccucaugcacacacuugcaccacugagcaggguucaugagcacugggacgccaagaguccagugggucgccugucccaggauaacugcacauaucagcaccaaguucaucauuaggcugugagcagcccauggccaccuugggaagauggccguacuucuuuccaguggcaacaccuccaaggcccaugcuuuuccuuguacgaagcagccaucaccgcgccagguaacagagcugagcccugugucucugacgcugcugugcggaggucugagccggcuucagaugagcccgaggccuccgugggcugcgccaagggugaggcaaagcuggcccagccacgugaagcugcgugucacagagggugugcacuggagcaggagccccuccccgcaggccguucucauuuguacaggaaaaggcacacacucugccggcuccuuagacaugggccucuguggccucggucaccagcuugaaguccuguuugacaagcccaguguacucucagcaggucuuguuagggaacugauuuggaggcacuugucacuuaugcauguccagggcagccccucgucaccugagugugaaggacaggcaggaccuggggagugucagguugagcuccuccuagggagguuuuucggcgagggucccagccugccuggggcaugggacggccugugccuuggcauggccugugugucgagugcugggucuccccugcccuugcugaggagacuggcggucucucggccacagaggguuccugggccuguuuccuaaggcugaaugucagugucgagucaggaauuucccagcccaaauggagacacgggaggaaggaaauggccucauucaggaacuugaagugggccaagcacaaucugcgggucuucugcagccugaaguucacuggggucgcuccgcuggcagcgcugacagcagcggaccuuuucgccaugauuucaucucagcuggucccauuccuuccucugcacauguacgucacggaagcggauacuucauguugaauauggauucagacccugcagccccugcgcaggaggaauacaaaugcuccacugucugcagaaaggcccggggguuuggguaggaucaacgaucuuugaccucuguaaugugugguccauggagacuguugucauuucgggaguaggagugacagugaggggccagugagaccgagaggggccuauccggugcucacuccagccucuccacagggcaggggguggaguccaggcauggcagggccuuuguucuuguucuggccucagcccuccuggccuccuccugcucugucaaguguggccgucguccccugugauugccagggcucgugauugccagggcccuguggugaggaggaugugucagggguaggggagugacucguguuugccugucucgcuccagggggugcgcggaccccuucagcccucauggcaccugcgaagggcuccucugccaccucccaggaggugccugcaacucuugcagauagagggcaguggucaugaugagcacgaaacaacagggcgaguuucuggagcucuuugcaccagcacggguaucgcugccccucucgccuggggguggcuccccucgccaucgccaucucauagacaggggcuuguccuccagggacagugcuuggagagccaggucuagccugcugggcucuggagcaggcaugucgccugccuggcucuagagcaggcaugucgcccgccccacugcccccgacagugguauggggaaugggacugcagugugggugccacaggguugccgggcuugcugcaugccuccugggacaaguugcccagccuguccgcuccucagguuccucaccuaaaagacggaggggucaagagaaaugcccgagggccuccugcugggaaaugucaugcugcugcccugccccccggaccccggggguccucagcggccuccccagguggcaucagggccuccccacugcagacagcuggcacuccacagcaccugcugugguuaggguuucucaccaggcugcacacgcggagugucaggaggcuguggaaaagcaaauuaaaccaauuaacccugcuccccgcgucgcaugucaccguggugaauccuguuucaucuuucucuguuaggggaagaaaauaacaagaguaggcaaaugggccuuuuagccccaucgugauuaauuuauucaucuuugcauguuggcaauuuguaaacuucugacuugaguagcuuuuaaguggaccucugugugcucucugcugugcccgggagcagguguugacgaguuuugccacugcacgcacagcccuuccugcugccugggggagccuuccgguaucuucagugugcacagaggguccaggggagggaagcacuggucagugcugccagcagacccuggccuggagcaggcagaggagggaggcaggauuuauaccuagaacagugcuguccagaaggaaugugucaccagccacauaggaacgugaaaacaaagaaagaggcaggugucauuaauuuuaauaaaauauuuaaccaacacccaaaauacuaucauuugaaccuagaaucaauauaaaaauuauaaaagaaauaguuuacauucuuuuguucuuaauaaauauucaaagucuagaguguguucugcacagacccgcccuguuucagacgcaccacucauggcccuugaaggcgaagucugcgguagccugcaucccaugguuccauuacgcuucucugcauagugcuggacacugucucuuuucuuguuuauuucuccaucuguugccugaccuacuggcacacacacucauacauguacgcccugcagggcugugggcugaguguccucagugccuggaguggggcccggcaugaggcagcccugggcauguggucacccagugaacaccugcagugccugugagaaggucuggcaugaagggccuggaccucaggcccauuugcuggaggagagaggccgggguacaggugggagcuggugcuccaggugcucuagcugcagugugggggaugccccacagcaccuggccuucucccuacccuuguaagcagagcuccagcaccaggcggggcacuguccuggcagcugcccagccggacaaggaggauccagcaugaucucagagcagacccuauacuucuuuuauuuuaaaaauuauguuuaguauacagcuaaugcauguuuauuuugaaaagauuagaauuuauggauaaguaaaaaauaaaucaucacguuuucucccaacgaugaccacguucgucuuuggcugaugguccuuuuggaguucuucaugcaaaugcauguccuugaauuugcauauacacacagaaagguaacacccagguaacacccaggcaggugcacagcggggaaccuucaugugccuggcucaucgugggcaccagaagccccguaguggaagguguaaccagccauucaagcauugccgaaggcacuuugcacacauucaacaaccuaauaagggaguuauuauuuuucuggcuuuuucacuccagcgguucaccaagugggaaggaguggcacccagcagcuucuuugcucccauaacucggcaagugggagggaggguuacagcucuuuuacuccugccgcccacagcucagcaagcauuacagcucuuuugcucucgcaguuuggcaaguucuggguucuugucccacagccaagaggaauaagguacguggacgccagagaguaaggcagaguagaauuuuacugaggaacagaaagaaagcucucagcugcaagaagagaccugaaagcaggguggccaucugugaggguaaguccaggguuuuuaugggcuuugaaugggggagugcaugcugauagguccauggaugggcuuggaaaaagcaccauucgauuggauaaagggcaucauucagaaggaaccaguugaaagagaguggguaagacggggauggaaguucucacuccggucguggacucuauccagaacuggcaguuaggugcucaggcucuaaaaguauccuuggcuugaaggucagguuucacuggggacccaucccugucugucuaggaacuugucugucuccuguugcuaucacuauuauuaucccauuuuacagaugaggaaacugaggcauggaggguuaugagacuugcccaggguuguguagcuaauaaaugcagggcugggauuugaacguggccguggggcacauucagaugugcuuuuaguugcuucaccggacucugcgacguucacugcccagcaaagugcugugggcucaguuuuggggauauagggacacacagaccuguugaaguagugguggagaugcuggggagaacucacugcccagcaaagugcugugggcucgguuuuggggauauagggacacacagaccuguugaaguaguaggugguggagaugcuggggagaacucacugcccagcaaagugcugugggcucgguuuuggggauauagggacacacagaccuguugaaguaguaggugguggagaugcuggggagaacucacugcccagccaagugcugugggcucgguuuuggggauauagggacacacagaccuguugaaguagaugguggagaugcuggggagagcagcagggacgcaucugcagugcucguggggucaggcagcauugggggcgggcucgggcccagcacucccgcaucuaauccagugaucuugcuucccucgcugcugcccguucucacaugagccucagcccugggccagccacucagagcucagggucucgaaggaacccagggucugcagucaaccacccacccacccacccacuguucuggagccuggggcccuaggacacgggcuugucaccgucucacccuuccugggaaggccuggcacgcgggggaggucaguguccuccacggauggcacuaggauucguuugacucaggaaaaauaaaacccuuuugguaagaaguagccaaagccauggcgauaucugcucuucagugucaggagccucgccugcucuucagcaucggaagccucaccuggucuucggcaucgggagccucagcauugggagccucgucugcucuucggcaucgggagccucaccugcccuccggcauugggagccucaccuguuggaacccgcccggggcaggagugagcggcauggcggcuucugucuaagugugguccacugcugugugguccauggggggaaacuguuggaaacaucccagcuuggcuucccaccuccacccugugucccacucacugacguuuuagagagaugccuuugccugcaugguggugugugagucagggcuccacuucugccugggugguguggguagggccaacccccacccccaccggcccucaacuucaacagggguugccugguggaaagcgugagcaacucuguccacucuugugauucaugauguguccgagagugucuagggcacacccaagucgcccaccauccugagaaccaacacaucccucuccccaggccccaccucccagaucccaggucaguugcuugggcuggggccaggacaauggggcauuuuuuugagcuccuugggugcugauggacauguggucaggccugagaaccgucaaccuccaggccaugcagcgagagucugauucuguugcuuuugaucccucacugaucacagaccccacagccuuuacaaagggcccuugcagacacucgguguccacuggaaggauucucggcacacaggcugauggagaaaggcagggugcacuccacgcugcccucuggcuguggcuuuguugagaugguggugccccagggaccgggggagggacggauugcagaccugacgcgaccuugacuucuacagcaucagugugaugagcagagccuuccuuuaacuuuuagauccacagauguggccauuaauuguuuauggaaaaguuaagaaugaaaaugcaagugccgucuauaguuuucugggcugggcccugggcaggccucucuccaccugcccuccuggacaggcagcaccgucauugcugggagagccaugucccugaaugugaccgagggauggcuucgcccgugguggccccucugccugccuggugugggugaugcagaacagcucuuggcuaauaaaugugccgcguuucccagacaggagacgacguggccuagugcauaaauaagacaagccuuuuuaaaaaagaaaucuguauuuaaggauguguuuggcuguguucuucuccucccguaaaggucacccagauagauuuuuccuucuuuagcauugcaggcugcgaagaacugggcauuucuauucucccuccauccagugaaccuggcggacuaaauuagauucugaaauugagugugcaguagagucggugaguuaccguaaugggaggguacugcuucucaccuugcaaggagcgaggucaugauaauaugaagcgaaguggauuaaaaauaaaaccaaagguauuuauuuaugaccugcucagaauuggauuggcauccauguaaguugcaucuaauggugaaagacagcagauugauguugauauguccccagggacuuuuagccagugaaauucgcucccugaauucaauuuaaaggcccacugaaaguauccaaaaugcgaaaggaaauggaauugaggaaguggggguggaagcccagcaacugcgaaauagcaauuggaagacgguccugguguguaacccuccugaugcaggaccggagagaggacaguccugguguguaacccuccugaugcaggaccagagagaggacaguccugguguguaacccuccugaugcaggaccggagagaggacaguccugguguguaacccuccugaugcaggaccggagagaggacaguccugguguguaacccuccugaugcaggaccggagagagggcaguccugguguguaacccuccugaugcaggaccggagagaggacaguccugguguguaacccuccugaugcaggaccggagagagggcaguccugguguguaaucuuccugauucggaaauggagagcgcagcuccgggauggccggggggccugccucagugaggguggggcaacaugcagacggcagccuccggcacagccaggaugugagcccaggucaucuguccaggcucugugccugcacagcucagcucauccuggcugugccuauguggagagccugccauccuuaucuccagaugaagaagaguguggcuuggagagccaggcccacugcccaagaccaccuggacaggaagacaggaugugaacuucagagcccagcuaccccccauuccccuccaugccagucuugcugggcugcguuuucucgaggcaggcgacaugggcaucccgagccuguggcccucccugucccuugucaccugcuaggaguggggaagggcaguuccagcacccugagggcuccucagccgccuuccugacuuccuggauccagcuucuguuuggggugggagguaggagaagccggggagccugcagguggcccccugggggcaaauucucgaggaccagagcccacagggccaucugagcaguguagaccccucccucagggagucugcccagcuucaugacagagccugggcuugggcuggcccugaccugaugguccccuguuucucuucugagaacccccacugcaggaggcugucuuggccacucagcccucucugaucccuacuucugccaagcccucuguguguugggguccccggagaccugcccugcccuuggugggcugccagcagcuguggaugugggcguggucaugugggagggcggggcugucaggcgguggucguggggggucccccgaggaccugugcuuuuccuuccccguuguggccucaguggacguaggucagucuccaucuccucaguguccgcaucccggccuccagaccaugagcucuggagacagucgcccaugugucuuuugggggugggacucagugcccccauagcccaucugagacacggcccagcugcaggccagaggagcccacccagcacucccaguaagcccaacgcaccugcccagugcgcccggugagcccagugugccuacccagcacucccagugagccuacccagcacucccagugagccuacccagcacucccagugagccuacccagcacucccagugagcugugugcucacccagagugcccagugagcccagugaguccggugugcccgcccgguguucccacccagcaugcccagugagccuuguguguccacccagugugcccgcucagugagccuggugugucuaccuagcaugcccauggagcccacugugugcccacccagugcuggcuguacugcuggccguauguguguuuucccagucuguccagcagcccugacaguaauuuacuacaguaaauaaaaauuuguacuaugugaauucaaugcaauaaaugcugugacugggaaguagaaugggagaaugaaggguacaggaggcgagauuuuaaaaauacacauguaagaugauuuuauccacacugaacgacuuauaauuguugcuuauucccuauaguucccuauuuuccuacuuacaugcaugucauucaccuuuauguaaaaccuuuuaccuccuaucuuuaccuaugagaauccuaccugaauuuuaagagucugaucaaaugucacuuccacagaaaggccuucuuugguuguaacuggaauuaauuuuuaaaucucagucuaaggcaaauaagcacauuagaaagcaauaaauaaauaaaugguggccccauuuugcagaggaggaagcugggccucgggguggagucauuguuccagggcaccagguuggaccuagaccugaagcuggguuugguggagcccugcaccccaacccacuggugugagguggucaugcaggaggggccaguuggcgcuuugcugugcuccugggcucccggggugggccugagccggcuccguucugugauccccucgugugggcuucaucugcugauggugcuggugcccggaggggucuccuggugcacagaaaucugugcuuaguggcaguuccaggggugcugcgguacuuccugggcugauacaggcuuugugggagugggaagcuccugggcggaggcugcaaagcugcagcagggccccgagagcugggucucccccugaggggcaggggauucaguuaaaugaagcucugggcggccccugccacgacaucucagaugccggacuuggagcugcgcagugggccuccugccuggcugcugggauggggcgguggccguggggcgaggccuggggcccuucugggguugagcagggagcagcugccggcugggcaaguuuuccugggucacccacccuccacugugggucaccuccucugaccugggcuugugucuuucucuccaguuuuccuggaucacccgcccugcaccgugggucaccuccucugaccugggcuuguaucuuucccuccaguuuucuggggucacccgcccuccaccgugggucaccuccucugaccugggcuugucucuuucuccccaggagcugcugcucuuccuccagaaccugcccacagcccacugggaugaugaggacaucagccuguugcuggccgaggccuaccgccucaaguuugcuuuugccgacgcccccaaucacuacaagaaaugagcccaggcccacccgcagcuggccucacugucccggguggcgcgccccaccugccuggcuggugguaggccccugugagcuggucccgggcugcuaaaaggccuugugagguggccccacccuccaggggagcuggugaagaugggccacagaccuggucuagggcugacaaagacagggacagccuuuguuuucugagauaccaaagagagccaggggagggccccggguucggcggccagaggcaggucagggguccccucucccucucccugcaauguccuugccaaaugacugccucgugcugccccuaguccggggcagccuaggaggccgacccucuuuggaguccugcugucugggugccagggccggaacgagguaguggccaucucauaccuacucugaaaugcaaaacuucuauucuguugagugaaagaauaaaauguagacaaaaucuagaccgagacguugcgcugacccggggucucugugccgcgagguccccucacagcuguauuucacugcugcuggcccuuucccuccguguguuuuccugcuugcuugguuuaaacguggcugggaagcugaaggcuggaguccaagccgugagcccgccgagugccugggaggccgugggaccaaaggcugggagcagagggaggccucgccaucgccuuacuuuccaccuugaaccucuuuuacaagagagaaacccccaccucccugagguccagggccaaguggccccgccacgcagguaggcgccggccucagccagagccccuggaggcccacccaggcugucgggccauguugggcuggcagacgggcagggggucgcgucccugucaucaaagcccugaaccacagugcucuucucaccgcagccuggaagcggaaugagcuuuuggagacuuccugggacuugcuguccuuguccaggucugccagguguaggggaggugugacugguuccaucauggaccgguuccuccauggaccgguuccuccguggaccgguuccgccauggaccgguuccgccauggaccacuccugcccuggaccacuccugcccuggaccgguucugccguggacugguucccgccguggaccaguucccgcuguauacugguucugcccuggacugguucccgcuguggacugguuccuuggggcucuaagugcggaagggcccagagcuggucccugcccagcgcccugcuagggcuguguccuuggcuccaggggccuugggacuggcuucccagcguucccucggugugucacaggcugcaugaccccuggaaugcgggcagggccacagccacagucugucugaucccugagcccaggacaggcucacguccucagcgacccacuggugacugacuucccagacucuccucugucccucaggagcagccguguccucucccaggcccuaggacacugccagagacugugggacauacaggcauaagugauguguguguuucugcuucuguuuuaaaaauccagggucauuacacacagcauggaaauuagcacaaaaugcugugcaaacgucagaugcucccaaaccagcaaagggaugggcuugcuucacaucagaugcgggcacgccuuaccccugccuuccguguccccaccccagggucaaggguuccucagaccagccaugccuccuccuccugccgccuccuuuucuagauggggaggggauuccgucacaagaagagccgccccucggccgugugcaggaagccccaugucgcuuugccgagaucagcccugggaggauccccuucuccagcucagaucaugccguguggccagaaggcugcggacacaacugaccugcuucucgaggugguugauguuuuaaacaggaagcuccacggaguucagcccugugugcauuuccucauguauguaaacgccaagacugaaugugagagguguuggccgcgggccuuaagucugagcagauccaucuggaauguucggggugugcugucuggauguggugcgcuaaaaacacggaauaaagaucagugacaaagccgcg

SEQ ID NO: 192571 - RNA, 36230 nt, Homo sapiens
guccggcggcgucgcgggcggcgggcggcggggccgcgggaggggcgcgggggcagacaaagccgcgguaaugaauggagcguccgcccgcgccgccgucguccgcagccggccgggagccgccccagaggccgggccgaggugagugcgcgggcgccgccgccccgccgccugccgcgagccccgucccccgcggaccgcgccggggccgggccgggccgcgccauugucugcgccgcgccggggccagggccggggccaggcgggcgggggcgcgguuccguggccucgggguccccgcccggcgccgccccggacccgcccccgcgcggaccccggcccugacagcuggcgcgggggcggcgccgacugagcggccgagugccgggggucggcgcccggccuggcccacgugcccgcgccguugcuuccgggcggacgggacggggcucgggcucggggcgccgcccggguccgccgggagcgcgcugucccggccacgucgaguuaaccccgcgagccccgucccugggacuucucuggacgugucauucccgucccaccuccaggaagggccaccugggcccugcuucaugucucagcccagacggguccuugcgacgcgccccgaggcagguuauuguacgugguucuggggaugaccguucacauuuaaugaauaaaaauguaacuugccuugcgaaccauaauuucaaauguuuuucgacugcagugguuuuccuacacccaaaugagcucgcagucaguuuuguuucuucuuuugucccguuguguggcccacaccgccuucguugcuaagagaaucgcagccccucgggcucccuucugcgccuuucuauuccggguggcccugguagacccgggcaccucuguggaaacacgucccggccaagcugagccgucagaagcuucuguugguguucucguguuggucgaaagggaaguuauuuauuuugaaguuaacucugaucagauuacguuuuuagaaauccauucagaccucauagugaggccaguuugguaaagcaagggcauccugcgacuuuuuacacagaaauguuuuuuauuuuuucuguguaugucauucauagugacaaaauugaggcuaggaaggauuugguugggauuuuuuuuuaagugcuaugaauaagccacauuuugauuaugaauuaauugcaauuacuaaacaaaguuacuuugcaagaggaaaguuuacaggaguuugauuccauacuccgaggguuuccaaugggacguccguacaaggcugcacacuucccguaguccuuaaacggauuauaucugcuugucaugauuggcuuuuuuucaagaaaagaucuagcacaaguuaagagagauucugugaaucuugaaaaagcuucagaggcccggucuuugaggugaggacacaguuaaucuauauggaaagaaaccuaagacuuuuaguccacuugacaggugguuacagggucucccccaacacacacucuuguccagguaauuccugaauaaggugguugauguuguuggauguaaaaccucugcucuuuaagguuaccuccuccccaacccccuccacacacacagugaguaacucagcugugcaaaguauguccauaacaccuugcagaaagacuaaaaaaauuacuaggggagcggacugacuucugugugugugcagaggagcugagaagcagcuucuuuagcgaaaggugugugugugugugugucucagauccuuggugaggagcccuggggaguggacuccuggcggcaugaggagcaggaagugaccguggucagugccguccuucacuuuguuuugcguuuuuuucuuugccuggcuuuagcuucuggucucauucucuuugguguggugguugucuuuugagaggagggagcaggugaaacagcugggcguggcuuugcccagcccugggguagaggccaagcuggcccuuccuuaccaacguuguuuccuucacuguuuaaaucucaggaccugagaauguaccuauaggaauugcucuuauuuacauuuggcuguguaagaaagucacugugccuuuagcccgugacaccccuuagcgguuugguuuuggcuuucucuuuuagugucuguggauuccagcagcucucuggcuucagcccuuucaaggauucgggccucucugcaucccagccuuccaggcccuucugcuccccacuuuuuagcaccuagguuuuucuacauucugcaguaccucagaucccuuccuuggucaucacuggauaugugcuuuuguaguucaaauucugggaggcauuguuaggaauaaaauaagcucuuugccauuucugaggcggaggggagcaggagagacagaggugcuugccucucugccugcuggggccauggugguuuucaaagaaggcccuggccguagggaacauggugguggugaggagcagcguaaaccagagaaaaaggcucaguaagugcuucaaggagaaacaccggcaggugagagcagggguaaucccaguuucucaggaaagcaugcuccggagaccucauagggagaggagguugcccugaagggucugggggcgauggcggaagccccaggagagcauuguccaugaggugcagaggcagccucacggcaucccagugcguaccuccugcccggcccaagcgccugcugcugaagccgccucccagcucccccggguuguuucggaauucaggggacaugcagccuaaaugacccacacuggaaucccggccggcuucccaucccucguucuaggugaaggccgcgcuggaaucccggccggcuucccaucccucguucuaggugaaggccgcgcuggaaucccggccggcuucccaccucucguucuaggugaaggccgcgcuggaaucccggccggcuucccaccccucguucuaggugaaggccgcgcuggaaucccggccggcuucccaccccucguucuaggugaaggccgcgcugcaaugccagccagcuucccaccucauucuaggugaaggcuuuucagcagccauggcccaugucuuucccagcaaacucugugugcaauagaaacagcugaugcuggccuggcccuggggaugggguugugacugcugcagcccccuaccugauuagggucgggaggaccuggccccccgcccuuccugccuugccaccuccacagacaaacccugaggggcugacuuccuccaaagcugcuccucaucgaggcccaccugguggucucugcuccaccuguuugcugcagggagcagggucgggagcaugugcauuucggagagcucugguugcuccgucauagaagccaugcuccacauccuguaagugagagacuccccagcagcguucagccauagcugcgaugucaggccugucacuagugggacugcccggacccccaagguauggguacacggcgagggugcugguguuaaauacaggggacccacaaaaccaccuagcagaacaauccacaugacccugucgugugacccagaacauuucagggauggaacacggaccagcugaccuuagcguggucgcuggcuugcucuggaaggugccguuuccaagacgcccuuaccuggguuccugagcacgucugacagagcagcucugacuccggguuucuggagucagaccccuugccacugucuuugaccuuuagcuuuggguuccccuucucaguuuguuuguuuguuuguuuauucucacucugucacucaggcuggagugcaguguuacaaucucggcucacugcaaccucugucuccuggauucaagugauucugcugccuuagcucccugaguagcuggaauuacaggcacccgccaccgcacucagcuaauuuuuguuuguuuuuugagauggaaucuugcucugucacccaggcuggagugcaauggcacaaucucagcucccugcaaccucuaccucccagguuaaagcgauucuccuuccucagucuccugaguagcugggauuacaauaggcgugcgccaccgugcccgguuaauuuuuuuuugcauuuuuaguagagacgggguuucaccauguuggccaggguggucucgaucuccugaucucgugauccguccaccuuggccucccaaagugccaggacaggacuacaggcgugagccaccgcgcccagccaguuuuuguauuuuuaguagagaugggcugucaccauguuggccaggcuggucucaaacuccugaccuuaggugauccacccgccuuugccucccaaagggcugggauuacaggcgugagccaccgugcccggcccccuucucaguuuagcccagaccuggauguuggcuucugugugggcagcuguugugagccauggcuccugcuggaauuuguggcaguugaugcugcugugcacccccagaauaggugaaggcuacucagguguagccccgaugguaguuuauguccucaggaggagaaacugccauguccccgucugaaccaggcccggagucuugaugcauagcucuuugccucccuggguauacucgacagcuuguugagagugcgugugcucugaguugaacacgaauauauuucuguuguuugaagguuauuauaaaguuucuaacuuacagaguuggcacuccuacgucccuugcccccagcuggagcuaccgugacugccaccagcugccaccuggcacgugcugaacugucuugaaggaaacugcagauaucuggacacuucucuaaguguucuuucuccuaagaaagggaaagggacauucuacugucuaaugacagucgcgucaucgauggcgucuacaaaacgugacugugucccuuggcgucauccaguagccaguccacggucugaaguugucccccaacgucuuuacuagcuguuuuucccaaccagaaucgaguacagggccacgugucacaguggcugugaggucucuuugcguuccggugcccccggagcacccccugugaucuggcggugggaggccugauuugauacaggggcacguuuggggcgcaggugaugcugugugcugcacugugggcggaggcugucccaugaggacggaugcgacuuugcucacuggcccuuuaaauugugucccugccccccacaguuggcgaguuagaugagggggugucucgggguguguggacgcucugcucccaucagaccuccacaugcuguuugcuggucuccccagaaccugugggcaguggcaccuuggcuuuaguaugcuguuguucuuuuuuucuuuauuuuugucuguguuucccuucuuuguuacgucuuagaaaaugcugaguucuuucucuuuauuaccaauucuuagcggaagauggucuaguagacaccucugugggggcaaauuuuuacuuuuccuuugucuuccuugaguaucaagguggacuaguggauuuuauuuauuccaugucauaaucuaguaaagccuuuuguuuugugaugcucaaauagcuauaaaugugacuaguugggagccccuuccaagcuggccccuguguccuuuucacuccauacgugguccugggaaugcauccuuucuggcccagugucccaggcucacggugaugucuuucccaggccugcgucagcugcuucuccacagcgccuggguuccuuuuagugcagaaaggcaucuggacaccgagguccaggccauagacguagucauugugcuugucuguuauugcuuaaugcccuguucgcggacacagcuagaaaauauguauuuaaaacauugugaguucagucaauuugaauuauaguuaaaauuaauuuuaauuuucauuaaaauuauguaguuuugcggggugugguggcucacaccuguaaucucagcacuuugggaggcugagguggggagaccacuugagcucaggaguuccagaccagucuaggcagcguggcagaaccccaucuuuacaaaaacauacagaaaucagcugggcaugaugguaugugccuggaguuccagcuacucaggaggcugagaugggaggaucacuugagcucaggaguuccagaccagucuaggcagcauggcagaaccccaucuuuacaaaaacauacagaaaucagccgggcaugaugguaugcgccuggaguuccagcuacucaggaggcugaggugggaggaucacuugagcucaggaguuccagaccagucuaggcagcauggcagaaccccaucuuuacaaaaacauacagaaaucagccgggcaugaugguaugugccuggaguuccagcuacucaggaggcugaggugggaggaucacuugagccugggagguugaggcugugguaagcugcaaugacgucacugcacugcugccugggcgacagagugagacccuguaucaaaaacaaaacaaaacaaaacaaaaaauacauauauauaguuuuacuuaauuucuuugauucuuaaauuauauguuauucugaaaaaucuuaauaauaucauuggccuuguuuugugcuaaaaugugcauacaguagguuguagaauuacaauaccacuccuguaagaaaacugcuuaguuaacuuugcagguuuuuguugaguucuuuuuguccuuaguuaucuuccacuuuggaugaauaaagugcuguauuuuaaaguuccuugacaaauacucuuguuuuauuuuuuauuuuauuuauuuuucccaagaaagaaauaagacaaauauuauuuucucugguuauguugcccauuuguuucagaucauuuuuagauuuaggauuuuuuacaaauuuuauguacaaaauaauuaccuguuauaaaggucagaacuacauaaaagcuaccuuucuuauccccaccacucuucuaagcaaccuuuuuuuuuuuuuuuuugagacagagucuugcucuguugcccaggcuggagugcaguggcucgaucuuggcucacugcauccucggccuuccggguucaagcaauucuccugccucagccucccgaguagcugggacuacaggcgcccaccaccacgcccagcuaauuuuuuguacuuuaguagagaugggguuucacuauguugcccaggcuggucucgaucugagcucaggcauuccacccaccucggccucccaaagugcugggauaaugggcaugagccaccaugcccggccuaggcaacgcuuuuuacuucugcuacguccuguaaaaguaagcaaaacacacccacaacucauuuccccuccugucuuucacaaaaguuagcaugggcuguugacacugugugugucugguuuuucuuguuuguuuguuaugagauggagucucgcucuggauucaagugauucuugugccucagccuccugaguagcugggacuacaggcacccgccaccacgcccagcuaauuuuuauauuuuuaguagagaugggguuucacuguguuggccaggcuggccucaaacucuuggcugcaaaugaucugccugccucagucucucaaaguggugggauuacagaugugagccaccacaccugaccuguuuguuuugagauagcgucuggcucuguugcccaggcuggagugcaguggccugaucuuggcuuaccgcagccucgaccucacgggcucaagugauuuucucacuguacccuccugaguagcugggacuacaggcgcaugccaccaugccagcugauuuuuuucaaauuuuuuguagagaugggagucucacuauguuacccaggcuggucuugaacucuugggcucaaacgauuuaccugccuuggccucccaaagugcugggauuacaggcgugagcugccguggcuggccccugcgugucugguuuuucugcucagcacauguaugaauguguggguccuauugacgggcucugauccuuugccgugggaugccgcugugacugacguugccguguguugcauuuuuuguguuucuggugaggacugucuucaggucuguucguagcgugugguugcugggugggaggauacauguaauuuuggugagugcuuccaaguucccccgcacaggccugcacccugucagcacugugggagagggccugaccaacagagggcauuacuaagcauuuggauuuuugccaggaugguagggugagaagggguaucuugaacggguuuucauuuaauuugcuucaaucugaaugugaaaaaugaaaaaacugugcuuuacugaauuggauguagcacggagcaguugagaucauugaaugcaaguggcucauuuuguuaguaaguccccgagggcgguuggcccugugcguggaaccuauacggagcggccccaacgcuucugccgcaaagucgcuuggaaggugguuucucugucuuucuuauuuuuugugcggcggaggccuuacuuuuuugcugagacuggaauugaucuccugugcucaagucucucaccguggccugcaaguagcugggacuacgggcguaagccacugcgcccagccuaguguagcuuuauaaguguguuuuuaaaccuuuuuuauuuuaaaguguggcacagauacagaaacugaauaaaaucagugucuagcguaaugagucauaugauaagauggacacaguuguaacuggugcuugggucaagaggugcuugccagcuuccagagccccugugcgugccgccccagccccucccagcagaggcugccucaaucuuacuguuacagcagcuacuuccuuauucuuuguuguuuugacugaacugaguaccucuaaauauuaguuaaguuuuuccuuuuuuuuuuuuuuuuuuuuuuuuuuagacuuaagucuugcucugucgcccaggcuggagugcagugucgugaucucggcucacugcaaccucugccucuuggguucaagcaauucuccugccucaguuuccugaguaacugggauuacaggugcccaccaccacgccuggcuaauuuuuguaguuuuaguagagacaggguuucacccuguuagucaggcuggucucgaacuccugaccuuaggugauccaccugccucagccucccaaaaugcugggauuacaggugugagccaccgcacccggccagccuuucagucugaaucuacagguuacauuauccaccccaccucccguggaaguauuuucugagguaacuuggugguuggacucgugcaucucacggucuagauuuugcuggcugcauucuucuggagaggcccaguguguuccucuauccuuugguuucuuguagauuguguuugguugguugguugguugguugguuuugaggcagggucuugcuuuguggcccaggauggagugcaguggugcucccgggcucaagugauuuucccaccucagccucccuaauaacugggaccacaggcacgcaucaccacacccagcuaaguuuuaaaaauuuuuuuguaggccgggugugguggcucacgccuguaaucccagcacuuugggaggccgaggcaggcggaucacgaggucaagagauugauaccauccuggccaacauggugaaaccacgucucuacuaaaaauacaaaaauuagcugggcgugguggcgagugccuguaaucccagcugcucaggaggcugaggcaggagaauugcuugaaccggggaggcggagguugcggugagcugagaucgcgccaccgcacuccagccuggggacagagcgagacuccgucucaaaaaaaaaaaaaaaaagugugauguucuggcugaguuauugcuucuuuauguaguagaugaacuauuaaagauaaaccucuucuuauccacucucugguguuauaguucauggagaaaacugaagauaaaugccugauucuuuuuuuaaauucaucaguuuucacaaugaugaaucauuuuccuaucagccuccagaggcgaccaguuagggauuugauguugguauuggugaacuaaugaauuuaaacauauuugggauguuaaauucuguccucuuuggacagugagagccccuacaagcuggcuccuggauccuuuugacaucauuccugaacucucucagagguuucuggcugucugauauguucugugcucaucuuguauuuuuccggcuccagaccugaaauaagccauuucuucagcucugguuucuuuuaagggcuuggaaguuucaaaaccacagucugcaugugacaggugcucacugcuguuggguuggccgcugguucuaggccucugcuggagugugugaucugcuuucugacggcagggcguucacaugggugugcuuuaaucuuacgucuccguccucuuuuuccacugagagugcuggucucaaggacaguggagaugagagaauuggaauaucgcauaaugucucaucuguuuuaucucuugcuacaaacaucacaaucucaaaauaacaauggcaguacaacugccaccuauaucauuacugaaaacagugaagauauuuuuugccuaagucuucccauucuguguaguuaugcagggucucaacuacagaguguguagccauuacguacuacagaugcuucgcaacucaggacacggccacguccgauaaacccaucaaagucgaaaaugcacuuaauaccugauuggagccugggcaugguggcuuacgccuauaaucccagcacuuugggagguugaggugggaggaucacuugagccugggaguuugagaccagccucagcaaccuagugagacccccucucuacaaaaaauguuuuaaaauauuagccagguguggugacacucagguguaguuccagcuacucaggaggcugaggcgggaggauugcuugggcccaggaguuugaggcuacagugagcugagauuguguacugcacuccagccugagcgccagagugagacccugucuccaaaaaaaaaaaaaaaaaaagcccugauuaaaccgucguagagcugaaagauugcgagucaaaccaucgaugaaguucagaugcuccuugauugaccaugggguucuaucccagcaagcccccccccccccccgugaagucagaaaccacggaguccagcuauugugcuguguuucuccccugcaaacccuuauucaguccuagcucugcaagugacggcagccccgggucucacuaagggcagggguguguucugagaaaugcguuacucagcgauguugucguugugugaaccucauagagugcaccuacacaaacccagaugguauaaccugucacuccgaggcugcaacucugcacagcaguuacuacacugaagccuguaggcauuuguaacaccguggcaaguauuuguguguccaaacagaaaaggcacaguaaacagauggugucguuaucuuauguagccacuguggggugcgcugcucuuugccgagugagguguugcugugcagcacgugacuguguguguuaaaugcuuacacgggggccgggcgcaguggcucacgccucuaaucccagcacuucgggggcuaaggcgggcggaacuccugaguucaggaguucgagacccgccuggccaacauggugaaaccccgucucuauuaaaauacaaaaaaaaaaaaauaauaacccgucucuauuaaaauacaggugugguggcaggcaccuguaaucccagcuacucaggaggcugaggcaggagaauggcuuaaacccgggaggcagagggugcagugagcagagaucacaccacugcacuccagucugggcgacagaguggacaaaaauaaaaauaaaugcucacauuggguccucauguuucuguuguguuuugguugagguuugcucuccgguagaucucucaggaaggacucauggaacaagaugucuugacuuccugcaucuugauaguaguuuuucugcauucauugugcucgaaggucaguuuggcuuaguauaaaauccuugguucacauuuucuuuuuuuuuuuuuucccuuuaauuuuuuguagagcugggggucucacuauauugcccaggcuggucucaaacucccagcuucaagcagcccucccgccuccaccucccgaugcugauuauacgcgugggccacugugccuggcuaguucacuuuuuuccuugaaugucuuaacuauguuauucuauggucuucuaggauaaagcauugcugucaaaaucaugacaguuuuuucuuuccaagugacuuuguacuuugccugagagcccaaaggauuuaagucuaguaauuuuguuagaaaauaaauuaguguuauuaguugaggauggauuuucucagucccuuucacuauguggcuugacaauuucuaauucaggaaagguuuuuaaguguuuaguauucuguucucuugcccuguccccuccuguuucugggguggcuguucugauuguacauauguuggaucuucuuuacgugucuuuuaaauugguccguuucucuugagucuuuuuuaauccccucauuucuuuuucauuaaaaaaaauuguguuucccuuucauuuaucuuaagcugucaucuguggaguuuguucuccuguuucuucuuuuuuaggucuucauucuugaagucauauuuuacuuuuauuuuuaguguuuuugugggaccuauaaucucacaucagaauuuuucuauccugauuuauguuguuucuuuauaucauuuucuuaauuucuuuaguuucuuugcaagaggaaguuaccguuuucauuuaaucugaggucacauuuuucugugagcauauuucguuaucugcagugauguuuuucugcucuuuaguuuuucucauacccuucugugagaugugacagaauucuuuucuguugccuauuauauuaguuuucuagugcugcuuuaacaaauuaccacaaaccgaguggcuucacacaaacggaaauuaggaaucugaaaucugagaugggucucacugggcuaaaucaagaugcuggcggcucuugaacgguggcucucggcaaaugcacguucuuaccucuugcgccuucaggaggucaccugccuuccuuggcuugcauugguuugguuugcuguuuuuucuaguguuuucuuuuaggugaguacuuuauugacuggaggucaucuuuucuaacacagguauguagagcuuucaguuucuugcuaaccaccacuucagcugcaucucauccauuugguggguuguauuuuuauugucguucaguugaaaacacuuuccaguuuaccucacgguuuguuuuucacccgugaguuauuuagaauuguauuuuguuuucaaauaauugcuuauuucccagauuucuuucuuuugcuuuauaauuuaacuccauuguguuuagaggacuuguauaguuucaguccuuuugaaaugcccaacgcguauguuaugggccagcauguggucuauacugugggagguucccugggccccugaagaagcgugugccaggcggcggugggagcggcgguuggggaggcacugcggugcauccacugggucaguuggcugacgguauugcucaagucuucucuguucucgcugacuuucugucuaguucuggguggccugguaggcccagcagcuucucuucaugggaguuuuugccccagaaagaagugucagcuguuuuguuuugccccagaucggaccuuggacccugacccuccucugcuuugcagaugugcagaaagucacccaccucagcagcuugguucugugggccguccagugauaccuguuggcuacuuggggaugcucgguguaucacacgcuugaugacaucuuucuuuuccagcugccagaucuaauaccaucuaggccuuguaauacugacugcaagggggcuuccauccugauacacccauccaucaucaauuaaaaauaucuucaguggaaaaugcauuuaauucaccugaugugccgagcaucauagcuuaguccagccccccucaaaugugcucagacacuuacaugagcccacaguugggcagaaucaccugacacaaagccuguuuugucauaaaguguugaauaucucauguaagagugucacaccguauguuguuagccuaggaaaagaucaacauucagaauucaaaguacaguuuguacugaaugccaguggcuuucacaccaucguaaaguugcagguucguagguugaaccgucauuaaaucagggacccacuuacccauauucaugguuugucccuuccacuuacauuuguugguuaacggaaagaccuugucagucuucuuuuuuguuguuguugauaacaucagaggauugugguuuuacuguucuaguuuuccuuuuauugagagauuuggggaaacuaaaaaauaaaauauaggcaguguuacaagcaaacaaaugagcuuacuauauuucaaaugaauaaaauaacuacacuugaggaaggaagcuggcugaggcugguggaucacccaggaucaggaguucgacaccagccugggcaacauggugaaaccccaucuccacaaaaaaugcaaaaaauuaacugggugguggcacacaccugucaucccagcuacugaggaggcugaggugggaggauuacuugagcucaugaggcggagguugcagugagccaagauugugccacugcacucuagccugggcaacagagcgagacugucucuuccaacaaaaaagaaaaaugaaaacugacccaagaaacucuuggacacgaugugauuauaaaccuccaaguaaaaagauaaaaauuauaaaugaauugugaucuccagcuagaaggcuuguuuucuugguggccuggguuaguaauucugcagcuacuucgugcauguguuguaggguugagcaaaugaggaaaucugccaggagggugggagcccagccucccagagguggauugaaacgucacggaugcaggccgggcgcaauggcucacaccuguaaucccagcacuuugggaggccaaggcaggcggaucaccugagauugggaguuugagaccagccugaccaacauggagaaacucugucucuacuaaaaauacaaaaaaaaaaaaaaaaauuagcugggugugaugguguaugccuguaauccgagcugcuugugagacugaggcaggagaaucacuugaacccaggaggcggagguugggugagucgagaucaugccauugcacuucagccugggcaacaagagcaaaacugucucaaaaaaaaaaaaaaaagaaaaaucacgguuguggaaagggggaugcucggucuugugaucucagggucagggcagaguuggcggugucagugugaaguuguggcuuugauucacguacacacaugcauguugguguguguguuuauggguucuagugcuuccgcuggaagggccuaaaggcagaggcacccguaacagugagugcacggcugccuaccucguacccgcguggugguuauccaccucgggccuuuuuggcagcgcucguccuccagaccagauuauuucaucucugacuggagaacacucuugcguggacuuuagugugggucacuuagagacacguucuguguuugguuugucugaugguguuuuuuaguuccuguuuauuccucagggaauauuuguacugcuuacugaauucugguuuggcucucauuuuucacagcuuugaagaugucauuccucugucuccugauuuacauuguuucucuuaaaaagucagcaguguaucucauugguuuuuuucuuaaaauagcuuucauggaaauaaucugauauacguaaaaguggaaaggguagcauaauaaacccugugcacgcauccccagcuucagaauuaccaguucacagccauucccauuucaucuguguccuccacucacuuuuuaaaaaguuuuguuuuuaaaaagaauuucaacuuugauuuuagauucaucaggcacaugugcagguucacgacaugguauauugcgugaugcugaguuugggauaagaaugaucgucgcccagaucgugagcaugguacucaauagguuguuuuucagucuuguccccuccucccuuccucccucccucacuccucacucucgcagucccagugccugugguucucaucuuuaugucccuguguaccacaugcuuagcucccacugauaggugagaacaugugguauccgguuuucuguuccuguguuuguucacuuaggaugauggucuccagaugcaugcauguugcugcaagggacaugauuuuguucuuuuuuauggcuguauaauauuccaugguguggauauaccacauuuuccuuauccaguccaccauugcuaggcacguagguugauuccaugucuuugcuauuguaaauagugcugugaugaacauacauguguacaugggguuuuuuuguagaaugauuuauuucuuuggguacauaccugguaguggcaucacuggguccaaugguagcucuguuuuuaguucuuugagaagacuccacacugcucuccgcaguggcugaacucauugacaucccugccagcagugcuugaguuucccuuuucucuguagccucuccagcaucuguuauuuuuuucuuuuuuuaauaaaagccauugugacgggugugagaugguaucucguugugguuuugauuugcacuucucugaugacuguugaugucgagcauuuuuucacgucuguuggccacuuuuaugucuccuuucgagaaguaucuguucauguccuuugcuugcuuuuuaaugggguuauuuuauuucuuguuaagcuucuuauagauucuggauuucagaccuuugucagaugcauaguuugcagauauuuucucuuauucaguggguuuucuguuuauucugucgauggucuccuuuucugugauaguuucagcuaugcagaggcucuuuaguuaggucccaguugucaauuuuuguuucuguuacaauccacucaauuauuuugaagcaaauacccaaaaucauaauucacguagcuacauuucaguaaguauuuuuaaaagauagauuuuuuuuuuuuuuugagauggagucucacucuguuacccaggcuggagugcaguggugcaaucuuggcuaacugcaaccuccaucuccaggguucaagcaauucucaugccucagccucucaagcagcugggauuacaggugugcaccacaaugccuggcuaauauauuuuuuuuuaguagagaugggguuucacccuguuggccaggcuggucucaagccucccaaagugcuaggacuacaggcgugagucacugugccuggcuuagaauucucuuuuaaaaguuaauucaucagcacuuugggaggccaaggcagguggaucacgaggucaggaguucgagaccagccuggccaauguggugaaaccccgucacuacuaaaaauacaaaauuagcugggugugguggcacgcaccuguaaucucagcuacucaggaggcugaggcaggagaaagcuugaacuugggaggcgaagcuuacagugagccgauauugccacugcacuccagccugggcgacagagugagacucugucucaaaaauaaaaaaaaaguuacauuuucaguauaauguagucugguaagcgugcaauagcaugacgucuaaaacaauguaccuaccuugauuuuuaaaaagcuuguugcugaaaaugccaacagucaucugagccuucagcaacucauaaucucagcugggaggagauguugccuugguguccagggcugcugaccaaucagagugcagauugcugaccaaucagagugcagauugcugaagggugggguggcugugacaauuuauuuauuuauuuauuuuuuuuuuuuuuugagacagagucuuacucugucgcccaggguggagugcaguggugugaucucagcucacuacaaccuccaccuccuggguugaagcgauucuccugccucaguagcugggauuacaggugcacaccaacaugcccagcuaauuuuuguauuuuuaguagagacgagguuucaccauguuggccaggcuggucucgaacucuucaccucgugauccgccugccucggccuaccaaagugcugggauuacaggcgugagccacugcacccggcugacaauuucuuaaaauaagacaaugaaguuugcuacaucgauuaacucuucuaugaaagaguucuccauaguguacauuuuacccacaguagaacuucuuucaaaauuguagucaauccucucaaacccugcuguuguuuuaucaauuaugcuuauagaauauuccaaaaucuuuauugucauuuuaacaguguucauagcaucuccaccaggaguagauuccaucucaacaaacuaguuucuuugcucaucccuaagcagcagcuccucauucacucaaguuuuauccuaagaguacagcaauuccgccguaucuuuggguucuguguauaauucuaguuuuugcccuuuccaccaaaucugcagucacuuccuccauugaagucugagccccucagagucauccaugaggguuagaauuaacuuccuucaacccauucuccugguaauguugguauuuucccgucccaggaaucacacaugguuuuguuuuuguuguuuuuagagauauggucuugcucugucaccaaggcuaaagugcagugucacgaucacagcucacugcagucucaaccucuuggucucaagcgaaccucccgucucagccugccagguagcugggacugcagguguaugccaccaagccuggcuaauuuuuaaauuuuuuuuuuuuuuuccugagauggagacucacuccaucgcccaggcuggagugcagugacgugaucgcggcucacugcaaccucugccucccagguucaagcgaauucuccugccucagccucccgaguagcugggaccgcaggcaccugccggcuaauuuuuuuguauuuuuaguagagacagguuucaccauguuagccaggauggucucgaucuccugaccuugugauccacccgccucggccucccaaagugcuaggauuacaggcgugaacuaccgcgcccagccaauguuuuaauuuuuuguagagcugggguuuugccauguugcccaggcuggucacaaacuccugagcucaugcaguccaccugccuuggccucccaaggugcugggauuacagacaugagccacuacagccagggauuuccuucaagaacuuuccuuugcauucacgucuuggcuguugguacaagaguccuagcguuggccucucucagcuuuagacgugccuucaucacuaagcuuaaucauuucuaucuuuugaaaaugagagacgugauacuuccuuucacuugaacauguagaggauuaaucggccuaauucuaauuucucgugugucucagggaagagggaggcuggaggagagggagagagacggggaacugcugguugauggagcagucaggacacacauuuaucaguuaaguucacugucugacauggguguggcuugugguggcucacguuaauuacgaugguagcauuagagaguacugaucacagaucaccauaacagauaccaugauaauggaaaagugugaaauauugccagaauuaccaaaaugugacacacagguggagagccccugcuguuagaaaauggcaccgauggacgugcuugaugcaggauugccacaaaccuccaauuugggggaaaaaaaaguaucugcaaagagcaguaaagcgaggugcggugauaugaggugauaugagguauugggucuucccaccucaucacccccacccugcagccccaagaaaggcucagagagagucaagaccaaccuagaaugagaugucuguuuugaagagagaacagcuggguucuucucgacccacagggaugcacggcccaccuuguagguuggagcgaggagcguggaggacaagaucauccuggaaugagaacauaagggcuggggaauggggcggcgcugccaccagggaggagagaugccugaaauuaggacauucccggggagcuggcccgugccgagaacaagaaugagcuugaguccugugaccucucugaacucucuuacucuuuagcucuaguacuguuuuguagaggccuuacaaccuuuaugacaucgauggcccugucgucugcccaucaaggcaguucugauuuucucugacagccgccuccugccugggcagacucccauccagugcuguauagaauaugccgaggggaagcacucacucuuucacugaugaguaugaugggagcugcacuguuucccggaugcgucucauaaggcugaagauguuuccuuccauuccugguuugugcagaguuuuugcugugaauagagguagaaguguuggcaaauguuuuucuacaucgaaugacgugcccauaugguuuuccuccuuuugcuaauguauuguuuuaauuuuuuuuuuuuuuuuagauggagucuugcucuaucucccaggcuggagugcaguggugcgaucucggcucacugcaacuucugccucccagguucaagcgauucuccugccucagcgucccaaguagcugggauuacaggggcccaccaccauuuuuguauuuuuaguagacaugggauuucaccaguuuggccaggaugcucuugaucuccugaccucgugauccagcugccuuggccucccgaagugcugggauuacaggcgugaaccaccaugcccagccuuuuuuuuuuuuuuuuuuuuuuuuuugagacggagucucacucugucgccaggcuggagggcaauggcucgaucucagcucacugcaccucgaccucccguccagguucaagcgauucuccugccucagccuccugaguagcugggaaaacaggugcgugccaccaugcccggcucauuuuuguauuuuuaauagagacgggguuucaccauguuggccaggcuggucuugaaugccugaccucaggugaucugcccaccuuggccucccaaaguguugggauuacaggugugagccacugcacccggccuguuuuaauuuuuugacuauuaaaccaaccuuuuauuccugugaugaaucaugacguauuaucuuugauacauaguguuuaauuuaauuuguuacaguuuuguuaaggauuuuuuuucugugcucauaggguaucaaguuguuucuuuuauuguaaugucuuugcugguuuugguaucaggguaaugcugcugauauaaagaauugggagguguuucuuccuuuauuuucuggaagaauuuguauuuuuuuuuucuuuaauguuugguagaauucaccacugaagucaucugggccugggaguuucucugugggaagguuuuucaacuauaaguucaauuuguaaauaaaaggcuaaucagcuuauucuugaguuuuuguaguuucugucuuucaaguaauuuguccauuucaucugaguugcauaauuuauuuucuuuuuuuuuuucuuuuuuuugagacggagucuugcucugucacccaggcuggaguacaguggcgccaucuuggcucacugcagccuccaccucccggguuccagggauucuccugccucagccucucagguagcugggguuacaggugcgcaccaccacgcccggcuaauuuuuguauuuuuaguagauacaggguuucaccauguuggccaggcuggucucgaucuacugaccucaagugaccuaccugucuuggccucccaaagagcugggauuacaggcgugagucaccccgcccagcuuguccauuucaucugaguugcagaacuuauuuuuauaaaauuuuuuauauguuuccuuacuauccuuuuauauauguaggaucuguagugauacucccucucucauuccugguagugguaaauucugucuucuccauuuuuuucucuaaucaauauuuguagaagcuuaucaauuuuauugcucuuucccaagaaccagaguuugguuucauugauuuuuuuucuuuuuuuuuuauuucauugauuucacaucuuuauuguuuuuuucuugcugcuuacuuugggauuaaauuugcuuuacuuuuguguguuuuuucuuugauacugcguguaauauaaaaguguuauuuauuugaaaauaguuuggauuuuuucagauauuauuguauugcugaaguuuuauucaguuccuuugucagaaaccauucuuugauuuugguucuuuuaaauguauugagguuugcuuuauuguccagagaagagucugucuuggugaagguuuuguguacacuuguaaauaauguguauuccguuguuguuggacugcucaauaaaugcccauuaggucaacuuggauaauaguguuguuugaaucuuccgugucuuuacugauuuuuauguaccuguugguuacuuauugaauaguucuguggaaaucuccauccgugauggugacuuaccuugucucccuuuaguucucucagcuuugcuucgugguuuugaaggucucuuugcagguauaugcaccuuugggagaaugcgcucuggaugaauugacccccuuauaauuuugugauguuguuuguuauauuuaguauguuauucuuaaaucuuuacccgguauuaaugucgccacuccagcuuucucucgguuuguauuaacaugguauaccuuuuuucauccauuuguuuuuagcccuuuuccuguuugcccugagaauacucaccggcagugcuugcagcugcagcguuuaccccgagauaaguuugccaugaaaucucucguuuucaugaugacuucugcauugcucgaguauaucgacuuuggaaacaaaagaccucguucuauuuauggcauucuguuuuuaguagugguauuuccauuuacaaaauauaggaauucucaguugcugaaaacgucagaucccagaagacacagcguucccacacgugguguuaacaucguucccaguugcuggccaaagauuccuuugaugaauccgauuuuuccaaaauagaugauucugaugauucagaugacucugauguuaguucuguuuagaaauaauuccaagaacaguuuuuauguuuuauuuucacauugaaaaucagucagauuuaccucagccucaaagaguguguuuauguaaaaguaaaugaacgcuggcagugagcugcaauuuuuuuuccuaaacgagaaaaagauuaagcuauuugugucuuuauguuuaaagcguguuucuuguaggcagcauauaggaagucuugcuuuuuuauucauucugacaaucccugucugucucaaaaaaacagcuuuauuauuuauuuauuuauuuauuuauuuauuuauuuauuuauuuauuuauuuugagauggaguuuugcucugucgcccaggcuggagugcaguggugcgaucucagcucacugcaaccuccgccucccaggcucaaaugauucuccugccucagccucccaaguagcuauuauuacagauauguaccaccacaccuggcuaauuuuuguauuuuuaguagagacgggguuucaccauguuggccaggcuggucuugaacuccugaccucgugugaucccucccaccuuggccucccaaagugcugggauuacaggugugagccaccacgccuggccuaaaaaacagcuuuauuuggguauaauugauauacaauaaacacauauuuacagugcauaaucugauaaauauauauccauauccauauaguaugccuaaacagcugcugugaacauuugcauaugaaucuucauauggacaugcuuguguauccauaaacccauccugcagguggcauggacacacacaucccuccugacugugucuucugccccucguggccccuccucccgccagcacagaccugcccuuuggccucccgcacucugcaggauuguuucgagauucauccguguugcguguauccauucauucuuuuguuauugcugcauaaugauccauuguagggcuguaucacaauuugucuucuaguuuuuagauacuacauauaaagcugcugugaauuuuauauguaagucuucauacagaggccaggcgugguggcucaugccuguaaucccagcacuuugggaggccgagaugggcggaucaccugaggucaggaauucaagacaauccuggccaacguggugaaacaccgucucuacuaaaaauacaaaaauuagccagacguggugacaggcaccuguaauuccagcuacucaggaggcugaggcaggagaaucguuugaacccgggaggcggagguuacagugagccaacgcaccacugcacuccaaccugggugacagagugagacacugucucaaaaaaaaaaaaaaaaaagucuucauacagagauaggcuuucauuucucaagaguaauaauaacugggaguggaacagcuggguuacguggucaguauaaacaccgaagaagagauugguggagcgauagagaauccagaaauagauccacacauaugcgagcaaccaauucucaacaaaguuacaugggcacuucauggagaaaggauuguccuuucaacagauuguguuggaacaguuagacauccaugugcaaaaaaaugaacuucaauccuucagagaucuaaauauaaaacuuaaaacuucuaaaagacaacacagaagaaagucuuugaauuaggcaaagauuucuuugguacaagcccaaaagcacaauccauaaagaacacaugagugaaguggacuucaucaaaaguaaaaacuuaugcucuucaaaauacacuaguaaaagaauuagaagacgagguggguggaucaccugaggucaggaguuugagaccagccuggcaaacaugcugaaaccuugucucuacuaaaaauaaaaaaaaugagccgggagugggccaggcgugguggcucaugcauguaaccccaacacuuugggaggccgaggcgggcagaucacgaggucaagagauagagaccaucguggccaacauggugaaaccccgucucuacuaaaaauacaaaaaaauuagccgggugugguggcgcgugccuguagucccaguuacucaggaggcugaggcaggagaaucacuugaacuggggagguggagguugcagugagccgagaucgcgccacugcacucuacccuggccacagagugggacuccaucucaaaaaaaaaacaaaaaacaaaaaaaaacaggagugaaguggcgcaaucucggcucacuguaacuugcgccucccggguucaagcgauucuccugccucagccucccgaguagcugggauuacaggcacgcgccaccacgccgcgcuaauuuuuuuguauuuuuaguagagaccagguuucgccauauuggccaagcuggucucaaccuccugagcucgguugauccgucugccucauccucccgaagugcugcgauuacaggugugagccaccaaacccagccuaauuuuuguauuuuuuugcagagacgauguuuugccauguugcccaggcacacaccacuauauccgcucuuacaauagcuguuuucauguccuuguccacuaauuuuauuauuugucuuauguccgggccuguuuuuauugguugguuuuucuccuggucagugucugggcguguuucuauugguugguuuuucuccuggucagugucugggcguguuucuauugguugguuuuucuccuggucagugucugggcguguuucuauugguugguuuuucuccuggucagugucugggccuguuucuauugguugguuuuucuccuggucagugucugggcguguuucuauugguugguuuuucuccuggucagugucugggcguguuucuauugguugguuuuucuccuggucagugucugggccuguuucuauugguugguuuuucuccuggucagugucugggccuguuucuauugguugguuuuucuccuggucagugucugggccuguuucuauugguugguuuuucuccuggucagaggugguuuucucccgcuucaucgcaggucugguuguuuuugucagccauuuuguauuuuacuuuauugggugcaggauuuuguuauauuccuuuaaaugcuguugagacuuguuuuagguuguaguaaaguuaaucauagaccguuuccuccucuugaggcuggcguuuaagcuguguucggguggcuccuaacacggcuuaaaagagcggccguuguugugaagcccacuguucaguccggacccuucugacccugcuugcuguucacucuuggugguggaaacacaagcuguucccagccuccagggagcccuggcaguucuuuuccccuuugguucucugagggugguuuccucaaaugcagaugcagaucaguauucagccaaagacacgaggaaccuccgcaggucugcguagcucccuccucucccgcgcucgggacaugcucgagaccaccgggcucugccaaguuccgacuccccgccccgcagccuggaagccuggaagccccgccgugagcgagggcagguggggcucccucuuuagcuuucacacuucugugaucacuguccugugcuuucucuucucucucagcgucugaaaacgucguuucgugcacggcgucuggcuuaugaguugucugaggucaaccugguuuccuuuguuuuguucaucauggcuagaaguggaagugacugugaguccagcuuuguucuuucuuuccaaaauaauuuuauuuauuccugauucuuuguauucccauaucaauuuuagacuucuguuuaucagcuacugcaaaaagcguuuuggaauuuugacugggaucauauugaauuuauaggucaauuugggaaaauacugaugucaacauugaguuuucuaauccaugaacuugguauauuucuccauuuguuuaaaagccuuuaauuucagcaguguuuugcagcuuucaguauacaggucuucuuuuuaagaccuguauacuuguguaccuguauacuaaaacaagcauauuuuaaaaauuuuaucuuauuucaugcuuucaugcaugcuuuuggacauuauauguggaauuuaaaaauguuucauuuucuggccaggcgcaguggcucaggccuguaaacccagcacuucgggaggcugaggcagguggaucacgugaggucaggaguucaagaccagccuggccaacauggcgaaaccccgucucuacuaaaaauacaaaaggaauuagccgggugucauggcacacgccuguaaucccagcuacuugggaggcugaggcaggagaagcacuugaacccaggaagcggagguugcggugaacugagaucgugccgcugcacacugcagccugggcgacagagugauccgucucaaaaaaauuuguuuuucauuuucuaauucaucuguagaaauacaguugcuguuuuuuugagauaggaucucacuguuggccaggcuggagugcaguggcacaaugauagcucaccacagccucaaacuuuuggguucaaaucaucaugucuccucagccuuccaagcagcugagauacaggcacgcaccaccgcaccuggcuaauuuuguuuguaaagacagaguuucacuauuauucaggcuagucuucaaacuccugcccucaagugaucgucccaucucagccuccugaguuccugaguagcuugggacuacaggcucaccauacuuggcauuuuuuguuuguuuguuuuguuuuuuguuuuguagagaacagggucuuguuuuuuugcccaggcugaucucaaacuugugguuucaagcgauccucccaccucagccucccaaguacuaggguuacaggcaugagccacugugccuggccuguguuaauuuuuuauuuuucuuuuuuaucuggcuguacuuuguagaacuuauugggaaugcuuuucagaaagaaccugcauuuauuucuggugggagcuagcaguuuuuauuaaccuuggaacacuuuuuagggcaaccauacaucuugcuuugcuacagauagguuuggcuuaagccuguuuccccagcaguauuauuaauagcucccuuucacucucagaaaugcccugguuuagaaaauacaugauguggugacuucaguucuugguuccugcaugguggaggaaugucggguucagcuccucccugugggggugacccaugcugaccaggcuagggauggcgcaccucuccugcccauuugccacucccugugucccuugaagaguucucccacuuucuggcaugcccaguaauacuuuaaaaaguaaguuuguggugggcgcauuggcucgcgcauauaacuccagcacuuugggaggcugagucgggaggagggcucacaccugggaagucgaggcuucacugagcuguggucacgccacugcacuccagccuaagugacaguaaaacuccgucucuucaaaaaaaguuuguuagagguuuucuagagucugguuuuauuauagaauauuuaugcugccauauuacugaaaacaugcuuuuguugcuacuugguuuuaguuccuuaguaaacugcuccaucuccuaccccacaugacuccaucguccuccgagcuucggcucaguuacacccuuacagcuccugccccuguucuccgucuugcccugcucucuccugucuuuguaacgccauguuccuucacuuccagcguuuaccauagcuggaaucucacgguucuuggcugucaggucccgugacugucuccucuuggcugcauuccagcacggcgcagcaucacuuggggacggggcauugaaugggugacaggaggaugggcuggaagcgguuuucacccacaggacgccuuucccuucucagaugcaggagccacugugguccguuuccuauucagcuuuucgucuggguugaugauuucacacguuagcuagaguuuuucaaauucguauuucauguaucaggucuucuagcaaggaaggaugaauagaucucaaggaauucagcuuugcugauuauagcagcugugaguaccucucaugaacuguuugaaggaugagggcauaaauucuagaugaggcaaccucuuuauaccauucuagguuuuaauucauguuccccaauccuuuauuaauaggccacuugcauuuuuuuucaugucucuauuuuuugcuuauuuugcaauuuggggguauugucauccuguaaacggauugcaggaagucagagaacaaguuuuucgauuccaguuuuccauuauacaguuuuuuucuauacauauuuaggcggauggagccaugacgguagagguuaaaaugugugauuuaguuccaugcuuaauuugauuucaucucuuauagguaaugcacaagggucacguguaugcucucaagaugaucaggcagauccuguccucaggaccagaagcacgucucugcugcacacauuguugucuacaccaugaguguuuaguagcaggacucuuggaaagcagugaucuaugcuguaagaccaugagucacagauucuuuuuuucaguacuauuuaugauuagccauauuucuagaaacauccugaaagauggaauuaugacgaaaaagugaagauaaucuacauucgggggcacaaaugagcacuuggaucaguguuuuaugaaccuaagauacagccggaguaguuauggucagucauggagaauaacuugaaaacuugucccaaagaggacggugauuucguuucugauaaaauaaaguuuaaaauagaagaggaagaugaugauggaauuccuccugauaguuuggaaagaauggacuuuaaaagcgagcaggaggacaugaagcagacagacagcgguggggagcgagcgggccucggugggacggguugcagcugcaagcccccggggaaguacuugucugcagagagugaggaugacuauggcgcgcuguucucccaguacagcagcacccuauacgacguggccauggaggccgugacccagagccuccuuuccagccggaacaugagcuccaggaagaagucuccagccuggaagcauuuuuuuaucucuccccgagacagcacuaaagcaauaugcauguacugugugaaggaguucagcagaggcaaaaacgagaaagacuugaguaccaguugucucaugaggcacgugaggcgcgcacacccgaccgugcucauucaggaaaauggcagugugucugccguguccucguuccccucucccucacuccugcuuccaccacagccugcggacgcgggugaccucagcaccauccucucacccaucaaacuuguccagaaaguggcgucuaagaucccgucccccgaucgaauaacagaggagucugugucuguaguuucuucugaagaaaucuccucugacauguccguuucggagaagugcggcagagaagaagcccugguggggucgucuccccaccucccugcucuccauuacgaugaaccugcagagaacuuagcggagaagagccuuccacuuccaaagagcaccucuggguccaggagaagguccgcugucuggaagcacuucuaccugucgccacuggacaacuccaaagcugucugcauucacugcaugaacgaguucagccgggggaagaaugggaaggaccugggcacgagcugccucaucaggcacauguggagggcacaccgcgccaucguguugcaggagaacgggggcacgggcaucccgccacuguacuccaccccucccacucugcugccuuccuugcugccgccggagggggagcucagcucuguguccucgucuccaguaaagccggucagagaguccccuucggccuccuccuccccugacaggcugacugaggacuugcagucucacuugaacccuggagaugggcugauggaagacguggcggccuucucaucuuccgaugacauaggggaggccucggcguccucuccugagaagcagcaggcugaugggcugaguccuagauuguuugaaucuggcgccaucuuccagcagaauaaaaaggucaugaaaagacugaagucggaggucuggcaucacuucucccuggcccccauggacagccucaaggccgagugucgguacugcggcugugccaucagccgggggaagaagggugaugugggcaccagcugccugaugagacaucucuaccggcgccauccagaaguugucgggagccagaagggcuuccugggugcaagucuggcaaacucuccguaugccacuuuggccucugcagaaaguuccucuuccaaauugacugacuugccaacaguggucacaaaaaacaaucaaguuauguuuccuguuaauagcaaaaagaccucgaagcuguggaaucauuuuucuauuugcuccgcagacuccacaaaagucgugugcuugcacuguggccggaccaucagccgggggaagaagccgacuaacuuggguaccagcugucuucugagacauuuacagcgguuccauagcaacgugcugaaaacugaggucucggagacggcucggcccuccucuccggacacccgggugccgcggggcacagaauuaucaggcgcuuccucuuuugaugacaccaaugagaaguuuuacgauucucacccaguugccaaaaaaaucacaagucucauagcugaaaugauugcacuugaccuccagccauauucuuuuguagacaacguuggcuuuaacaggcugcuugaauacuugaaaccucaguacucccuccccgccccuuccuacuucuccaggacagcuaucccagguauguaugauaaugugaagcagauaauuaugucccaccuuaaggaagcugagaguggugugauccacuucacgucuggaauauggaugaguaaccagacccgugaguaccugacccucacggcccacuggguuuccuucgagucgccagcccggccgcgcugugacgaccaccacugcucggcgcuguuggacgugucgcagguggacugcgacuacaguggcaacagcauucagaagcagcuggagugcuggugggaagcgugggugaccuccaccggccuucaggugggcaucaccgucaccgacaacgccagcaucgggaagacgcugaacgagggggagcacucgagcgugcagugcuucagccauacggugaaccugaucgucagcgaggccauuaagagccagcggauggugcagaaccugcugagccucgcccggaagaucugcgagcgggugcaccggucgcccaaggcgaaggagaaacuggccgagcugcagagggaguacgcgcugccucagcaucaccucauccaggacgucccguccaaguggagcacuuccuuccacaugcucgagcggcucauugagcagaaaagggccauuaacgagauguccgucgaguguaacuuccgagagcugaucagcugcgaccagugggaggucaugcaguccgugugccgugcgcuaaagcccuucgaggcugcgagccgggagaugagcacgcagauguccacccucagccaggucauccccaugguacacauccucaacaggaagguggagaugcucuucgaggagacgaugggcaucgacaccaugcugcgcucucugaaggaggccauggugagccgccugucugccacccuccacgacccgcgguacgucuucgccacgcugcuggauccucgcuacaaggccucccuguuuacggaggaggaggcggagcaguacaaacaggauuuaaucagggaacucgaacucaugaauucuaccucagaggacguggcugccucccacaggugugaugcuggcuccccgucgaaagacucugccgcagaggagaaccuguggucacuuguggccaaggugaagaagaaagacccaagagaaaagcugccugaagccauggugcuugcguaucuggaggaggaggugcuugaacacagcugugacccgcucaccuacuggaaccugaagaaggcguccuggccggggcuguccgcgcuggccgucagauuuuugggcugccccccaagcaucgucccuucagaaaagcuguucaacacacccacugagaacgguagccuuggccaauccaggcucaugauggaacauuuugaaaaacuuaucuuuuugaaagugaaucuucccuuaauauacuuucaguauugaaacucacgacggcaccacuaggccagaggcguggcugccccagcguuagcagccuguaccaggucuaugacccgcucugcccacggcuguguacgacaucagaccaggcacucucagggccgcucuccagcucaccacagugucuccacgugccuuaccccuucuccuucaggccaaguuucgcgggguguuuuauuaagacguccacuagaaauagcuuguccugucaacuaugaaauauggugacuagauuuuaauucauaaccguaaaguuuuuuaaaguuuuggguuaguaauuuguuuuacuagaaugacaaagaagauguaaaccauuuuauucuguaggcuuuuuacucaauuauguacaaaccacaaaucagguacuguauuuuagugaagcauugcuuuaauugcaacagaauagcuuuuguggcuaucaaaugaaaucuguaaauaggagguggagggcaagccauccugacugagcaguuuuuaaccgcagguucuaaagugucccgcggaguacagauaauauucuggaagguaacuguuuacuacgacagagacguggcauuuggaaacgaaacuuagauguuucauggagcuuauuuugagaacuuucccauuucagguuucugcauucaggcuuuacauggucaguuaacucagagauaccccagcuguuuaucaucagcuccucugaaaugugaucccuuuguaacugugcucaucacuucgccagugcguucaaugacacgcugauggcagguggucccugcugaaacccccacgccuccgcuucagcaucuccacgcucugaagcugucuuucaaaaugugugcacugacccccuuguuugaucaaauuuguguaaaauuuuuuuagaagagauggcuuauuaacagggaagaagcuuguuauauuccaguuguaagaauagccuuaguguuuagauuuuuuuaugauagggaagaugcggccaucacugggauauuuucaaaucccaaggacaucagagugaagugucaguugucagaugauuuuaaaaguuaugucuucagagaaaaaaagauucauuuucucauuuuaaaccaauuaaauauucugagugagacuaaucacucauuugccuacgaccuuuuagaaaaguuguuuuguugaaauacuguacguacgcuuaaucuaaauuugcauugacuauguuuuaguguauuuauaaauggugaacucaguuucugaaauuaaacuucuuauuugcaauuuucuagugcuggcagacacuggcuuuuuauuuuuaggauaagaaaacaggcauauucuuugugguccauuaucuagagcccauacuugggcagcauuugaaauuucaccuuaaccccagacagggcuccagggaaguggagauguaauucuuacaacaacaguucugaucauggccauggugaugacuuuccaggucucguguucaaguggugccagaaugcaggagccggugggcagcccugagggguugccuuggccgcagccucugugcacgcucuuccugguguccucuuacccgguagcugugcgcuuguucccgugagaacagccugcuuccagagugcccaggagugcuggucagggacagugcccgugaggcugcagaggaggugggguccauggcccacccaucucucccucgccagcagcccuggccagugucauccugguguagaaaggguugcgcacaggauaggagggagccacaguucuugcuuagcugugcucacgaccagcuugcaguccuguguuucuuaagauuguauuuggaaugguaauauccuuagaauuuugggauauugagcuucauggauuuucucuccaaaacaagccagcacaacuaacuguagcagaauuguauccacucauucauucaacugagaugaagugcccucccuuuuccagggccugggcuaguuccuggaaugcaacagagauuuccguggacacagucucuagucucacagagcauauagucuaguccacgauuggcaagcugcaaccacagacccaguccggcacucugcccauuuuucuaagugaaauuuucuuggaauacagucacagcuguuuuuuuaacauggugucuuggcuacuuucaggcugcgacgggagaacugaauaguugugacagagaccacaggcccacugaaagggacaaacagggcugaaaauacucacuguuuggcccuuuccagaauagcaaguuugcuggcccuugagcuagccugccuuuaugggguuuuuuuuguuuguuuuuuuaagcuuucagcuucaugcugcuguauuuuuaguugaaguguucugaguaacagucaguguauaaaaggggauugcagaaaaaaaugagggcuugcuuuacucaacagaaaauauggcccuuccugaaugacacuaggagagucauuuuaucucauacauucccuucauuucguugguggacauuuguugaaaccggcacucaauggucaaaccgucucugcccuccaguugcugacaguccugcaggaagauggacaagaggcccagugcugacagucacacgacucucacuacuugaaugaggggacugugggugcaacuagaaaauauguugauucuuagccauucccaccuugccucuccguucagaaccccagcugcgagcuguuuguuucccugccuggaaaugauguuuuaggcagguuccuuaauuucucaggucugucucagauaauaaaaagcucuuuguaugagccucagaacugucucuucagugaaugaaauuaccagucauuauacgaagggacuuuaaaaaauuuguggaaauacugaaguaaaagaugauaaaaaaauaaaaacuuuauuucuuggcuggg

SEQ ID NO: 192572 - RNA, 8759 nt, Homo sapiens
gggagcgggagcgccccagcggccggcgggcgggcgggcgagcggacgagcggcgcggagccggcccgaggcgcgcgccgagggagccccguccccggucgugggggcaccgcccgcaggcucugcggggugggcagcucccgggccugccaugagcucuccgccgcccgcccgcaguggcuuuuaccgccaggaggugaccaagacggccugggaggugcgcgccguguaccgggaccugcagcccgugggcucgggcgccuacggcgcgguguggugagcgcgggccgggcggggcggccggcggggcgggcggggccugcgcggggugcccggccuucccgcuaagcgguccgccccgcagcucggccguggacggccgcaccggcgcuaagguggccaucaagaagcuguaucggccuuuccaguccgagcuguucgccaagcgcgccuaccgcgagcugcgccugcucaagcacaugcgccacgagaacgugagucgcgcggccccgcuccgggaaggcgccgcggccucggcuugguucagcugggcuggguucccccacccggcaaccccuccuccaggcagccugcuguggggccgggcgggggucgggccguggguccccaggggagaaggagagcaaggccugucucuccuugggagacgacucccccaagggccguuccccauccuccgccagccccgggaaggacucagccccuugacucggcgccucagccaggcccuggucagggaacacgacuuggccaggcccaggggauccuccaggucucacgccaagccuugcccccagccaggaagcccgcggugagagcaugcucccggcgggaggauuuuccuggaaggggcaccuucccucuuccccauccccuuuccagccccucuguggagcccacucugcugcuguccaucucccgagucuuccgacccggugguggagggggaggaggggggcgccagaacgcagggaguguguugaacccucaggagccccugggggugaaggguuuagggagcugcuguuugaggagcacugggcgugguggccgccucacagacacccuccugugcguugugggggcccauccuuuccaguccuuccagugagaugccacguacagcugcccugggccucucccauggcgguggcuggcugcuaagaacccgaucucucugccaggggugcucugguuucuggauacagucccacuuguccacugccccccacgucacuccugcccucccccuggucugggcccagccugagggcugguggucugggcacccggacccuaccuacagggugagaugcucuggacccuccugggucaucugagccaccggugccuugggagaacgagucccugcguccaccagcaaagugccccguccaccagcaaagugccccgucccccgguuccuggccaccgcuacucccucagccccuuggaugggucuuuuucucugaggcuucccaugcccacccugacccccagcucacuacccugggcccugugaaauccauuugcaguggacaccagcccugcccgcaccucgacaccccgucacacccagcccugcccccacuucgccggcaccgcacccccccaccacccgcccaucacaccaaggccuugccccaggacugcagccuuccccacggcccccugcucccacccacccacucacccacccgugccuugccccauccagccaagcgcucuggggcuuuuuuucuuuuuuuuucuuuugagaccgaguuucgcucuuguugcccaggcuggagugcaauggcacgaucucagcucacugcaaccuucgcguccuggguucaggcgauucuccugcuucagccuccucaguagcugggauuacaggcgcgcgccaccacgccuggcuaauuuuuuguauuuuuaguugagaugagguuucacuauguugggcagacuggucucgaaccccugaccucaagugaucugcucgccucggcuucccaaagugcugggguuacaggcgugagccaccgcgccgggcuccaccggggcuuuucuuuagccaccgccccgcugugcugggaucuccgcugugccugugggcccacccccugggcuccuggccugcagcugaggcucuuucccuggaaccccaucuuccugggagacugaagcucugugaggccacgugccuugcucagcgggggaggaggcucugccacaggccucaguccugccaggccgccucccucuccaggccagcccccauaccacagaggccaggccaaguccuguggccccuagcccacaggacccugcucuccgucuucugcuaaagcacucucccgggcacccuccagcucucauguccacaguccccgcugcccccuggacacccccucuguucccucuccuccucccuccacauucuugcccauggcucuggcccacguggcuccggcggagcuguccuuccagcuuguguccauucuuaccucacucuggccgguuccuacaccacggccaggaggacgcauuuagccucacguccccauuuaaaucguccccgucucuugggaucaaagccaaacuuccaccuggugugugcugcccugccggcucccucuggccucuccucagccccucccuggccugggccuccgccaccuggccucccucccuguauucuucaaacuauccaagugugcucccuccugccucggccacucugugugugcccucugccaggugucccgcagcccacaugucuaccugccccuccacccuuggcugugcaaaacuccaggccucccugggaccgucaccccaaaaugcugaggcggcaguugucacaugaccugucuacugucuaucuccccaaccaggggugcugaggggaccaggucuggugggucacggugcuguccgccugggccucaccagcagaggccuggccucuuuccauagcgcuguccccacccugggccuggaucuguuugguuggggugaagaggggugaaagggucaggcggcaggagcccuuuggaugguucggagccaucccagacuccggguugccccucccccagaagaucccgguugucaccguccaaaaauaaccuuucuguggguaugugugccagggcugggccacacugccaguggguaugugugccagggcugggccacacugccagugggcagagccaggcccuuuggacaguggggcaugacaaugacagcugcagaggggguuuccugcccagaggguugugccacucuuggggggugccccagcccguguccucugcugcauucucaacccuauguggcccccccaggugaucgggcugcuggacguauucacuccugaugagacccuggaugacuucacggacuugugagugccgaccugggcuggccgcugggcacgagggguguugggcagcucugggcacuggcuucagguucuagguuggcaaugggguucucuuccugcagccugagugggggaugcacaccgcccacccccuccccauaccacuguccaccccacgcccucccccacaugguccugggacccacgggcacuggcacagcugggcagagcuggggcugcugccucucuccacgccuggcaccugggcccucuccagcaccggaggugugaaccuuggaccugaccauuuguuaacaggaaggucccgugcucgggacccuggcaccaaguguguggccgguaacuggagcugcugaccuuuuccagcgggugggggagaagcgguagggaggacccacccugccccugcccugcagccgaccacccugggacucacacccugucggccaagagugaagggccaggccgaggaaggccuggagaggguagcaggcgccucccgccugacuugcagaggucaagucaguggccucugggaaggugcuaaauaccauucuccugugucugucuccaccggcccagccgaccccucugacccagaugccuugccgcgcccccaucgcccccaggcaccucccucauuucuggcacaaaguugugaaguugaaaccugacugccucccuccccugccugugaagacucgaguccugcugccucuaccauggagccucagccccuagccuggcacgcagggcgcuucagcggaggguucaaaaaccccaaggcagccuccucccugccugacaguccucagggugggaggggggugugagcgcugcuggcaguaacaguugcgggaggauggagccuggcacugcaagguggggcugcgaggacaccgaggccaguguggaugugugcugcaggggugaccuuccugggggugccuguuggauccgggacgggucugagccugggccugcugggugggucucugggaugcagaggcuggcucuguccgcugacagcgcuccggccccucccacaguuaccuggugaugccguucaugggcaccgaccugggcaagcucaugaaacaugagaagcuaggcgaggaccggauccaguuccucguguaccagaugcugaaggggcugaggguacgggccccgggggaggcugcagggaggcaggcagggccucggggcugggcagaggagggcccuguggcucugagagggugcgcugaagccugccaaauccucugccccccgcaguauauccacgcugccggcaucauccacagagugagucccgguggagaagccgcucaucagcccucccccagugcaauccccccgccuccacgucccaccugugaggaugugauggggucugggugcugagccacgcccuaugcacagccccuggugggaaccugccugggugcccagguaccuuggucugcccuugaagggcugcagagagcaagggggccagguccgguggccccaucuuuaggugccacccaggcucuuggcugugcccaugcuugggaggguggggcacaguggccaccuuuccucugcccccaggaccugaagcccggcaaccuggcugugaacgaagacugugagcugaaggugugugcugccuggcagggggcccugagguggggcaggggcccccucuggaucugcccaucuauccaccugucaggccugggcagggggccaaggucccaggcucugggcaguggcugaggagcuggugggugggugagcccaagaggcagugguacacaacaugccguacccagggcaccugcuccgucccgagggcugcugggcuuggugcacuggccagagggaggagcucggggcaguuugggguccgagggcguggccucaaguccuugaagguugucaggaggccccagcuugggagcuucaaguccaaccccccggggucuccuggaccguggguggccuguccgcuccuugggaguccccuagaacccaccuccccaauucuucccacagauccuggacuucggccuggccaggcaggcagacagugagaugacuggguacguggugacccggugguaccgggcucccgaggucaucuugaauuggaugcgcuacacgcagacgggugagaagcugcccagagaucugggccucucaggcugcaccaucugcuucuccacuucuucacggacagcccugugguggcugcucccagggaggcuguugagcuggggugggagccgggcaggugggcuguguuggugucuccucccuccccgucucauccugucccccugcccacggagcugaccagggcuucuaucucaguggacaucuggucugugggcugcaucauggcggagaugaucacaggcaagacgcuguucaagggcagcgaccguauccuccagccgcagggcggcaccaggggcggguggggauggcuccugcccaggugggggcagugggggcccugaucucuggcccccgagcuguguuccugaccucggugcagaccuggaccagcugaaggagaucaugaaggugacggggacgccuccggcugaguuugugcagcggcugcagagcgaugagguaaggggugaguggggagcugggugggggugggggcggaccugggccuugguguuggccccucacccuuucuucccacacaggccaagaacuacaugaagggccuccccgaauuggagaagaaggauuuugccucuauccugaccaaugcaagcccucuggguacggcuggcuagugugggggccaccgggugcuggaguguggggccucccguggucuggccugaugcaccuucccccgcagcugugaaccuccuggagaagaugcuggugcuggacgcggagcagcgggugacggcaggcgaggcgcuggcccaucccuacuucgagucccugcacgacacggaagaugagccccagguccagaaguaugaugacuccuuugacgacguugaccgcacacuggaugaauggaagcgugaguggggggcuccuggcacggccuguguggacccaaguggggggcucugggcagggccuguguggaccugugaguugggggcuccggguagggccuguguggacccgugaguugggggcuccggguagggccuguguggacccugugggcccugugcagguggccaggcucagaguccuagauccccaucccugggaugcaggucaggugaggaggaugggaggucagggcagcauggggccguguggccugguggagaugaccucuggcuggagcuggaaguugaagggaaggguguuccuggcaggcucagcacagaggcuggcacagaaggagccgggaguggugaaaggcagcugugagucagggaaccagggcccacuuagccccuccuggcccccagaccugcugcccuuccgccauguccaggccagagaccugggccacccugacacccucaccacguccgcuugucccuaaggccucucugcucacaccuccugaaucuguccuugccucuccuugccccauuuuuguuuuuugagacggagucucacucugaugcccaggcuggagggcaguggcacgaucuugacucacugcaagcuccgucucccggguacacaccguucuccugccucagccucccgaguagccgggacuacaggcgcccgccaccaggccuggcuaauuuuuuguauuuuuaguagagacgggguuucaccguguuagccaggauggucucgaucuccugaccucgugauccgcccgccucggccucccaaagugcugggauuacaggcgugagccaccgcgcccagcccucuccuugccccacuuuaggaucccuccccccuggacaacuguauacccaagacaguccccagggccucgccugucucccccagcccccgcuaagcaguccagacuccaaccccaacugcugggguccaucauccccuauaccaggggcuauccccucaacuuggagggcuggccaaagccugugcagccucaggcuggacucagagaagccuccccagcucccgcagcuaugcugcggccugaggcugugcuggaccuggcuucauuucugcuccaggauggcaggcugugucuucuucauggcugcaugaccagccuggggugggugugcccggggaaaguagguguacacugggagccgugccauguuucaggcccuguccuggcucugccucgggugcgggaccuugguccuccacacuggcuggguggggcuggauggguugagauucacaugugcuccuuacgaccacgggucccugggugcccgcagcagggccuccacccuucgcugugugcauauucgugugcuuaugaguuuggcuuuguuugauuaaagguuucugcugcuagaaagauaacuugaaagccaugggccauaggauccucucuguaguccccacccacacaacuguggcugaggccucagcucuuaggacagaccgugguggacauguggccaagcccuggccaccuccccuuucccuggaaaauccagaucuagagcaauggccucuucacacaaaccuucucucagugguucagaccacauuaggauuagagaagggccccacgaggcaccgccaggcgugucugugagcgacucccaggauggaaggcaaaggcugaccccccucucuguugugcccgcccccccacccccgccagguguuacuuacaaagaggugcucagcuucaagccuccccggcagcugggggccagggucuccaaggagacgccucugugaagaucucugggcuccgggguggcagugaggaccaccuucaccuuccaccugagaggggacucucguugccaccuugaccuuggcuggggcuugcaucccaaggcauccaucagagcagacgcccggguuccauggacccuccuccccacggccaugccucugcucuugggcgcccaucauggaggagcaccugaacuuucuggacaagaccucuggccgaccuggggauggccucugaucccuggagcaguggcccacuugcccggugcucucagaaaccucagagcugguggggcuccagaucaggccuuggccucugagcccugccugcucugggccaugcagaggaaggacagagggugggcgcagggcaccaacucagggacauccccucuccugggcgacgucaguggaccuuccugcacccccagccuggaauguaaaucagcuguguggugcccgcguggcuggaaggaaauagacccuuuuguagcucccu

SEQ ID NO: 192573 - RNA, 101773 nt, Homo sapiens
gugcgccgccgccgccauuuuggagcgaucggagugccgcccgcggccccgagucggucucgagccgccggccggccgugccgguguccguaggcgcugcgcccucggccgggcccaugugugugcggcccgcccgaggccgcccgggcuuugccuccaccagcgcccuggccuccgcucgggccuccacacgggccuccgaagagcugccgcgacgcccggcccgcagggcaggugagugcggccgcccgccgcucagacccggcccccagucugccagugccccccaagucacuucuccccgagucagucagugcccccuccagauaguuaucccccagucagucaguucccccuccagucaguuccccccagucggugcccccggagucagugccccccccaagucagucagugcccccuccagucaguucccccccaguuagugcacccucuagucaguucccccagucagugcccccuccagucaguucccccccagucaguucccccccagucaguuuccccccagucaguuuccccccagucagugccccccagucagugcccccuccagucaguucccccccagucagugcccccuccagucaguuuccccccagucagugcccccuccagucaguucccccccagucagugccuccuccagucaguuucccccagucagugccuccuccagucaguuucccccagucagugcccccuccagucaguuccccccccagucagugcccccucuagucaguucccccccagucagugcccccucuagucaguucccccccagucagugcccccucuagucaguuuccccccagucagugccuccuccagucaguuucccccagucagugccuccuccagucaguuucccccagucagugccuccuccagucaguuucccccagucagugcccccuccagucaguuccccccagucagugcccccccagucaguuuccccccagucagugccccccagucagugccccccagucagugcccccuccagucaauuccccccagucagugcccccuccagucaguuccccccccagucagugcccccuucagucaguucccccagucagugcccccuccagucaguucccccccagucagugcccccccagucaguuuccccccagucagugccccccagucagugcccccuccagucaauuccccccagucagugcccccuccagucaauuccccccagucagugccuccuccagucaguuucccccagucagugcccccuccagucaguuccccccagucagugcccccccagucaguuuccccccagucagugccccccagucagugcccccuccagucaauucccccuagucagugcccccuccagucaguucccccccagucagugccuccuccagucaguuucccccagucagugccuccuccagucaguuucccccagucagugcccccuccagucaguuccccccccagucagugcccccucuagucaguucccccccagucagugcccccucuagucaguucccccccagucagugcccccucuagucaguucccccccagucagugcccccucuagucaguucccccccagucagugcccccucuagucaguuuccccccagucagugccuccuccagucaguuucccccagucagugccuccuccagucaguuucccccagucagugccuccuccagucaguuucccccagucagugcccccuccagucaguuccccccagucagugcccccccagucaguuuccccccagucagugccccccagucagugcccccuccagucaauuccccccagucagugcccccuccagucaguucccccccaagucagugcccccuccagucaguucccccagucagugcccccuccagucaguucccccccagucagugccuccuccagucaguuucccccagucagugcccccuccagucaguuccccccccagucagugcccccuccagucaguucccccccccagucaguacacccucuagucaguucccccagucagugcccccuccagucaguuccccccagucaguuuccccccagucaguuucccuccagucagugccccccagucagugcccccuccagucagugcccccuccagucaguuuccccccagucagugcccccuccagucaguuccccccagucaguuuucccccagucaguuucccuccagucagugccccccagucagugcccccuccagucagugcccccuccagucaguuuccccccagucagugcccccuccagucaguucccccccagucaguuuccccccagucaguuucccuccagucagugcccccuccagucaguuccccccaucagugccccccuagucagugcccccuccagucaguuccccccccccggucaguucccccccccagucagugcccccuccagucaguuuccccccagucagugccccccaagucagugcccccuccagucaguucccccccagucagugccccccuccagucaguuccccccagucagugcauccucuagucaguuccccccagucagugaacccuccagucagugacccacccagucagugcccccuccagucaguucccccccagucagugccccccuccagucaguuccccccagucagugcauccucuagucaguuccccccagucagugaacccuccagucagugacccacccagucagugcccccuccagucaguucccccagucaguugccccccagucagugccccccaagucagucaguucccccuccagucaguucccccagucagucagugccccccagucagugccccccccaagucagucacuguccccuccagucagugccccuccaguaaguucuccccagucagugcauccccuagucaguuccccccagucagugcccccuucagugucccccagucaguuccccucagucagugcccccccagucaguuccccccgcaaucaguucccccgucagugcccccuccagucagugccccccaaaucagugcccccagucagugcccacuccagucaguuccccuccaguaagugccccccaagucaguuuccucccaagucagggcccccuccagucaguucccucccagucagucagugcccccccagucagugcccuccuucuguucccccacccuacaccagucagugcuuccugcaccagucaguguccccugcuagcuagucauugcaccucacccaucaguccccaccccacccaucagugccccccaccgucagucagugccccuugcaagucaugcuccuccugucggucagugccuccgcaucugucaguccgcgcacuggucagugccuccacuguuggucagugcucccccaccgucaguccacucugcuccccaucagugucccccagucagagucccgcaucccugucccccgucagccagugcccccccagucaauuauuuucuuucugucauguccccacuucccaucagugccugcacccccacccguacccgucagucacugaccgcauaaucccuccccugccagugcccuuccuugucaguccaagcgcucugugaccccuucugucagcaauguccccaccugucauugaucuucucugucagugccccccaucagugccagugccucugucagugagccccacugucaguaaguuucccucauaagugucucccucauccugccuguuguggcccuuccgcucuuugcuaucggccucuguguuagugccugucagauccuccccaucaguucuccccuguugucaguuccuguccccuuucaugcuaccuccuucaucccuuaucuguuagggacccauuaguacccugcccugcuguuagugaccccaccugucagugucuccccacugcuucucuccugccugucagugggagaacuuucagugcccgcugucaucaccccucuuguccaaucacugauuccccuuuccauuauuuccuaacccuuuccaacacuacucgucuuuuccugucgcgcuccccaucacggcuugagauaucaccagucaucuaaccucaccuuaccccgcacugcccuguugcuuccauccccaucaucucuuccuucagccugucaccuucccccaugcaccguacugucccccgaccugccacucuguguacucgcagcuucccuaccugcuuuguccacucucuuguuacugacuccucccaauuugcugcucauucccugaccugucagcaccagcucccccaagucugucacuuccauuuagucccugccuuucacugcagcccccucuuugucacuguacccacugauuuuguucuagacccuucuccugugucuuguucuuucauccacccuucccucauggccucucucugcccugcucuuggcuucuccuugccccugcaguugccgacacuguucacuguucacugaaagaggcucuucaccucuuuuugaugucccuuuuucugguuuaucuucccuuuguuuuuauuuuuuacuuuaaaauguuguggguacacaauagguguauauaucucuccccuuugacuuuucuaacucacuucaguuaaucuuuggaaugugagaggcagcuagcuuugagacaaauugggggacagagucucccaugcugagaggacagcacaugcaaaggcccugaagugggaaauuuugggugugauauccuccaggaaccuagauaagacugaugugcuuaugguaagggagagagaggcaggagccugggcuggaaaguugguuuucucauuaagccguuccuugcagguguuaguagggaguuggaccuucagucugaguuguaggagaaaccuggccuggagauugaguuggagagugccaugaucauauggacauuggcacguggacagcaggugggggugagaugaaguguugggagcuggguguagugauuguaaugguuuagaacuuggugguggguuuagggagauauuuuggagguagagcuguugggacuuguugguagaugagaagagaggugugagagaaugaauggacucaggguaauuucugggcugcuuuuauccucccagccccaucaacccuucuaggcuuucugauggaacaaauggguggauaguagcacuguuuauugaaauagggaagcugaauuaggguggugucagggcuggggguguuacuacaguuuggaaguagaaagcaaggcuuucucuuggcugaaaguaggggaagucugagaaguccgagggucacuagggagaagguaucuuacaggagggucuggaacccagaggagaggccaagccgcagguauacaacugucaucaugggggcaagguauaaagccuuggggauggcuauuuauuuaaaagcacaugggcugggugcggugguucacgccuguaaucccagcacuuugggaggcugaggugggagcaucacuuaaggccagggcagccuggggacaugacaaaacccuaucucuacaaaaacaaaaagcagggccgggcgcaguggcucacgccuguaaucccagcacuuugggaugcugaggcgggcggaucaccugaggucaggaguucgagaccagcuuggccaacauagugaaacuccaucucuacugaaaauacaaaaaaaacuagccaggcaugguggugggcgccuguaaucccagcuacucaggaggcuggggcaggagaaucgcuugaaccugggagguggagguugcagugugccgagauugugccauugcacucuagccugggcgacaagagugagacuuccucucaaaaaaaaaaaaaaaaaaaaaaguugggcaugguggugugcgccuauagucccagcugcucggacacugagguggcaggaucaccugagccuggggaggucaaggcugcagugagcugugaucacuccauugcacuccagccugggcgacagcgugagacccugucucaaaaaaaaaaaaaaaaaaaaacgggcuggacguggugacucgugccuauaaucccagcacuuugggaggcugaggcgggaggaucacuugaggccaggaguucuagaccagccugagcaacauagugaggccccaucucugccaaaaauaaauaaaagcacacccacaaaagcagaauguggccaggcauaguggcucaugccuguaaucccagcaguuugggaggcugaggcagguggaucaccugaggucaggaauucgagaccagccuggccaacauggugaaaccccgucuuuacuaaaaauacaaaaaauuagccaggcgugguggcaugcgccuguaaucccagcugaggcaggagaauugcuugaacccgggaagcggagguugcagugagccaagaucacaacauugcauuccauucugggcaacaagagugaaacuccaucuuaaaaaaaaaaaaaacagaaaaaagcagcugggugugguggcccacgccuguaaucaguuugggaggccgaggcggguggaucaccugaggucaggaguucgagaccagccugaacaacauggugaaacuccgucucuacuaaaaauacaaaaauuagccaggcgugguggugcaugcuuguaaucccagcuauucgggagccugaggcaggagaaugccuugaacccaggugguggagguugcacugagccaagauugugccacugcacuccagccuaggcaacagagcaagacucugucucaaaaagaaaaaaaaagaaaccauuuuauuugcucauucauuaaaagcagcuccuuaucuguuuuauccugagauugcagcaauucagucacaucuucaggcucuacuucuaguucuguuacuuauuuuuugagacgaaguuucccucuuguugcccuggcuggagugcaguggugcaaucuuggcucacugcaaccucugccucccgaguucaagcgauucuccugccucagccuccugaguagcggggauuacaggcgcccaccaccaugccuggcuaauuuuugcauuuucuauaaagaugggauuucaccauguuggccaggcuggucucgaacuccugacuucaggugaucugccugccuuggccucccaaaguugcugggauuacaggcaugaaccacugcgaccggccugaaauguauuucugaaauaauaagaaaauuaggcugggcgcgguggcucacgccuguaaucccagcacuuugggaggccgagacaggcagaucacgaggucaggagaucgagaccauccuggcuaacacggugaaaccccgucucuacuaaaaauucaaaaaauuagccgggugugguggugggcgccuguagucucagcuacuugggaggcugaggcaagagaauggcaugaacccaggaggcgcaacuugcagugagccgagauugccccacugcacuccagccugggcgacagagcaagacuccgucucaaaaaaaaaaaaaaaauuacuccuugauccaugggcugcaguauggaguauguuagcaggcaugacaacauuagucuccuuguacaucuuaaucagagcucuugggugacuagaugcauggucaaugagcaguaauauuuugaaaggaaucuuuuuuuucugagcaguaggucucaacaguguuuuuuuuuuuuuuuuuuuuuuuuuuuuuuugagacagaguuucacucuuguugcccaggcuggagugcaauggcgcaaucuuggcucaccgcaaccuaagccucccagguucaagugauucuccugccucagccucccuaguggcugggauuacaggcaugugccauugcgcccagcuaauuuuguauuuuuaguagagaugguguuucaccauguuggccaggcuggucucaaacuccugaccucaagugauccgcccgccuuggccucccaaagugcugggauuacaggagugagccaccgcgcucggccugauuuagcauaauucuuaaggguccuaggauuuucagaaugauaaaugagcauucaauuuaaaagucaccagcugcauuagcgagucagccugugcacucaagcuuugaagccaggcguugacuuacccugucuagcuaugaaaauccuagauggcaccuucuuccaauagaagacuguuucaucuguauugaaaaaucuguuguuugccauagccuccuucaucaauuguccuagcuggaucuuccagaucuagcgacaacuucuauaucagcauuugcuguuuuguuuuuguuuuuuguuuuuuguuuugaaauggagucucccucugucacccaggcuggagugcaguggugccaucucagcucaccgcaaccucugguucccguguucaagugauucuccugccucagccucuugaguagcugggauuacagguagccgccgccauacccagcuaauuuuuuuuuuugaaacggagucuugcucugucacccagucuggagugcaguggcgcgaucucggcucacugcaagcucugccucccagguucaugccauucuccugccucagccuccccagcagcugggacuacaggugcacaccaccaugcccagcuaauuuuuuuguauuuuuuaguagagacgggguuucaucguguuagccaggauggucuccaucuccugaccucaugauccgccugccucggccucccaaagugcugggauuacaggcgugagccaccgcacccggccacacccagcuaauuuuuguauuuuuuaguagagacgggguuucaccauguuggccaggcuggucuugaacuccugaccucaagugauccuuccgccucggccucccaaagugcugggauuacaggcaagagccaucgcgcccggccggcauuugcuguuucaccuugcacuuuaguauguuauggagguggcuucuuaaaccucaugaaacaaccuccgcuagcuuccaguuuuucuucugcagcuucgucaucucugucauccuuuguagaacugaaaagagugagggccuuacuguagacuauuuaagucugguuucgucuucucuccaaaccauuaaaacuuucugcaggcauugggugcggugucugaccccuguaaucccagcacuuugugaggcugaggcagguggaucacgaggucaggaggagaccauccuggccaacauggugaaaccccaucucuacuaaaaauacaaaaauuugcuggguaugguggugcgugccuguagucccagcuacucgggaggcugaagcacaagaauugcuugaaccaaggagguggaaguugcagugagccaagaucacgccacugcacuccagccuggugacagagcgagacucugucucaaaacaaaaacaaaaacaaaaaaaaaaaacacacaaaacaacaacaacguaacuuucugcaggcuaggcacgguugcgcacaccucuaaucccagcacuuugggaggcugaguggggaggaucgcuugagcucgggaguuugagaccaaccugaguaauacagugaaaccucaucgcuacaaaauaaaaguuuagcugaaugugguggugcaugccuauagucccagcuacuggggaggcugagguaggaggauggcuugaaucugggacgucagagcugcagugagcugugauggugccacuacauuccagccugggcaacagaguaagaccugccuccaaacagaaagcagccuucuccgugucagcaauaaagcugcuuugcuuuauuauuauuuaugucuucacuggaguagcaguuuuaauuucccucaagaaccuuucuuuggcauucacaacuuggcaaacuggugcaggagggcuagcuuuuggccugucggcuuuugacaugccuucuucacuaagcuuaagcauuucuagcuuuugaucgaaaugagagacaugugacucuuccuuuccuacaggauuaauugaccuaacguuauuacguuauuacuguugugucucagggaguagggagcccugaggagagggggagagacucagggaaauggccggucagaacuuacgcagcguuuauuaaguuugcuauccuauaugggcacgguuuguaguuucccaaaacaauuaaaauaguaacaucaaacaucaccgauaacaggucaccauaacagauaaaauaauaaugaaagaguuugaaauauugugagaauuaccagaaugcaacacagagacacgaaguaagcacaugcuguuggaaaaauggcaccccucgacgugcuugacgcaagguugcuaccagccuuuaauuuguagaaagcacauuaccugcgaagcacaaugaagggaagcacguuagacaaaguacgccuguguuguuuuccauuucacagaugaggaaauggaaauaaacagcaaguagaugauagaggcaagauuuguaccccagguagugugacucaaaagccucucccuuuuuuuuuuuuuuuguuaagggaaaggcuaacuuuuaaaaauauuuuuaaaaaauuuuaauagauucccuagaagaauagaggaagaacaaagaaaauuaaaagaauacauuuuggaauuguaacgauaacugauuauguaucaggcauuuguguguucuuguuuauguuccaauacaauuuuauuuagaaaagcugacugggaggccgggcgcgguggcucaugccuguaaucucagcacuuuuggaggccgaggugggcggaucaccugggguccggaguuugagaccaccguggccaacauggugaaacccugucucuacuaaaaauacaaaaauuagccgggcaugguggcacguggcuguaauuccagcuacucaggaggcugaggcaggagaaucacuugaacccagaagguggagauuguagugagccaagaucaugccacugcacuccagccugggcgacggagcgagacuuugucucaaaauaaauaaauaauaaauaaaauaaaaugccugggacuagagauguuuuggauuucaaauuuucucagaguuaccaguugagcuuccccaauaaggaaucugaaaugcuccagugagcauguccuuugagcaucauguagaugcucaacaaguuuuggauuggagugcuuuuuuuauuuuuauuuuuuggcuagucaagugaagcacugggaguggaaaaggaacacaaacauuuguaggugggcacggcgccucacaccuguaaucccagcacuuugggaggcugagguggguggaucaccugagguccggaguuugagaccaggcuggccaacaugguuaaacccugucuguacuaaaaauacaaaaauuagccgggcaugguggcaagcgccuguaaucgcagcuacucaggaggcugaggcagggguugcagugaaccgagaucaugcuacugcacuccagccuggaugacagugagacucucucucguacacguacauacaaaucuguaacugguugugaucaauuaguuguaaaagcugcugcaccuggaucagccuuuuuuuuuuuuuuuuuugagacagucucauucugugucaccuagguugagugcaguggcacagucacagcucaccacagccuugaccugccaggcuccugaguagcugagacuacaggugccugccaccaugccuggcuaauuuuuuauuuuuuguggagacagggccuugcucuauugcccaggcugauccugaacuccuggacuuaagcgauccucccaccucagccucccaaaguacugggacuacaggcgugagccacuuugccuggcccaggauuucaauuucacgauuuuugguuuagggauacuccuccuauauuggaaauccuguuauauccacauacagcaagcagccuucuuuuuuuuuuuuuuuuuuucuuuuuugagacagagucucgcucuguagccuaggcuggagugcagcggcgugaucucggcucacugcaagcuccgccucccagguucaugccauucuccugccucagccucuccgaguagcugggacugcagguaccugccaccacgcccggcuaauuuuuuguauuuuuaguagagaagggguuucacuguggucucgaucuccuaaccucgugaucggccgcccgccuuggccuuccaaagugcugggauuacaagcgugagccacugcgcccggccuuuuuuuuuugagauagagucucgcucugucgcccaggcuggagugcaguggugcgaucuuggcucacugcaagcuccgccuccuggauucacgccauucuccugccucagccuccugaguaccugggacuacaggugcccgccaccacacccagcuaauuuuuuucuauuuuuaguagagacgggguuucacuguguuagccaggauggucucgaucuccuuaccucaugauccgcccgccucggccucccaaauugcugggauuacaggggugagccacugcgccuggcacagccuuauucuuuaaaauggaaaaaaaaaaaccaaaaaaaaagcuuuuaaaaauuuuucucuuuuaaaaaguguacacauaacacauaauuguauauauuuaugggguacauagugauguuuuaauaccuauaguguauuucccucuuuuuuuuuuuuugagacggagucucgcucugucacucaggcuggagugcaguggcgcgaucucggcucacugcaagcuccgccucccagguucaugccauucuccugccucagccuccagaguagcugggaccacaggcgcccgccaccacgcccggcuaauuuuuucuauuuuuuuaguagagacgggguuucaccguguuagccaggauggucucgaucuccugaccucgugaucugccugccucggccucccaaaaugcugggauuacaggugcgagccaccacgcccggccuucccucuucuuuuuaacacagaauguacagucuauuuuuccuuuuuuuuuuuuuuuuugagagggugucacucugucaucucggcuggaaugcaguggaaugaucguugucacagaagucucaaccuucccaggcugagguagucaucacaccucagccucccaaguagcugggacugcagguacacaccaccauguccagcuaauuuuuuuuuguauuuuuaguagagacaagauuuugccacguuggccaggcuggugaaaauucuuacauuaauacaagucuuuucuguggacauauguuauuucuuuugaguaaacaggaguagaagugcuggguuauaacauagauguauguuucacuuuuuuaagaaacugccaguuuucggccgguugugguggcucacgccuguaauaugccagcacuuuaaaggaggccgaggcggguggaucacaaggucgggaguucgagaccagccugaccaacauggugaaaccccgucucuacaaaaaauaaaaaaauuagccggccaugguggccggcgccauaaucccagcuacuugggaggcugaggcaggagaauugcuugaacccgggaggcagagguugcagugaggcaagaucgugccacugcccuccagcuugggcgacagagggagacucugucucaaaaaaaaaacaaaaaagcaaaaacaaaacuuccaguuuuccaaacuggaaacauuuuacacuccuacuaguaaugggugagaauuccuuucuccuugccuaugacagcacuuagccuuuuuacuuuuagccauucaggcgguagugguaucuuacugugguuuuaauuugaguuugucugaugaauuaugauggugagcaacuuuucaggugccuuacgggccauucguguauuuuuuugugaaauauuaauaucuauucaugcuuuuacccacuguuuauuggauuguucuuuuauucacuuuuaggaguuuacaaaaauaaauucugguuacaaguccuuuguggugugugcaugcguauaugcauauacauacauagugaggggaggaagaggaagggggugaauuuuuuuuguuauacuaguugcuuauuuucucuuucucuuucaucucuuucccucccucucuccaucccucuucuuucuuuucuuuucuuuuucuuuuuucucucucuuucccuaccucccuuccuuccuuuccccuuuuccucccugucucucucucucucuuucuuuuuugaugaggucucacucugucacccaggcuggaguacaguaaaugugaucauagcucacugcagcuucaaacuccuaggaucaagcagucuucccaccucagccucccuggcuaauuuuuuuuuuucuuuuuuugagauggagucuugcacugucacccagguuggagugcaguggcaugaucuccacugcaaccuccaccuccuggguucaagugauucuccugccucggccucccgaguagcugggguuacagacaccugccuccaagcccagcuaauuuuuuuguauuuuuaguagagacaggguuucacuauguuggccaggguggucuuuaacuccugaccucgugauucguccuccuuggccuuccaaagugccgggauuacaggugugagccaccgcaccuggcaccuggccccuggcuaauuuuuuaaauuuuuuaaauuuuaauuucuugagacacggucucgcuuuguugccuaggcuggagugcaguggcgugaucguggcucacugcggcuuugaccuucggaagcaauccucccaccucagccucccaaguagcuaggaccauaggcacaagccaccacaccuggauaauuuaaaaaaaaaaaaauucuugguagagaugggggucucucugcguagcccaggguguucuuuaacuccugaccucaagugauccuccaccuuuagccuccugagucgcucagauuacaggugugaaccaguguacccagcuccuguuuguuuauuuuguuuuguuguuucuuauuuguuaaugguaucuuuugaugaacagaacauuuuaauuuggauauaguaaaaauuuaccaauuuuuucuguuaugauuauuuugugucuuaagaaaauuuugccugcaccagguuguguagaugcugcccuguguuuuuuguagaagcuuuacagugguagcuuuuguauuuaggucugucauccaucuuuuucuuuuuaacagcuuuauugagauaaaauuaauaugauaaacuauacaugcuuaaaguauaaaauuugauaaguuuugacauauguauacauuugugaaauugucacuauagucaggauaguaaacauauucauuguccccagaauuuccucaugcgccauugggauucuuuccuuccacucuauccuuucccuccuucucuaagcaacugcugaucucuuuucuguaugauccaucuugcuuuaauuuuugugugugaugugagguggggucaggaugcauuuuucuccauauggauaugcaauuauucugccaucauuuguugaaaggacucucuucuccauucaauuccauuggaaccuuuguuauaaauuaauuaaacaugucugcaggcuuauuucuguuuuuucuguuccauugguuuauuuucuauccuguguuaacaccgcgaugucuugauuauuguaacuuaaugguauauccugaaaccaaguaguguaaaagaaccgccccccccccccccccaacucuuuuuuugagacggagucucacccuauugccaggcuggaguucaguggcgcgaucuccacucacugcaaccuccaccuccuggguuugagugauuuuccugccucagccucccgaguagcugggauuaugggcaccagccaccacgcccagcuaauguuuguauuguuaguagagacacgguuucauccuguuggccaggcuggucuuuuuuuuuuuuuuuuuuugaaacugagucuugcucugucgcccaggcuggagugcaguggcgugaucuccgcucacugcaagcucugccucccggcuucaugccauucuccugccucagccucccgagcagcugggacuacaggcgcccaccaccgcacccggcuaauuuuuuguauuuuuaguagagaugggguuugccguguuagccaggauggucucgaucuccugaccuugugaucugcccgccucggccucccaaagugcugggauuacaggcaugagccaccaugcccggccuguggaguguuuuuuuuuaugaugaaaaagguuuauauuuugucagaugcuuuuucuguguauguugagaugaucacuuguguuuuguccuuuauccacaugugauauguuaaauuaauugauuuucggguguuaaagcaagcuugcauucuugggauuaaauccccugugguaugguguagaauccuuuuuauaugugguuggauuugguuugguaguguuuuguugaggcuuuuuacaucuaccuucuuaagaaauauuugugugugacuuucuuuucuuuugaugucuuugguuuugguaucaagguaauacugggacccauagaaugaguugggaaauucuucauuucuuuuacagaucagauuucuauccgggauuauuuuccuucaggauuucuuguaauguggguaugauaaggacaaauucccucagcuuuuguuugucuuaaaaugucuuuauuuauauuuuuguuuucaaaggauauuuuugcuugauacagaauucuagguuaacagcuuuuuuuuucccuuucagcacuuuuuuuuuuuuuugagauggacucuugcucugucauggaggcuggaaugcaauggcacaaugucggcucacugcaaccuccaucuccuggguucaagcgauucuccugccucagccucccaaguagcugggacuacaggugcgugccaccacgccuggcugauuuuuguauuuuuaguagagauggggcuucaccguguuggccaggauggucuugaucucuugaccucaugaucugccugccuuggccucccaaagugcugggauuauaggcgugagccaccaugcucagccuuuuuuuuuuuuuuuuuuaagagagacagggucuccucugcugcccacuuggaagugcaagugguaugaacacaugaucaugacucacugcagucuugaacucucaggcauaagagacccuccugccucaguuuccugaguugcuaggacugcaaguacaugccaccacaccuggcuaauuuaaaaaaagguuuuuagagauggggucucucuguguugcucaggcuggucuugaacuccuggcuucaagcaauccuccugccuggaccucccaaagcauggggauuauaggugugaggcaccauuccuggcccaggagaucuguauuuuuaucccuguuuaccgaggagccacagagaagcuggcaguuagcuacacugucagagcucacagauaggacaccuauugggugugagccagggagcugaccugugcuucugcccacuguugcugcucacaccagucucucucagguuuggcacuguguagagucugucaguaucuguuuucucugcuagacgucagguuccuuggggcaugacuagguuugucccauuauuagcuacauuuguugcugaaugaacugacugaugcccaguguccucucucugggcuacuguggacagucagaccuuuaggagcucuucaagaauuugacugucacucaucauccuguugacugcuccacuuugaagacuugacuucucucuccucaugaucccaccaucucuaagccuguggaacucugcucugacccuuucucagcucuuugcugugaugcccuuccuggacuaguucgguccuggguagugccuuccugucaucacccucaaucuuggucauuccuuuuggauuuccuuugauaacuccuuuuuuucuucauugacucagucagaaucugguuaucauauggagacugagaacaugggcuuugcucucagccaaaccuggguucaaguucuagaacggauacuuacuagcccaugacguugcgcuagucauguaauuacugagaccucugcuuuuuacuugugaacuggggguugguaggaaacuaccugcugcauuaggcuuugagcuuugaguguacggaugaagccagcuacugccacucuccuguggcugcuggaacccuaaaggcaguuuguuggcucuuacuucuucugugcgucuuguuuggacuugagcuuuguucacugccccaguuuccucccugcugcuuuuuggugcuguuuucugcuuguuugacaaugcuuuuuaucuagcuugccuucagcuauuuuuccuucaacagucucagcccagaguaugcccugcuugucuuccuuugacccaggacccagaguaugcccugcucgucugccuuugacucuuuguucugguacuuguuuucccaggauuauauuauugacaacaaauauagcauaggugcgcugucugucuuguggugcgcguaggugcggacuagggccuugcuguggugggccuuugguuuccugcaguugauuguuuuucucucuaggccccuuggaggcaucugguauuagucacuguccuagggcagugguggcagucaugacuguucucugucuuggagucaacacuuuuaccugcagugcacaugcagcaggcacuugcccaagguuccagagcugcucagugauggaaacuggacuuuaugccuggaccuuuguggucagggacugcccugauguggccaggccucccuggcucaagagguucucuggcugccuggagggucugcauugggcuccaggaaggggaggagucggggcuagggcccuuagcacuggugaugaggaaggugcauccucauaaugcuggccaucucuguccuuaacugggagagcugccaugguugcuaguguugagcagauggagguuuucaguuuucacuugagccuucauccuauguaacagccaggaggauacucuucugagccuggcgugggccugacagccaucucucggggcuguguguuaaagucaccuuucugagacuuuggugggagaccagcugggccuccgcugcugggaggagaauugcuaccuugggagcuugaagaccuuggaaugugcagcgacgucagcucuucucagcccgucgcugaguccuuacuguguucccguugcagagcacgugcucugcauggaggccucaugccauccuuaguugguggaagggcucaaagacaggcagggugcuagggacugaauugugucguguccaccccagauuccuauguugaaauccuaaguuccauuuagugguauuuggagggaggccuuuaggagauaauuagguuccgugaggucaccagguggggcucucaagaugggacugacacccucauacaaagauacaccagagagcuugcucucacccucccugcugugaggacacagugagaaggcaauggucuaagggcagggaagacaggcuuucucagcaaccuaauuggccagcaccuugaccuuggacuucuaggccccagaacugugaggaauaauugucugcuguugaagguguuguauucuggccgccuaagcauacgaagacaccgggucaguggagggcaagaagguggcuggcucucuggcagagcagucauugaagacuggcuccuuagccacugguggccugaggauguauuuagcuuguccugcauuuuauuggcccacauaguguucaaaaguuaauuauaaacaugaagauguggggauuuaaaaaaaauguggauuuuugucacuucuuguagaagcagacaugugcuggugcccuguguccuugcacggcugugauugcuggggugggccugucucugcucccuuccaugcccucuugugcugcagccuucacucugcugcugucuuuuccgccagcuuccuuccuuacacuuagcaucuugccuuguucugcaggccuuuaaguugcaaucugugcuuuaggauguggcaggagaaucagcagucgggugacugggcacuucuccauugccacaguuaagaaaggcuuuuacuucagaauuauagugcucuaguauguucaucucugaguagagcaagcuuccuuuuuuucccuuucauauuccuggugucuggaguuagccuaggccugagugcuuccaaugcucaugcaaagcuuuuuccggaggaagauucuccaccuuuucacuguguuucuuggcucuucuucuugagggcauaugguagagucaggagcuggcaaccugcagaauggagaagccagcuccgcuguccgcagcugcugcucaugagccuuucaaucucucuccugcuucugcucuuacggacggaccuggaguccuacuagagcugggcucaucugaccauucagcgugcuccagggggacuuguuucaggauccagucucugcuguuuccucaucaauuugguuccauuuacuuauuuuacuagaaaauuuuaaaguaaagggugaagaauaaccaagacaagugugaaaaagaauaagaagggaguugcuguaacagauuuucaaacuuuuuuuuuuuuuuuuugagacggaguuuuugcucuugucgcccaggcuggaguacaguggcgcaaucucggcccacugcaaccuuugccucccggguucaggcgauucuccugccuaagccucccgaguagcugggauuacaggcaugcaccaccacgucuggcuaguuuuuuuguauuuuuaguagagacgggguugcaccauguuaaccaggcuggucucaaacuccugaccucaggugaucugcccaccucggccucccaaagugcugggauuacaggcuugagucaccgugccuggcccagguuuucagacuuauugugaggccaguggaauggauagccuggaaaaggacccuguauaaaugggaacuugguauaugagagaagugucauacuugaaauauguauuuaaagcaauguaccauuuuuagguauauaagucauaaaauaaugaaauuacggauacugcaaguuagugauugucucucaagaaggggauugcuugaguuccuggguuccucagugucguagaaacauuuguuuaagaaggaggcacauacaaacaaauguuaguguuuguuaagucucaucacauggauauuauguccuucucuagacuucaauauauuuaaaaaauuucauaauuaaaaauaaaaauauuuaaaacugaguuauaauucucugaaagauauaaacagucuugugagagcacugaggagggacucagaaaguugacaaagguagcuauagauggucuucagauaggaagaucaggcaagaguuugucaaauagagaaagugggaagaaggcauuccagucagagggucugugugugcaaagguguuagcugggggagacacucagcauauuuagauaguuuugguacgguuauggaaucagguggggaugaggaaagagugccaaaguuguauugugugcgggucccacuuaaugugucaucguguagaggcuuacagcagaaguacgguguauucuuuauucccuguuugucuuuuucuaccuuauuuuggauuaagaauguuuuuaugugugaugguauuagaaggugggcauaaaaagaaaaaaaaucuuuuaugauucucuuugggucuuuguauaucuuccaugucuuuacuuaaucuuuccuuuagguucuugaacauaugagauacuuuuuuuuuuuuuuuuuuugagacggaguuuugcucuuguugcccaggcuggauuguaauggcgcaaucucggcucaccgcaaccuccaccucccggguucaagcaauucuccugccucagcgucccaaguagcugggauuacaggcaugcaccaccacaccuggcuaauuuuauauuuuuaguagagacgggguuucuucauguuggccaggcuggucuugaacucccgaccucaggcgaugcaucugccucggccucccaaagugcugggauuacagguaugagccgccgugccuggcaugagauacacuuauaagaacuauuuaggcugggcauaguggcucacgccuguaaucccagcacuuucggaggccgagguggguggaucaugaggucaggagaucgagaccauccuggcuaacacggugaaaccucgucucuacuaaaaaauacaaaaaauuagcccggcgugguggcgggcgccuguagucccagcuacucgggaggcugaggcaggagaauggcaugaacccgggaggcggagcuugcagugagcugagaucacaccacugcauuccagccugugcgacagagcaagacucugucucaaaaaaaaaaaaaaaagaaccauuuaaauguccuuaucaauucuuuauuuauuauuauuuuuuuagagacaguguucuguuugcucugucacucaggcuggauugcaguggugcaauccuggcucacugcaaccucaaacuccaggccucaagugauucucccaccuugcuccugaguagcugggauuauagacaugagccccuguaccagcauuaucuguuaacucaucugugucauuucuggguugguuuuguguuguuuuuccccucauuaugguuuaugauuuuucuuuuccugcucccuugcaugccuagaacuuuuugaucagaugcccagacuuugugaauuuuaucuuguuggauacugagcauuuuuguguuccuauaaauauucuugaccuuuguucugggaugagguucaauuacuuggaaacaguuugauucugauaggucuugcauuucagcuuuguuagguggaacccuaguaauuuuuagucuagggcuaguuuugcucugccacugaggcaaacgucuucugagcauuacguccaaagccuugugaauuacaagguuuuccacugcaacuggcaggaauaggcucugcgugagcuuugaggauuguucccucucaucuuuuuuuuuuuuuuuuuuaaauggagucucgcucugucaccuaggcuggagugcaguggugcaaucccagcucacugcagccuccggguucaagcaguucuccuuccucagccuccccaguagcugggauuacaggugcccgccaccaugcccagcuaauuuuuguauuuuuaguagagauggaguuucaccguguuggccaggcuggucucgaacuccugaccucaggugauccaccggccucggccucccaaagugcugggauuacaggugugagccaccgcacccggccccucucaucuuuuugagugaugcuuucccuggcuugaauaccuuccuuacacacaugcacugaucagugcuuggcuggagacuggagugggagguguccuguguggaucuucagcauuugcugugagcucugcccucugguguucugccugugaacucgagcuaccuuggacugccugaacuccuaguuuugauuuuucaagucagagacugccagccagccuccacugcuucuucuuccuugggcuguggccuggcuuuuccagcagaagcuggacaacuacagggcucccuccugucuuuuguuuccuuuuuucagggacccuucacugccuggcguccagugucuagugucuugaaaaccauugcuucccuauguuuucuuuuuuuuuuuuaguuguugcagaugggaaguaaaucuggucuguuccgucuuggccagaaacaaaagcauaaaaaauggaggcuuuuuaaugaaagcuuaaguuaguguagaaauacucacgggcaccuagaagaaugcugacccacuuucugguugagaugugggagcggaggaugccuggacaggggagcagaggaugccuggacaggggagcgggggacgccuggauaggagggcagagguggcuuucucccggguaggcaucaaagcacuuggaguauguagcgaagaugaugggaguagggcuuggaagaaguuucccuagaaaaaucaagggcuacagaaugagaugcugagggaaugauaagaaagcgauugaagucugcccuccugagacagaaucuuagguggagggcacaggcaaaagaaggcuuauauccugcagugggagaguguaggaggcugugauguugccgggggagcagugggcagaggaugagggguggaugcuuaggauguaccuguuaaggagugggccuggagcugcccgucucuccuaugcugucacaguugccauucaaggcacauaguuaaguagaaaaugaaaaagggagggaaggaccuuugcuuccaguauuauuagaugcuguuaccagacugucccauuacaguccaauuagaugcuggauaaauuacaauaaauauaauugcuuuauuuuuuguuuuguguuguuuuuugagacaguguaggguccagcccuacagggccuguggguuuuucucuuugugugcggagacgagagaucguagaaauaaagacauaaagcaaagagauagaagaaaagacaguugggccugggggaccacuacuaccaagacacggagacccguaguggccccgaaugccuggcugcgcuguuauuuauuggauacaggcaagggggcaggguaaggagugugaguggccuccaaugauagauaaggucaugcgagucacguguccacuggacagggggccggcccuucccuguuugguagccgaggcggacagagagagaagagcuuacgucauuauuucuucuaugcauuucaaagacguuaguacuuucacuaauucugcuacugcuaucuagaaggcggagccagguguacagggcgaaacaugaaaauggaccaggagcgugaccgcugaagcacagcaucacagagacguuuacgccuccagauggcugcgggcgggccugacugaugucaggccuuccacaggaggugguggagcagagucuucugucgcucgcccaggaaagggagacagacucccuuucccagucugcuaaguaacgggugccuucucaggcacuggcgcuaccacuagaccaaggaguccuuuaguggcccugucugggcgugacagaaggcucacacucuugucuucuggucacuucucaccaugucccuucagcuccuaucucuguauggccugguuuuuccuagguuauaauuguagaacaaagauuauuauaauauuggaauaaagaguaaugcuacaaacuaaugauuaauaauauucacauauaucuauaaucuauuucuaguauaacuauucuuacuuuauauauuuuauuuauuauacuggaacagcucgugcccucagucucuugccuuggcaccuggguagcuugccgcccacaauacaaggucucacuuugucacccaggcuggagugcaguggugugaucauagcucaccacaaccaugcacacuuaggccgaagggauccucccacuucaauccugaguagcugggacugcaggcgugcaccaccacaccuggcuaaugcuggugcuguuuagggacacacacauucuuccuccagcucacacugaguagaauuuguuaagaagaugcaugcuacaaaaucauugacucaagauuagaauaaacaggcccaagaucaaaaacauuucuuggccgggugcaguggcucacgccuguaaucccagcacuuugggaggccgaggugggcggaucagcugagguugggaguucacgaccagccugaccaacauggagaaacccugucucuacuaaaaauacaaaauuagcugggugugguggugcgugccugcaaucccagcuacuugggaggcugaggcaggagaaucgcuugaaccuaggaggcggagguuguggugagccgagaucacgccauugcacuccagccugggcaacaagagugaaauuccaucuaaaaaaaaaaaaagaaaacacauuucuuuauuuugaaaacuguauaaaguuuuagaaaagugggcugaaagccuauuuugaguuauuuagcuuaauuuuaaucaugaaguguuagguauaaaaaguauuaccuguuuuagaaggugguaacacugacuuaucccugggcuacuggcaccacuuugaguaucuuuuuuguuugauuuuuauuuuuuauuuuuuuagagauggggucucacucuguuacccaagcugcaguacaguagugugauuguggcucacugcagccuuuuauuuuauuuuauuuuuugagacagagucucacucuguugcccaggcuggaguggcucacugcaaccucugccuccaggguucaagcaauucucuugccucagccuccugaguaucugggauuagaggcguacgcccggcuaauuuuuuguguuuuuaguagaggcaggguuucaccauguuggccaggcuggucuugaacuccugaccucaagugaucacccaccucggccucccaaagugcugggauuacaggugugagccaccgcgccugaccuuucacugcagccucgaacuccugugcucaagcaguccucccacucagccucccaaguaucugggaccacaggugugugccaccacacccagcuaaguaauuuuuuuuuuuuuuuuuuuuuuaaguagaggcaaggucucgcuguguugcucaggcuggucuuaaacuccagcacuuaagugauccuccugccuuggcuucccaaagugcugggauuacagaugugagccaccacaucccaccuuuuugauuuguauauaaaauguaaaaauaugcaaaaguagagaaaacauaauuaacaucuauguacccaucaccuaacuucgacagugaucgacacuuuuuuuuuauuuugaaagaucugauuuuauuuucugaaucaaaaguaaguguauucauguuaaauuuagaauguuuuagcuuuccauugaucuuucaagaugcuuuccaaauacuaacagugcacagaacuaugugccacgucuuguuuguuuguuuuugagauggagucuugcacugucaccagggcuggagugcaauggcgcgaucucggcucacugcaaccucugccucccagguucaagcaauucuccugccucagccucccgaggagaugggauuacaggcgccugccaccacgcccagcuaauuuuuuguguuuuuaguagagaugggguuucacuauguuggccagacuggucucgaaugccugaccucgugauccacccgccuuggccucccaaagugcugggauuacaggcgugagccaccacgccuggccacgcuauguuuuaaagaaaaaaguuuaaaaguaggaccuauuucuuuuuuucuuuucauuuuuuugagacggagucucacucuguugcccaggcuggagugcaguggcgugaucucggcucacugcaaccucugccucccggguucaagugauucuccugccucagccucccgaguagcugggauuacaggcgccugccauugugccucgcuaguuuuuguauuuuuaguagagacgggguuucaccauguuggccaggcuaaucuugaacuccugaccucaugauccacccgccucggccucccaaaguguugggauuauaggcgugagccacugcccccagccacaaauguaggaccuauuucuaagaaacccuuuguagaggucaggguauugggaauccuaauuuaaaaauauuuuuaaucauuauuggaaauuuaagugacaguggguucaagagcuaaacgucagaccuuuuuuaaaacaaauuuuauuuucugaaggacuucauaccugacaacgccaauuaaacauaauacuccacccauccuacaaauuauuaaauacauuauuucaccugggacuaggauaauuauaaaauggaauuuuaaaguuguaauauagccaggcacagugguuugugcuuguaauuccugcuacucagcaggcuguggcaggaggaucacuugagggcuguaaugugcugugugaacugggugucugcacuaaguucggcaucaguauggugaccucccagaaaaggaagacugccagguugccuaaggaggugugaaccagcugagguuggaaauggagcacaucagaaacucccaugcugguuaguagugggacuggagcugugaauagcuacugcucuccacccugggcagcauagugagaccccaucucuuuaaaaaagaaaaaaaaaagaaaacuaucuuaaaauaucauuuuaacugucauguuugcuaguugaauuaugaaaucaaagacaaauuuuauauuuaagggacagauaauaaaugcuguuccauugcuuuauuuuuaaaauuuuguaauugcuuuuuuuugagauggggucagucucuggucacccaggcuggagugcaguggcaugaucucagcucacugcaaccucugccucccaggcuccagugaucccgccucagccucccgaguagcugggacuacaggcaugcgccaccacacccggcuaauuuuuguauuuuuugguagaaaugagguuuuuccaugucacccaagcuagucuuaaacucuuggacucaagugaucugccgccuuggccucccauucuguggggauuaaaggugugagccaccgcacccugccuccuuuuccuguugucugccauuuugauaaguuaacuuuaccgaggaagaacuuaaagcaagauuuuuccucuuauuuuucagguaaagagauuauaaaucuuccacugaaugaaaaaaauuuucuuaaagcugcauauacuccaagaaaaaaaccacaaauguuuuucuguuuugccugaauacaugauuuaaacaagagauuuccacagaagguaagauaaguuucuuuuucaauuugauucuguuuuauuguguaauuuauguaaaaguucuguacagguggaaguucaaagaugggucacagcgaaaaacguaguuuagaagauaugcuggcugggcacuguggcucacaccuguaaucucagcacuuugggaggccgagguggguggaucaugagaucaggaguucgagaccagccugaccaacaugaugaaacccgucucuacugaaaauacaaaaauuagcugggcauagugguguguaccuguaaucccagcuacucaggaggcugaggcaggagaaucgcuugaauccaggagauggagguugcagugagccgagaucgugucacuguacuccagucugggcgacagagcaagacucuguuucaaaacaaaacaaaacaaaacaaaaaaacagaugugcucauggucuguugucuuuuggugguuuuugauccuccugugucugguuuugagaugcucugcauguuuuugagcaaguugcuuggucuuuccaagcccaaguuuaauucuucuuuuuuuuuugagacggagucuugcucuguugcccaggcuggagugcaguggugugaucucggcucacugcaaccuccaccucccgggaucaagcgauucuucuuccucagccucccaaguagcugggacuacaggcacgcaccaccacaccuggcuaauuuuuguauuuguaguagagacgggguuucaccauauugaccaggguggucucgaacuccugaccuugugauccgcccgccucggccucccaaagugcugggauagcaggcgugagccaccgcgcccuguccaaaguuuaauucugacaaaacaggaacaguuuugcacauauuuaaugagguauauguuccgucucacuugcagggaacaugugagauacagcauauacacugucacaguugccauucaaaccacacaguuacgcagaaaaugaaaaggggagggaaggaccucugcuuccagcaauauaagauacucuuacgaggcucuuccauugcaguucagugagaugcuggauaaauuagaauaaauauaauuucuuucuuuuuuuuuuuuuuuuuuugagacagagucuugcucagucgcccaggcuggagugcaguggcgcgaucucggcucacugcaagcuccaccuccuggguucaugccauucuccugccucagccucccgaguagcugggacuacaggcacccgccagcacgcccggcuaauuuuuuuuguauuuguaguagagacggcauuucaccauguuagccaggauggucucgaucuccugaccucgugauccgcccgccucggccucccaaagugcugggauuacaggcgugagccaccgcgcccagccuaauuucuuuauucuuuauuuuuuuucaagacaaggucucacuuugucacccaggcuggagugcaguggugugaucauagcucaccacaaccauguacaccuaggcugaaaggaaccucucacuuaagucuccucaguagcugggacuauaggaaugcaccacuacggcuaauuuauuuauuuauauauuuuuauguguuuuuuuuugugagacagagucuugcucuguugcccaugcuggagugcaauggcaugaccuugacucacugcaaccuccgccuccuggguucaagcgaauuuccugcgucagccucccgaauagcugggauuacaggcaccagccaccaugccuggcugauuuuuguguuuuuaguagugacgggguuucaccacguuggucaggcuggucuugaauuccugaccucaagcaauccacccaccucagccucccaaauuacugggauuauuauaggcgugagccaccgcacccagcccaccauggcuaauuuaaaaacaauuuuuuuagagauggggucucacuguguuguccagacuggucuugaacuccugggccgaagugauccuccugccuuggccucccaaagugccgagauuauaggugugaguuaccacgcuuggccaaauauaauuucugugagcacucugaugcguuaaaaauuaagaugacccagcugggcggauggauggcuugagucugaaagguggagguugcagcgagacaagaucgugccgcugcccuccagccugggugacagagccagacccugucucaaaaaaaagaaacccaccaaaauucaacauauggauuaaacagauuaaacacagaugcagauggaauugguaaagugaaacacagugaaagacauuauccaaagugcagcccugagagaucagugaugguaguaaauauguagcuggaauucuagaaugaaaaaaucaggaauauugaagagauguauuauucgaaguauuaauagcuuugaacuuucagaaacuaauaaaagaccuaaauccauagguuuaggaaucacaauaugucccaaucaauauuuuuagaaaaaaacaaacccagccaggugcaguaguucacgccuguaaucccagcacuuugggaggccaaggugggcggaucauaaggucaggagauugagaccaucuuugcuaauacggugaaaccccgugucuacuaaaaauacaaaaauuagccgggcgugguggugcgcgccuguauucccagcuacucaggaggcugaggcaggagaauugcuugaacgugggagauggauguugcagugagccaagaucacgcuacugcgcuccagccugggcgagagcgagacucugucucaaaaaaaaaaaaaaaaaaaagagaaaaagaaaaaaacaaacccacacccauacacugaaaucguauagcaccaaagacaaaaagaagguguuaagguaaaguuaaaagauagauuaccuaaaauggaacauuagcuagguugacaacagaugucucagcagcaugaauggaagccaguagagaguagaauaauuccucaaagcgacgagagcauguauguuuuauuauagaaucguguuaucaaauaaauuuugcaagaaaaauggcaagguuuuauguuucugagaauguuaggcuagguuagacuaccuucuacucccccacccuccaccccagaaaaacagccacaauuguuagaugaaaaaacauaaauaaaagaacugacaaaaaagcaggaaacuuuuggaucaaaaucuaacugaaaauaacgcagaaagguaauuuaaacaccauagaauggggucugcuuuuguccugagggcauuugcucauguggacaaaguggggcuuugaguuuagaggauuugugaaaagaacaguaguuaagcucgauuccucucaagguaaauagccuaaaggagacccuccccacaccgauggaacucugaagggcucuauccucaaggugugagggcagacuagaggcacaugugccucacaccguuccuugcccucaucugguugucuuuuuacuaaauguagcacaaaaagaugaaaagggaaaaaaaccuguuccugagaauuguagcucuguauuggccuuugugaggauuuuuagcccaguuacauugccugguaguucagggaaaucgggcaugaauuuaauucaagguguuucuagcuugucaucugacaggaacaaagauaaaaccucucuggaagaaguuaccuucauccuaagauacaaagaaucccugcagauuuuuuuuuuuuuuuuuuuuuuuuuugagauggagucuugcuuuguaucccaggcugaagugcaguagcacaaucucgguucacugcaaccucugccucccagguugaagcgauucuccuaccucagccuugcaaguagcugggacuauaggcguguguccggcuaauuuuuguauuuuuaguaaggacgggguuucacuguguuggccaggcuggucuugaacuccugaccucaggugauccgccugcagauauuuuuuaaagacagugauuaauaguacacagacaaaaaugacuaagcacacaagcaaauaagccacucugaguuaaaaccaguacaguucaggugugguggcucaugccuguaaccccagcauauugggaggcugaggcaggaggauggcuugaguccaugaguuugaggcugcugugagcuaugauugcaccgcugcacuccagccugggugacaaagugaaaccuugucucaaaaaaacccccagaaaaugaaaacaggaaaaccaguagaaacacuuccucaaagacuucagguauuggaauuguuagaaacagacuauaaaaaaaguguacuuuuuguaugugugugagaaggucuuacucugucgccuaggcuggaguuggaguacaguggcgugaucuuggcucacugcaacuuccgccuccugggcucaagugauccuucugucucagccuucugaguggcugggacuacaggcacacaccaccacaccuggcuaauucuuuguauuuuuuguaaaaacagguuuuugccguguugcccaggcuggucuugaauuccuggcuuuaagcaaucugcccaccucggccuccuaaaguacuggaauuacaggcgugaucuagcaugcuggcugagugugcuucuuauuuuuaaagaaauaaauauuuggcugggugcaguggcucacgccuguaaucccagcaguuugggaggccgaggcgggcagaucacaaggucaggagauggagaccauggugaaaccccgugucuacuaaaaauacaaaaaauuagccgggcgcgguggcaggcgccuguagucccagcuacucgggaggcugagacaggagaauggcgugaacccaggaggcggagcuugcagugagccaagaucacaccacugcccuccagccugggcaacagagcgagacuccgucucaaaaaaauaaaaaauaaaaagaaauaaauauuuaacaacauaaaaauauuuguaagaaacaguaaaaggugauauagaauauuugaaaaaggaccauguagaacuucuagaaauaaagaauaaaauauucaguaucacaaauucaggccaggugagguggcucaugcuuguaaucccaguacuuugggagguagagguagggagaucacuugagcccagaaguucaagaccagccugggcaacauggugaaaaccugucucuacaaagaauuuuuaaaauuagccaggcgugguggugcacaccuguagucccagcuacuugggaggcugaggugggaagaucacucgagcccaggaggucaagccaucauugugcaagugcacugcagccugggugacagaacaagacccucucucaauaauaauaauaauaauucaguguguacagguuuaauaacaaaauauauacagugaagugaaaaucagugaaccagaaaacaggucagaaggaauuacccagaaugaagcacagagaaaaugaugggaaacauaggccagaacaugggacaucgagggcaaaugucuaauggauguuuacuuaauguucuguaaagagaaaagagagaaugaggcagauuuauuauuagaaaagauaaagacuaaaauuucucagaauuggugaaagaagucuacagauuuaggccaggcgcgguggcugacgccuguaaucccaguacuuugggaggcugaggcgggaggaucacaaggucaagaguuccagaccagccuggccagcauggugaaacccugucucuacuaaaaacacaaaaaguagcucagcgugguggcacgcaccuguaaucccagcuacucacgaggcugagguaggagaauugcuugaccccagaaggcggagguugcagugagcugagcuugagcgcuccagccugggugacagagcaagacuccgucucaaaauaaaagaagucuacagauuugagaagacaaaugaaugguaagcaggauaaauaaaaauaaaauuuauagcuagccaaaggagaguaaaacuacaaagcaccaaagaguguucuuaaaauaaacgaaaaacacagaucaacuuuaucugagcagcaguaagaaugauggcugacuucuuaagugccacaauggaaaccagaagccaguggaguaauauuuucauugugcugaaaguaaaacaauuccugacuucuaacuuuauaucaggaaaaauuaucuuucaaaaaaauuaucugcuguaggcugggugcggugggucacccuguaaucccagcacuuugggaggcugaggcagguggaucaccugagguggggaguucgagaccagccugaccagcguggagaaaccccaucucuacuaaaaauacaaaauuagccagacgugguggugcaugccuguaaucccagcuacuugggaggcugaggcaggagaacugcuugaaccugggagguggagguuguggugagcugagauggcgccauugcacuccagccugggcaacaagagcaaaacucugaaaaaaaaaaauuaucuacuguaguugaauguuuaugucccuccagaauucauauugaaacuuaauccccaaugcaauaguuuuaagagguggggcuuaccagccugagcaacauggugaaaccccaucucuacaaaaaaaaaaaaaauuagcugggccugguggggcaugccuguagacccaccuacuuggguggcugaggcaggaggaucacucgagcccaggagauugagacugcagugagccaugauugcacugcugcacuccugccugagcaacagaauuaaacccugucccaauuaaaaaaaaaaaaaaaaaggugaggccuagaauaugaugaggccgugagggcuccacucucaugaaugggauuagugccuuguagaagggcuugagggagucuguuagucccuuuugccaugugaggacacaguggaggcaccaucugugaaaauuagguccucaucacacacugaaucugcugcugccuugguuuuggauuucccaucucccagagcugugagaaauaauuuucuguuguuuauaaauuacccagucuaagauauuuuguuauagcagcagaaacaggcuaagacacaguccuuuacuaaauacaauucucaagaauaggggccaggcacagugauucaugccuguaaucccagcacuuugagaggcuaagaaggguggauugcuugaguccagaagcuugagaccagccugggugauguggugaaaccccgucucuacaaaaaaauaaaaaaauuagccgggagcgguggugcaugccuguaguuccagcuacuugggaggcugaggugggaguaucacuugagccuggagguggaggcuguaguaaguuaagaucacaccacugcacucuagccugggugacagagugagaccccguaucaaaguaaaauaaaagauagaauggacuuuaggcagaaaacagugauccuaaauggaagaacugagauucaaaaaagaaugcaaagcaaauaugugagcaaauucaaauuagcauuggaggggugcaguggcuccugccuguaauuccagcacuuugggagggucacuugagcccaggaguuugagaccagccugggccacauagggagaccuugucucuacaaauaauaaaaaaauuagcugggcaugguggcacauuccuguagucccagauacuuaggaggcugagaugggaggaucacgugagccuuggaaguugacauugccgugaucacaccaccauacuccagccuggguggcagaccgaaacccuguccccuccaaaaaaccccacuaauuguuuaguaauauaauaauaucuaugggguaaaaucaagguagaauuucauaauacaugaaaauaguaacaaauaagucaugaaggagaguaaaugaaguuaaaacauuccagucuuuguaguagcugugucuuaguccauuuguguugcuauaaaggaauaccagaggguggguaauuuauaaggaaaagagguuugacacaguucugguucugguaagaguuucaggcugcuuccgcucauggcaaaaguucaaggggagccaaagggaagcuagcuuguagagaccccguggugauagagaggaagagagagaaagagaaggugccagucuuuuucuuuuuuuuuuuugguauuuuuaguagagaugggguuuuaccguguuagccaggacggucucgaucuccugaccucgugauccacccgccucagccucccaaagugcuggguuacaggcgugagccaccacgccugauguuuuuuuuuuugagauggagucucucugccacccaggcuggagugcaguggugcagucucggcucacugcaaccucuaccucccagauucaagugauucuccugcuucagccucccgaguagcugggauuacaggugcccgccaccacacgcagcuaauuuuuguauuuuuaguagagacgggguuucacuacguuggccgggcugaucucgaacuccugaccucgugauccaaccacuuuugccucccaaagugcugggauuacaggugugagccacugugccugggugccaggcuuuuucaacaaccaguucucuugggaacuaagagugagaacuggccgggugcgguggcucacgccuguaaucccagcacuuugggaggccgaggcggguggaucacgaggucaggagaucgagaccauccuggcuaacacagugaaaccccuucacuacuaaaaauacaaaaaauuagccgggcgugguggcgggcaccuauagucccagcuauucgggaggcugaggcaggagaauggccugaacccaggaggcggagcuugcagugagccgagauuacgccacugcacuccagccugggcgacagcgagacuccaucucaaaaaaaaaaaaaaaaaauuagcugggcgaggcaggagaaucacuugaaccugggagguggauguugcagugagccaagaucacgccauugcacuccagccugggugacaggaaugaaacuuugucucaaaaaaaaaaaaaaaaagagaacucaguuacucccucaagaauggcaccaaaccauuuacgagggaucuuccccgacaaccagaaccccuccuaccaggcuccaccucagcauggggcaccacacgggccccaccucagcaucacacgggccucaccucagcaccacacgggccccaccucagcaccacacgggccccaccucagcaucacacgggccucaccucagcaucacacgggccccaccucagcaccacacgggccccaccucagcaucacacgggccccaccucagcaccacacgggccccaccucagcaucacacgggccccaccucagcaccacacgggccccacuucagcaccacacgggccccaccucagcaugaggcaucccaguuuaacaucaggcuugguggggccaaagaaaccauauccaaauuacagcaaacuaggauagggauuaacuguagauuuuaauaagugcaguuuacaaguucuaaggaauuauuguaggaauagaaacuggccaggcgugguggcucacgccuguaaucccagcacuuugggaggccgaggcggguggaucacgagaucaggagauugagaccacggugaaaccccgucucuacuaaaaauacaaaaaauuagccgggcacgguggcgggcucccguagucccagcuacucaggaggcugagacaggagaauggcgugaacccgggaggcggagcuugcagugugcugagaucacaccacugcacuccagcccgggugacagagcgagacuccgucucaaaaaaaaaaaaaagaaaaaaaaggaauagaaacuguacaauuuccaaauuagugaagagaaaguaguggaccuuccuuuauucuuguaaggaaaagcugcaacaauuuuuuuagcaaccauuaacuaaaugauaauauauauugaaaacuuaaccugugaaaauggaaagaagacagggugcaugcuuuuaccacuugagaauagugauggaagucuuagcccaauaaaucagaaaaaggauaaaaagauaaaagaauuuaaaaggaagaaacaaucuauuauucguuggugauacuauuauguauguagaaaauccaaaaugauccaaagcuauaauacagucaauucuuuacccaaacagcuuuaaagucaauaaucuuuuagcaauugucuggauaaaaaagucaaacagggcacgguggcucaugccuguaaucccagcacuuugggaggcuaaggcgggcggaucacaaggucaggaguucgagaccagccugacuaacauggugaaaccccgucucuacuaaaaauacaaaaacuaagccaggcaugguggcucacgccuguaaucccaggccugggcuaggcaaaagggugaaaauccgucuccaaaaaaaaaaaaaaauucaaacaaaaauaaauuacaguguaccaccaacaaacacacugaaguuaaaaaguagaauuauaaauaaaaaauaccugggaauaaaauaaaagauguguaaaaccuuuauggagagcacuauacaauuuugaaagcaauuaaagacuugaauaaaugggcagagguacccugguuuuggauuggaaaacuuacuguuauaccaguucuucuccaacugaucgagaaauugagugcaaucccaauaaaaaacccgagauugucagugagggugugggaaaagggugaaauuuacaagcaaauuuuuuuuuuuuuuuuuuugagauagggucucacucugucacccaggcuggagugcaauggcacagucucagcucacugcaaccucugccucccagacucaagcgauucuccugccucagucucccgaguagcugugauuacagggauaugccaucacgccuggcuaauuuuuguguuuuuaguagaaaugggguuuuaccauauuggccaggguggucucaaacuccugaccucaugugaucugucugccuuggccucccaaaguucugggauuacaggcauaagccagcacacccggccugauuuagaaaugauaugaaaaugaagggguccaugaauacucaaggugugauugaagaauuccaauucauuccaugugucaaagaucuuguuuuaagauguugguguuuuuauauugguagggugcccaucagcccugguuugcccaaguguccugguuuuuccugugguccuggucucauuaagaaaguguuuucauuucgaguccuuuuggaagucuuauucugcuguuuggguaaagaauugacuguauuuuuuaguuuuuaauuuuuguuuuuaggguugcccguguuuucccaaauacagaauucuaaaccagagaauagcaccuuacauaguagagagauugcuucucuuuugguaggcgguggccaggaaggaacgccagguagcauuaagccuuggcccccaaguaugucuuguucccugucucuuugcuuucaguggguuccuugggccuucuuguuuaugauggagaauacauaggaauuagccuccucagcuuccuucuuucuugcugugcuuaagacaagcagccauauggggcuguuaucuuucugccacugggaaaugagagggugggugcuaaaaaauuaacuuaaaaaggaaaaggaugaggccaggcgcaguggcucaugacuguaauugcagcacuuugggaggcugaggugggcggaucaccugaggucaggaguucaagacuagccuggccaacauggugaaauccuguuucuacuaaaauacaaaaauuagccaggcaugaugguggaugccuguaauccaagcuacuugggaggcugagacgggagaaucgcuucaacccgggagauggugguugcggugagccaagaucacaccacugcacuccagccugggcggcugagcgagacuccaucucaaaaaaaaaaaaaaaaaaagaaggaugaacaccuuugagcucguguguuagugacaucacaucccuucuuucauucauuuaguaaauucaaguaugauuuguugggcacuuauaauaugccaggugcauuacauaacuccuguggccuuuugaagaaaauauuauuuuauaugaagcucagugucuuaaucuguuuucugcuguuuagaauaccugagacuggguaauuuauaaagaaaagaaauuuuaguggcucacgccuguaaucccaccagucugggaggcugaggugggcagaucacgaggucaguagaccgagaccauccuggcuaacacagugaaaccccgucucuacuaaaaauacaaaaaauuagccgggcgucguggcgggugccuguagucccagcuacucaggaggcugaggcaggagaaucgcuugaacuugggagguggagguugcagugagccaagaucgcgccacugcacuccagucugggcgacagagcgagacuccgucucaaaaaaagaaaagaaaagaaauuuauuucauaugguuauggaggcugagaaguucaagguugagaggcauaucuggugggggccuucuugcugcuggggacacugugguggcccaagguggcgugggacaucacguggcaagggagcugaguaguguacuagcucaggucuuucuuccuuuuuuuuuuguuuuguuuuuuuaagagauggggugucacucuguugccuaagcuggaagugcaggggcacaaucauggcucacugcagcuucaaccuccugggcucaagcgauccucccaccucagccuccugaguagcagggacuauaggcgcacagcaccaugcucagcuaaucuuguuuuguuuuguuuuccauagagacagggucuugccaugucuagcaggcuggucucaaacuccuggccucaagugagccuccugccuuuagccuuccauaguucugggaucacaggccugagcuacuguaccuaaccucuucuuuuuauaaagccaccaguuccacucccaugauaacucauuaauucacaaauggauuaauccauucuugagggcagagcucucaugauccaauuaccucuuaaaggcccuaccuuucaauacugccacacugggauuaaguuuuguuuuguuuuguuuuggagacagaaucucacgccgucacccaggcuggagugcaauggugcgauuuagacucacugcagccucugccucccagguucaagcgauucuugugccucagccucccgaguagcugggauuacagacacgcacugccaucacguccggcuaauuuuuguauuuuuaguagagacagaguuucaccauguuggccaggcuggucucaaacuccugaccucaggugauccaccugccuuggcuucccaaaaugccgggauuacagcaugagccaccacccccagccagggauuaaguuuuuuuuuuuuuuuuuccuuuuuugagacgaagucuugcucucauccccuaggcuggagugcaauggcgcuaucucggcucacugcaaccucucccucccggguucaagcgauucuccugccucagccuccugaguagcugggauuauaggcaccugccacuaugccuggcuaauauuuuuauuuuuaguagagacaggguuucaccauguuggccaggcuggucuugaacuccugaccucaggugauccaccugccucggccucccaaagugcugggauuacaggcaugagccaccgcgcccagcuuuuuuuuuuuuuuuuuuuuuuuuuuugagacggagucuugcucugucucccaggcuggagugcagugacucgaucuaggcucacugcaagcuccaccuccccaguucaugccauucuccugccucagccucccgaguagcugggacuacaggcgcucgccaccacgccaggcuaauuuuuuguauuuuuaguagagacgggguuucacuguguuagccaggauggucucgaucuccugaccucaggugauccgcccgccucagccucccaaagugcugggauuacagacgugaaccacugcgcccggacaagguuuuuuuuguuuuguuuuguuuuguuuuuuuugagauggagucuugcucugucucccaggcuggagugcaguggugcaaucucugcucacugcaaccucugccugcuggguucaagcgauucuccugccucagccuccaaguagcugggauuacaggugcccgccaccauacccagcuaauuuuguauuuuuaguagagaugggguuuugccauguuggccaggcuggucucaaacuccugaccucaggugauccaccugccucgaccacccaaagugcugggauuacaggugugagccacuacgcccggccuuaaguuuuaacaugaguuuuggagugguuauauauucaagccauagacucagggaaguaaagaaccuugcucaaauuguaguaagguacaaaccgagcuucugcagcaaggaggucccaaagaacaguggcuugagcaaggugcaagcacauuucuuucuccucuaacagucuggucugccagguggccuuccucagcuuguggcuuccacucguggaucuagaagggucuuuaugguuuuugguuucccaccaggcgguaaaaucagaacgaaggaagcucacaacaguaagagguugagguuccaguguuaguuacuucuacucgcaacccauuuacccagaguuuagucacaugaugauagcuggcuguaaggaggguuggaaaaguuaggcugaaggaggguggccauguacccagcugaccucuauucuguugaagaaagggaaacuggaaacuggggacaaguagaaugucccccacaccugccugcagucacacagguggaggguguggauccaggcccucucuuccuaucuguccugcucuuccgcgguaccuuacuacuguuuuugggaagaagcagccuuugcgaacuuuauguauguauuaaauuaaaaucauuuauuuauuuuuugagacagggucuugcucuaucaccgaggcuggagugaagggguacgaucauagcucagggcagccucaaccuccugggcucaagcgaucccccugccucaggcucccggaguagcugagaugauagucccacaccaccaugcccagcuaguuuuuaaaacuuuuuuuguagagcuggggucuugcuguguugcccaggcuugucuugaacucugggcucaagugacccucagccucagccucggccucccgaauuguugggauuacaagcaugagccaugugccucuuuucacuucugauuuuggauuuuuacuuaacuuguuugucccacuccacccccuuuuuaaaguuagacucuuuuuccuggucuuuuuuccccgguggacuaugcucaggaucgacauagucuuguuuguuccuugguuguacaaauagucauugugcuucaugugcucacguugccauuuuuuuccgggccaaauggaaaucaagcauucagccuauccagugguauguugguaaauguuuaacaacgggcuuucuggggaggaaaaaaccuccugguuuguaacacuugcugauuuccauggcguuaauacucccaccacguuggaguugagcugccagggugauguccugaagguggaagagggaagagagguaugagggcucagguugggccaccgcggcgcacgcccucugugggcacagugacuuuaucucuguuuccgucucuuuacgcugagggucuuugagaaugaaacgugcugggaacuguucuagagccuuuauguggaauaacuuaguaauccuccccacaggggaugucgaugcugcauuuuacgggugaggaaaucaaggcaugagagaucaugugaguggccucagcucacaccgcagagcuaggacuuugaucauaaaucuuuaaaagaacaaaacaguggcugggcgccaguggcucaugcuguaaucccagugcucaugcuguaaucccagcaccuugggaggcugaggcagguggcucgcuugagcccagguguucaagaccagccugggcaacauggcaagauguggucucuauaaaaaauuuuuuuaggauuaaaaaaaaaaaacagucagcuuggguaacauggcaaaaccuugucucuacaaaaaaaguacaaaaauuagcugggugugguggcgcaugccuguagucccagcuacuugggaggcugaggagggaggaucacuuaagccugggagguugaggcugcagugugccaaaaucccaccacuacacuccagccuuggcaacagagcaagacccuaucucaaaaaaaaaaaaaaauaagccuaaauccuggacaagguggcucaugucuguaauuuuagcacuuugggaggcugaugugggaggguugcuuaagcccaggaguucaagacugcaguggcuguguucaggucucugcacuccagucuggcucacagagcaggacccugucucaaaaauacacauaaauuuuuuaaaaagggccaggcacgguggcucacgccuauaaucccagcauuuugggaggccgaggcgggcagaucacaaggucaggaguucaagaccagccuggccaauauggugaaacccaguccuuaauaaaaauacaaaaguuagcuggguaugguggcaggcaccuguagucccagcuacucaggaggcugaggcaggaaaauggcuugaacccaggaggcggaaguugcggugaccugagauugugccacugcacuccagcguggggacagagugagacuccaucucaaaaaaaaaaaagaaaagaaaaaaaaaugauuuguggccagacagguaauagggcauuucagauucuaauuuucucuuagcaacagucucuaucacagaauguuguuuuuuaaagggcgcuuucauggaacuauaugaucauaugggcaacauucuguugcagucuaccuucugucugacggauaugccauccugaaaaaggaaagaagcugaacuucaaguuccuuucauuuagccuuggguaagaaucuagaagauguuggucauacugugcuugacaucccagauggaccacugaggaugggagucaggaugugagaggaguccuuaagcucuguugagacuuccgauguaaccagaaauuccuuaaaccaacaagccaggccaugaccacuuguuuguucugaagaugcugccagugcugaccuugaggucauguagggaaggaaauggaaggccuucccuguaggugagggccaaccaggaagaugcuagcaucuguuuggaggauaggguguaguugugcagauaggagaaaacuuggaaaaaagaaguauguaauauuauguuaguaaauguucuggagucaguuuauaccaguuucuuugacagugaaauuagcuguaacuaaaccagugccauugcagugaacucuuaaaggaugucucugaugugaucuuuuuuuguuuuuuuuuuuuuuugagauggagucucgcgcugucgcccaggcuggaguguaguggcgugaucucggcucucgcucugucgcccaggcuggaguguaguggcgugauuucagcucacugcaaccuccacuuccuggguuccagugauucuccugccucagccucccgacuagcugggauuucagaugugcaccaccaugccuggcuaauuuuuguauuugugguagagaugggguuggccaggcuggucucgaacuccugaccucaagugaucugcccgccuuggccccgcaaaaugcugggauuacaggcaugagccacagugcccagccugaugugaucauuuuugaguguuucuuagaauguggggagagcugauagaaacauagaaauguucuuguuaugcggagauuuuuuucuuuuuucuuuuucuuuuuuuuucuuuuuuuuuuugagauggagucucucacugucaccuaggccagagugcaguggugugauaucggcuuacuacaaccucugcuucucggguucaggcgauucuccugccucagccucccaaguagcugggauuacaggcacccaccaccacgcccaucugauuuuuguguuuuuauuagagaugggguuucaccauguuggucaggcuggucucaaacuccugaccucaggugauccacccgcuucauccucccaaagugcugagauuacaggcgggagccaccgcgcccagcccauaugccguuuuucaagagaaacauuuuaaauauaaaggcacaaguagaugaaagucaaaggauguuaaaggacauaccaaacaugaaucacaagaauggugagauugguguacuauguuaauaucagacaaagccgacuucaaaacaagguauguugccagagaucaugaaggacauuucaaaaugaucaaagaauuaaucaucaagaagacguaacaggccaggcguggugguucacaccuguauucccagcauuuugggaggcugaggcaggagaaucgcuugaacucaggaggcagagguugcagugagccaaaguugcaccauugcacuccauccugggcaaugagagugaaacuccgucucaaaaaaaagagaagacauaacaauccuaaauaugugucaacauaauaaaagaaauucagggccgggcgcggucguucacaccuguaaucccagcacuuugggaggccgaggcggacagaucacgaggucaggaguucaagaccagccugacuaacaugguaaaaccccaucucuacuaaaaauacaaaaauuagcugggcgugguggcacacgccuguaaucccagcuacucaggagggugaggcaggagaaucgcuugaccccaggaggcggagauugcagugagccgaggucgugccacugcacuccagccugggugagagagcaaaacuccgucucaaaaaaaaaaaaaagaaaagaaauucaggccggaugcaguggcucacaucuguaaucccgacauuuugggaggccaaggcgcuugaggccuagaguucaagaccagccugggcaacauagugagaccccaucucuauaaaaaauuuaaacauaguccaggcgcgguggcucacaccuguaaucccagcacuguggggggccuaggugggcggaucacgaggucaggaguucgagaccagccugaccaguauggugaaaccccaucucuacuaaaaauacaaaaaaucagcugggcaugguggugcaugccuguaaucccaacuacucaggagacugaggcaggagaaucacuugaaccugggaggcggagguugcagugagccaagaucgugccacugcacuccagccugggcuacagagugagacuccgucucaaaaaaaaaaaaaaaaaaaaaaaauguaaacauuagcuggucaugguauuucuugguuguauuccuagcugcuuggaaggcugagaugggaggacugcuugagccugcagugagcuaugauuguggcacugcacuccagccuggacaacauggcgaaacaccaucuuuaaaaauaaaauccagucugacaauguuugucuuuaauugaaaugacuauuugcauuuaaugcauuuauugaaaugguugaauuuaugucugguaucuugcuguuuuuuuuuuuuauuuugucuccucuguuuuuguugcuuaucuccuuguauuuuuauuauuaguuuuggucuuuuggauuaauccaguuguuuuaaauuauacuacuagaaaaauucuucuagcaggauccuauuucgucgauggucuuuuguaauccacccaggcuuccaccuucucuguggcuagaaacaggaccguccagaagucaccuguaacugcccuaucuugcaaguucugauuuuggcaaaaaaaaaaaaaaaaagccuugacaagguuggauucacuucuuucccuggauugugugucauccaaguacgugagacaucugguagugcauuucagagagaggaguaucugauauguguguggaggcagccaucuuuuccugaaaguccuuuuaggaaucauuauuucugguccucugaaguuugccgcuaccacucauaaauaucuauccacaccccuuacaagaagaauaaggaagaucuuaagaccuagaaggaaaacugauugcagaccaggcuugguggcucagugccuguaaucccagcacuuugggaggccaaggagggcagauugcuugagcucagcaguucgaggccaaccugggcaacauagugaaucccugucucuacagaaaaaaaaaaaaaaaaaacccaccccaaaaucaaaacugaagguagugucaguguauauauggagucccuugugcugaaagucaaagcagcuucauuuuggggccucaagagcuccagcucugggcucuucaccucuaagcccaugggcagugcccgcccagugguguguauagaucggaggcugcagggccucacccuuagcugcagcugucgcgugcuggggagccugugcaggaggguacaaguaggaaagugccaucugcaugggaagaaaaaugcagcauccuuguagugcggaugggguccaggagacccaggagcugcccagaggaccugguggcaugcuguagaaagcagccagguagguaucuggggccaggagagguuuuggagcugagaugagauguguagacaucaagugaguuugaauuagccaaagccagaggcugugggaguguggcuggacgauggaggcucccgugucagggguccuagggcaucaccggcuuuacagucagacaaaccugggcauuuacaucuguggucagccuuuuguuuuucuaaguaaaaaauuagauaagauaaauuccaucuacuauuacuauaauuuuuaaaauguuucauguaacauugaaaagauuuguaaucucacaguaaaguuuuaacuuugugaaagauguaggcuuuauguuuucacuuucuaucagaauagugaaaacuuuguugcuaaccagcccuggccugcagaaugacaugugagacacuaggaaggacuguccagacaaagacagcaagagcugggauguuugggaagcagaggaggggcuggaucaguggugauuccucaggugccuauggcaagaccuagugcccaguugguguaugugugaggaggugccugcuucagagagaacccugggugugauucagcaagauggggacgaugaguggaugggccggguggcugggggaggcagaggagugagcgcagggucaggcagcaucagcugucuugauuuugacuugcugaguuugcucacaaaugugagacuuucagaggggagauguccaguguucacucaggacagaagacaucccugacacaugggagagacaccugggcgcauucgccuaacagaacuacagagcaagcaagagcauugaggggcaugucgagcacgcuggugggugggggacaguguggggaaggagggcaaaggaggggguuagcccagaggagaaccuggggaggcagguccuggagcugggggugcagccucagagcuguugagcagcugggaagucugcuaacuuugugagcccaaccuggagaggucugaugggaaugguuacuggggagggcccccaccauccugagcucugggaaucuuguguguucaugcugcagauggacuuccaggacuugggucuaguguugcugaggguggaucugcagaggugagagaaaugaccccuuuggacuugggucuaguguugcugaagguggauuugcaagggugagagacgugaccccuuugcccucguuugcagcucugcggccgucacgauguucuggaaguuugacuugaacaccacgucccauguugacaagcugcuggacaaggagcaugugacgcugcaggaguuaauggaugaagaugacaucuugcaggaguguaaggcucagaaccagaagcugcuggacuuccugugcaggcagcagugcauggaggagcuggugagccucaucacacaggauccgccccuggacauggaggagaagguccgcuucaaguauguaccaaagcugugacgggccaguacgccaggcagugcugcaggcaggccgcaggcagugucugaggauggccauaguuggggauuucugaugaagaagcgagccguaaaaauccaccccaugugagaagugaggagggcacucccauggggucugagguugaagaguuuggagauugggugcaguggcucacgccuguaaucccagcacuuugggaggcugaggagguuggauuaauugagcccagaaauuugagaccagccugggcaacauagugcgacccugucucuauuaaauuuuuuuuuuuaaauuagccagaugugguguuguagaccucugguuccagcuacucgggaggccgagguaggaggaucacuugaacuugggagguugaggcugcagugagccaugauugugccacugcacuccagccugggugacaagagugaaacccugucuuuaaaaaaaaaaaaaaaaaaaaaaaaggccgggcacaguggcucaugucuguaaucccagcacuuugggaggccgaagcaggcagaucgcuaggucaggagauugagaccauccuggcuaauacggugaaaccccgucucuacuaaaaauacaaaaaauuagccgggcaugguggcgggcgcccguagucccagaggcuacuguacucaggaggcugaggcaggagguuggugugaacccgggagguggagcuugcagugagcugagaucacaccacugcacugcauccugggugacagagugugacucugucucaaaaaaaaaaaaaaaaaaaagaguuuugacugucuugugccggcauuuuuucauucuaaguaaaguuaauuuuagguugguacacgucagaguguuuugaguggcaauauguugggaaaaaaagacugaucccaugcuagagaugcagguguuauugcagcauaaggcuguacugucagcaggguuggcuccaggccacaaaauggcuaggcaggagagauaugcaguaucugaccuacaguccugggacaugcuucauuuuagggucuucagcucgaaggaaauagaucauugucauucgugguaccguccguucucagaguuuuuccugaaacgcccauucagcccuggccaggaugcuaggagaugacacagagggagggggcaguguggcgagauggcuggagccucagggccuugagucaggacagaagggugagcaaggauggggcuggggcgagagggagaacagggcggagcuggccuccagcuccucauggugcagaucugcgaggcacacaugacccgcaguguccccaggugacgccucauuaggaagugggagauacauacagguuagcaaaccucggccugcaggucauguccuuuuccguguguccugugagugaagaaugguuuuacauuauuuuuuauuuuaguuuuuugagacaaggucucacuccaucgcccaggcuggggugcaguggcaugaucucggcucacuagagucucugccuccuggucccaagugauccucccgccuuagccucccuaguagcuggcacuacaggugcgugccaccaugcccggcuaauuuauuuuuguauuuuuuuuguagagacgggguuucaccacguugcacaggcugguuucagacuccugggcucaagcaauccacccaccucggccucccaaagugcugggauuauaggugugagccacugugccuggcucguuuuaccuuuaccuguuuaaaugguuggggaaaaaaaaaucgaagcucgggcaucguggcucauaccuguaaucccagcacuuugggaggccaaggcgggcggaucaccucaggucaggaguucgaaaccagccuggccaacauggugaaaccccgucucuaauaaaaauacaaaaauuagcagggcguaguggcgcacgccuguaaucucagcuacuccgggaggcugaagcaggagaauggcuugaacccaggagguggagguugcagugagcugagauugcgccauugcacuccagccugggcaacagagcaagacucuggcucaaaaaaaaaaaaaaaaaaaagccgggugugguggcucacaccuguaaucccaacacuuugggaggccaaggcgggcagaucacgaggucaggaguucgagaccagccugaccaacauggugaaaccccgucucuacuaaaaauacaaaaauuugcugggugugguggcaugugccuauaaucccagcuacucagaaggcugaggcaggagaauugcuugaaccugggagguagagguuucagugagccaagaucgcuccacugcacuccagccugggcgacagagugagacuccgucucaaaaaaaaaaaaaaaaaaucaaaggaagaauauuuugucacacacaugaaaacgauaugaaacacguuucaguauccaccaauaaagucuuguuagacacagccacacucauccacgucucauagcguugagcagcuccagcaggggccacggcaaauaauuccucccuggccauuuauagaaacucuuugcuggccuuugucuuagaaggaagauaaagcaggauagugagccagggugucccuguggcaggggguggucaguacuucauuuaggguggucaggcguccucuuagguaaggggagcagugcuggguuggggaggagaguucuagccugagcagggccuugcuguaaggaacugaggguuaggguggggcagcugcagccagaagcugcuguggcuucuggucacaccugcugugucagcaucacuguugacaguccccaucccucccacuuucaaauguggcccagucuggugacaaauuagaguugagagacagguauggggcaaggagaguggggaggggucuucuggaucaggacaggaaucccagaguagcaucagugagccgggagagucucauagaguuugggagaaaucaguaguagauaaguacagaaccaagcaaacagagcaagaggacuaugaaccuggggggagacuuccguaaguaagcaaagaugcccugaguaaacaacccaggucaggauauccauuuaaauuacccugugacuucggagggagagcaagaggacuaggggaagacuucccuaaguaagcagagaugcccugaguaaacaauccaggucaggauauccaucuaaauuacccugugacucggagggagggaaagggagagggaagucggguggugggaaagcuuugccuuccauuguaggaaguuaauucauaaugucuaaaauuggugaacaaagaagaaauguauguguguauuauuuagaaacauggagguuaacguuggagaaaacugcugaaagaguccagugauugccucugaggagcaugacuugggaugcuggggggcagggggccuguccucaccagcccugucaucucugaguuuuucucugaggagugugacuugggaugggggcaggggggccuguccucaccagccuugucaucucugagcuuuucucugaggagugugacuugggaugggggcaggggggccuguccucaccagccuugucaucucugagcuuuucucugaggagagugugacuugggaugggggcgggggggccuguccucaccagccuugucaucucugagcuuuucucugaggagugugacuugggaugggggcagggggccuguccucaccagccuugucaucucugagcuuuucucugaggagugugacuugggaugggggcgggggggccuguccucaccagccuugucaucucugagcuuuucucugaggagugugacuugggaugggggcaggggggccuguccucaccagcccugucaucugagguuuuaaagcacgugcacauaucacuuguauaaaaaacaugaaagucaggugugguggcucacgcugguaaucccagcacuuugggaggcugaggugggaggaucacuuacgcccaggaguugaagaccagccugggcaauauagcgagacuccaucucuuuuuuuuuuuuuuuuuuggucugagauggagucucacucugucgcccaggcuggaguacgguggugcgaucucgguucacuacaaccuccgcgucccagguucaagugauucuccugccucaggcucccgaguugcugggauuacagacaugcaucaccacacccagcuaauuuuuuguauuuuuaguagagacaggguuucaccauguuggccaggcuggucucgaauucccgaccucaggugauccaucugccucagccucccaaagugcugggauuacaggcaugagccacugcacccggcccccaucucuauuucuuuauuuaaaaaaaaaaacauauuaagacuuuuuuuuuuuuuuuuuuggaaacacaguccuuucugucaaccaggcuggagugcaguggcgcgaucuuggcucacugcaaccuccgccuccuggguucaagcaguucuccuaccucggucuccuuaguagcugggacuacaggcgcacaccagcaugccuggcuaauuuuuuguauuuuuagaagagacgggguuaccauguuggccaggcuggucuugaacucuugagcucaggcaaucugccugccucggccucccaaagugcuaggauagugcuaagauuacagaagacacuuuuuuugaggcuagucaaagugcagcaguguuuacaccuaauuggucacaagcaguuaagauuucuuucuuccuucuucagucugucugcgucacaugacuagccuuguaaauaaagugaaacaaaaaacacuuuuuuugagaaauagaauaggggccgggcgugguggcucacgccuguaauccuagcacuuugggaggcugaggcgggcggaucaugaggucagaagauggagaccauccugacuaacacggugaaaccccgucuguacuaaaaauacaaagaauuagccaggcgugguggccggugccuguagucccagcuacuugggaagcugagagaguaagugcacuccagccugcaugacacagcaagacugucaucucuuuaaaaaauaaaaaaagauggagaagauauaaauauauauguagaccaggaguuggcagacuguaucuaugaaaagucagagaguaaauacuuuaggcuuugcagguuguaaggucucuguugcaacggcucaacucugaaguuguagcaugaaagcagcuacagaaaauaguaaacaaauggauggggcuacauuccaagaaggcuucauuuauacagagcagcaccugugcuucgcgacucugcuauccuugccuaguggcacugccagguuaaacaccgccucccgcaaccuguuagccuuggaggucaggguucuccugcagaccuggcagaacaccuccaugaccacaggcucaauuaugggaggacucuucuugaaaguggagaauuugccugagcugucugugcucaagagaagcugcacuugguuuggguggauugggaucagguagcagccacugacccugcuuaauuaaagccaggggcugcuccagggaggugaggcccacacgcugccucuuccuaaggccucacaugcagcuagcccugcuucugcggagcagcccuuggcugaaaagccacugugacuguaagauggcuggucaccuucuggagucagagcacugccugcccaggccacagcagagggcgccaccccagggcuggaggcagcagcagucacauggucagcccuagagccuggggaugcuccuggucuuuucgugagcucuugucuaguuugcuugccaagaucuggauuauuugagaaauaagacagaagagucaguaagagacaccaagcugucgcuuucauuacucauaaagcagugucauuuauaacucugagcugugggcuuccucauuccugauugcagaauuagaacugcucacccagugggaagcagcagugggucacagcgggcccccaggaagcacccccugccgcagagagacuugcugcacucagggcagaacugaaagaaagacagcgucuccaccaagggaaacacugggaggaagggaacuuugccauaacaguuccugggccacugaccauccacuccacauccauuguccaucuccugucauggcuucuuccucuucuucgguugacuuccugugguaaauuacacucuguuaaaacagcuuccugagauggaguucguggguggugauguuuagggcaucgggccugcguguuugagacccucugauuagaaguucagacugggcauuacccccugggcuuugggagccuccguguuguccucuagucucacaagucugauguagcaagcuccuggcucacgugugucaccuguuuucucuccucucugagggcauuuagguucuuuucuaagcccuauuguuucucaauuucccaguaauguggaauuauuccaugggucaggacaggggauccccaaagagcaucauugagccaagagaguuucauagucagagcuugggcgaauuuaguaauagguaaguacaaaaucaagcaaacagaaaaauauugacucuaagggaaaaguuguauaaguaagcaaagauaucccgaguagacaaaugaggucaacaguggauauccauuucuuucauuuguuguucugggcucccugaacccuuuuagucuguacauuugugacauuagcugagggaaauuucucauauuguuucuuugauauuuucccucuuuucucuuucugggacuucuaaugagguguuagauuacucaaauuaaugcuuuccuuauuuuugcuuuuaauguuuuguacuuugccuuuuuggccuacaucugagagacuucuucaucuuuuaaguucucauccuuuuauugacuuuucaaaguucuaccauuauuuuuuguuuguuuuuuagaugugaggucuugcuauguugcccagucuggacucaaacuccugggcucaagugauccucccaucucagccucccaagcaguuggaaccacaggugccaccaugcuuaacaucugucauauuuuaaaauuuuauuuuuuuuuugagauggagucuggcucugucgcccaggcuggagugaaguggcacgaucucggcucacugcaaccuucaccuccggguucacgccauucuccugccucagccucccguguagcuggaacuacagacgcccaccaccacgcccggcuaauuuuuuauauuuuuuaguagagacgggauuucaccguguuagccaggauggucucgaucuccugaccucgugauccgcccgccucggccucccaaagugcuggauuacaggcgugagccaccgcgccaggccaauuuuuuuuuuuuuuuucugagacagagucugucucgcucugucgcccaggcuggaguacagugaugcgaucuuggcucacugcaagcucugccuccuggguucacaccauucucccgccucagccucccuuuuucuuuuuucuuuuuuuuuuugagacggagucucacucugucgcccaggcuggaaugcaguggcacaaucucggcucacuguaagcuucgccuccuggguucacgccauucuccugccucagccucuugaguacaggcgccugccaccacgcccggcuaauuuuuuuguauuuuuuaguagagacaggguuucaccguguuagccaggauggucuugaucuccugaccuagugauccgcccgccuuguucucccagagugcugggguuacaggcgugagccaccacgccuggcccauauuuuuaauuucuaagagcaguuucuuauucucauauauuuuaauaaaagcuucaaguucucauucauggauacacagucuuaaugugucaucucugagaacauuguaguuuaaaagaguuuccuucuguucucuacacuugcucuccuccgugugccuuguuuucugcuuggucagcaccacgcuucuuucauaaguggggcccuagauccugcacagaguuugggaucugcauggggcuuacucaccacagcuuagaggccacuaguugacuuuucucuuugucccauuauuuuucccagaaaagaauccuucuagcucuccccuguggggaauggaccugucaguaucaggagcugaguugggaagagggcugggggcaccccaguuucuuuuuuuuuuuuuuuuuuaccaaguucccuauuucuggauggugucuggucacccuguggcugugccuggugucccuggccccaggagccauaaggaagggacaugucccacugcccuggccuguaaguucucagcccacccugcccuuacuggccgccaaaucaguguccaggccucucuggaguucuguggccugaauucucaucucuaguugaugccccuucugugggcuccugaaacucagccuucccugugccaagucagucuucacguggccggcugcuucaguccuccaggcugguucgucguuucugccucuccauucuugucuuuuuaauucuuuguguuauuugagauggaguuugagagggaauaugaacaagccugugugcuccaucugcuguguuugacuggaauuucuauaccuuguauacauuuuuaaaacuacuagagcagcaccugucauuugaagaauaacuguaaaauguugauaaaggaaaaaagaaaaucuuagucccuccaucuagagaaucagugucuucuagcuugguuugugccaugugugcacacguuuguccguguguagacaagaugaguuuggagcugggugugguggcucacgccuguaaucccagcacuuugggaggccaaggcaggcagaucacuugaagucaggaguucgagaccagccuggccaucaugguaaaaccccgucucuaccaaaaauacaaaaguuagccgagcaugguggugcaugccuguaaucccagcuacacaggaggcugagacaggacgugaacccgggaggcggagguugcagugagcugagauagcaccacugcacuccagccugggcaacagagcaagacucugucucaagaaaaaaaaaaaucaguuuguucccugugguauugagacacuucuucaaggaaugauuuggauguuucucugcuuccuuacguuugaucuuccuccucaccccaugggaugugacuuccucccccugcccagcucaccggucuuaguguuagagaucugguagaccuggggccucacuguggccuuugaggcugccaaccuggcccuccucuccugcucucugguccuccugcccugagggaccauguguuguccacuugcuggccagccccucugacaucccacaggguggguacugccugccccaauuaacagacaaggacacuaaaggccagaaaguucggcuagugaggucggcuagugaggggaugagcuugggccugccccagcccccugcgccagcucucaggcccccucucugcccacacauccagcuugcagugccccugugcccugacccuacuccaucgggccccagccagguccucucucccaaacccaagccugcugggccacucuuugacccucuacacuccaccugcccuucacaggcgcuguuccucagagcucuaaaaguggcacuuucuugucugggcugaugaggcacacccaccccccagccagccgagaucauugcguuucuuccccuuccacacuuggucggcugccaggccuggccagcuguuuccuauagagucucucaaacccuggccccuccagccggucgcguggaccaccuuggcuuagguccagugcuagggcugccucucuaccuggcgguggccacauguuggcaagagaaggaaggucauagcagcugaccuugagcacacauuugcugugugacaggcaugggcaggcacugucaccugcacauucuauuuuuuuuuuuuuuuuuuucuggaaacaagagucucgcucugucacccagacuggagugcaguggcuugaucucaucucacugcaaccucugccucccagguucaagugauucuccugccucagccuccccaguagcuggcauuacaggcgcccaccaccacaccuggcuaauuuuuguauuuuuaguagagaugggguuucaccauguuggccagaauggugucaaucuccugaccucaggugauccaccugccucggccucucaaagugcugggauuacaggugugagccacugcacccggcauauauucuuuuuuuaagucagagucuuacucugccacccaggcuggagugcaguggugugaucuuggcucacggcaaccucugccucccgggcucaagccauccugcgccucccgggcucaagccauccugccaccucagccucccauguagcugagaccacaggcaugugccaccucgccuggcuaauuuuucuuucuuucuuguuuuuuuuuuuuuuuuuuggagagacggaguuucaccauguugcccaggcuagucucccacuccugagcucaagagugauccaccugcccacccucccaaagugcugggguuauagguguaagccaccgugcccguccuuaccugcacguucagaugagaaaacccagacacagagaggacaggucacuugcuggugucaggacaggccuguucugagacagccauuccuacaggacgcucccacugggugggcccugggcuccuccccagcauucccagaggcagggucaugcaccaggccuugcuaugggggcugcuguugagggcugcguccugggcugugggguguaccucuccuggggcgauggcugucacccaccucugucuaccaguuacaaaagagggagcaaaguaccuuauucacagguguugguauuucuuagucauaacguucuugcguagugccucaucccucacaugguuccugagcggcugauggguguuucucccgucuagggauggaguggucuguguuuguugauggaaggggcauggcuuagaaggaaaggagaggcucaguggaggggaagauggaaauggccacagauguggccucgcggaaacagugugguuagacuggaggugagaggccuggagggaggcaagaggccuggcaggcgagugcgaaggccuggagggaggugagaggccuggagagaggugagaggccuggcaggcgagugugaaggccuggagagaggugagaggccuggagagaggcgagaggccuggcagacgagugugaaggccuggagagaggugagaggccuggcaggcaagugugaaggccuggagagaggugagaggccuggagagaggcgagaggccuggcagacgagugugaaggccuggagagaggugagaggccuggagagagguaagaggccuggagagaggugagaggccuggcaggcgagugugaaggccuggagagaggugagaggccuggagagaagugagaggccuggcaggcgagugugaaggccuggagagaggugagaggccuggagagaagugagaggccuggcaggcgagugugaaggccuggagagaggugagaggccuggagagagguaagaggccuggcaggugagugugaaggccuggagagaggugagaggccuggagagaggugagaggccuggagagaggcgagaggccuggcaggugagugugaaggccuggagggaggugagaggccuggagagaggugagaggccuggagagaggugagaggccuggcaggcgagugugaaggccuggagagaggugagaggccuggagagaggugagaggccuggagagaggcgagaggccuggagagaagugagagaccugcagagaggugagaggccuggagagaggugagagaccuggcaggcgagugugaaggccuggagagaggugagaggccuggcaggcgagugugaaggccuggagggaggugagagaccuggcaggcgagugugaaggccuggagagaggcgagaggccuggagagaggcgagaggccuggagagaggugagaggccuggagagaggugagagaccuggagagaggcgagaggccuggagagaggugagagaccuggcaggcgagugugaaggccuagagggaggugagaggccuggagagaggugagaggccuggagagaggugagaggccuggcaggcgagugugaaggccuagagggaggugagagaccuggcaggcgagugugaaggccuggagagaggaaaagccggaagacugagaaagguuauuuaaagaaugggaguagggucagaaaaugucagauaucagcguauagggcaugaggagcauagaagguauguuaaaaaacugaacuucuaguagucagaaauaccagcuggucacagguagucacguuuuuguucuguucugaggucuguaguguuuguuugaucacgugggucugcuuccuaagaagcagacuauguaagcagcuuccuaagaguuggagaagucuaauuucaccuccagugcuuggacugugcccuuuuagauauccaaacacagccugugagcuucugacuugugaugugccgcagaucagcgaccgccucgguggggacgagagccugcugagccuccuguacgacuucuuggaccaugagccgccucucaauccucugcucgccaguuuuuucagcaagaccauuggcaaucucauugcaagaaaaaccgaacagguaaaucacgugcaaagccuccgugacuuggggcaccgucaugguggaugcugacguguccugcugugagccuggcggugcgacucauccuccggccgcgggaacagcaucugugacucuucugcgcaacacguggagcaguguguggguuuugccagucugggagcuggaauuugaaagaguguuucuggcugggugcgguggcucaagccuguaaucccagcacuuugggaggccgagcugggcagaucacuugaggucaggaguucaagaccagccuggccaacaugacaaaacccugucucuacuaaaaguacaaaaauuagcugagcgugguggugcgcaccugucaucccagcuacuugggaggcugaggcaggagaaucgcuugaaccugggaggcagagguugcagugagcugagaucguaccacugcacuccagccugggcaacagagugagacugucucaaaaaaaagaaggaguguuucuuauagcuggcucuggaauaagcagcacuucccaccaucccugggagcugcacagugccccaaaguaggccaucuugugcugucacugaccagguggaggugugagguccuggggcaucauggcaggaccuuggacauccacuuucucaggucugcagcuucaucugucuggguggcgugucugucuguccagagcauuuauucuuucaaaacaaaggucacuucuagcauuagacuucugcaaaagcaguuagugaauucaucucagccagcuguaacggggucuuccuggaguccauccuugcuccugccuuacaugugaccugaccugggcuucugccccuccaggcuguggacacacagguagagaggcgugguggucccugugccugcacccugcaguccgccuuggccagucuucuuuccugugucaugccccacccgcccaucccugaugggaguauuuuaaaacaaaucccagacaccagauuauuucucauguaaauauuucaguauguauguacauuuauuuauuuuugagacagggucucacuacgcccaggcuagaguccacuggcuccaacacagcccacugcagucucaaccuccucaagcucaggugauccucccaccucggccuccugaguagcugggacuacaggcacauaacaccacaccuggcuaguuuuuaaaauauuuuuuguagagaugggguuuccccauguuacccaggcugguuucgaacucuugggcucaagugaucugccugcccaggccucccaaaguccugggacuacaggugugagccacgaugcccagcuauguaucucuaaaauaaagacuuuuuucuuuuaaauauaaucagaauuucaugaucacacuccaaaaauauuaaccguaauuguuucauaccaucaaacauucagucagggcacaaaccaguaucuuacaucugcuuugagcucugagaaagcgcagcuccacgaaggccgcgguuccccuugacgacauucagcaugcaugugaguguucaguggaaugccgucuucccuugcgcuguaaaucugagaguugcaagggccgccaggggacugccucaccucagcuccuucugaagcugagugugagugaaggucgccagcagcagugggucgugcugggugugaggcugcuggcagaaugggagugggaguggaggcagcggggagcuguggugugggccgggggauugucguggcugugaggugguaguagauguuguaaaaaccuuuacuaccuggcccuugcagcccagugacuagaugcauguaucucauaauuugccauaaccugaucuuauuccccugccacuuucggauauuuucuuuauaauuuuacugcuucauauaauauuuuucuuccauucucucacccaguacuuaaggcauuaaaguaauaugaacugaacuguuaaacauuucuucuguuggcugggugcgguggcucacgccuguaaucccagcacuuugggaggccgaggcgaguggaucaccugaggucaggaguucgagaccagccugaccaacguggagaaaccccgucucuacuaaaaauacaaaauuagccgggcgugguagcacaugccuguaaucccagcuacucaggaggcugaggcaggagaaucacuugaacccaggaggcagagguugcagugagcugagauugcgccauugcacuccagccugggcaacaagagcgaaacuuuccaucacccagcagcuggcuuguucucacggccagcugugaggcagggaugccuugagccuuccuccuguguuuccugaaacugugggaguagccuaaagguggggcuucagugaaaugaccguccgcauuuuccccgcccuucauuaugaauucuuucaaacgucuacaaaugagagaaaauauuucaugaacccccaugucucugucacucagauuccacaucaucuguucauggcuaaucacauuucuucuauaucucuuuauuuguuuuucuucaagauuauuuuuaugauucuuugccuuuugaucaugaugaugaugaugaugauuuuuuugaggcagagucuugcucugucgccaggcugaagugcaguggcgcaaucucagcucaccacaaccuccgccucccggguuccagcgauucuucugcuucagccuccccaguagccgggucugcaggcgugcacccccacgcccaacuaauuuuuguauuuuuaguagagacaggguuucaccauguuggccaggauggucucaaucucuugaccucgugauccgcccaccuuggccucccaaaguguugggauuacaggcguaagccaccgcgcccggccgacgaugaugaugauuuuugagauggaguuuugcuuuguugccaaggcuggagugcaguggcgugaccuuggcucauugcaaccucugccuccaggguucaagcaauucuccugccucagucucccaaguagcugggauuacaggcgccugccaccacacugggguaauuuuuauauuuuuuaguggagacagaguuucaccauguuggccaggcuugucccaaacuccugaccucaggugaucugccugcuucagcuucccaaagugcugggauuacaggugugagccacugcacacggccuauuuuguuuuuuguuuuuauuuuuuuucuuuucuauuuuuuaauuuuugcuuucucuuuuuuauuguuuuagaauaagcaaauuuuagaaugaguuugucacuuucuacauucucccucuccauacccugccccccaaaaauaaaccuacugaaauuuugaugagguuugcauuggcuguaguugggucugacaaacugugguccacaggccaaaagcagccaucacugauugugugagugaggucuuaguguagcacagccacuuccauuccugugcacgcugcccggggcuccuuucacaccacagcagcacagcugguagcucaggcuacuuugauuucucagaaauacacugcaguucucuguauggcagucuuaagcaucuuucacuagauuuauucuuagguauuugauaucuuuguauuauuuugaguggugucuuuuuuuuuuuuuuuuuuuuuuuuugagacggagucuugcucugucguccaggcuggagugcaguggcgcaaucuuggcucacugcaaccuccaccuccuggguucaagcgauucucauggauucucgugccucagccucccgucugggggauagagugagauucugucuccaaaaaaaagaaaaaagaaccucuuauuuuuuucaagcccauaaugaucaauguaucauauucacauacaucaguauucuaguugugauauuauacugguguuuuagaaaaugucacaauuggaggaaacaugucaaagcauacaaggauuuuguuuuuguuuucguuugagacaaagucucccuuuugucucccaggcuggagugcaggggcacaaucucggcucacugcaaccuccgcccccugguucaagugauucuccugccucagccucccgcguagccaggauuacaggugccugcccccaugacccgcuaauuuuuguauuuuuaguagagaugggguuucaccauguuggcaaggcagucuugaacuccugaccucaggugauccaccggccuuggccucccaaaaugcugggauuacaggugugagcccccacacccggccuuuaaaugguaucuuuuuaauugaaauuuugacugagauuacuguauuuacaugagguuguaugaaauaauaugaagaaaauccuuggccaggagcaguggcucacuccacccaacacuuugggaggccgaggugaguggaucacuugagcccaugaguuugagagcagccuggccaacaugccgaaaccccgucucuacuaaaaauauaaaaauuagcugggugugguggcacacgccuguaaucccagcuccuugguggggcugagacaggagaaucacuugaaccugaaggcggagguugcagugagccaagauugggccacugcacuccagccuagguaacagagcgagacucugucuccaaaaaaaaagaaaaaaggccaggcgugcuggcucacaccuguaaucccagcauuuugggaggccaaggcaagcggauuaucugaggucaggaguuugagaccagccuggcccaacauggugaaacccugucucuacuaaaaauacaaaaauuagcugggcgugguggccggcaccuguaaucacagcuacucaggaggcugaggcaggagaaucacuugaacccgaggguggagguugcagugagccgagauugugacucugcacuccagccugggcgacaaaggggagacugucucaaacaaaaacaaggccuggcgcaguggcucacgccuguaaucccagcacuuugggaggccgaggcgggcggaucacaaggucaggagaucgagaccguccuggcuaacacggugaaacucugucucuacuaaaaauacaaaaaauuggcuggacguagugaugggugccuguagucccagcuacucgggagccugaggcaggagaauggcaugaacccaggaggcggagcuugcagugagccgagauugcgccacugcacuccagccugggccagagugagacugcaucucaaaaaaacaaacaaaauccuuguaugcuuugacauguuuccuccaauggugacauuuucuaaaacacuaguagaauaucacaacuagaauauugaugugaaugugugaauaugauccaucgaucauuaugggcucaaaaaaaauagagguuauuuuuucuuuuuuuggagauagacucucacucuaucccccaggcuggagugcaguggugugaucucggcucacugcaaccucugccuccuggguucaagcaauucucaugccucaacauuccgaguagcugggauuacagccacccaccaccacgucuugcuaauuuuuauauuuuuaguagagaccauguuggccaggcuggccuugaacuccugagaucaagugauccgccugccuugaccucccucaagugccaggauuacaggcaugagccaccaugcccagccugggguuauuuuuucuuaaauguuuggaagaauuuauuaggccauuaaaccuucucuguauagagagccuauuaauuauagauuuuguggaguuuuaguauguucuggaacuauucugauuuuguuucuugucaguuuaaauaaguccuuuuuuuuuuuuuuuuuuuuuuuuuuuuugagacggagucuugcucugucacccaggcuggagugcaguggcgugaucucggcucacugcaagcucugccuccuggguucaugcuauucuccugccucagccucccgaguagcugggauuacacgugcccaccaccaugcccggcuaauuuuuuuuguauuuuuaguagagacgggguuucaccauguuagccaggauggucuugaucuccugaccucaggugauccaccugccucguccucccaaaguguugggauuacaggugugagccacugcgccuggccuagauaaguccuuuuuuuuuuguuuuuuuuuuugagacagaguuuugcucuuguugcccaggcuggagugcaauggugcgaucuuggcuuaccgcaaucuccgccucccagguucaagcaauucugccucagccucccgaguagcugggauuacaggcaugcaccaccacgcuuggcuaauuuuguauuuuuaguagagacgggguuuccuccauguugaggcuggucucgaccucagucuggucugaccucaggugauccacccaccucggccucccaaagugcugggauuacaggcgugagccaccgcaccuggccagauaaguauuuuuuuucaaggaaauuucuuuucuaaauuuacaaaaacuggcauaaaauuguuucuauuaauuucucauaauauagcaggugugguggcuccugcuuauuauuacagcauuuugggaggcugaggugggagaaucacuugagcucagaagguggaggcugcagugaguuaugaucgcaccacugcacuccagccugggggacagaguaagaccuugucucaaaaacauaaaaacaaaacuacaaaccucucauaauaguuuuuauuucuguaggaucuuuggcgaugccccuuguuucauucuuaauauuguuauuuguaccuucuguuuuguccuucgucuuucuagaaguuuaaucauccuuuucaaagagccauccuccucuccuccuccccuacccccuccucuuccuucuuccccuucucuuuucccaccacuccuuuuccuacugucccuccucauugcagcacuggggagugaggcugaggcccugcagccaggugggccuucucuguguucccauuguuuccaguggagggcugggucuaccccagcccccagcccaguagccuggacauagcagacacuuauuucuguaggcugaguugagcugaauuugcagcgagcccagccuucacuucuccacuguuaccuuggauccgccgucugagcagcccacugcgucugugaugggugcugugcccccccauggccucacgcuuagcugucuacaccuuguuggcacuggucaucagccagcugcaggaugccucuuuuucuuuucuaaaaccucagucuucuuuccccuucaaccgcucauggguuuuggucagcagcuggcgucuugugcacucugugcucccuggauguguguucuaggccuggggcugccagugauggccaucagcucagcucagcucugucuauaccauucguuucuguuggaaaaacccgaaccaguagguauuggauggcagcugcucacggcagccugugcugccccaccugggacagcuguguccugucggugcagagccacaggggucccugugcaguggcccccccccccccccccccgcccagacccucacauacaccacugccugguaggacucugccugucccuugagggggcuuucuuacaaucuugucugggucuuuccguuauuucugcuuaauauaauuacuaguucaacuuucccaugagaguuuuuggaggaggugucucaggguugucagggucggccccgccugccucucaggugugugugauuucaggugauuacguuuuugaagaagaaggacaaguucaucagccugguguugaagcacaucggcaccucagcgcuuauggaccugcugcugcgccuggucagcuguguggagccagccgggcuccggcaggacguccugcacgugagugcgggaguccccccccguucccgagggcaggggugcugcaggaagccagcugguuaagugcaggagcucagagcaccagggcgcccggcccccaucucuccaccuagcgugcauuucuccguggggcuguuagggguucuugucaaggauuguggccuguaccuuuuccacugucccgacuuaacucgcucagaagcacagagcagagaggucccuucuccccgcagucuccagccuccggcucugugaagaggccgaaauggacuuuccucgccugccuccuuuuccccugccagcgcccaccccuguggcuuagagcaggaggucagugaggugcuagcccugcguccaggccugugccugccaggagagccccgguggacagcaguucccugcagagccccguuguuuacccuggaguguggaugcgucuguucugaugguguuuagucagugagaacaggugcuacaguucccgaaaagaggaggaugccccccagauaagcccaggaaauccgugcugacaaacuucugcucacuguucggccagcuuuguuuguggugaaguuuaaaauagaguagaguaaacccugaggcgcucugccuguuucccagcuccuggaaucaggacucauccgaugaccacucucacucuuagguuaguaaugcuuccucagggaggagcuucucaccaggaaugacugaccgccaccaaccuuuacacaguggacacaggaucaguacuagcuguggucauagccguuagugggaagccugcagaacuguacgucaggcagccuuuuagcugcuuuacuugauucacuucacgaaguagccacggggggacagcucaucccauuuuuggauaaggaauuuaggcacagggcgcagcagugcggugcgguagccagguacggcccaggccugccagaccccgacacucacacugggcccccguugcccuugagcuuuaccccacaguguucguguagccucuccaggguggaguuacucuuccucaacaugggaaggccccagugcugcagggaacagcugaggcuucucuggcuucagcauccagcggggcuccugagcuauagcuuguguggcucauuugcacccugguccuuaagagagaaguccugaagacagagcuuacauacgcaccauuaggacagagggaugguggucauccuuuaucaucuuuugagccacucccagaaccucccagaacucagucauuguguguuauguguguucuuucugggucuggggugugucaggcaaagagucuauauucuagaaaacgggugcagugcugcaccaaaggggaaagguuccuguuguuuacuuagacuugagcagcgacacugaaaggccucuuuuucucuuucaguggcugaaugaagagaaggucauccagaggcuuguggaguugauccacccgagccaggaugaagaugugagugugcugcuuaccgagcuucgugcaucaguccaggccugugcugccaggucacccacugcugcgggccagggggcgagggagggcaagucaucccuuuccuaagaugaggaucgguuagguacuuuucuuucuuuaaucaagcacugacuucuaggcuggauuuuuuuuuucuuuuuuuuuuugagauggcguuucgcucuuguugccugggcuggagugcaguggugcaaucucggcucaccacaaccuccgccucuuggguucaagcaauucuccugcucacccagucgggugagccaccacacccagccucuaggcuguuuucuucuuguuguuguuguuguuuaaauagagaugaggucucacuacauugcucaggcuggucucaaaaaccuggccucaagugauccuccuaccucagccuccuaaagugcugugguuacaggagugagccaccaugccuggccuacacuuuuuuuucuuaacugaaaaauaaucuauguguauuauaaaaauaggacaggcgcgguggcucaugccuguaaucccagcacuuggggaggcugaggcgggccgaucacuugaggucaggaguuuugagaccagccuggccaacguggcgaaacccugucucuacuaaaaauuagcgaaguguggugucaggugccuguaaucccagccacucaggaagcugaggcacaagaaucacuugaacccaggaaggggagcuugcagugagccgagaucacaccacugugcuccagccugggcgacagugagauucugucucaacaaacaagcaaaccaaagaacaauucuaauagaauuguaucagucgucugugaccgaauagcaaauuacccugaaauguaguugcuuauggcaaguauuuuuaccuguagcaguaucaguuucuguggaucaggcgucugaauguggcuuaguggcucuucuguugagucucacaaaauacagucaucucagagcuccacugggguagaggccagcuccauggucacagauggcuuggcagcauccaguuccucagggcugugggccgaggccgcccucagcauugcaccacaugggcgucuccacagggcagcacacaacguggagcugagcuuuccccucacucuuaauguauuuggcucuuuagaccuggguggcuggguccagcccacacuaaaagagaugggggcuauaaaggcaugaacuccaggacgggauugcuaggggcccccuaggagccacccacccuggaagcaccuaaggugacaauggggcucccuguggugaucccuguugagaguuugggguauaucccaguaggccuuuuccuagcauuacacauaccgaucuauacauacaaccacguguccuuggcagauuggaaaacaguggugcugacucgugucugaggccuucaccgcugccuggccaaccacccuacuuuguucuccaucagcccacagggcugaucagacagacaggagaggccacguuggcgucuguaggaaacaaggaggccgcccugccugauguuggcgucuguaggaagcaaggaggccgcccugccugagaacuggagcccacccaugcauguggguguugugggcugauggccuggccugggucccaaaggcagaccugagagcuaaucuggcugcuuucuuuucucccuaaaauacuccugugaguguuugcuuucccucagucuucccacagcaugugaaccaaugcugcagggagucagggguuguuucucucuuaaucacauuugucuuaccuacagaacagcccuacauugucagcaggggcacguucccaucacggauugcguguuaauguuucccuagaaaagaugaguccucuguuuucuugguagcaacuucccuauuuucauuagcuuacaggacucauucugaauaauagcagcuacuuauuaccacauuuaaaauauaguaucaguaacauggccacauauucagcauauuucaaaacguggaucacagguauagcccaguaucugcauugcauaucugaccauuauuagcccuguuuugaauuccugaagauaguucaaugcagcuuuaaaaaaaagaaaacucuaaccagaucuacauuuugacgacagaaaaggcagacacaggcuucuuugaaaugaagcuguugucuggaaucuuucuuuguaggaaacugguuuagagaaagucccacaucuuuuucuuuuuuuuuuugagauggagucucgcucugucacccaggcuggagugcaguggugcgaucuuggcucacugcaagcuccuucucccagguucaagccauucuccugcccucagccaaccgaguagcugggacuacaggcacccgccaccacgcccggcuaauuuuuuguauuuuuaguagagaugggguuucaccguguuagccaggauggucuugaucuccugaccugaugaucugccugccuuggccucccaaagugcuaggauuacaggccugagccauugugccuggccaaaagucccacaucuuaaaaaaaaagaaaaaguauuugaacaucacagugguauugaacaacaacgaaagucuagcaucugccagagaagcagcaggacuugugcccugugugcccagcagggcugguccugcuguuucuucuccacacugagggacucuguguuucccuugucuuuucagaggcagucaaaugcuucucagacucucugugacauaguuaggcugggcagagaccagggcagucagcugcaagaggcucuggagccagacccgcuccucacagcgcuggagucgugagugcuggugggccguggugcuggugggccucccuuucugggucauggggacgucugugagccuugcucugagcaccaggauauguugccaccuccucugauucacauucgaaugaaccccagguucagagcccauguuaacuuggggccuguuuccagagggaggggucuccagaggagucaccuggugggucuagagagugggccagcagcagcaggaguguccugagaacccuggcgccuugccuugagccugagcagguugaggguuuugcugggguccuccacggggaggaaggagcauccuugcauccuuugugugugugucugcucugccaggcagugaccucuguguguguccagcaggcaggacuguguggagcagcuucugaagaacauguuugauggagaccggacggagagcugccucgucagugggacucagguguuacucaccuugcuggaaaccaggcggguugggugagucucacgaggagaaaucguguagagcugaacuugacgccucagugauauggcagcccacacgagcagucuggauuaugucauuugugguuuuaauuuuugauuaugcaaguaacaacauggauagauuccccuuguugaaggcuugacuuuauggcuguggccaaguccccuuagacccucaucaucacuggugcucccucuccagccugaagcugcucgucacgaccaguuggcgaugcauuugucgaugugcguggaacaggugugguuggcagguuuuccccaaggacuguuccgacaaguccccacagcucccguguguguuugugugugugucgcaggguuuccacucugaugcaugguuacauauacauguguuuaucucccaugcagacuggcccucacagggcaggggugugacacucaccgcugucucccgugcccugugcacccacgggucggcaccgccugcugagcgucgugcugagcacuuuuuucccaggcgacucuccuccauugcccuuucucauucaucaggugucauuucugcacccacugugcacuaacacgggcccgaggagacagagaacugagacacagccccuccccuuuaauugcucccagucuggcacaggaggcccgucuguggacagcgagggugaugcagaguggcgagugcaguagacaugcacccagugccucggggcucacaagaagggacccacauggggcugguggguggagccucgcagucagggacauuuucccugagaggccgcaucuggucagacacagcuccuuggaugaggcagugagggggucccaguguggacacaagcauggggcaguauguggcagaggagaguggagcuugcuuggaggugcuccuuugcugugaccccacaucgcuguccugaggugcagcugucggaggcugcugagucacgacagugaaugggcagagacagaggagucagcagcagaagagugaguucgggugaaaguugaguuuguuugaggauauaggugcuggagacccuucucugacccccaguagaaauuucaggaaguguuugaaacuguuucucuggaucauaguguggccuaguccuucccucaagucauagaaggcugggcacugccagagccguucaagcaguugaaacuccaaagaggaugcccaugaggcgcaaauggaaagacagccgaguggagucugugagggaggcauuggcacaagggggugugguuggcccgccaggugcccaggagauccuauagggugugucccaaaagggccacaucaguguccucugggcacuuccccuccuggccucacccuggcccuugaaccccaucucuggauucagguuccccacaugccggcaggaaccugaugucucaggacguuuccgucgucuccguuccaucacaggcugggacgaugucuaacucucccaagguggccguagcucccuuauuuccacguucuggggagaacauaauucagcccccaacacugauagccugugcuuuuuuaaagugaaagaaaaaggaacaaugagaaaaugauaagaaauugacuuaaccuugauagugagguuguuaggacucucuuucucucucucucucucucucugucugucucugguaguaccuaauacauauuuguuaguuuauuaaccagaaguaguguuauaauguuaccguuuucucuaguuaggcaacuggaauauugauauuuuaaucuucauaaacccaggaaagcugagccacuucugaggcccaagcuuaacccuguaugugauagaggggacuguguaaaaaucaggaaaacagagauaagccagcuguuucucuuagauuauugugauuauuauuauuauuauuuucagacagugucuugcucugucacccacgugggaguacagcagcacgaucauaucucagcguggccucagaguccugagcucaagcgauccucccaccugucccccccaaagugcugggauuauaggugugagccacugcaccuggcucucugauuuuuaaaauuauuuugcauauuacuuuaaaaaauauaugauuacguauuacuuuuacaacuggaaagaguguuuaaauaaauaucucagaagacuugcuugaaaacaccacaggggguaggcgcaguggcucacgcuuguaaucccagcacuuugggaggccaaggcggguggaucaccugaggucaggugaucgagaccagccuggccaacauggcaaaauccugucucuacuaaaaauacaaaaaggaggcugaggcaggagaaucgcuugaacccaggagguggagguugcagugagcuaagaucgcaccaucgcacuccagccugggugacagagcgagacucuggcucaaaaaaaauaaaaauaaauaaaaauaaaagucgacacaggaacagugaaagagacagggauagcagugaagguuuuaaaagugggacagagcaggaccucuaacuggugcuagggccagugaguccuguguugugucacuugcccugccuccauauucucggaugucgcaagcaagcaucugccugaaggucuuuaguaccuuucucuucugccuguaccagucaccagaucacguguggagacgcuggguagcugcacugcucuaggguuucuuuuugggaaaguuaaaagggcucuuucuggaagaagcgggugcacugaguugcuggugagguuggacaggguccugguguccccggucuccaucugcuuuccucauccacaggacagagggcuugguggacuccuuuucucagggacuggaaaggucauacgcugucagcagcagcguacuacacggcaucgagccucggcugaaggacuuccaccagcuccugcucaacccgcccaagguaaauggccguggcgacugcugagugccuuuggaggcgucgcaggagagguugauuugcagggaggagaagccacagcuugucccauagguagcagaguguggagugaauguguucuaagacggccauucccacacccccacuugagaagcaccgggcaggugccaaaacacauuuucaggacugccccucccagaucugcaaaugcucaucucugccucugcaaaugaccccgaggucaccauaagccuggccuccaaguugggggcaccuagcuaaggggugcucggcuccugagaggggaccaggggguggcaggggaggcccuuugcccugcucagcagcauguugaggggggugaggcacacaaaggcuccuccugguucagacugccagccaggcaacuccccaucccgucucacccuccccagacacaacccgaccccugcugcauagcacccuccugaccuauagcucaguuccucucacucgccaccuugguaagauccaccugucccacuagcgagcucugugggggccaagauucuguuuugucagcuggagguuucagugaagagaagguaggugcaguaggcugagugugggggaucagaaaagaccgcgguccaucggaggaggcauucccgucaguguccccaaaguguguucaugggacacuuguuagcuugguguucugagauuguggccgcagagggacccccacugggcauccucagugaggcaucgugccaagggcucuggccuuagaccgguacugcuggccccaucuuggacaucucacccgcugaggugcacggcucucuggcccugcaggcucagacuggagugcccgugagcauccugggagcacucucugaagcccugaggggagcagcaggcucuucaccccauugaugccuucauuucuucuggcagacggcccucccugaggaacccccaccacauaccucgcuaccccaggcugggucccagccuagagugaugggcaugagcccagagacuccagcaguggccucacugcucacagggccuaacuggguggugccuucuguguuugcagaagaaagcgauccugaccaccauuggugugcuggaggagccccuggggaaugcccgucugcauggcgcccgccucauggcagcacugcugcacacaaacacacccagcaucaaccaggagcucugccggcucaacacgauggacuuacugcugguaagugggccccucagccagcccugcaugucugugagugugccgggcauggccuguggacuugucaggagcagcagagcagggccccagcauuuggacaaagcucugccacggggagguuccagucccaagucccaaggcuggacuacaggucucuggcggggcacagagcagcaguggggugugucucagcugcaggcucaugggaagugacgagucuaccguagaauugcccugaaagcagaaggcggauuucuaacccgguuugauggaauagagugacacgucuaccuccuuucucauguucugacugaacaacauagaacuuacacggugguuauuagguauaaaauggcuaaaagagaagcuccugucguccacaguagaaggccaaccuggcaguuuuugucaaagccagcgggcagugccucuccaucccgcagacggcuugcaugaugcuccagguggcugaggagaggaaggggcaggcggugcuggcaaguagugccagugagcagcccuggcuguggguggcgggcuccucugcggagagcaugaggcugcuccccugagaacgaagggcacugcccuaguggguccuguuggcagacgcagcccccgucuucugccuggcucuggggcucugcuggaaucucccugcaaucuuagucccagaacugggcucgaagugcugucuggcucaguucugucagcguguggaaggucuguccgcguguggaagguccguccgcguguggaagguccguccgcguguggaagguccgucaguguguggaagguccguccgcguguggaagguccguccgcguguggaacgucugucagcguguggaagguccguccgcguguggaacgucugucagcguguggaaggucuguccgcguguggaacgucugucagcguguaugaguucugggcacugcuuuggcugugagaucccagucugcaucagggaagcaauuacaaaagagaccuacuuuccuuuucccucuucuucuuuuuuuuuuuuuuuuuuuuuuugagauggagucucucucugucgccaggcuggagugcaguggcgggaccuuggcucacugcaaucuccgacucccugguucaagcgauuuuccugccucagccucccgaguagcugagauuacaggcaugcgccaccaugcccagcuaauuuuuuuuuguauuuuuaguagagacgggguuucaccguguuggccaggauggucucaaacuccugaccucgugauccacccgccuuggccucccaaagugcugggauuacaggcuugagccacugcacccagccccuuuuccuucuucaaaagaauucugucuuccacuuucuuccucucuuuuauauuuacugugguaaaauaucauaacauaaacuuggcuguuuuaacuauuuuaaggugugucacucagugcauucacaaucuuguauagccauuaccauuauucacaucuagaaguuuuucauuuucccaaacagaaacucucuccguuaaacacuaacuccccauucauucucccucuccacagucucuggcaaccaccauugucuuugucucugaauuugacuauucuagguacaguuuaugaguggaaucauaaaguauuaucuuuuugugacugacuuauuucacuuagcacuaugugcccaagguucauucaguauuguacuguauguccaaauuuccuuccuuuuuaaggcugaaaaauuacugugugggugggccacauucuguccauucauccauccaucaguggagacuuggguugcuuccagccuuggcuauugugaauaacacugcuguauauguggguguacaaauaccuguuugaguccuuacuuucaguucuucugaaaguaagaagaaguucuucuggauaaauaccuaugaggccaggucaugugacaauuccaugauuaaguuuugaggccagaccuuuccacaguggcugcaccauuuuaucuuccugucaacaaagucuccccuuucuccucauccucccccucaucccgccgacacuugucuuccuucuucugaugcucgucaucugaugugcguguggaacggugucuccguguggcugaugcucgucaucugaugugcguguggaacagugucuccgugugacaagugaugucgagcaucuucucgugcuuuuuggccaugugaauagcuucguuggagaaaugucuauucaaguccuuugaccauuuuugaauugaguuuuuuuuuuguuuuuuuuuuuuaguuuuagaaguucuauauauauucuggauauuaauccuuuaucagauauaugcaaauauuuucuuuggguuaucuuuuuacauaaaaaauuuuuuuuagauguagggucuugcaguacagugaucauagcuuccuguaaccuugaacuccugggcucaagugauccucccaccucagccuccugaguagcuaagacugcaggcaugcgccaccacauccagcuaauuuuuauauuuuuuguagagauggggucucgcuauguugaucaggcuggccuugaacuccugacuucaagugaugcuccggccguggccucccaaagugcuggaauuauaggcgugagccaccagccacccagccuuuacuccuugauaaugaccuuugacacacaaguuuuaaauuuugaugaaauccaauuaucuuuuuuucucuguugccugugcuuucggugucauauccaaaaaagucauugccaaaucaguaucaugaagcuuuuccucuaugcuuccuucaaaaaguuguauguuuucucucuuauguuuaggucuuuaauccauuuugaauuaauuuuuguaucugguguaaaguaaggguccagcuucauucuuuugcaugggguuauccaguuuucccagcacuuguugaaaagacuguccuaggccgggcacggugguucacgccuguaaacccaguauuuugggaggccaaggcaggcagaucaccugaggucaggaguuugugaccagccuggccaauguggcgaaaccccaugucuacaaaaaauacaaaaauuagccaggcaugguggcagcgccuguaaucccagcuacuugggaggcugaggcaggagaaucacuugaaccugggaggcggagguugcagugagccaagaucacaccacugcacuccagccugggugacagagcgagauucuguuucaaaaaaaaaaaaaaaaaacaccguccuuucccccaugaauggucucggccuaauuguuaaaaaccagcuggccggccgggcgcaguggcucaugccuguaaucccagcacuuugggaggcugagguggguggaucaugaggucaggagauugagaccauccuggccaacauagugaaaccccgucucugcuaaaaauaugaaaaaauuagcugggugugguggcaugugccuguagucccagcuacuugggaggcugaggcaggagaauggugugaacccgggagguggagcuugcagugagccgagauugugccacugcacuccagccugggcaacagagcgagauuccaucucaaaaaaaaaaaaaaaacagcuggugaugugugcaaagguuucuuucuggacucucuguucuguuucguugguuuauaugucuguccuuaugccagugucgcacuguuuuggugacuguagcuuuguaguaagugauaagugugaguuuuccaacuuuguucuuuuuccagauuguuuuggcuauucaaagucaucccgugagauucuguaugaauuuggggauggguuuuucaauguuugcaaaauugcuguucagauuuugguagggauugcauugaauuuauagaucacuuuggguaauacugucuucuuaacaauauuaagucuucaauccaugaacacagauguguuccuauguauuuauuuauuuauuucuauuuuugagacagaaccucacccuguugcccaggcuggagugcaguggcgcaaucucggcucaccgcaaccuuugccucccggguucaaacaagucuccugccucaaccucaugaguaccugggauuacaggugcccgccaccacaaaauaauuuuuguuuuguuuuguuuuuuuugagaccgagucucgcugucgcccaggcuggagugcaguggcgcgaucucggcucacugcaggcuccgccccccagguucacgccauucuccuuccucagccucccaaguagcugggacuacaggugccugcuaccucgcguggcuaauuuuuuguauuuuuaguagagacaggguuucaccauauuagccaggacggucucgaucuccugaccucgugauccgcccaccuuggccucccaaagugcugggauuauaggcgugagccaccacgcccagccaauuuuuauauuuuuaguagaaaugggguuucaccauguuggccagguuggucucaaacuccugaccucaagugaucugcccacauuggccucccaaagugcugggauuauaggcaugagccaccgugccuggccccauuuacuuuaaauaggucuuuaaauucuuguagcaguguuuuguaguuuucaguguacaaaucuuuuaucuccuugacuuaauucuucuggaugcugucauauauaaaauuguuuucuuacuuuccuuuuuggauuauucagugcuaguguauggaaaugcagcugcuuuuuugugugucaauuuuguauucuagaacuuugcugaauucauuuauuagcucuagcaauuuaucuggaauauuuagaauuuucuauguguaagaucauaucaggucaggugugguggcucauguuuguaaucccagcacuuugggaggccuacacaggaggauugcuugaacccaagaguuuaagaccagccugggcaacauagugagaccuggucucuacaaaauaaauaagaauaaaaauuaggcaggugugguggcacagaucuguagucccagcuauucaggagacugaagagggaggaucacuugagucugggaggucagggcugcagagccgagaucacgccacuguguguacuucagccagggcaacagagcaagauccuugcucaaaaaaaaaauacauauucuaaaaaaaaaaaucaugucauuugggaacaaagauaauuuuacuuuugccuuuaccauuuggaugccuuuuauuucuuuuucuugccuaauugcucuggcugggacugcuaagagaagaccgaauagcaguggugagagugggcauccuugccucgcuccugaucuuagagaagcuuucagucuuucagcauugaauauguugucagcuaugggcuuuucauaggugccuuuaucauacugaagauauuuccuucuauuccuaguuugaguguucuaucaagaaaguauguugaauuuuuuuuuuuuuuugagacagaguuuugcucuuguugcccaggcuggagugcaguggcaugaucuuggcucacggcaaccgccgccuccugggcucaggcgauucuccugccucagccucccaaguagcugggauuacaggcgugugccaccaugcccggcuaauuuuuguauuuucaguaaagaugggguuucaccacguuggccaggcuggucuugaacuccugaccucaggugauccacccuccucggccucccaaaguguugggauuacaggcaugagccaccgcaccuggccguauguggaauuuuaucagauuuuuuuuguaugaguugagaugaucauuuggcuuucguccuuuauccuguuaaugugguguauugauugauuuucauacgucgauccauccuugcauuugaggagcaaaucccacuuuauccugguauauaauucuuuugauaugaugcuaaguuugguuugcuaguauuuugcauccauguugauaaggaacauugguuuguaguuuucuuuucuuguaguguccucauucagcuuugguaucagagguaauucuguccucacagaaugaauuagaaaguauucucucuuaguuuuuuggaagaguuugagaaggauuaguguuaacucuucuuuaaauguuugguagaccucaucgccaggaaaggaaaaacaaacaacaaaauaaauguuugguagaauuuaccagcaaagccaucugguacgggcuuuuuguugagagguaggucugacuccauguuacagaugaggugacacaggaaagccuccuccaagguugcucaaggucacaugggcagagaaggugaagccaggauuuaggacuacguuucuguggagaacaugaagcaaaugagccuccugccuuucucuagcuccaaccccacuguguggaacgaggagcccaagcucgaauccugguguggaauauacaccucaccccauuccccucuccauacaguccuccuucuccauggaggcagaagagggucugggacacaggcugccguggcccuggaauguaagagacggcaguggggggcgagugcgucagaccuaugucccccucucuguccucaucuggaagaagcuacaugggaggugagagauggcagcuguccucguucagccaccucugucccccaggggaguaucuagguggccagaaccaccucugggcuucagcccaugcugguuaagucugggcucccuuggggagugucugaaugugccccucacagucucacguuugugugguggacgauaugcacacgccugcccauccuggguggaauccucaugugcuugagagucuaacacacuuccaauaauucaugagaaagacagaaucauaaaggaacuucucacauacuuagaacugaagaaucauaaaaauacuacuuagcaaaauguguagaauguaguuaaaguugauuguauacagggaaauguagccuuuaaagacagacuggaaagaaaggcugcaauuaaugaguugagcuuccaacugaaggacaaaagaagccaggccuggugacuuaugccugucaucccagcacuuugggaggcggaggcgggcagaucaccugagguuggaaguucaagaccagccugaccaacauggcaaaaucccgucucuacuaaaaauacaaaaauuagcugggcaugguggugggcaccuguaaucccagcuaccagggaggcugaggcaggagaaucacuugaacccaggaggcagggguugcagugagccgagaucgugccacugcacucuagccugggagacaaagcaagacuccgucucaaaaaaaaaaaaaaaaaagaauaaacccgcagaaaguagaaaggugaugauucagauugaagcagagaccaacagacacccacaggcaggaggcagaagugcucaguggcuauuugaagaagcuccguaauagagagaugacccucaggaaaacgcuuaaaacuccuuccuagcuacccagagacuggacuugugaggaguuaggacgccaccuuuaggaaggguuucccucagcuuugugguguagccggcaggagaaaaccgaucuaagaacugucuucuguccucuguuuacccaggacuuguucuuuaaguacaccuggaauaacuuuuugcacuuccaaguggaacuaugcauagccgcuauucucucccacgcugcccgugaggagaggacagaagccagcggauccgagagcaggguggagccuccgcaugagaacgggaaccggagccuggagacuccccagccggccgccagccucccugacaacacaauggugacccacgugaguccaagaagcauccaucuuaucagcgccaacugcgccccacucagaccguguccaugucagcgcugacgugugccggaccucacugugcagcugacacgggggcagggcuuugaaaaggguccccaggugucuggucagacgcucguagacaguggggcuugagugggucuugcagaucucauuccuaccugccuucagcagggguacuggugccuuccacgugcaggccuggcaaggguuagcacuggaugagaugaguucagucuggccuccagcuggaggcccagggaauaaaugcccagggagccagcagugucagugaugggagccacacgguggggaggggaugcugagggacaugcaggccaaccagggacugucacccggauagcaaggccacagguauaucguagugugagguggagcccaggaaaaacaucucagguacaagaagugaucugugucagggccuggaggugagagaaagugcugagggcagacagcccuagucguucuuccggacacagagaaagagggcaggagaguggccaaaguggagggcaauggagagacggggagaaggcccaggggaagacaggggucagggggcaauuccaggaguuggaggagaagggagaggguccuuuucucgggcuucaucuuuagggcgcucagcaguaugagccccgaaccgcacccuccucugguguuuggugaggaccgcggaggcuggggcugugcgugcgcagcagucagggccugcaaaguccacacagacguggccgccagccagcccugcccaguccagggauggguggaggggugcgugccgccuucagacccugacucacgcugucccccugccccgccccccagcuguuccagaagugcugccuggugcagaggauccuggaggccugggaagccaacgaccacacgcaguaagagccgcucggacguggagggacccagccuggccagucagggaugcagagacgcaccucacccaagcccuggugacgcugcgugcaggacugcaggaucggguggaguguagggugugcgacguggcuccacguucuggggcugcugugcaaggggcccuucuacugggcggacagcugcaaaugcuacuuggggaggggacacagggagccgacaggaagcggucccguccccaccaggcaccugcucuggcccccgcccagccuggcuuugcccucuuguggguccgcuguccguuccugaucuuccccaggaacucgggcccuccgucagcacucgcacacagggacgcguuauuuuggucuuuccaucuucugcuuaaugggugcucccucuggucaggacacaugucccgcuuauugucgugggcccagagccauccccacccguuugcuguccugcugggaacugucuggcucugggcgauaugaggagggacuccagggagcugggaggggucugagugcagcuguggggaagcagaggccgagcugggcuguacagcauggaggucccgcccaacccuccccuuggggugcugagccugagcuugguagcuggcagcaugggcucaccuccugcgccacugcugccaccagcgggacuuaggccacgccacggccuuucugccuccauuucccugucuguaaaauggagugagagcagugucuguuuccucaucugucucaguggcacuuuugguagugagguuggggugagccugcugcacguggcaggugcuacucaaacagaaguguccuggaggagggcagggggcgcggacacugggcaggggccgggcauuugcucuggaggugaaccuggaggagggcagggggcgcggacgcugggcaggggccgggcauuugcucuggaggugaaccuggaggagggccgggggcauggaugcugggcaggggccgggcacuugcccuggaggugaaccuggaggagggcugggggcgcggacgcugggcaggggccgggcauuugcucuggaggugaaccuggaggagggcugggggcauggaugcugggcaggggccgggcacuugcccuggaggugaaccuggaggagggcugggggugcggacgcugggcaggggccgggcauuugcucuggaggugaaccuggaggagggcugggggcgcggacgcugggcaggggccgggcauuugcucuggaggugaaccuggaggagggccgggggcauggaugcugggcaggggccgggcauuugcucuggaggugaaccuggaggagggccgggggcauggaugcugggcaggggccgggcauuugcucuggaggugaaccuggaggagggccgggggcgcggacgcugggcaggggccaggcauuugcccuggaggugaaccuggaggagggccgggggcauggaugcugggcaggggccgggcauuugcccuggaggugaaccuggaggagggccgggggcauggaugcugggcaggggccgggcauuugcucuggaggugaaccuggaggagggccgggggcgcagacgcugggcaggggccgggcauuugcucuggaggugaaccuggaggagggccgggggcauggaugcugggcaggggccgggcauuugcucuggaggugaaccuggaggagggccgggggcgcggacgcugggcaggggccgggcauuugcccuggaggugaaccuggaggagggccgggggcauggaugcugggcaggggccgggcauuugcucuggaggugaaccuggaggagggccgggggcgcagacgcugggcaggggcugggcauuugcucuggaggugaaccuggaggagggcugggggcauggaugcugggcaggggccgggcacuugcccuggaggugaaccuggaggagggccgggggcauggaugcugggcaggggccgggcauuugcucuggaggugaaccuggaggagggccgggggcauggaugcugggcaggggccgggcauuugcccuggaggugaaccuggaggagggccgggggcgcggacgcugggcaggggccgggcauuugcucuggaggugaaccuggaggagggccgggggauggaugcugggcaggggccgggcauuugcccuggaggugaaccuggaggagggccgggggcgcggacgcugggcaggggccgggcauuugcccuggaggugaaccuggaggagggccgggggcauggaugcugggcaggggccgggcauuugcucuggaggagggccgggggcauggaugcugggcaggggccgggcacuugcccuggaggugaaccuggaggagggccgggugcgcggacacugggcaggggccgggcacuugcccuggaggugaaccuggaggagggccgggggcauggaugcugggcaggggccgggcauuugcucuggaggugaaccuggaggagggccgggggcgcggacacugggcaggggccgggcacuugcucuccgaagugaaccuggaggccucugccacuuggcucucugggucgugggucuggcaaggucggggccaggaggccgccccgauggugccuguugcuuucagggcagcggguggcaugagacgugggaacaugggccaccucacacggaucgccaacgcgguggugcagaaccuggagcggggcccugugcagacgcacaucagcgaggucauccgaggugagcccccaacccggucauccuucugcuggucgcgggcaccgggaccccgaaggagcugccgccugagacuaagcucugcccggcagcaggugcugacugcacugacagugagagacccauggccaccucuguccucucacuucacacaucacaucucuccucgugggggccugggucucaugugucaguucuauugggcggacuucuguggagacccugccaggcgucagcguguggcacaagagacagucccucccgggguaguuggugacuccggagcuggcacucagaagccguuagcgccaccgggcuccuugcagcucagggagcccugccuggcuaggcuguccuggcugugugcucugcacucaggugauuggagagucucauucucacucaggugugagauuucguagcacaagucucaggggagcagguugcagccuguuucuuaagaacgcaguggguuaggugggcgcaggcacagcacauguguggcagaggcgggcccagcuguggccucuccucccuauacccguguaaggugaggaagcucuggauaguccuccccgcaccccaggaccauagugaggggacuccuggguugggcuccauuagccccuggcgaggucaggccugccggcugccaucacaaauaauaaaagcagggcaggaggagcuuccccacauccuggagggcaaaguagauggguggagguggaggccagggacagcuccccagggcaggggcaguuuaaggaggcgaggggcaagcaggaagcuguuggaucauuccauacgaucuccagauugugaauccuuccaggacucugaccuccccggaaaaacaggcaggacacgcgcccaggccuguaggcugcugcugaguuugggccugugagguggggggaaggaagcuggcugcuuucucagauucuguuccacggcuucugcguuucugggaguuccucagaaugggcuuccacccaacagacuuggaacucagaugcccacugggguuucgguaggggcagaagugcccaccacccugcccacaggugcugcaccucaaucucacuguggccccaggccccuccggacacgcggcuaugcugccucuuucucauccggcaaagccccugcuucaggcccucagacgggcugaccacaguagcagcgccccauccucccggacccaggaugcaccugccggagcccccgggugcccugcaccaucugcacggggucucccagggcucaccaggcagcacuucccuugcagggcucccugcggacugccguggccgcugggagagcuucguggaggagacgcugacggagacgaaccgcaggaacacuguggaccuggugaggaggcucggggcugcccccucggugcacgcacggugcugggacgccgucagacgcuccugccuuugcccugaggcagaggccaagggaggcacaagggccgcacgccugccugcuccucuugacuaugcggugccccugcauaguguguccuccgggcugauguccguaacagagaccccguccugugccacacccagggcugggucucugaggaccucugugcagagccgguguuggccucaggucccuuuccucccacuccaggagcuguagcuuguuggcagagggcuccuuuugccugagacccacaaccugcccccugcacauggaggucgggcugucacggggccuuggccucaccuaggcaccuccuuacacagcacggccuccugggcccagagaucugaugagugaugugcuggguggggucugggagcccugggcugggcaugguccugggcgcugggcuggguggggucuggggcgcugggcuggcucacacgcccaccccaucuggccuguguuuuaggugagcacucaccaccuucacuccucaagugaggacgaggacauugagggugcuuucccuaacgagcugucccuucagcaggugagggcguggccggcaccugcacccugccgggcccuucccggcaccugugugcgcugcgcuugguccuccagacgagucugauggcaucucacuagcaaaggggagcgggggcucgucuccgagcacguauggggcggggugggucugaagggagaaccccaaagucacuccaccuugaugagagcacugaggacacggcagauggacucgaaagucagagaauauggggcguaucucagaugugaccgcagcgagcgcgcagccugaguuuugguagaaucgugagcccugaacagaguuuacugcccacuugugcuggaggagaagcucccgaacaacuagagagauugugguucccaaagagcagccuccaggccugaugccuccuccaugaccggugucuguccgucccucccucccucccucccucccaggccuucucugacuaccagauccagcagaugacagccaacuucguggaucaguuuggcuucaaugaugaggaguuugccgaccaggacgacaacaucaagugagucuacuuggagcgcacucugcacgaggcgcggcucucccugcugcugagcucccguggaggcagcucccugaggucuugccgggagugccgucugauguccccgggagacagcagguguucccaguugugugagggugcugaggcccccgaugagcaccgggggaggagcacugaggccccagaugagcagugggccuggaggaacgcugaagccaucccccuugcucuugcagugccccguuugacaggaucgcagagaucaacuucaacaucgacgcugacgaggacagugugagcaagccgggcuguguggggugccgccacccuuuucccaggcagcucaggccaugcccauggcucggucugucaugggccugugcgguggggcugggagaggccccucuguggagcucggaacagucgcuuuccuugccccuccccguccuccccuccagcccggggcucccacaucccgaacuaagccccucugggagcucuauggggagagcggcuccugucucccccagacccucuggaaacucaccuuggcguuuuacucugcagcccagcgcagcucuguuugaggccugcugcagugaccgcauccagcccuuugaugaugaugaggacgaggacaucugggaggacagugacacucgcugugcugcccgggugauggccagacccaggugcggggccugcccauccccacaaagccucugccgaggagguucagcccccagaacaccugucagacgcccugugguucguuagcuggcuugcagagcagccacaccuguccugccagcucuggggcccaaugcagcgggugacccuaaggagcccagagcugaggccuggagcgucucgugcuccucucucgagacgaucugugcucacccucagccccgagccuggggccgccacugacccuccauguuaggcguccguccugggccaccagacaucugacucugaaucucccccagguuuggagccccccaugcuucagagaguugcucaaagaauggcccagagcguggaggccaggaugggaaggcgagcuuggaagcacacagagaugcaccuggggcaggugccccaccggcccccgggaagaaggaagcgcccccuguggagggugacucagaagguggugcugggcgccaggggcugggaguguggguaucggggacaggacaugguaccccggccuggguguuguggaggcuucauuuggagcugaggcauuuggggcucacuguggcccggagccugaauccccagcuauuucccagccguccugaguaggggucugugcugcgcugugcccagcgcaagguggccuccugccccugccuugcaguuguggucacucagccacguugccaaggcuggugggugguguccaccuagucuccaucguccguccagcccccacacagucaggcacaggccugacgcccuccccagcacagcagcacaggccggccgccaccuucauggccgacaucuauggcaggagccaguccaccucacaggccgcauggcugaugagaccccucuccuuacccugcccugggggcagcacugaggcacucaggacuuugguggcgggggcagagaucucuguuaggaggggcugagcucuucgcugacagagcaagggugacacccuggggaagcaggaacaucccagauaggaggaagacaccccauccucgaggccaggaaggggccaguggugcucggugagcugccggcucuguggguugcgguccuggguaggacagggcaguggcaucaccuccacacugucagugucaguccugcuggaggccugggggcccucaggcaccugacugagccccaggucacacgccccaugggugucggcagcuugucaggacccucgagcuguccccuguugcuccuugaggggcugacgggcacugccugggccucccuccuggagcagccccaucuuccugucaaccucugaggggcucccggggcaggggcgcugccuccccuuugccugcagcaccccaggccugcccacgccugaccacugugucucucccccagcaggcgccauguggacggcaguguuugaugagccagcgaacucaacgcccacagccccaggaguggugagggacguggguuccagugugugggcagcuggcaccucagcuccagaggagaaaggcugggccaaguucacugacuuccaaccuuucugcugguaacaaaugcgcuggcaggagggggcugugccaggaagugccugucagggccaggaggcaccugucccccaggacugauccuguccucguccuuguaugcagcuccgagucagggcccaggugcagcucuccgguggacacagaaugcagccaugcugagggcagccggagccaaggcccugagaaagccugugaguaggagcagugcaggcggcacccagccuugcccaguuuaaggccugaggccagcuggccccccuccuugggggcagugggaggagguggccggggccucgcaugcugcuacgucucuggugacauugggguuugauacagcaaugggacuggagcagccacguguagauggggaggcccccagaggggaggcagcaaggccauugggcuggcucugagccuggucugaguagguggcacagcucaggucugcacccuggauuccggacagcagcacugggaccccagcauugagauguguguggguggguuguuggcaggaagcuguucuguggccugaucagagccccuggcccccagcccccuagucaggcucagaagcucccccagauaaggcugagagcuccaggugagugacagcuggcucccaacacugguguccccgguuuugggguccuuugggcuuaaaggagcuguggcaggaccacacgaggcggagugggccccucccugagccucugcguccuccugugagaccagggcaugugucccuguaucaugggggaggcaacaggguuguuuguguggagaccccauggcaggugcgugagccugucugccucaucaugcggcucccacacaggcacaugugugcaggcaacaggcugcaugugagagggccacauguauggggacccuauggcuggaguggccgcacccugugaccccuccugccucacuggacagcacaggccuccuacuuugcagucagcccggcuucuccaugugccuggaacgugugugucaccaggaaggccccccugcuggccucugacaguagcuccucugggggcucccacagcgaggauggcgaccagaaggcagcgagugccauggaugcggugagcaggggucccggccgggaggcccccccgcugcccacaguggccaggacagaggaggcugucggcagguguguggggcguggcgggggcgggccugccgggugcauagggcguggcuuccaggcucuguccccaggucucagcuccccugagaggaggugaggccaggccagggucuucuccacacugccucccccauggccccgugacccuucagaggcuggcugaggcggcgguggugcccacgcguuuacguggaggccagaugggagaaguguggggccuucuuucguggacagaacaucguguucucuguugugagugguuaagacaagaagacagggccuggaugucccagacagucccccagggacuugggggagcagccccuaccccagaucccaguuggagagaacagcccagcucuuggggcucugggccuggcugagccgccugggaucuggguacccugguggucggggaggggcacagacuuuuaagucuggcaggcgagcgggcaucuguggggcucacgcagaccucgccugcugcuccccuuccacgggaggccuaugauuccgagacgccucagaagcaggauaguaggauggggggcggcggccucaggacugcacugggggcauccaaauccugacugagaguuggaggcagcuugcaggcuggcagaggcccaggcucccuugagcccccaagagccaucccuggggagagaguggagagggaggcucucccugugaggagguuggaggcuggccggccccuccagcaagcugaaccccauccguccccagggccacaggaaggucccugggauccuucaguaaacagauaccucucuggccucuggggucagggcguggguuagcaggagggcaggaccgcugggguagaugccagggccagguaaaccugagggggaggguaggacugggcuugacguggggaggagggcgcacccagcaacggcacagcugugcaaagacccugaggccugagcucccaguagguccaggcaacaguggggaaguccucgggcuggauuccucuaggaggggacaaggugccuuucacaucugguggugcaucccagucacuccuggcuccaugguugugaagggccugccuggagcggggugagggugucccccagccucaccgcccaaugcagcucagccugcaugcgucccaccuguacuacccuucccccacagguggggcaggccugacaccucagaggguccugcucacugacccccggcaauccuggagagucugugugguacuggggcuccgggcaucucccccagccaagcugcaagcucagcaccaggcuggcucuccccgcccuguugaccagcaggccccgucugugcucacagcuccuccccuuguuuggccacccugucuucagggcaucugcagcaaguggggggcacagcacgggaaacggggccaaggccguuucccgaugccggcagucacugggaagcccaggccagagccccucggguugaaagucauacagaguuccugugugggcuucauuccuucuuaaaguuuagucacugaaauuuuuguuuguuuguuugagacagagucuugcucuguugcccaggcuggagugcaguggcgcaaucuuggcucccugcaaccuccgccucccggguucacgccauucuccugccucagucucccaaguagcugggacuacaggcauccgccaccaccaggcccggcuaauuuuuuguauuuuuaguagagacgggguuucacuguguuagccaguauggucucgaucuccugaccucaugauccgccugccucggccucccaaagugcugggauuacaggugugagccaccgcgccuggccuagucacugaaauucuuaacagucuuuacccugccaggcacaguggcucacgccuguaaucccagcacuuugggaggccgagguggguggaucaccugaggucgggaguucgagaccagccuggccaacauggcgaaaacccgucucuacuaaaaauacaaaaauuagccaggcgugguggcaggcgccuguagucccagcuacuugggaggcugaggcaggagaaucgcuugaaccagugagccgagaucacgccacugcacuccggccugcgcaugagagagacugacugucggcaaaaacaaaaccaaaacaaaccuuuacccacuucuccuaaacaaccccuaaaaaacugcucugaaaagcagggaauaucauugugcaaaguaaguuguuuuuuuccacggggcugucugcguaaaacuugccacuuagagcccugccugcaccgucgucacggcccagccugcaggugagcuuccucgcgcccccgccugaccugagugccccucccucagucagacacagugucgucgcccugcaggaagccagggggcccgucugcugcucguggccaggcugggccuuggggugcccgacccccuccagagcaagccccuuagaugcccggcaggguccucucuacccucccauccccugggagguuuccccagacuguguccagugugaggcugaaguugagaucauagcacaggaggcucugggguccuugaagaaugaggcgcuugaugaugagcaggaucugagugcugccuggaggagguuugaggucaucaauggacaggcagcuugucccaguacuuggaacuuggggcagcagagcugccuagcugggcacaaccugggccaccccacaaagggcaggagugagaggggccaaagauggugcucccaggccgccuggaccuuuuuguccagcugguccuugggcaugaggcgggguggcacugagggugggggugcccguaaccggaguccauguuugccacacagggucgggugugcugacagccggcuguuaagcccugccugccccgcgccaaaggaagugacugcugccccagccguggcugugccccccgaggcuacuguggccaucaccacagcacugagcaaggcuggccccgccauacccaccccagcagucucuucugcacuggccguggcggucccccuagggcccaucauggcagucacagcagccccagccaugguggccacccuggggacagugacaaaggacgggugagcagguugaguguggggguaggggguguggacagggcccgcagcccgcacgguuccaaccccaccccauuccugcaggaagacagaugccccgccagaaggagcugccuuaaauggcccagugugaugcugcugccgcccggccacggcccacccuggucaggcugccuccuuaaucgagaaaacuaccuggugaugcaaucuuuuuuuuuuuuaauuuaauuuaauuuuaaaauaaaugcugcauugguaaagcuggcaguugaaaccaguuggacggcccagcuugcgucucuucugccugagugggccucucaggucacucgugcccugcuggaggacagaggggcaccucagccgcccccaagcccagagcacagcaauaaggucggccugcaggagccgggguggggguggggguggggggggcaggacccugagaugccaccaggaccugaugggccaggaagggcguggacauggaggcuguuuuuacaguuuuuuuuuuguuguuguuuuguuuuuaaagaauacagaaggagccaagcuuuuuugcacuuuguauccagcugcaagcucagggcagagucaagggccuggguuggaaaaaccugacucacaggaaugcauaauugacccuugcagcuacccaauagcccuuggagcuggcacugaaccaggcugcaagauuugacugccuuaaaaacacaaggcccucuaggccuggcagggaugucccugugcccagcacagggugccuggcagggggagaccacagguaugcagguggggggacaugguguggcacuaggggcucgaagacugguuucuagcacuaccggucacggccaugucguccuagaaggguccagaagauuauuuuacguugaguccauuuuuaauguucugaucaccugacagggcaccccaaacccccaacucccaauaaaagccgugacguucggacaa

SEQ ID NO: 192574 - RNA, 5420 nt, Homo sapiens
cacaggucacggggcggggccgaggcggaagcgcccgcagcccgguaccggcuccuccugggcucccucuagcgccuuccccccggcccgacuccgcuggucagcgccaagugacuuacgcccccgacccugagcccggaccgcuaggcgaggaggaucagaucuccgcucgagaaucugaaggugcccugguccuggaggaguuccgucccagcccgcggucucccgguacugucgggccccggcccucuggagcuucaggaggcggccgucagggucggggaguauuuggguccggggucucagggaagggcggcgccugggucugcgguaucggaaagagccugcuggagccaaguagcccucccucucuugggacagaccccucggucccauguccaugggggcaccgcggucccuccuccuggcccuggcugcuggccuggccguugcccguccgcccaacaucgugcugaucuuugccgacgaccucggcuauggggaccugggcugcuaugggcaccccagcucuaccacucccaaccuggaccagcuggcggcgggagggcugcgguucacagacuucuacgugccugugucucugugcacacccucuagguaaagagggggccgcgccucuuccccgccccgacccuccaucccuuuccucccaauggauugcaggggggcgggaaaaacgucugucucucucucuagggaaggccacauuucugucugucucagggacucugugacuugucccgcagggccgcccuccugaccggccggcucccgguucggaugggcauguacccuggcguccuggugcccagcucccgggggggccugccccuggaggaggugaccguggccgaaguccuggcugcccgaggcuaccucacaggaauggccggcaaguggcaccuugggguggggccugagggggccuuccugcccccccaucagggcuuccaucgauuucuaggcaucccguacucccacgaccagguaggaaccacccgggcccucagccacccucccaccucccaaagucccccagcccuugaugcucccgcagccccaccugccagcccagcccucacggcagcugcccgccucagggccccugccagaaccugaccugcuucccgccggccacuccuugcgacgguggcugugaccagggccugguccccaucccacuguuggccaaccuguccguggaggcgcagccccccuggcugcccggacuagaggcccgcuacauggcuuucgcccaugaccucauggccgacgcccagcgccaggaucgccccuucuuccuguacuaugccucucacguaagugaucuuggcccaacccccuggcugcccgugaccccuacccagugcuaacuccagucuuugcccccagcacacccacuacccucaguucagugggcagagcuuugcagagcguucaggccgcgggccauuuggggacucccugauggagcuggaugcagcuguggggacccugaugacagccauaggggaccuggggcugcuugaagagacgcuggucaucuucacugcagacaauggguaugccagcagggcagcugggugcuccggcccugucacgggccagggcccuggaggccuugcaguucagcugcuugccaagaacauagugggugagggggugccaggagaugcuggccacguugcaggggcccaagguguagucaggagacacagugcacagagagcuggucuugguaggccugggaggugccgggcucaugcugggcaccuccgggcaagcuuugugacuuagagguguggggccacuggucacccucgguggcucagaggcuguggcuccauggcucaugagcgccuccugugucccagaccugagaccaugcguaugucccgaggcggcugcuccggucucuugcgguguggaaagggaacgaccuacgagggcgguguccgagagccugccuuggccuucuggccaggucauaucgcucccggucaguccgcaggcccucuccuuggaacccuggccccaccaccccaaccuugauggcgaacugagugacugaccagccuccugcccccaggcgugacccacgagcuggccagcucccuggaccugcugccuacccuggcagcccuggcuggggccccacugcccaaugucaccuuggauggcuuugaccucagcccccugcugcugggcacaggcaagguagggccggugaccccugaucccagauccuuggccccuguccuggccuuccccuggggugagugugggcagugccugagagucugugccucagugccuccugcacugaguggcauccaaguggcgccaccucucagguuccugggugggcaagaagcggugcacguccagggccucccaccagggcuggcagccccagguaugugcagugcuuggggccugccccgccccgugaccccugacucugcccccagagcccucggcagucucucuucuucuacccguccuacccagacgagguccgugggguuuuugcugugcggacuggaaaguacaaggcucacuucuucacccaggguaaccccuccccguggaucccuccccccgaccugcugaccccuccccggagcccuagaucccuggccccuccucucgcccuugcccugugcacagaauuggcccccuccccaggcucugcccacagugauaccacugcagacccugccugccacgccuccagcucucugacugcucaugagcccccgcugcucuaugaccuguccaaggacccuggugagaacuacaaccugcugggggguguggccggggccaccccagaggugcugcaagcccugaaacagcuucagcugcucaaggcccaguuagacgcagcugugaccuucggccccagccagguggcccggggcgaggaccccgcccugcagaucugcugucauccuggcugcaccccccgcccagcuugcugccauugcccagauccccaugccugagggccccucggcuggccugggcaugugauggcuccucacugggagccugugggggaggcucaggugucuggaggggguuugugccugauaacguaauaacaccaguggagacuugcagaugugacaauucguccaauccugggguaaugcugugugcuggugccgguccccugugguacgaaugaggaaacugaggugcagagagguucaggacuuguacaagaucacccagccagaaagagguugggcugggauuugaacccuggugucguggcucuggaagcugcccuggcgccuuggugaucugcgugggucagugcacacaggcacacgucagccucaaggacaugggcacaucuguucacaggagcagcgccacgugccuuugagugccaggaacggggugggagggugggagggugugagggccagaagacucagaagaugcaaagugccugagagagacgggauauucccccagaagaagcauucuuagagacacaggcacuggaccuccuugguucuuauaagaaaccugucugaagcugggugaugaguugcacacuccagguggggcuaaggggccuggagccccugcuggcuccuaggaaggcacagcagcaggcccugagacggcuccucuggggccccuccacccucccaggccucugcauuucaccugugcccacacuucugucuccugccuucaccuuuugacccacuacuaacgauucuccacccagcagacaaagugaucucuuaaaaauaucuguuggcugggcacgguggcucacgccuguaaucccagcacuuuaggaagccgaggcggguggaucaccugaggucgggaguucgagaccagccugaccaacauggagaaaccccaucucuacuaaaaauacaaaauuagccagguguaguggugcaucccuguaaucccagcuacuugggagucugaggcuggagaaucacuugaaccugggaggcggugguugcagugagccgagaucgcaccauugcacuccagccugggcaacaagagaaaaacucugucucaaaaaacaaaaaaucuguuaggcugcacacggcgauucacuccuguauucccagugcuuugggaggcugaggugagaggaugccugaggccaggaauucagaccagccugggcaacauagugagaccccagcucuaaagauuuguuuuuguuuuuuuuuuuuuuuuuuuuuuuuuuuuuuuuuuuuuuuugagacggagucucgcucugucgcccaggcuagagugcagugguaccaucuccgcucacugcaaccuccgccucccggguuccagggauucuccugccucagccucccuaguagcuggaacuacaggugugugcugccaugcccagcuaauuuuuuuuuauuuaauagagacaagauuucaccauguuggccaggcuggucucaaacuccugaccucaggugauccacccgccucagccucccaaagugcugggauuacaggugugaaccaccacaccuggccaacaauauuuguuuuaauuagccaggcgugguagcauuuguccuagcaauuugggagguugaggugggagaaucacuucagcccacuaggucgaggcuguagugagcuauaauuguaccacugcacuccagccucggggacagagugagacccugucugcaaauaaacaaauaaaacaucaggcugggcuugagcaucuauuccugcucaaaauuucgcaggcuucucagaagaaaauccaaaccccuuacagugacccaguuugcccuugaggccuccacccacacccccuuccccccagucuuaggggguggccuggcuguucccuucaacggcaacgcucugccuccauuguuggccuccucugcagggagggacugucugagcaccugcccgugucugugcagcauggcacacugacgucaggcccacgugcaugcccagguggccagucacacgccaggugcucccucaguguuggccaagugagaggagcacaccuuccgggcguucagacaccuccccguggcagacaccguucguugcuaccaaacagccaccuccuuccuaaugggcucccauuuuucagugcugggcaaaggucccuugaucuuggaguugcagccucuuucucuccaaggagggcggugaccagccugagccagucaauccagugauugguucaggaguagccugugaccaggaguccugguagugaacgacuggggcagcccugggggugaggaccuugcgcagccgucacaggcccugauuggacacugggcagcugcuaacccagugucuccagcugccuaccuggagagcuccaagcguaagaaaauaaacccugccuguugaagcca

SEQ ID NO: 192575 - RNA, 14045 nt, Homo sapiens
ugaaauuucaaauaucuuuuuaauauauuuuuucuugggaugacaauaauaauauuacuaugauaguauuaacuuauuucuauugcuuuuacuaguuaaaaaaguaaugggcauucuuacaaaguuaaacaauauagaaauauacaaagcagaaaauuaaaggcucucuaaucccauuaccauauacccaccugcagacagaaugggaagauuuagucauaaauacaaagacaauacauggaaaaaaaauagacaauuauuaacucuaggaaaaaacguaaucauagcauauuccuuggcucagaaaugaaaaguauuuacuugguuauuaaaaaagauauauauggauucccccaaauuuuuaauacagccacauugggaauauugaggaagguaggagaaguauaagagauugaauaauucuccuuuauucuuuuauuaagugacugaaauauauguacuuuauuuagcuacaugugugcacauguaaguaguuucuucuagggaauggaauuuggugcuauggguagggcagacaaauaacaccuguguuugauuuuaagccuuuuagagcuauguuacuuuauauuuuauagguauuuauaauuuauuuuauagguauuuacaauuuauccagauugggauaaagcuacaagaaauaugaugacaaaacacccauauuuaaagacaaaauucucuugaaaaguuuauuaauauaaguaacaauaaaucauucaacuuuucggucuucaggaaguuuguuuuaaggauuaauuucagaaguccucauguaaacaaaucaggcaugaauaaagcccuuauaaugaacuuuucaaauaaauuuuuaaaauaucuuuuuucuugggaugacaauaauaguauuaacaugauaguauuaauuuuucuuauuuuuauuaaaauuagcucuucaagauuguuacuaacaaaucuugauuuuuauuacugugcuggggcaagauuuuaaucacuaaguucuuccucaucacugaaauaugugcuuuucuuuauccuugggcgucuugaaucaucugauguugaggggacuccugaacuggguuuccauuuuuuuuguucuucuucaauuuuggcuugcugugauucaaaaaacaaaacaaaaccaauaaccuguuuaauauuauuuaugguucauuaauucaaaacauggcaaaaacauaccacaaaugccauuacuucccacccucccaguccaugcagacaauaagaucugcucccuuccccugaguucugucucaucucaaaaucuuacacaaaauuauccuaggcaauuucuuaaaaaaaucuuuucuguugggcuauauucacuuugagcaaauaguucugcucauuucuuuaaugaaaaaagauuaagauaguaaguguuguggggcccuuaaaaucuaggaagaaccaaugggaacuuuucauucacacuggcuaaguaccucagagaaacagcuugucuccuaaggcuuaggagguuagggggaaaaagagagguugccaugaggugaucaaugaaguaagcaagcacuauaaaccaagucaacuauuguaugaugccuuuuaaaagaacaauuuaauaccuggaaugcuauggccugacugaggcugucaagagcaggauccuccccuucaucuucacuuucuucuacuuccucacuuaaauaaagaaaaacaaauuggaauguaaccaaccaauaaucaaaagcaaccaaccaaaagacaaaagcaacaugaugauguauuuaguaagaauaauauacauacauuucuucuucugguucaggagcuuucuuuuuuuucuuuuuuucuuucuucuuuggaggcucacguucuccgagcauauuuuucggacaggcauaacuuaaguguccacuuuccuuuuguuucccauuaaaaaggaaaggaaaaauaccauauuugauguuauuuauaaaaacuugccugguaccuuauuacuaaaaaguuuucaaauuuaaaaaggaauauucccauacugggacuauacagaagacauuaaugauaaaacccaguacuuuaauauuuagaaggugauauuauaacucucaguuauuuuaacauuuaggacuauuuaguaguuuuacuaagaguagugguaguagucuucuuucaaacauuuaaaucucaaaauucaagauauaaaacaguuuggucgggcgcgguggcucacgccuguaauccuagcacuuugggaagccgagguggguggaucaccugaggucuggaguuugagaccagacuaaccaaaauggugaaaucccgucucuacuaaaaaaaaaaaaaaaaaaaaaaaaaaaaaaaaaauuaguugggcauaaguggcacacaccuguagucccagcuacucaggaggcugagguaggagaauugcuuaaacccaggagguggagguugcagugagcugagaucauuccguugcacuccagccugggugacaagagcaaaacuccgucucaaaaaaaaaaaaucaaaauuuaaauggaucauuuacccuaaauguaaacaucuuaaguuauugauaaaacgaggauaaaacuauuccuguuaauuuccaagauguugcuuaauacucuguugggcugggcaggcugaggcaggugggucaccuuaggaagugaguucaagacccgccuggccaacauggggaaacccugucucuacuaaauauacaaaaauuagcugggcuugguggcauaugccuguaaucccagcuacucaggagacugaggcacaagaauugaucgaacgcgggaggcagagacugcagugagcugagauugugccaccgcacuccagccuaggcaacagagcaagacccugucucaaaaaacaaacaaaaaaccaaaaaacaaauggaaaauuucuuccucacuuuuccuaugaauuacuuccguuuuuucccuuuuauauccugacuacacuugcacuauccaauuacaguagucacuagccagccaauguggcuacugagaacuugucugaauugauacguacuguaaagguaaaauacacauuggauuucugaagacuuaguaacauacguggcuugcauuauauucucauuugacaaugcuggacuaggcuauuauuccuacuuagcuagaacauugauuuguaaaacauaagagcucaacuauaaucuggacaucagcucacuacaauuccauuuaagagguuaugucaggguaggguguggggacugagccaagguuagaacaauagaagggaacaauaaucaugcuuuuccaguauauuugacagagcagacagacugugcacuuuguauaccuaggacauagcccaacuuaaagagguuacuuacuguuaaugagcugcugagaaaauagagacacauaucugaaacuguuuuggaauaauauuauagcaaaaaaaaauuaacauaucccauacuaaaaaaggauuuaaugaaauaacuugagaaaaaccaggcuaggucaauauaaaaaaguuuuuuuuggagggagggaaauuaaauauaaaaauguaaaaaauauaacaacucuauggauccauaaaccaaaaggaaccgauuaacagauucaucuaggauuucucagauaauuuaauauuuacugugaauaugaagauauauacuaaucugaauauaacuaccuucccucccucccuuucuuucuuuuacaaaacucaaaacuuuggaaaaguuucuaaaguguuuacuuaagagguuuuagaaucauaggaauugacagaaucaguauguauccaagcaacugcuugcucacucuuucuauucauccauccaucagucuguuuauuuaguuaucuuuuuugucggggguauggggagugacagugggguagaggaccucaagccauuuccuugcaucuuccaugugauuuuguagccaggacgguaucuuucagugauucucuccccaguuccccauuacuaccucuggacucuguuuuuuaaguauuuuauuuuauguuuauuuuuauuuuugagacagagucucccucuguugcccaggcuggagugcaguggaguaaucucggcucacugcaaccuccaccuccuggguucaagcgagucuccugccucagccuuccaaguagcugggauuacaggcaccugccaccaugccuggcuaauuuuuuuuuuguauuuuuaguagaaacucaguuucacuauguuggucagucugcuuuugaacuccagaccucaagugauccguccaccucagcaucccaaaaugcuaggauuacaggcgugagccacugugcccggccuguuucuuaaguauuuuuauggucauuuuacaaacuuacaccugugagaaccagacuaaaauucucuugguaccaauacagaccuuauacaaaauuauucuauggcugucucucucucuucaucaccaaaacuuuaaauggauaaugacagaucaugaagagaaccaaagaagaaaauguggggauaguucaguuacaaaacacuagcaauacuaauaggaaaaaauaaaaaacuucaaaacacaauaucccauagaggauaaagucacaugauaauguugcuauugaacugugacuuaaaaacuguuaaagaaacaggcaauauccuauuaacaaaaauuuaugaguuacgaaaaucuugcaagacagugacauaaguaaucagucuaacacuuuuaaaacuagugauuuucaaagauuuaggaacuagagaaaauaccacuuuguauuacccaacucagguuaucuuuacacauugcauuucaauugaauuuacuuugaugaguuuagagacccuaacaacuaggccaggcaccauggcuaacaccuguaacucuagcacuuugggaggcugaggugggaggacugcuugagcccaggaguuugagauuggccugggcaacauaggaagacccugccucuacaaaaaaauuuaaaaauuaaccagggugugauggugcaugccuguggucccagcuacucagacacuguggugggaggaucaguugggcccgggagguagaggcugcagugaguugugacugcaucacugcacugggugacagaggaaaacccuaucucaaaaaaauaaauauuaaaaaauaaagcauuuucauaaucugguuuagccagucagaaguuuuggugagcaaaaauaaaagacugaugugaaaaguaucuuaaacuauggaaaguuccauuaaguuuuagguuuacuuaccccacauucauaacacuuagauuuaucaaaguaguuucgccuucggaugaacucagcugcucuuccauugucaauagcaaugcuugcuuuuaucacucuaccaaauaacuaaacaagagaaaaauguaaauguagaauguauuucacugaaaccuaaaauuaauuauuuaaucaauuuucucaaaucuucaauuccaguuuauuuuggauuuuuuagcaauugucacuuaggugugauaaauucuauucuguaguauucuuauuccugagauuccaccaauguuuugagaacccaguaguuugaccucuuuucuuucuauaaguuagauaucuuaagaaucuacugauaucugcuagaccugaugauccacuauauccccacauuuuuggccuggaugagcauaaaggcuuuggggcuaaaaaccuugauggagaugaauagcuuaccuguuuguuguuuauugcccugguacaguuuugugcagagucuuuauccaaaaauaaaauaaaugcaaccccuuuacucuuccugguaucuuuaucuuucaugaugguaacccuuaaagcauaaacaaagaguuaaaaaugaggcagcaauaaauaaaacagauacuaauacuugaaaaauucauuuuaaaaagggcuaaaaauuuauaagauaaauuaauacauuugaaaaaucagcuaucucuucaaagucaagggauaucaagaauggaaaugggaaagggugauacugauuuaacagaagugagcacagcuaugauuaggaguuaaucagagauugaagggugaaguaaagaaauuacagagacaaugaaaucuuaaaguguaaccacaaucccucuuccaugcuaacucccucaccuugcaaaacaaaacaaaauaaagguauacuuuacacaaaaaguaaaaugauuuauuuauuuuucuaaguguuagaaucaaaguauauucuuaauauucuuuuaaagaaucuucagaaaaauaaggaaaaaaacccuccagagcugguugugguggugcgcaccuguaguuccagcuacuugggaggcagaggcaggaggaugcuugagcaugggaguuugagaacagccugggcaacauaaugagaccccgaucuuuagggaaaaagaaucuccaguucugugguuuuuagccauaccacccaccaggguguaccugagugacaaggagaguuaugagagcacagagccugcucuuucuccugccccauccacaucccuagucauggaggcccuugcccaccguaugucauuuaacauaguuuaaaaacaauguucaacagggcucuuuggagaaauagcggauuccaaggcuacagcagggcagguacaagaggagcuuggaacaucuuaugccagaagguaagagagugcaagagugcgugagcgagugagagagagagagacggagggaggaaugaaugaaugaaugauggggccaagaauacagcagccagcuggaaggagcucccacuggccaaaucaaggacaauuugagcaucaaaauaauucauuacaguaauaaauuauaagccacagagaagguaggaauuuauaauucuuacugauaaaagaccaauaaauaaguggaggagaugggagggaaggcucuugcuuacaacagaaugccaagggaugacuggugaauguagagggaaugcuggaguuggaaaaaucaccaauuugacagaaauauugaauaagguaguugcuuuauguuuuggaauuuuucguaauguuugugaaaguuaucagucuuuuuuuuuaaaguaguauuucaaaagaaguauuggcuuucuacaucauccucaauuaaugaucucucaucuguugccucuuuuccaauuccacugcuuuuuucuuguccauaggggcauuacuguuuuaacagucuauucuuauugguuccuuuaugguaauuuuuucucuuauaauuuucucauauccuuaaguagucuucuacuuaaggaauaaauaaaaucacaccauuccuuuguucaaaaaucuuugguucuguaaguugccuauucuuugucccacugucaguauccuugaugauuuggcucccaucuccuucaucuuucacugcuccuucccacgcacacacuaugaagucuacccaaaagaaaccacucaaugcuccaguagcauggccuguauuuccccaaauuugugccuuuguucauacagcuucuaucuucuuccaccucugaaucacugcucauuaaaauuuuccucauucuuucgggguucaggucaaugugucaguuucuaauagcuucaacuggauauaauuucuccuccguuaugcuagucucugcugaauuguguuauucauaaacaaugccucaucucaucuauuuuaauguaaacuccuuuaaggcugucucuguaauccauaugugcccagcucaauauguugauugauagauauaccuuuauauucaaugggaaagacagaccaaaaaaaugggaaaaguaguuucuaaaagaguacauuguguguguucauucauucggucacucagucacucuguuagccucaagcccaugugcuaagcacuaacaguaguuuuuacccucaggagaaaucuuacaguuuagugguagagacagaccaacaaaccaacuaucauacaauacuuugauagagauaccuucugugguaacagaaaaaaaaaauuacaucagagauuuaaaaggacaaaucuacugugacucccauguuucuggcaagggaaaagagguagauaauagcaccauuuccuaauauaagguauaugauguacuuauuuaagcacauaauaugaagcauacacuauuuugggaaaccugaaugucauccauaacaccuccuucuuguucacaaaguccuuauacgcaaaguaagcauaucacuaaauaguacccacuuugcuuccuauacacaucacuauuacccacuuuauuucauaaugaucucugaaaucugaccaccucucaaaucugaccagucucuauaucuccaccuguacuauuuuaguacacauuucuccccugggcuacaguuuuagauucagacuggucucacugcauuugcuuuuuucuuuuuuuugcgauggggucuugcucuguccaggcugcagugcaguggugugaucuugguucacugcaaccuccaccuccauccgccuccuggguucaaguaauucucaugccucgccucccaagcagcugggauuacagguguguaccaccagggccggcuacuuuuuguauuuuuuguagagaugggguuucuccauguuggccaggcuggucuugaacucaugaccuuucaagugauccucccacaucggcuucccaaagugcugggauuacaggugugugccacugcacccagcugcauuugcuuuuguuccccuccaaucuaauuucuacauuaagccagaauaaacuuuaaaaaauuuaaaucaugucaccccucacuuaaaauucuuaaaugauuccugauauucuuagaaugaaaaccaaauaccuugguaaccugaccaagaaguaagaugaggaaccugcuuccaucucuggagccaccuugugcuuucucccccuuacucacucaucuccagucacauuggccuucuuucuauuucuugaucucacuuuauuuucucuugccacagggccuuugcacaagcuauucccucuaccugaaauauuccucccuuauuuuugccuacuuaacucuuacucauccuuuagguuuccacucaaaaaauacugaccuagguaagccuucccuggcucucuagacuagauagucuucccuguuucuaggugcuuauaacucucgugucuuuaacuccauugcaguuucaugguuuaggacuauauauuuauauggagauccauucagagauucuaacaaaguggaaaaagaaaaaagguaaaagggagugggcucugaaaucucacuguuggauucaaauauuuucuccaccacuagcuagcaagaugaccuuagguuuacugugugcuucaguuucaucauguauaauacugagaugauaauaguaccuaccuuaaaggguaguugugagaauuaaauaauacacauaaagagauuagaacaaugccuggcauauauaugugcucauuuaaguaucacauaccaucaucauuaccaguguuuggacugaugacaaugacuuuuuaaaaucugaacacccaaaaauuuacacagaagcauuuuugauaaugcuuuuuuaauagcaaaguaacuguaaaagaaguuaguaauuucaagaugcaaaagagcuucaacuguuuaauauccauuuauggaacacuagaagaaauuagccaagauaaauaugcucaaaauucuugggauuuuaaauuuauaucagaaucuauauugguuacaagaaaguuaggaugacaguauccuguuacuuuuuugccccauaauauaguugcuugauuuaaaacagugaaauacgagaaguucaaguucuuuuuauuguuccuaacccucagcccuguuaucauccauuaccauuuuugcauguuucuagucuuuccaacgaucuccaagcuaucucugaaggaagauaauauguuuucuauuuaaaagacucauagcauccugcaagucagaugcacugaaauauuuguuuuuacacuauuuauaugaaaaaaaacaaaacaaaaaaccaccuauuuauuugaaaguagguuacuuauaguauacuugauaacacacuuccuaguaaccaaaauauuuguuuaccauuagcuaugaggauguaucuuuauagcacauggaaagacauuuaugguaugucaaauuaaaaaagaaaagaaaauuguauguauguaauagucuuuaagaaaaauugucuacauguuuauguacauggaaaaccaacuaaauugucauaaaaauguuaauaguauuuucuuuauuauaucaagcauguuuuauuuuuaaaaaucugucauuaaaaaaauguagaagcaaauucagauaaacuuuuaaaugaaguuacaaaauuuaaugugaauacuuacuuuacaacuuugccauacuuggaaaauaucugaaacaaaagaccaaauauuuacaauuuauuuuaaaaucauaaaacaucaaauuuuuagguugcagacauugaccaaauucuuuguuacaguuuaugaauaauuucagccuucagucuauaagacaggcccuaggaaaaaguuuuuuuugguuacuagaauaauauacuuacuguuguuggagucacauguaucugucuguuucuaaauuugacaauggaguaaauacagagaaaaaaacucacucuacacaugugguagaucuaaggcauacauacuggacagcugcuguguuccugagguauacccauggcaacuaucaacuccaucauagugccagauacaccugugcuucaaaugucaaucuuauggagcagcacuuuuccaauucuacccucaccacuaccuuguuauuccuauuaagcaaucccuguuugagaaggcaaauccuuagacugcuuuauuuaaaaaacaaaacaaaaccucauaaaauaagcuuuuauaaugaaaaauccauuucuaucagucuucuuccucugcccaccauuaacauguugguggaacuuuauacuuggcucucucuucuguuacuuuuacuuuauccuaugcaaucucauuuauuucuacaguuccagcucauuacccauauacuaagaguuccuauuauauaaaaagucuuuuagaauguguuaguauaugcaaccaauaauaacgaauuuuuucguucuaugauuaagcuguauaaugcuggaauguaaaauaacuggauagcaguguuagcaacacuggguucugaaggccaguacagucuucuauauaauacuuacuaauggcuucuuguuucaugcagagugaaagccagaguccuuaccaugauguaaauaggucguauaaggcaccucgagugggcuuaccuaagauuaccccucuuuuucugaaauguuuguccucuagaauuugcacaggugccucuuacucguuucaggucuuuauucaaaagucaccuucucaauaauggcauuucugaccgcccuauguaaaauuucacuuccauucccaacuuaacguucaauagcccaccuuuccugcguuauuuuuucuccuuagcaccuaacaucuuagcaucuccuuaguaucuaacacauaauuugacuuaaauguucaauaaauauagcuucuauuuuuuuuucuuuuuuuuuuuugagacagggucucauucugucacccaggcuggagugcaguggugugaccuuggcucacugucgccucgaccuccuaggcucaagcaaucuuccaaccucagucucccagguagcuuguagaggcaugguggcacacaccuguauucccagcuacuugggaggaugaggugggaggaucaccugagggggcggggaggcugcagugagccaugauagugccacugcacuacagccucgugccucagugacagaauuagacugucucaaaaaaagaaaaaaaaaaaaaggaaaaaagaauuugccagggagaacuauuugcuuaagguuaucuguaucucaaauagcagucacucgauaagauuuacuuacccgguacaagucauuguuugucagggaaaaaggcaaguuggauacauacacugugcucuuacuuggagccaauccaccacucauuucuaaaagugaaaacaaacuuaucagcaaucagucuaaaccaggauucuuuuuuuguuguuugagacggaguuucccucuuguugcccaggcuggggugcaauggcgugaucucggcucacugcaaccucugcuucccagguucaagcaauuauccugccucagccucccgaguagcugggauuauaggcauccacuaccaugccuggcuaauuuuguauuuuuaguagagacaguguuucaccauguuggucaggcuggucuugaacuccugaccucaaaugauccaccugccucagccucccaaagugcugggauuacaggcaugaaucaccacaccuggccuaaaccaaguauuauuaauuccaaauaaaaccaauacaucagaccagucuggguauuauuuggaaaaaaacaaaaaacaaaaaccaauaaaguauuaacaaucaccgauuuaauuaugccagauguguacaccuuccuuacauuuuaggaaguuaggaacaaugacuccagcaggcugaauuaaggaauuccuuuuucccagucaccacuuaaaaaaaauucuuuuuugguucuucuucuuucaaguauucuuuauaccaacacuuucagugccagauuguauggguagggagacggguuuugaacagaugaaggaaaaacccugaggcuacuccuaacuuccacucagaccaugagcaaaaaaaaugcucuauugaauauguacuguauauguacauuaccugcaccuugcucacccaggucagaaagagcauggggacucagacagaaccuuagccacugauuuuugcuaauacacagucaugcuaugcuuaaugaaggagguauguucugaguguuacgugauuucacagugcagacaucacaggguguacugagacaaaccuagauggucuagccuauugcuccuaggcuacaaccuguacagcauguuaauguagugaauaauguagacaguugaaacacaaugguaaauauuuacauagcuaaacacagaaaacguacacuaaaaauaugguacaauguauuacacucuuaggagaccacugugguauaugugguuuguuguuaaucaaaaaguuguuaugcugugcaugccuguacuauggcuggguaccuuuuuugcuugucuuaauauuuuuuuucucuggagugguguguuaagaggaaaauuuucuuuuccccuuuuaguaugauguuaaggaguaaauuuaagcuuuauguaucgacaauauaaacuucuuucgaaacgcuaauuuugcuuauugccaaauuaugaaaugauacauuauauaaauaggcuuggugccucgaagagacagaccuguagguauguguguauauguauauaaaguuuacaaauguaaucaguaauuuucacaucuuaucuuacaaagucagcaaauuaccgugaaaauaucaggcucaaccaaauucaaauuucugauuuaaaaagagcgugcgguguguauuugagaugggaagaucaaccaucacaaauggaaaaauacugacucuauggcaugccaauucgugaaggaaugagaaaacugccucauguuugguguuaugggggaauuauuuagaaaacuucaggaacucaacauagauacgucgcuuuuuaaguuucucauuugaaacuaugcguuacacguucugcugagagccgcgaaggcaggcagagguuaagguccuggaauaaaaaggguggcgggagagaggggcagagcguuuuggcagccgagucuggggagggggccccgcaggagagaaggccgcagcugaggaggcguuuaccuucagguggguugggccugggagaccagaagagugcgagcccucggcucagcuggggcucaaccccgacucuucguagccgcucgcagcggccuuggcaucacgaguccugggaggggucaggcgcggagagcagauaauagcagccacggugcuucuucccgacuguuugagauccgggccccgaaggcgggcccagaggcgagc

SEQ ID NO: 192576 - RNA, 122476 nt, Homo sapiens
auugcgcgcgccggaaguaccuaccugggauaacggcggcgagcggacggcugcauuuacggggucucccggagggccagagucggugagcgcuuuuuaccuuucccagagauggaugcagagcgugugcgggcugcuaaacgggggggagugggcgggaguuuucugugucggguccuggauucuccugccuuugaauugugugacaauucugcccaugcgguugaggguggagagacgcaguggaguuuggaauaaagggaaguauugagucuaagauagggguucgccucucuguagcgccuuaauaugcaagaagacgacugagcuagguaacuucagugacccgagaggagucaggaagucgguaauuuuacugaagguguucacgguacccagcuauuaggcacuuugggaacuacaaaauaaacagaccuuuuauguuuuguuuuguuuuguuuucuggugaagaucucagucuaguuggggagacgaggucaacuuggggagaguuggauucacagaaugacucaucuuuaguauggguauggacaaguguugaucuucuuggcaccuuuucucuuccuguaaaucuauaauggcuacgcacugcuuuuucucuaagaggccauaacaugcccaccauuccuacagaaaaaucagaacguaaugcaagguaauuuauacuucugccuaccagcacauacagaccaggccucuaaccacucccugggagccugcguuccagcagccuggaacccacagccucuccuggagccugcacaaucaauccagagugaagccgaugucuucuauagagacggaaguacaauccauccagggcgcagcugaauuuugagaggccugaaugccuccguggccgacaggagaccgcuggcacuaauucucuaggcauacuuguggccagccaaacuuaccaugcuuuacaucucuguuauccuugguuaccgcccaagauguaagcuucuguggucuucugugcuauagucucauuuccaugcugcuuugugcuuucuuucgacuuaggcuaucacugcuucuucguuucuuccccauuuaaccccucaacaccccaucugugcuuucugaaaccucuauuuccugcuuaaacuauuuuacauauucaacuucuuuagugaaauucuccuucaucuccuaaccuuaacuauugauaacacguagauuuuccugccagccauuucaguugagcccuuucucugacccugcauuuaaagguugggcauggcuguagccauguugaacggauuucaauuccucagaauacuuucuucccucaguaucuucacaaaggcucuuuucucucucugggacauuugagcucccuguuuccuccuaucuuuuucuggauaacuucuauuaaagaucugaguuuagcugucacuuuacuugagggguauacccuaacuuccauagaguuagguauuuuugcuauguacucuuagcuguccugcacuucccucacggcauuuaucacauguaucuuaauugcuucuuugccaucccuacuaagcgagacugucggugagggacuguguuugucucguuuaucuuuguaacuccaguagcuaauacaguucuuggcacauaagacagucaguuauuucuugaaugauugcaggugcugaagguaugcugcagagaucaggcaguuaacguuaaugaauacuucacccuuagaaggggucaccugccacucagcuacagcugauuguggcuaugugagaauaugaucccaguuuugccagaacaucuaauuuuuucaaaaaaaguuggaaauaccauuuuuuaaaaagcauccucucccaguuuuuaaauguugucaguggaauagaauuuuauuaaaaaaaaaaaagugggucaaacacaagucucauauggccuaucagucacuaguuuggaaucuguuuuaagucuuguaggguuuauauaaugggcuuuguggagaauaauagguuuugaguugggccuugauggaccguuggauguugaaugagagaauggaaaaagauaucccguuuggaaaauaaacagcuccgugguaguauguguuagucuguuuguggcacaguaaggaaacaggcauaauuauaugcuuuuggagagaauagaagguuagauauaauagaaggaggcauauggaagauagaaguuuggauuuauuaugguuaauaaaaaaccucuuggauucuugauccuggaaacuucacauuaugaauaugcguuaacaguugauuauccuuuuuuaggguaaaauggaggguaaaacacuggaaggaggcugaccgguuaaggccuuaacuuccauccauauaugaaauaaaauucagauuuauaaauauuauauguaggcagacaucuggcauuuuuguuuacuuguguaauuucaguuaauugaucaauuauaauggacaaucagggaucuccuacuaaguuuagugcaguacauucgggcuuauaaaagaaguauccuuaaagcguuggaaagucaagugacuugugaaacuaguagagaaugcaguacuuuuuauuuuuuuauuuuuugagacggugucuugcucuguugcccaggcuggagugcaguggcacgaucauggcucacugcaaccuccaucucccagguucaagggauucuccugccucaacuuccugaguagcuggaauuacaggcaugucccaccaugccugguuaauuuuuguauauuuuuuaaguggagacgggguauuacuauguuggccagacugaucuugaacucucaaccucaaaugauccgccaggcucagccucccaaaauggugggauuacgggcaugagccaccgcacccagccccagcaucaguuaauuuuuuuuuuucaaugaccuuaacuaauuauguucuaaaauuuauguuuaguugucuggaauuucaauuuuuuuuuuuuuuugugugugugugugacggagucucacucugucacccaggcuggagugcaguggcgcgaucuuggcucacugcaagcucccccucccggguucaugccauucuccugccucagccuuccgaguagcugggacuacaggcgcccaccaccgcccccggcuaauuuuguuuuuguauuuuuaguagagaugggguuucaccguguuagccaguauggucucgaucuccugacuucgugauccgccccccucggccucccaaagugcugggauuacaagcgugagccaccgcgcccggccuggaauuucaaauauuuucuaauagaaacauuagaauauuaauucacucugaauacugagcacagugugcaaauuguucuaggagcuuaauauucaucagugaacaaauagacauuccugcuuuuuauuauuauuagcauuaauaaucuaagauacuauauaguguacuuuuaauacagauuaaacccucacuacuagaaauacuacuaguagaaauauuacuagugagggacuaauguguauuaaaaguacauuaugugguaucuuagauuauuagugcuaauuaaagauagcacgauugggggaucuguuauaagugacauuaagaaggugacauugaagggcaggaaaguuaauuccacagauaccuggaugaaggguggccugccccuccacaccuguggguguuucucgucaggugggacgagagacugagaaaagaaauaagacacagagacaaaguauagagaaagaacagugggcccaggagaccaacacuuagcauauggaggaccugcaccggcaccagucugugaguucccucaguauuuauuguuuacuauuugcacugucucagcaaggggaaugcggcaggagaacagggugauaguggggagaaggucagcaagaaaacgugagcaaaggaaucugugucacaaauaaguucaagggaagguacuaugccuggaugugcacauaggccagauuuaugcuucucuccacccaagcaucucaguguaguaaagaauaacagagcagcauugccaccagcauaucucgccuccagccacagggugguuuucuccuaucucagaauagaacaaauguacaaucggguuuuauaccgagacauuccguuuccaggggcaugcaggaggcagaggccuuccucuuaccucaaccgcaagaggccuuccucuuuuacugauccuccucagcacagacccuucaugggugucgggcugggggacggucaggucuuucucgucccacgaggccauaucucaggcugucucauuggggagaaaccuuggacaauacccggcuuuccuggguagaggucccugcagcuuuccgcagggcauugugccccugguuaaucgagaauggagaauggugaugacuuuuaccaagcaaacugccuguaaacauguuguuaacaaggcacauccugcacagcccuagaucccuuaaaccuugauaccauacaacacauguuucugugagcacaggguuggggcuaaaguuacagauuaacagcaucucaaggcaaaacaauuguucaggguacagaucuuuuuuuguuuguuuguuuuuguuuuugagauggagucucgcucugucacccaggcuggagugcaguggugcaaucuuggcucgcugcaaccuucgccucucggguucaagcgauucucuugccucagccuccugaguagcugguacuacaggcacgugccaccacaccuggcuaauuuuuuguauuuuugguagagacgggguuucaccaugucagccaggauggucucaaucuccugaccuugugauccgcgcgccucggccucccaaagugcugggauuacaggcgugagccaccgugcccagccaugguacagaucaaaauggaguuucuuaugucuuccuuuucuacauagacacaguaacaguccgaucucucuuucuuuuccccacaucuggagaagaauauucugugcagggaauugccagugcaaagaccuauguucaucugaaguuugaggucaaugugacuuugcuguucaguaacucuaguuggcuaucaauaguuguugaaagaauauaaaaagcgaaggaaugaguuuugguggggaggggaagcuauuuauccugaguguauuuaauaauggaaacugacuagauuggaaugcagaguuacuauagccuaaguugcuacuauaaccaguuugguuaaaaugaaaaaacagauccauuaucuugacuuuggauucagaguguuaaugguuugacagaaggauauugccuaugacuuuguuuucucaauuuccaugacacuuuugcuuagagugcaaguccuccauaaucucucagcccucaguugaaguuaacauaacagugguuggauagcccaguggagugcucuaagaaaggcuucuuuucuuucuggaauuaaauaucccaugaugguauauuaaacauaccgucuucauugaauauggcauaagagaaagagauuuuuauaauccauaaccaguuauuagcgcacuucugaaugaagcuuguauucuccacacugaguucuaauucuguucuuugccuaauugugauguagaggguccuucuauuguucuguugauucuucaguuugaauaucuuguuggcuuagauaacuuuucuggaguaccaucgaaacugcacugauaugaggagauguagugaugauguggcagguaacaugaucacucacugggagucugaacaccuuuguauaaauguaacugauuggucaauuuccuaagccuggauaauaucauaaacaacauaugccgcuaaucaggaagcuugcuguacuuaucagcuauuuuuaaauccuuuaaaaauuacaagguucuagcaugggggcaacauaguaagaccaugacuugauaaaaaauaaaauuagccagguguggugguaugccugugguuccagcuacuagggagguugagucgggaggaucacuugagcccaggaggucaaggcuacagugagguguguuugccccacugcauucccgccugggcaacagagugagaccuugucuaaggaaaagaaagaaaaagaaaauugcaaguuuccauuugaauauaaggugauauuaguguauucugucuucuaauuaccauaggagaugguaauuuucaucauacuaaacuauggagguauuuugaagucauuguuuacaauaacagcuaaaaacaaccuuaaacaucuaguacaaucucagagauaaggauaagagagaugaccugcccagcucucaacuggcaaaauucuagacuagacuucuaggacuagaauucuguuauuauaauuuuguucuuaugaaacuuggguggccucugguggccaaaaugauaucuucuauuuucaagaguguguuugaagcgaguuuggccugagaguucuguuuauacaauuaaugaagauuuaauuauuucucuauauugguugguuuauacagacacaaaucuuuacgucuguauuucccccccuuacaggaaauuguugaaaacguuaaauuugauuccuaaaaggacucaaguaaguauaguauaguaguauuuaauauaguaguuauuguuacauuuuuugugggacaccgguaaauuuuaauauuucaguauuaaacuacauacuauuucuuuagaacucuuauuguuuauuuuucucauuuauuacaaaaccuuauuuuuauuuacauucuccuuuaguauauuaauuuacauucaucauuuuuaucaucacuucacauguuaugcuuauugaaugauuuucaggaacuuuaaaaacaguuacauacuuuuguaauacauaauaguauauauacauuaugcaguaaaauauucauccucugcccagcuaccuaguucuccccagaggcaauugcuguugcauucucuuguuacucccaggaguagucuguacauaugcauauauauucauaccuggucuuuuuacugugcuuuucuuugcuuagcaguauaucuuggcagucuuuucauauuguuacugggguuacuuuucuuugaaaugguuugcaaaaauacuccuuuuguauaaauauaauugaucaauuuacaaaaggaauacaaaauauuccuuuuguauaaauguaacugauugguucagcaauuuaauuugugcuauuuugauggauauuuuaaguuccuuucaaucuuugcuaugcaaguguacaaguauaccuagaaguagaauugccaggucaaagcauauguguuuuuaaaauuuuaauaaauauugccaaauucuucccaaucuguaccaauuauacuuccuuuuuuuuauuuuuuauuuuuuauuuuuauuuuuauuuuuuuugagauggagucucacucuguugcccaggcuggagugcaguggcacaaucuuagcucacugcaagcuccgccucccggguucaugccauucuccugccucagccucccgaguagcugggacuacaggcgcccgccaccacgcccagcuaauuuuuuguauuuuuaguagagacagaguuucacuguguuagccaggauggucucgaucuccugaccucgugauccgcccaccucggccucccaaaaugcugggauuacaagcgugagccgcugcgcccggccaaccuccuuuacuaaccuauguaaguguugcuuuccuuaaucucaucacugcaguuggauuuuugcagagcuuuuggaugaaaauaaguaugccauuauaguuuugguuuucaucuucuuuauuuugaaggagguugaacaucuuuucaaaagauuuuuaagagccauuuguauuuuuuugugaacuguuugcuuauaugucuguuuuucuucuggguauagcuauugacauuuuuccccuuugauuugacuuuacuucauugcuguuacuauuucucuguacuguaucuuaaaaaggauaaaaucuaacucuuuagacugaaaccuuuaguggauucaguaaaggugggggaggaggaguaauguugacaauuuacuucccuuucaagcuuccauaguucuugcaccuaaaagacugauugcuuggaaucauacauuauuaaaugaggucuuauuguagacagagaauucaguuuuauucaugcauaauguuaaaagcuaauuuuuuucucuugaaugugugucuugagaaaaaguuaauuuuuaauuuaaaguaagauuuccuaggcaucuuuggcuaguuaauucauuauauugggucuguuuguauuagaaaauauuauaguuguguuuuugcagagaaaauugguugcuuugcuauaauaauaucaagaaaaaaaguugcacccuucuuccagccuuuaauuuuuccuuaacuuaaacuaacugaaccauuagaauucuauagcuguucuguacugucaaaauggaguagcuaucuguuugccccucccuuaguauuacauuauaaggagccaccaaaaaucuuuugacauuaagucuuuuuugaaauguguuucuucuucacauaucugugcccuacuuucuguguacugaaagguacuaacuuacuaccuggaccauuuucauuuuuugcucauggugguucuucuguacaucaggaugguucacaguucuuggcuuagaaccugcuucaugauugcuucacuuucuccugguucuucucuguuaaccauuugucauccacuccagaaguugugaagcuacugccugcaagcgcuagccuguuuuuguaaauccaguuuacacacuuauacauuuauguguauugucuauggguggagaugugaguaguuguaaaagagaucugugaccuacaaggccgaaaauauuugucugaucuuuugaagaaaaauuugccaacuucugauuuauaguauugccauuucauauaaauggucucuuuuccccuacccuauucucauuuucucuuguuugccuuguuuaccuugucuuuugucuguucaguuucuauuuucaucucuucuuguggcuauauacccuugaauucuuuaacaccauauucaccuuccucaaaguaggaagcauuuaugaaaagaauacaccgucccaccccccccuucucugaaucccaaaccugaaaaauguugacagaacuuuuaauuucacauuuugugagguggcuuuugcauuaaaauaaauuuauagcguuaaaaaaaucaggagugguuucuuucagggauuguugaguguguuuuugcaggauuguucuuuuaacacuuuuuucaguuaaaaacacauuauuuaacauagagagaguagauauauauuaaaugaagacuguagaaaagcaaaaaacuaauguuauuuauacgaacuauucaccaggaaauaggaauaacuuugccgaucagccauuuaaacgauucauuaaaaaaugaaucguuucuguuuuuugcuguaggagaaugaagaaguauuuguggucugaagugugccaccaauuuccucccauaauugauggcaacaaucucuuugaagcuuuaaauagucuugccuaagaaggaagauagggcuuuccguguuuuuuuuuuuuuuuuuuuaaagaaaaucucaaaauuguuuggaagaaacauucuuucuuuuggucacuuucauuuuuuuuuuuucucuuaagaucucuggaaaauauuuguguuggaaaguaaucauuuacuccuuccuuaccuuuucuguuacuuccuaguauaaaauccauaauucuuuuuuuuuucuuuaguggcuuacagaagagacgaaauguggucugagggacgauaugaauaugaaagaauuccgagagaacgagcaccuccucgaagucaucccaguguaaguuacuccuacauauugaaugauucaaaaaccuggugucugaauuaauuugauacaccaaagcuaggccuauuaacaaaaucuucaagugucagaaauuuaccaguguaguuuacaaaagagaucaagcuuaucuuuuaaaaguuaaaaguucaaaaauaaaagacaacauuuuauuuaaguagaaaacuuauuauuuauauuucuuguuuaaauuucuaaaaugaaggguuuauauugaauuuaauuugugaacaaaauuacagauuuuauaaagauuauaccaucaguuagcaaagaaguauuugaguaccugcuccugcuguuauuggcuguuaccuauuuuuuucuauauuccuaaaaauguuacaaauugaauauaugaaauucuaaaaguaggcuuucauucuaagagaggagaacucuuccuagaguggaaacauguuaauaucccuuguuaggauuccugcaggugugcuguccuguggucaggcagucugacugguaaguaagaaugccuggaggcucagggucaggcagacaggcagcuucuggugugcuguccuacuucuugucucucguugcucugggaauugggaauuuugagccaagccuuuucuaagcccaaagaacuuacuguuuuguuuacuauuuccagugcuacaucuaguacuuagcagguaauagaagcucaauauuuauuugagugaauauguguacugacuccccagaauucccuguggaggucuaaaggaggguuuggggaagguuaaaaagcuaacuuaaacuuuugcacagacccauucuaagcaccaagggacuaagguuguggugauaguauaugaauauauuauagauucauuauauaccaucaaaagccacaaauauuuaugucuacguuaguuauuuuuuacuuauguaacauuuaauccuauagcccacuuagaugggugguaucgucuuuagguuugucguuguccuagauuacaauccagguugggguugauuuaaaaugauuuaagauggaaaaaauaaagaugcccauuauacuucaggauggccagacuuaauuauuacuauaugucauuuauuuccaggugaauuuguagacuucauguuuucaaucaaaaucccaauguuuuuauuuauauuuuuuacuugauaagguuauucuguaguuuaccuguagggaaaagggaugacuuuuuucuuuaucuccccucuccccucugccacucugccaaggauauaucccauuaggaauuguucuguuuuuuuuuuucuuuuuucuuuuuuuuuuuuugagauggaguuucacucuugucaccucagcuggagugcaauggcgcagucuuggcucauucacucuugucgcccaggcuggagugcaguggugcagucucggcucacuggguucaagcgauucuucugucucagcuuccugaguagcugggauuacaggugcccaccaccacaccugguuaauuuuuguauuuuuaguagagaugggguuucaccauguugaccaggcuggucucgaacuccugaccucagguggccugcccaccuuggucucccaaaguucugggauuacaggcauaagccaccaugccuggccucuuuucuuuuuuuugaggcagucuuacucuguagcccaggcuggagugcaguggugcgaucuuggcucacuacguccucuacuucccggguucaagcgauucuugugccucagccuccugaguagcuaggauugcaugccaccauaccuggcuauuuuuauuuuauuuuauuuuauuuuauuuuauuuauuuauuuauuuauuuggagauggagucuaacucucuugcccaggcuggagugcagcgguacaaucuuggcucacugcaaccucuguguccuggauucaagcgauucuccugccucagccuccugaguagcugggacuacaggcacaagccaccacgccuggcuaauuuuuauauuuuuaguagagacgggguuucaccguguuggccaggccggucucgaauuccugaccucaagugauccaccccccucagccucccaaagugcugggauuacaggcaugagccacugccacugcacccgcaucuaauuuuuguauuuuuaguagggacaggguuuugccguguuggccaggcuggucucgaacuccuggccugaagugaucuguccaccuuggccucucaaagugcugggauuacacgcgucagccaccacuccaggccccauuaggaguuuuaaauucuguguuuugaagauacuuaaaaggguuuucugugugguuaugccaucaacugggcaccagucuguaggauugugugcuuuauuacuuugggacuggggaaagcagguuauuguaucgauuuaagauuguaagaugaguaguggauccaggggauaaggauguugaaggugcugacccagaaaauuauugaaguaauacaccauuugguguuggcugauaaagaaagagagugaggcugagagggacaggaaauugaaagaaugagugguugagggacaggaaaggcuuaggaaaggcuuugguaugguagaaagauaggcaaucgguauuuuagagugugggguuuccaagauggaacaguuuugagugaaguucagugugugacaaugagaauagagagcuaguguaaguuacuggaguugagagcaaugaaacuauuaggauagacuuuagauuugugauuuagaucagaagcucucaauccuuguuguacguuaaaauuuccuagagagcucuuuaguaacacuguaugggccccgucuuagauaauuaaauuauugucucuuugggugugauguggaccucaguauuguuuaaaaguucaagugauucuuacaugcagaauuuaaaaaauacagauguauuugaauugaagucauagugacaggaguugagguaaaaaugacaggugauggaagucuuuaaugaaucagcauauugcggaaaaaucuaaacaaaaccauuuucauuuaauauuaucuguguuuguguaaauaugaaacagaggcuucuuaucccucauaaaauaauuuuaucagaagcaagcagguagggagauauuguccuuaaaaucagacuagauguauucagcugucucuuaaaugccuaaagguaaaccuuacuuccuuaaguuaacuggcugcuugguuccucauggaggagccuagauuguuuuucucuuuuugagagcacaggaccugaccagaccuuguacagguucauuucucuccuuuuucuucaauuccauuagauuggucuuucuguucccccaaucagccucuccuaguuuauacaaauccuucuuucuguauauccauaucccuccuucccaagacucaggugcauuuuuuuuuucuggugcacuuggccuuauuuugguuaguaauuuaaagccuucucuuucccucaauacauuguaccccuuagauggcucuugaaaauuauccccugugccuucuguguuacaccugcaucuuaguuaaauaaaguguagauucuuaaccuuuuuuugugcgauggaucccuuuagcugucuggugaagccuauggaucccuucucagaauaacauuuuuaaaccuauaaauaaaaugcacagaacuaagugcacuuacauuugagaaugauuaucaagcuauuaaaaaccaaauuugugauacaguaauacauaguucuuuaguaggucauuaaauaucaaaagcuacugguggugguuucauugcuguaauuucaaaguagugaugaguguuacaaaugauauuuugcaauaccuguaacagcuagauguaacaugguauaaaauuaucugugaucucuuuugguaacaaagucacagauacaucugcuguuguuauuaucuaaaguuaguugaaaaaaguaauuuuguguucacaucucauuuaauggacccacugaaucuuuggguuaaaguaauugaacuagaaauguaaauaguuauacuuucuuacuuuaauaaaaauauaacuuauuaaaagcuuaaggcugaauacaguggcucuugccuauaaucugagcacuuugggaguccgagguaggaggaucacuugagcccaggaguuugagaccagccugggcaacaaugugagacccugucucuacaaaaaauuuuaaaaauuagccaugcauaguagcgcaugccuguagucccaccuacauugggaagcugaggcaggaggauugcuugagcccaggaaguugaggcugcagugagcuguguuuugugccacugcguugaagccugggcaacagagggagagauccugucucaaaaaaaaaaaaaaaaaagauuuaaaaauauuugcuuagauaaucuaguuauuuuaaaaaccauauuagcauaucauauugauguauaugagaaaguucauaagaagcauuauuuguaagagcuucaaacugacaacaaaccagauguccaacagugaaguugauuguuuaaauuauacaccaaugagaaucaaugggcuacugccaagugcaacaacauggauaaacuucacaaauauaauauuaaaagaaagaagucagucacaagaguuuauucugcguguuucauuuuauguaacauuccaaaacaagugaaacuagcugggaaagugguuucuuuugggaagaggcaguagugacugggagaccgcacaaugaacgauuuugcugcgcugggaauauucucuuucuuaaucugggugguacuuacaccuugugaaauuuauccauuugugauuuguacacuuuuuuauauguauggcauaccucaaaaguuuugaaaaggcagauuuuuuuugcaaaauauaaaacuaguuaaguugauaacccacuaucguuagugcuuggaauagaggaagguaacauucuauuuuguuuuauguauuugaauccuguucuuuaucaaaaaacaauuuuacagaauuucucucccuuuuuuucuuucuuucuuucuuuuuuuuuuuuuuugagauggaguuuugcucugucgcccagguuggagugcaguggcaugaucucagcucacugcaaccucugccucccagguucaagcgauucuugugccucagccucccugaauagcugggauuacaggcgccuaccaccacgcuuggcuauuuuuuguauuuuuuaguagaggugggguuuugccauguugaccaggcugguuucaaacuccugaccucaggugauccgccucggccucccaaagugcugggauuacaggcgugagccaucgugcccggcuucuccguuuuuucuuaguacacucuuugccccauuuaugaucaauucugauacaaaauaaauguauuugaggaacuacuagaugugauauaaagugcaacgugaaguggugacuguugggaagguaagguaccuucuguaguaguaugaccucguuaauaaaagcagcuguuuucugaguuucuagccuugauaaaccugaaaagacaauugaacacuaauauacuuugguuuugauguuaaauuauacuuaauuugaguuuuggcaaacuuauccucaauauacagcuuaacaaauguaccagucauuauuuuagcacuuuaugguaugcuuuuaaauuauuauuauuauuauuauuuuuugaggcggagucuggcucuaucgcccaggcuggagugcagcgggcgaucucggcucacugcaagcuccgccucccggguucacgccauucuucugccucagccucccgaguagcugggacuauaggcaccugccaccacgcccggcuaauuuuuuguauuuuugguagagacgggguuucaccguguuagccaggauggucucgaucuccugaccucgugauccgccugccuuggccucccaaagugcuaggauuauaggugugagccaucgcgcccaggcgcuuuuaaauucuuuauguauaaauaguaagucacuuuuauaaggggcuuucacagaaauuuuuauuuggccuuaaacuuggguagguagguagcagacuaaaguucaaagaagugcacuacagagauuuuguauguaaauauauaugcuucuucuauaggaaggaaaucagucaccacagaauaucuacacuucuagguaccuguaaagcucuuguuuuuaaagcaugcuuucugucuuuaaaccuauaauuucuaugagcuuaguuaucugauuucuuaaccuuuaucaaguuuugugacagaauggcauucauucauucauucauucauucauucguucauauguacauacacacagggucuugcuaugucauccagcugaagugcaguggagcagccacagcucacugcagccucagaccccugggcucaagugauccucucaccuuggccucccagaucguugggauuacaggcaugaggcaccaugcccagcccagaauggcuuuuaaauacauguaaacuuccacuuaugggguuccagcuucuuagccuguuggagaacaguuagguaauauggaacauuuuaaugaagcugcaacauaaaaugucgauuuuuucauuagcuuauuugaaaaugggagagaaguuccaguuucagaauuuuuaaaaguuguaauguuuggaaauuaggaucagagcacuagcaguuuauauucugggcaauuacaacagagcuggggcugaagcaguccuaucugcuuaucccugcuucauuuuucuguuucuuuaacaaauacauuauuuugcauuaaaagauuuuucugguuuuggcagcagcagggagaacaauauugacuaguagugaugucaagaacagcaacacguuauuuuucugucacauuugugguaaauaugaguuacauaauuaguuuuuguaauuaaguaguuaaauaacaauauuuacuuccuuagauuaauugaaucuuuuuuauaauucuugucauuguuuauuucucucuccuagagaguuuggccaaucaaaaauaaauccuuuaguaaauccagaacaugauuuuguuaauaucugagccuuuauagggaauagaugggaugcauaucaguuccaccuguucucaaauguaaauguacucaaaccauaauccagacauuuuucuuuugacuaacuugacagucaggucuacuuaauuuaguaauucaguuauauacauauuccauauaacauuguuuaaaauguauuaauguugaaauauuuuuucuuuccauucuuauuucaugaaacacuuuuauucaaaaucuucacaggcauauuuaaauuucuguucuuuuuaugccccacauauuauuauuguuuuauacagucaucaguguucauguaaauuuucccauguaaguacaacuucccaauauuuuauuauggaauuuuucaaacauacaucagucaaaagaauuuuuauagugaccauccauauacuccccauuuagacucaacuauuaacauuuuacuaaacuugcuuuaucauguauuuauucaugcaauuaauccaucuauguuuuugaauacauuucaaaguaaauuguggacaacaguauccuucccguuaacuacucaagcauauguauuauuagcuagagugcaauuuuuuaauaguuuuuuuuaaugggaaaauuacauacaugaaauguaaaaaaaguguuucuuugcugaguuugauuuaguaauguucccuucuguagaguugcccuaagagguguuuuacuuucuuugcugacagaauugcaaggacuuaacuuucuuuuuguugucacuguuuucagaagaaaugugaucaauucuuggcuacauucucgaauaagaugccuuagcucucugggucgauaccaguuuuuauguuuuugacacacugucaccaaaagacguuggaaugacucagaaacaccaauauuucauucaagaaucagugagugaaauaaaucaacaagugcuaaaauaagaauguaugucauagacuauagggaucagaguuaggaaauuacaagcuuaugaaagcaaaagccuaccagccuguguaauagaauauuuuaguuaggugugguuuguaugguacuuuucuguaaaaagcaugugaugccagaaguaaaauaaaauugagauagcaggguauaauauauauauuauggauguggugcuuacugugugccaggugcuguucuaggugcugggaauagagcaguaaauaagaccaauaaagguuuuguaggcuuacauuugcauuguaaguugauugugauaggacauaauggcauugauuauuuacauaugccaucguauuuacuucuuugguagguuaguguguuuucguuguuauuugauguuuuauaaggggaaauaucaagcauauaauaacacacauuaaugugaucaacucccaaaggagaaaucgacuaucagcuucauugccaaucuuguuuugucuaugcuucuaccacuuucuucccuccuagauuauuuugaaguaaaaccaugauaucacacuuaaaaugucaauaaguauuucaauauguguugcuagaagauaaaaauguuugggggggaugggcuuaauacuuuuacuuuuauauuaauacuuucauuuuaaauuaaaugauuuuaugugaaaaugaguaaauuuuaaugacauauuggaaaagaaauauuuuuaaagaaacaugguaauucauacaauuuuuaccuaguuacuuaugagauuuaacaacaguguggauuuuuuuuuuuuuuuuuugagacagagucuugcucuguugcccaggcuggagugcaguggcauaaucucggcucacugcaaccucugccucccaggcucaagcaguuuuugugccucagccucccauauagcugggauuauagaugugugccacuaaaccuggcuaauuuuguguauuuuuaguagagaugggguuucaccauguuagccaggcuggucucgaauuccuggccucaaacugaucugccccccucagccucccaaaguguugggauuacaggugugagcuaccgugcccagccagugugaaaaauuugauacagauuuuuauauugaaucaaauaaccaucaacuuggugcuuuuacuuacuaaaaugaaagcauuuccuguaaccgauagguauauuggaauguauggcaaauuaagaaguagcugauuauuuucuaacaaaaccauuucaccaguuggaaaacuagguauuuuauucugaccagauucucauuaacguaagcaaaccaaagaauucuuauuacacacacuuagagggucuuguaguaguaaucuuaggggugagaccucaucccuaagaugaugacagauuugaaaguuuaaauuucauugaaguauaacuuuccaaaaguauuuaaguuuaugugcaaguuuuuuuuuuaauacccugccagaguagguaaauuaucauuagauagaccuuucauuuuaaaugagcuacauauacuuuuuauuuuuggucugacugaucauaccauuaauacuaacaccauuaauacuaacuuuggaguagcaaauccaauaaauucuaugcauauuuuuuggaaauucuaguaacauccacagaaaauucugaucuuuuuaauaaggauacuuauauaaucauuaauauguagauauauauuaauauuuauauuaguauguagauauuuuuaauaaauagaagcagugaaaauugauaucauugauugaguaaauugagauuuuauauuuaaauucaagauuugaaauaucugcauuugaaauaauagaaauguuucaacuccaaugaguuuauuuuuugauuacuugaaaaugacccuguuaaccuuuuaagauagucuuuacaagucauaauuuuuuuuucugguuuguauauuauggugccauuguuuuucaagguauuuuccucuuuuuucuuuccauuuuuuauuuuuguuuacuuauuuuuaacauuaaauuuuauuguguauauuugagauucacaacaugauguuaugggauacauauagaugcagguacacauggaugcauauucauaguacagugguuacuguagugaaggagacaaacauauucaucaucccacauaguuaccuuuuugugugauaagaacaccuaaaauuuguauauuucacaaaaauuucuaaugcaauacaauuuuauuaauuuugguccucauauuguacauuagaucucuagacuuauucaucuuacuuaccuauuuuguauuccuugacuuaccauuccccauuucuuccccuacccgugguaaccaguuucauccucuaucucuguguauuugagcucuuuuuuguuuuuuuuaaauuccacauauaaaugauuaucaugcaauauuuuuuuguguguguaucuagcuuauuucacuuagcauaauguccuucggguauauccauguguuguaaauagcaguaucucccucuuuuuauaaggaugaauaauauuccacuaauauauuuauauaccagauuuucuugauccauuuguucauccauaggaacuuaaguuguuucuaaauuuggcaauugugaauaaugcugcagugaacauggaagugugaauaucuugaacagguggugauuucaucgccuuuggguauacaguauacccagaagagggauuacuaggucaugugguaguuuuauuuuuacuuucucuaggaauuuccauacuguuuuccauaauggcuguaccagucuacauucccaccaacaauguauuaggguucucuuucucucauacccucaccaacauuuguaaucucuugucuuucugaccauagccauccuuaagggugugaggggauaucucauagugguuuuaauuugcauuuucccugugguuagugaugucaagcaccuuuucauauaacuguugaccuuuuuuuaaaaaaauuauuauuacuuggagauggcaucucacucuguuuucccaggcuggagugcagucaccagucagcucacugcagccuugaacuccuaggcucaagggauccucucaccuuagccucccaaguaucugcgauuacaggugugagcagcugcacccagcuggccuuuuuguuuguuuguuucuuuucaacuagcauccugguguagucaacauagagguggcaugaaccaggccagaaugccaaucagcuauuggcuacuguucucccagaaguguaaugcuugccuagguacaaggcaaccuagaaagcugccuacagcuggggagcuggccauuuuuaugucuucuuuggagaaaugccuguuuauggucuuuguccauuuuuaaauugacuuuuugccaauaucuuucuaaaauggagguuccgaacauuucaguaguaccuuaagucuguguaccuauguuagcauacagaaaggaaaauuacauguuuacagcuuaauguaagauuugcauaagaauuucaguguuauuauuuguauucaugucuggcaaugcagguaauaaaaauacuguuugaauuucaacaauauaaucuuuuugaaaggggcgggcgcaguggcucaugccuguaaucccagcacuuugggaggcguaggcagguggauuaccugaggucaggaauucgagaccagccugaccaguacggugaaauccugucucuacuaaaaauacaaaaauuagcugggcaugguggcaugcaccuguaaucccaacuacucgggaggcugaggcaggagaaucauuugaaccuaggagguguagguugcagugagcugagauugcaccaccgcacuguagccugugccgcagagugagacuccaucucaaagaauuugaaagggaaauucugaauucuuugccacucaucauagauuuuauugggaacagaaauccuugaaugauauaccuggauaagacacgaacgcuuuaaaaauacaguccucuuugcuacaggcuccugcagucaucuuuguuuccuuaaaucuuuucauauagcuagggaguuuucuuuaagaucagguaucuacagagcagagauaguauaauguacauauauuugaacacuuucucgaaauaccaacuuggucuuuauagccagguauaagagcugucauugaauuuuuguuuucuuuugcugauuaaacagcuuuuauuuuuauuuuauuuauuuuuuugagauggagucuugcucuguugccccagcuggagugcaguggugcgagcucagcucacugcagccucuaccuccuggguucaagcgauucuccuaccucagccuccugaguagcuggcacuacaggcaugcacaccucaccuggcuaauuuuuuuuuuuuuuuuuuuuuuuuuaguagaaacgggguuucaccguguuggccaggcuggucucaaucuccuaaccucaagugcuccaccugccuugaccucccaaagugcuaggauuacaggcaugagccaccaugcccggccuuaaacaacuuaaagaaugauuguuuucauuuaccucaguugguaaagcaauuuuucuaaauaaguaacuaagugugauuugaauuuuacuucugccaaaguuuuaccaaauacauuuuacaauccccagauaacuuucuaauaacuggggcaguugaacaaaggaacagagugcuuuguaaaauaauaagcucucuauucauagaaguguuuaggcaugcauagucaccccaccaucccuccaaauaaucguauacaaacaaacaaggauauuguguaauggauuguuaugguuuauuggaauuuggagaagucaguuauucugauuuuaugagugacaaauuuucaauuagaaaugauguaaauuguaauuuuacuaauuuuggcuuaaugucaguuuuuuuuuugggcagcuuaguacuuaaauuuaauugaaaucucugugaaagguaguuuguagaagaaugagucaguauauucauuuguguaucauauuuuauguaaauguagaauauaucuuauaauuuaauaucuaacauacuaaaggagguaaccaccuuacauccccaugggaaaaauuaguuagaucuuuuaagcucucaaauaaauacaaacuacugauuuuauuuuuuccugacccauugacaaauuuccuagcuauugagagauuugaauaguauauagucauuuaauaacaauugaauuguuguagucauuagggcuaagaaguaauuuaaggaaacaguuugagauacuuaguauuuuuuuccguagauuugcacaguaguaaugaauauagcaaacauuuuuugagcacuuagugugugccugaacacgguacuaaacacuuugcauuccauuucucauuuaguccucacagugccaugagguagguguuaguauuaauuucauuuuacaggcucagggaugauagauaaacagcucugaagguugggcuuuauauuuuguaaguuuuguuuuguuuuuuaaauuuuuuuaguauuuauugaucauucuuggguguuucucggagagggggauuuggcagggucauaggacaauaguggagagaaggucagcagauaaacaugugaacaaaggucucugguuuuccuaggcagaggacccugcggccuuccgcaguguuugugucccuggguacuugagauuagggaguggugaugacucuuaacgagcaugcugccuucaggcaucuguuuaacaaagcacaucuugcaccgcccuuaauccauuuaacccugaguugacacagcacauguuucagagagcacgggguuggggguaagguuauagauuaacagcaucccaaggcagaagaauuuuucuuaguacagaacaaaauggagucuccuacgucuacuucuuucuacacagacacagucacaaucugaucucucuuucuuuuccccacauuucccccuuuucuauuugacaaaaccgccaucgucaucauggcccguccucagugagcuguuggguacaccucccagacggggugguggcccggcagaggggcuccucacuucccagacgugguggcggggcagagggggcccucccaccccccagaggggguggccgggcagaggcgccccccaccucccagacagggcggcugccgggcgggggcgccccccaccucccagacggggcggcugccgggcgggggcgccccccaccucccagacggggcggcugccgggcgggggcgccccucaccucccagaccgggcggcugggggaggcgccccucaccucccagacgggguggucgccgggcagaggcgcuccucaccucccagacggggugguggccgggcagaggugcuccccacaucccagacgaugggcggccgggcagagacgcuccucacuuccuagacgggcugaccgccaggaagaggcgcuccucacuucccagacugggcggccaggcagaggggcuccucacaucccagacgaugggcggccgggcagagacgcuucucacuuccuagaugggauggcagccaggaagaggcgcuccucacuucccagagugggcgacugggcagaggggcuccucacaucccagaagaugggcggccaggcagagacgcuccucacuuccuagacggggugguggccgggcagaggcugcaaucucagcacuuugggaggccaaggcaggcggcugggagguggagguuguagcgagcggagaucacgccacugcacuccagccugggcaacauugagcauugagugagcgagacucugucugcgaucccggcaccucgggaggcugaggcgggcagaucacucgaggucaggagcuggagaccagcccggccaacacggcgaaaccccaucuccaccaaaaaauacaaaaaccagucaggcauggcggcgcgcgccugcaaucccaggcacucggcaggcugaggcaggagaaucaggcagggagagguugcagugagccgagaucgcggcaguacaguccagccucggcaacagagggagacccuggaaagcaggagacggagaggagggagagggggagaccauggcaagcgggagagggagagggggaggggaagagggagaggguuuuguuuuuuuccagauuaguuaauucauauugaucuuauguuauaucaggcuuuacaguuuuuuuuuaacauauaucucauuugauauugauugaugugucaugaaugcccaagaccagauuauguacagauauauguucuguagcucucuacuucuuucuguggauaaucguuuuuguuauuuuauagcagcuacuaaccuaagacauauguucucccugcguccaauuccccaagucucacaaaaaaccuacucauuuuuuaaaacauuaacaagguauuccaguacuuugaaaauuaguucaaauuuuauaucagcuuuuauuuugcuucuagaccuguaaagccaaucuccucccuccauuacugcuggaaaaauagcaaaauguuuccuuuugaucauucuggcucaauaucaucauuagcuguugcuuguggguaaauagcuuauauuucuucuaaauaguauaguagaacaaauaugagagcugucuuacauaauuuuauuucuaaaauuguuaggcaauuagggauagagcuacuguaacauucugucuuaaguuuauuuuuuacuaaaaugauaauauuguauuuuuucuuuuacuuaugauugguuuucgcauugcugcaugucauuuugaacaccuggcuuucuucguugaacaacuugauuuccuuuaauccaugugaagaccuuaguauuaguuauauuuauguuauuucauuaacgcuuuuguuuauacauuuagcucauucgauuaaggguaagaacuccugugcuuuuuaaaaaccuuuccaaaaccaaauagagaaauuagucauuuguauauauuucuuuuugucuguuuuaggauggcuacaauagacuaguuaauauugugccaaagaaaccaccacugcuagacagaccuggugaaggaagcuacaauagauauuacagucauguugauuaccgagacuaugacgagggccgcaguuuuucucaugaucgaagaagugguccaccucacagaggaguauguaaauuucccccauguacuaauuguuauuucuuauaaguuuaaaauuaauguaauuuaaaaauuuaugugacggccgugaaagcaguugaauaaacacuuucugcuugaugcucucaugugaauugccugcuggagcugucagaugggaccuaauagucaagaaucuugggguacuggacaaaguagguaagcacucuggguggcacuaucuaaaugaaauuaauuccaaccagccugcuuuuuuuauuccccuaaauuggcagggauuugcaaaaccauuuaaagguaaucuguugucuuaguacuuaauaagugaugagcaggugguuaccauuucuuacuagauaacccacuuaauuuuuuuuuuuuuuugagacagagucuuacucugucccccagguuggggugcaguggcgcgaucucggcucacugcaaccugugccuccuggguucaagugauucuccugccucacccucccaaguagcugggauuacaggcacgugccaccgugccuggcuaauuuuuguguuuucaguagagacaggguuucaccauguuggccaggcuggucuugaacuccugacaucaagugggaggucacuugaugaucaagugggaggcccaccuuggccucccaaaguguuaggauuauaggugugagccaccacucccagccuaaagucuauuuauuaacugagauuagaaagcacucaaaacaucgucauaggaagcaauuuaaaaauguuagcuggcugggcauagcggcucacaccuguaaucccagcacuuugggaggcuuagguagguggaucaccugaagucaggaggucgagaccagucuggccaacauggugaaacccugucucuacuaaaaaugcaaaaaucagccaggugugguggugggugccuguaaucccagcuacuugggaggcugaggcaggagaauugcuuaaaccugggagguggagguugcagugagccgagaucgcgccacugcacuccagccugggcgauagagcgagacuuugucucaaaaaaaaaaaaaguuagcugcuauuauuacuauuacaacucgcuucucuugagcauucuuaauaauguagaaguauguauuuaaugaugcaguaaucuguaguugaacuuaauacuauucugugauggaauuccucuguccuaccuugcauguuuucaguauuccuuagcuagguuguuuucccaccuuuucucuuuuucccccuuuccuacuguauaauaugacaauuaacaguacauauucaaacccuguuuauaaaauaauuugaccucacauuggcuguuggaauuaguuuucauacuuuacgcuugaagaaauggagguaaggugauuuacuuaggaucgguauguaugggagucugguuucucuuacuacugcaucauagugaccccuaacaauuccaaaguuguaaugagacuauucaguguuuucucguguuuguuucuaaaguuugggguuuuauagcuuucuuaguuuucacagaauugauuuuuauuuuauucagcuuuugaaugucaugcugcuuuuugugguccucauauuuauuacauuuuuauuuuauuucaguagcuuuugggguucaaguagcuuuugguuacauggaugaguugaauaguggugaaaguuugagauuuuagugcaccgucucaguuguuaccacuuuuaugaaaauccuaugugaguuuucuauucauuggaccaguuuguauuugaaaccucaugaaaaugauuuuuuuucuaaaaacuuguagcauaauaaagcuucaauggcaguuuuuucuaauauuguuaccaauuguguuugucuuuauacuuuuguguguauaacauuuuuucuuuaaauucucuucaaacaaacaacaagcauacuugugauccuuaagagucucaugacacuaauucuuauauagaguucaguuauguaaugcagauuacuugauuuaauauuuuauuagcacuguuaaguuuugaauuguguuuauauuuaauauugagauggaaaaugauuauauuuuauuuauauaagaauagagugugugaugcuaaagaggaagaugaggauauuuauuuuagacgaauccguuuuccugauacguaauuugcauauuguauuauucuauguauaauuuuauuuauuuauuuuuugagacagagucucauucuguugcccaggcuggagugcaguggcaagaacuuggcucaguacaaccuccggcucuuggguucaaguaauucuccugccucagccucccgaguaacugggacuauaggugcacgccaccgugcccggcuaauuuuuguagagaugggguuucaccauguuggccaggcuggucucgaaauccugaacucaagugauacacccuccuuggcauccuaaagugcuggaauuacaggcgugagccacugcgccuggccaauucuguguguaauuuuaaaguaauuugguguggauugcuauaugguucuuuuuuauguaccuuugcaaauaugucuuagagaacaaaaugugcuuuguuugauuaauuuuaaauuuauuuaaacuuaaauaaauuuaaaucuuauucugauauagauuaucaauaagugacaguuucuuauauuguuuccaguuugguuuuuaauugaaaauaaggugagaaaauaaaacuugagcaggaaaaaugggaaaguagcaaguuuuucauugggcuugaaacugaaaauuggugagagaacuugacagaaggaaaaaugugagguugagaaaugugugcuuuauuaaauuuagacuuuguucucaaauagcccuuuacuguugugauauugauauauguaucuuuggcaauuagcuuguuugagucuaccaaagaaauaauuuaagcauuuuaauagagauaaaugguaccacagguucucagucagucuacucuuucaguuguugaaauggaugacuugcugaauguuuuucccuuuuuaugccuuugaaguuuagggaaauucggucuaguuucugguaguauuguuagauaugucccacuuguccaaaauaauguaaacaaauagcuaaguagcuuuuuuauguuacaggaugaaucugguuauagauggacaagagacgaucauucugcaagcaggcaaccugaauacagguaaaaggauaaaaauaauagcauaaguacuuugauacuugacucacugugaugucugcuuuggaaauauagacucaaggcacauagaugaaauauuuuacugggauuuuaaauuuugaaagcaacaagcauuauauucuuuuugugacuauguaguauaauagcacugauaacuaguguuccacaucucuuggcauuuuguaacucauaaaaaaauauuuaaaaauauuugggccuggugcgguggcucacacuguuaaucuccgugcuuugggaggccaaggcgggcaaaucacuugagguuaggaguuugauaccagccuggccaacaugguggaacccugccuuuacuaaaaauacaaaaaaaaagaaaaaaaaauuagcugggcaugguggcaggugccuguaaucccagcaacuagggagguugaggcaggaggauugcuugaaccugggagguggagguugcagugagcugagaucgugcagcugcacuccagccugggcaacagagugagacuccgucuaaaaaaaaaaaaaaaaaagaacuauugugauuuaguuuugcaaucuaauuauuaaauuauuaaugugugguauggauuaugagguuugcuuaauuaguauuugauuugauagguuugcuuaauuagaaaguaaggcuuuuuuucagaaguauucuggguucuuacaaagucuauuauaaggcaucucaguuucuuuaauuagugaaguccuuuugggaaacacauuuugcaagggccucaaucguuggcuuugauuacuuacagagggcaucuaauagaauaguugugggaaagaaacgauggacacauuuaaauugauugauaguuuuuguuuuuaaaugacaucacaguggugguaucgaaaguuguaaaaggagccuuguagagauuucuuaugaacuaucagggaaaauaaccccagucucauagagaguggcaaggcaucaacugucacaacuccaaagaugccaaaaguagacaagauucaguggaucagagcaagacagauuuuuauucacagcacagcaaucagcaggaggaucagcauuguaguguagguucccuguccccaaaucccacagggcgaugugauaggcacagauggugacugugcacacagugggauacacuguggcuguggaacccagggucaagagcuugguaccuuuuguagaaagcagaaagcaagcuaguccuccuuucccugggagugaccugccauaguagucacauuguggucaccuuaaccuauuuaauugucucuguaaccagcuacagaaacuguucagugucaguggauaguuaggucuuggaauuuggcauacauggcaauuaugugcagggacauucagaacccauggcagacuguuucuuccaaaagaagcaauagaauagaugccgaaaaaaaugcuuugauaaaauuaaucaccaaguaguuauaaaaauagccagcugggaauggaaagagaauuuccuugaccggguaauugggcauuugcuguacugaaugguaaaauuagaaacauuugcuuuaaaaucagaacaaaacaaugacaucuagucacugcuuccacucaacaugguaacaaugccuacaguaaagcgaaaaauaaauaaguuguaggaauuagaaugaaaaacgcaacuacuuaaagauaauauaauuaugcagaaaaucuaggaaagucuauagacuguaagaacuauuaugaaauuagcaagguccaauguaauaagaucaacuaucagcauaaauuagaaaauuuguuuucaaaauacuauagcaugaaaacuguaaugagugauaggaauaaacucaccaaaagaguaugaggccuauacaaggaaauuacaaaucauuucuaaaggaaauaaaagugaaucagaguaaaaggagaaucaugacauccuuagcgaggaagacucaguaucauauaagugucaguucuccucaaauuaaggugguaauucaauuugguuccagucaaagaucaaaauuuuuuuuauuuuuuauuuugcacggaaguugacaaguuaauuuuaagacuaauaugaaagaguaaagggcuaaauggcaaaaaugccuugaaaaagaugugaagacucaagauaccauaugugcauaauuauaaagcuguagugauguaaacaguguuguacuguugaugucaaauagaccagugaaacagaaucugcaaauaaaccuagauauaucuggaguuugggguacaguagcaguggcauuacaaauccaauggagaaagaaugaacuuuucaauaaauagugugcugggacaaacauuucaaaaacaugacauuggaagcugauauauccaaauaauaucugacauaauuaagaccuaugugaaaggcagaauuguaaaacacuuuuaaaaacuagaucagcuaguggcuuaucuuucuccuccaaagaaauaccucccaagaaauuuauuuuagcuuaauuguuuuuauuuauuuauauuauuuuuuauuuguauaaauuugauggauacgaguguaguuuuguuacaugaauauauuguguaguggugaagucuggguuuuuaguguauccaccacuugaauaauguauauuguacccauuaaguaauuucucaucccucacucaccucccacccuuccaaaucucugucucucauuccacuauguccauauguacacauuauuuagcuuccacuuauuagugagaagugagaacauucagucucugacuuuauguuucugaguuguuucacuuaagauaauggccugcaguuccaugcauguugcugcagaagacaugauuucauucuuuuuuuauggcugaaucguaugccauuguauauauguacuacauuuucuuuauccagucauccauugacggacauuuagguugauucuauaucuuucccauugugauuuuucaguuuguaaaauaacaguuuuuauguuaauuuuaauuuucucuuccugucucuuuuuuauaacauuuuguguauguauauaacauuuuacauaaaugaaauaaaaacauauauauaaaucucuaauccccacagccaugauaacaucuugguauaaguucuucuauauuuuucucuauauucauaaacauuuaggguuuuugauuguuuaauugagucuuuuuuuguuguuuguuuugagacaaaguucugucacccaggcuugaaugcaauggugugaucauggcucccuguagccuugaucugucaggcuuaagcauuccuccugccucagccugcugaguagcugggaccacaggugugugccaccacacccaucuauuuuauuuuauuuuauuuuuuaacuauuuuguagagaugaggucucacuuuauugccuaggauggucuugaacuccugggcucaagcgauccuccugccuuggucucccagagugcugggauuauaggcaugagccauuguucccggccaaauugaaucuuuuuaauggucaaguaauaguccauggugaggauaugucaaauaauuuagcuggucacucuguuuacaguacaaaacagugcugcaguaaauucuaguacauaauauuuucaugaaauaguacuuuaguuuuuacgagauagguuacuagaagcagaauuucugggucaguggguauauauauguauuuuaaauauuaauagaugucaguuugccugcuaaaaaugguuuaacauguguguuuaauuuuuuuuaauaaaaaucuuaacauuuuaauuuagauaauuauuuuucuuucuuauuuacuaauauaaguaguuugaaauuuccuuuaaguagugccaugacaguaucccaugauucugauauauaguaauuuacacagauucugacauacuguauucuaauuauucugugaucacaauguugccuguacuguaauuuuacuuucaaaauccauugauuauuaaugguucauuaguugaucagcuuccauaacuguaccaugggcauuaaaacaagguauauucucuguuuucagaguauggaguucauucuguaugguauauucauucauuuauuaaauauuucuugugguaucuaauaugucaaaugcucuucuagucucugggaauauaaagccucugucuucauguagccuacauuuuaauaugaauuauacauauuuaacaaauaacaaaacauaauuuuuacaaagaaaaagcagggaauagagaguauuuguacuguccacaccugcuugugucuucacuugacgucugaguuaucuucaauaaugucucagguuuuaugcuaucacaguagcuauagcuuuuacugccuggcaucuaucuggcuucuguaagcuguucucuguaucaggugggcucauugacgauuuccuacuugaaagacuuugugaacagaaaauagcuguuguuguagaaaaagauuuaaugcauugugaaccgugcaaagagaauuguuacaucuauugguaauguucugagcaguuaggaaagccaugucaguauuuuuguuuuugucagugggguguacaaagugauucuuugugcuguaggaagaaaauauuaaaagauuugaaaaauugaccaggugugauggcucacgccuguaaucccaacauuuugggaggcugagacaggcagaucacaugaggucaggaguuugagaccagccuggccauuaugacaaaaccuugucuccacaaaaaauacaaaaauuagucaggcaugguggcaaacaccuguagucccagcuacucgggaggcugaagcaggagaaucacuugaacucaggagauggaggcugcagugagcugaguucacccauugcacuccauccagccugggugacagagcaagacuccaucucaaaaaaaaaaaaagaaaaauugcaagaauaacugaaaacuccuguaacccuucacuagagauuucauuaaugucuccagaaauguccccaguaaugugcuuuauagcaaaaaacuugaaucugggcucauaaaucacauuuucauaagcuucuucaaucuggaacagcuccuuagucuucccuugauuuuuaugguuuaguguuuuuggcaagaugaauacagggcaaguuuuuuuuuuuucuuucucaguuuagguuuguccagcguuucuucauuucuucaugauuagagauuaggucuagguuauagguuuuugccaggacaguuccugaagugaugcugaauucuuuuuuuuuuuuuuuuuuuuuuuuuuuuugagaugaggucucacucuugucacccaggcugaggucucacucugucacccaggcuggagcgcaaugguguggucucggcucacugcaaccucugccucccagauucaagugauuccccugccucagccuccaaguagcugggacuacaggcgugugccaccaccgcuggcuaauuuuuguauuuuuaguagagacgagguuucauuauguuggccaggcugcucuugaacuccuaaccucgugaucugcccaccuuggccucccaaagugcuuggauuacaggcaugagccaccgcgcccagccgccgaauucuuuuucuuccuauaggcugcacauguuguuuguguccuuauugguauaguugacuuuuaucacuuguuuaagauggagucugcaaaguuucuuuacuguuaaguuguccuucccccugaaauugcuuuguguggagauacuuugaaacuaugugauugaaucauuuccuguuccacuuucagcugcuaguuuuagcauccacugaugguuuugccugaguuaauuaucaauauuauggacauaguauuuauguccccccaaauucauguugaaaccuuagccccccauuaugauaguauuaggagguuaggccuuuuaggaggugagauuuggucauaaagguggauuccucaugaaugggauuggugccuuauuaagaagagacauaagagcuugcucuccaccaugugaggauacaaugagaagacaaccaucgucagaccaagaagaaaguccucacuggacaccagaucugcugguaccuugaucuuggauuucccagcuccagaacuaugagaaauauaaauaguuuguuguuuaagccuaugauaauuuguuacggcaguccaacccuacuaagacaaauauaauggguuuuaaugggugguuagcccauucuuucuauauuuauuaugcuggcauucuauuguaaggaagaacauucuccucaccucuuuacucccuuaaaacagacaaaauuuuguuuauauauguauggacuaauagaugccuauuuuauucagugaguuguaauucauugcugucacuauuuugaugcuuaaauuuggccagugagagucccuucaaguuagcuucugugguugguugguugguugguuuuguuuuucaaauauuugcuugugacaauauauguaacauaauaaaguaugccauuuacacaauuuuuauguacacaauucaugagcauuaauucuauugacaguguugaauagaauuaauuuaauucuggugaguacagaaacccacauuugaauuguuuucaacuuuuggcauugugaauaaugcuacagugaacauuggccuacgaauaccucuuuugaguccguguuuucaguuuuuuggguacauauguaagaguggaauuacugaaucauaugguaaucuaugcuuaucuuuuugaggaaccaucaagccauuuucccuaguggcagcaccauuuuacuuuccuguuagcaauguauaaaguucccaguugcuccacguucuugccaaugcuuguuauauuccauguguuugugucuguauguguguaaccauccucaagaguguaaagucauaucucauugugguuuugauuugcauuuuccuaaugaugacuaguggugaugaacaucauuucuugugcuuauuguucauuuguauaucuuuggaguaaugucuguuuugaguuuuuugauuuuuuuuaacuggguuuuuugucuuucuguuguugaauuuuaggaguaugauauuaaacuguaugugauacaugauuugcaauauuuucuuccauucuguugauugucuuuuuacuuuauugauaauauucuuugaugcacauuuuaaauuuugaugaaguccaauuuaucuaauuuuuuucuuuuguuacucaugcuuuuggugucauaucuaagaauccguugccaaaccaaggucaucuguguuguuuugacauguccacgucauucuuuggucaccucuuucugacacaagauguuucagucucuucuuaggcuucucugccucacucuaaauucagguguuucuccaaggagcacgggccuucuauaguggagagugauuuuuugaagcuaagaaucugaacacacagacacacacacagacuuuuacuucugcauuuauuuuuauacaguguuuauguguauucaugacuaugagaucauggcauuaccuuuucuuuuauugcauacuuuuaucuccuuuuuccaucugugggaaaucuggcucccaguuguuaggagagacaguccuccaugggugucuugcacuccugcacaucuugccaagauaugcaagacccuggucacucauuauucaggguaguucucagagauguguuuguaaugagcaaucuugaaggccagaguaaugucucccuguuugucaaacagcaggcuugcuuauugcuugguguaaaaaugguggguuccuuaaguucaguguuccucaguugugacccacacccacugcaugugccacauuuaucuaggcuuauaucauguuaccccuggacuugguaccagagagaacugacacaaacaugccaaugcuuguguugcuaugcuaugagugauaaaguuuuuucucugacccagaagucugcuaggauccaggaaacaguaacagucuuaauuuauaaccuuguagguaaggcaaagucaaauuccagaccugacaccaguaucaucacuguguuuguucacaccccuaaaugugauuauuauccugaccccaugagucuuucuuauugcucucuccagcaccuuuuuuaaaauuaauuaauuaauuuaaaaaaaaauuuuuuuuguaguuugccaccacuggguggguguuacagggccaccuugcauucacaccaucuuccacaggccuauuacuggcaguggaacuuuauacucuagcuauuuuuuuuucauuuuguuauguguuucaugcuguggaacauacuuuauaaaucuaguauacguguauuagugguuuauauucaaauguguuuuacuaauggaagcguggaaucauuggaagcaacuagauuaaauaacagcuaauggaagaaaagagaaugugucaaguuuucugucauuuucccugaugcccacuccccacugcccugccccgcucugaaagugaucacuuucauauuugggcaugccuggugaaguuaucuacauuucaagugugucaucaccugcucgucuuguuucuguauuuacacaaugauuauauugucuauuuuuucaaaacauacuuauagaugaaauucagaauauaucaggauuuauuucauuuuguaucaaagaaacaugcuauacucuaccaagaguuagugacuuagaaugagguuguuuucaggucauuuuuucccccuguaguuaugagaucuuauaauaaaccuuagcggucgggcucaguggcucacaccuguaaucccagcauuuugggaggcugaggugggcagaucgcuugaggccaggaguuugagaccagccuggccaacauggcaaaacccugucucuacuaaaaauacaaaaauuagccaggcaugguggcacgugccuguagucccagcuacucaggagacugaggcaugagaauugcuugaaccugggaagcggagguugcagugagccaagauugcaccacuguacuccagcuugggcaacaagagcaaaacucugucucaaaauaaaauaauaauaguaauaaaucuuaggauggaacugauuugaaguauuauauaauguugaaaaauauggaacaagagugucaucaaguggccaauauacuuuacuuuuaaaugcuaggggcugggugugguggcucacaccuguaaucccaguacuuugggaggcugaagugggaggauagcuucagcccagaaguucgagaccagccugggcaacauaaggcgaccccauuucuacaaaaaaaauuaaaaaauaaguuggaugugguggcaugcgcuugguaccuuuggaagcugaugugggagaauugcuugagccugggagguugaggcugcagugagcugugaucacaccauugcacuccacccugggugacagagugagacucugucucaaaaaauuuuuaaaaaggccaggcagguggcucaugcuuguaaucuaagcacuuugggagcccgagguggguggaucaccugaggucaggaguuugagaccagcuuggccaacauggggaaaccccaucucuacuaaaaguacaaaaauuaucuggguaugguggcaugcuccuguaaucccagcugcucggaaggcugaggcacgagaaucacuuggaccugggaggcggaguuugcaggcgaaggcgugcuguugcaccccagcgugggcgacagagggagacuccgccuuaaaaaaacaaacaaaguucuaguuggaagaucucuuaguccauaucuuaugccuggaauacuuucguuuguucuacuuuuucuagaaugcuuuuaacuguaaacaugugauuuuguggaaacagccuugaacuugaccaccaaacuucuaaucugaacucaagcaggcagacagguguuugauuuuuugauaggauagaagaagaggugauauggaaaauuccucagcuuaagucgcagugucugugguuuuccguuuccacauuuaaaauaaaagauauuugagguuguacuucacuuauucuuaagcuugccuugcuaauuaccuggcugcuuucucaaaauaauucuugaaaucguaauucuuuuuggaagucccuauugacuagaaaggaaguagccaauauuuuauaugaauauuuguguauauuuggaugugggaaggagagaaaaaugagguucagaauaagaaguaaaugcuuuccaucuccccauucuucccuucccuuguaucccuuucucccacuuugucgaauuuuacucauaaccggugaacauaugucugcugacacugaggguucuaucaccgcuuaccugguuugacugaugugaggggcgggaauuaccuuggggauuuguauuaacaggagaaucugagcuucaaaaaucugcuuuucaaauaagcaucuaaaguaaucugcaaucacagaugguucaaggaccacauuuugagagacagugccuuaugggguguuaguucuucccuuccuccauucuccugaugacuuugcgucuuuuauaugccagccaguauagcuggaguguuugcgauauagccaaagacacuguccuaacucucaggcuguguacucuuugauaauaaaaagcaucaguuucgucagauguguuuuuuggaggccucauaauccugguuguauuguuauuuauauuucuucaaaggcccuuuuugauucaucguauaguucauuguauugaaugcauuguaucauauauguugauaccuucauuuccaacauagcuagaaaccuauaguuuugaaagcuuuuguuguaaguuuucucuccaugguaaauggaccuuugucuuacuugcaguuuuuaccuggugauuuauggaacaguauuaaaaauauguccagacuuuaauauacuguuucucuauuuagcaugcuucaggguuauggauaaaacaacaaaaaaauccuuaaaaucgagaugauacuugcacaaagaaaauuauacuaguugauacugagugguuuuuacagcuaaccacuaguaccggacacuuuuuuuuuuuuuuuuuuuuugagacagagucucacucugucgcccaggcuggagugcaguggugcgaucucggcucacggcagcuuucaccucccagguucaagugauucucuugccucagccuccugaguaguugggauuacaggcguacgccaccaugccuggcuaauuuuuguauuuuuaguagagacgggguuucaccauguuggccaggcuggucuggaacuccugaacucaggugaucugcccuccucggcucccaaagugcugggauuacaggugugagccugcaccuggccuuucuuguuuuuuuuuguuuuuguuuuuguuuuuguuuuuuugagacaggguuucccugucccuguguugcccaggcuggucucuaacuccuaggcucaagcaauuugccugccucagccucccaaagugcuggaaucacaggccugagccaccgugccccagugaguuggcauuuuaaacacagguuuuagaacuuuccuggaggcugagugaauauuuuuaaagauuaagugucuccuuaagcuuuaucaugaauaauaugcaacacuuggguuuggcuagaaaucacuagggauuuaaugguccuaaaaagggaaauacuacucuggcccauaaaucaagguuaaacuucuaggguccacacagagauaaaauauuagauaggacugcaaauaugacugucagaacgccuuucuuaucuucaugaacaaguuuuuuuucucucucuguacacagccauacauucaugucuguaaauaccuggcuuuuuuaggcucaguuucacaaaauguugcagaaugcuuuuaauucuuucucauucuucucaucacaauuaacuguugaacauaguuugcacuaguuuucaaaugucaaccaugagaguuucuaucucagggaaaaaaggagagauuauaaaagaauuccacuaauccguaaaugagaaaggguaucuugauguuuauuacuguuuaauuuuccuuccaacacuaacagagguacauauacagcuacuaugaauaauggugaguacucugugaauacucuuagguacuagugcacaugauguuaguuuuacaaaacaguugaguccuauuucuguuaaauuuuuauccccuaguauaaaaacacaauuuaugauaaaucagguaaaaaugaaaaaucaaagucuuaguuucuuuuuuuuuuuaauuaagacaccauggaaaggucaaacuaagcaaccuuaugucuuaccuuauaucuaaacaaaacccuuuccuagauguaauucuuuggcacaguaacugauuagaggagaucauuugccuauuuaauagagaaaacuuauuuuaacuuuguuaucuuaaauauuaauauuuagugaggugauauuuuucgucuaucuuccauugaauuaucuucguaucguuugucuguuuuuuauuaguguguucaucuuauucuuagugguuuugcuagcauucauuaaaagauuaaaaguaaaucauuauuauuauuaaguuuuugaaacagagucucgcucuguuccuccaggcuggaguacaguggcgugaucuuggcucacuguaaccuccgccuccuggauucaagccauucuccugccucagccucccgagcagcugggacuacaggugugcaccaccaugcccggcuaauuuuuguauuuuuaauagacacaguguuucaccauguuggccaggcuggugucgaacuccuugaacucaagugauccaucccgccucggccucccgaagugguaggauuacaugugugagcuacugugcccagccaaaaauaaauuauuaaauauuaauauuuaagacuggcauugauguugaaauuuucucuuuuaauuggaaauguacuuuaaaucuaauucuaauuuucaccuuagaggccuuucuguauauaguuuauacuugguauuuugauacaaaauggcucuuccugcauacuuacaaauuuuuuuuucuuacaguuguuuugggugggugggggaucuuuuuauucugucuuuuccauccaaacauuuagcuuuucaauucaccugaauuuaucaugauaugcguuauaauaagaauugauugcuguccuccccaaauugucucaguuauauaaaauauuuuaaagcuugagaguccauguauucauguaagguuaaaaaugagauaacugaugaugaaaagacuaaaaccugaaauuguaauauagauaccauucaugucagaauugcuaugucuggagagguuaggaaaaugaagcucagagagguuaauuauaauaaggucaaaaggccauauauaaguagaugaauuaauuguugaaucuguaucugccauuaaggaguaaucugagauguggaacucuaaguaaauguguuucucaaaguuauuuacucacagaacccccuuuuauguuuuguaguagaaugggaaauacuaauauuuuguggauuaguguucuaugcaacauauuuuaagaaaggcuuuuugucagaucucugguagagaacaaaauaugaaccagccaaaacauuucuaucauuauuuaauuuuucuuuccaaaauacaauuaaacuuuuaaagcacaaaaauuuuaagauauugguaaaagauggggugaaaaaguccguaccuuucuugauauucugugggaaauaugaagcuguagguagccucuuucuucuuuaauaaauugugcuugaaaacuuucaggacgugcguaauuauuuagauuggagguugacaaauuacaacccauaggccaaaucuggucagcugucuguuuuuguaaauaaaauuauauuggaacacagccacgccuauuuuuuauauguuauccguggcugcuguugugugucagaggaauguugagaagaugugauggagaccauauagccacagugccuaaaauauuauuuggcuuuugaaagagcaaacauuuucugaccccuaguuuagugagcugcauuuuugccuacuuuacuucauauguuuuaucugcauaaagauucuuuuacugaaguucucggcauuucauccucuguaaaguaaguucccugggaagucaagcugaagucuuuuucuagaagcuuuauuauggcuugguuuuaaacucuuagagacaugcaagauuccauaguuuugcuuuccugaaugacauacaacuaucaggcacuuguauuggcaugccuggcucuuucuugcugcaaaccuuuuacugguuuaauggaaguaauaccaggguauaggguaaauagacauagcuaacaucuuuugagugcuauaugccagguucuguucuaaauuuuuaacauauauuauuuuguuuauuccucacaucaacucugugaaguagguauuauuauuauccccacuuuauaguugagggaacuaaagcguagggagauuaaauaacuuggucaaggucauccaguuguuaaggaaugcaaugagauuugaaacuuuccccccaacuuacuugccuccuaauuccuugauucuugagaugaguucgggcauauuucuuccuccucauuacuuucuccaagccucuguuuccacgucaacuuugaacguccucauuuacaccacccugucuuauuguauucucugaugaauuuccaggagaccauuccuucuuccuugaugauuacaauuucugacucacaaucuucucuauccaaucugccucuguaucgugauuuaaugccauguuuaacucuaguuguuucuuguauuuuucaacuuuauauauccacaggcauggccaggccuuacuuucaucacugggaauuguuuugccguuaucaugaacucugaauuucugcuuucugacuucugaacgguucacuuacauacagcccuuacaugcuagugagcuucuuuaauucaguccuuuuuaacauuucgugugcauaggaaucaccuggaaagccuuaugcagaauccugagucacacccuuagagauucugauucagcuggugaggguugaugcccaugaauuugcauuucuaucaccuuuccugcaaaugcugaggcagguaggucuauggacguacauuuugagaaggauugcucuaauuaauacuuugccccagaggaucaguaaaacuuucuaauuugcauaaagccuccauucacauucuuucuuuacuuuuuugaugacuucuguaauuacugagacaaaggccuuuugaugagaacucuguuguauuuuauuuucuugaaauaagaguuuuucuauuuauucuuuucauauucuucucuucuacuuagucccuuugucucacuuucuccaguugacuuuuggcuccuucuuuaccauuaacauuuuugugucuugcguuaucaguuuccccuuuuauagugaauuggcuuuuuucuaucagccuucaguaguggucaaauaagccccuuuccucaaaauaccauuccuucccaucuucccuccuucagccuguuuuggaagaaaaguuacagcuuuuaacuucuucacuagcuauaucuuaauuucuugcaaucugcuuugguuuccagaauuuuacuggacucuuggacugacagaucaaaugacuucuagguguuuuuuguuuuguuuugagacagggucucacucuguugccuaggcuggagugcaaucucugccuccuggauucaagcaauucuccugacuuagccucccgaauagcugggacuacagacacacaccaccacacccagcuaauuuuuguauuuuuaauagagaugggguuucaccauguuggccaggccugucuggaacuccugcccucaagugauccgcccugccucggccucccaaagugcugggauuacaggcgugagccaccucgcccagccugguguuuuuuuuuuuuuuuuuuuuuuuuuuugagacagagucuugcucugucacauacacuggagugcaguggcacgaucauggcucacggcagccucuccuguggggcucaagugauccucccgccucagcccccugaauagcugggaguaccagugggugccaccucgcucagcuauuuuuuaauuuuuuguagagacaggcuucucuauguugcccaugcuggucuuacacuccugggcucaagcagucuucccaccucugccucccaaaauucugggauuguaagcaugagccacugcacccggccaacuccuaggucuuaaaugcauagucuccucgagacuugcaguguuugauacuaucauuucucuuuuuaaaaguuuucuaccuuugcuuuuuacucacugcuuuuuuaaggucuuacuguucuaacuacuucaguucuuguucacauaguacuuuaaucuguuacugcuuuuucuaaaguuugugaugcuuuucccaccaucuaaaucuaugcuguccaauaugggagcuacuaaccgcauguaccuuuugagcacuugaaauaucgucagguuagacugaaauauucuguaagcauaaaaugcacacuggauuuuuaauauuuagguugaaaaagagaauguaaaauagcuuaccaaauuuuuuuaaugccaauuacauguugguaauacuuuggauauauuggguuaaguaaaauaaaaugcuaaaauuaauuugaccuguuucucuuuacuuuagauaugacuacuucuucuguggcuuggcuauauuucuguuagauaauauuaaucuaaaucucaucuuuccuuaagaccuggaucaguuuuccaucuauuuacaaaguuaccuuuguagcuuuguaccagccuucuuaaacauuugguccucacccccucucacccuacucccccuucccaauauacuuagcuucuucaaagcaagaguaauucccuauagugcuguucauaugguggacacuauauacauuauauaauacacacacacauaucugaaaaaauggcuaauauuaccacuuuaucaaaaaggauacuuaugaaaauugaggccuguugugauguuuuugcuuaaauugguggggagcagaagaaggauugaugugaaggggagaagagacauuauucuacucugagcuauugacauuugacacuugacaucccccaaguguauccugccaccuuaggccacugauagcucuguacugcugugauuuuacugccaucuggugucagauuaggaaacuguaguucagcauuuugucucuucaauagaggaagguaggcaaucuuuccucucuauccuguaagcaaguuaccaauaagagcucauauaauuucaauguaggaaaccuuuauuuuccuuguuggaauacucuuuccuuggcuuccaugauaaaugcauucuccuuucuaauguuucucuguucucccauucuucgacagcccauuucucucuucaugguagaguuuuuuuagccccacguucuaggccugcuguucuuuuuuuccuuugcuuuccucuauaccaggcuuuaaguacugccuauuuacagacaaauuuauauugauagccaaaaauguccucugaguuugagacuaguaucuuuaguugcuuaccuagauauuacacaaacaucuuaaauauaacaugcucccaucaaaauguggaccucucaccugcauccucauuucuuaaauuuauuuuucucauuucauuaaucuaucaugccagaauuaugggaaucagcuuggcaucccgucuuucacacuuuauuaguaaaacguuaacuacaucccauuaagucuagaggguauauucuuguauauguaaaauuugugaccccucaccugcuccugucccaucuaagauaccacugucucuugccuggacuaaguuagguuccucguuagucucucuacauccauucuugacugcauucacauguuuuauguauauuugucuaaugucagccucuccuauuaaaccgagaguucugugauggcagggacuguguacauuuggcucaccauugggucccagcaccucacacaauuucuaaaaccuguuuauuuaauacccauaucaccacucuggcuaaccagugcuguugguaugacccuuguaguuuuagugacuaaacuagugcuagaauuccuuaaugcucuauuucauuauuaguguucuauaccaguucauuuaccauaaaugaauuuaagcuauuuucugcuuuuucccagggaaacuuacuugugucugaagggacaauauauuugggguauuaaucagcuaguguucaaaugaacuuuaggacaacagccuguuuauauccuauggacugccaaucaagaugcugaaaugauuuuccaagcacuugaaauuguaugcuauugguaugucucuuagcacucuucugucugaaauuuaguauucuuuaauguugcaguacauuuguuaaaucauggauuaaaaccuguuugacucuuaaguguucuuuuauuagaggcuuaguugaugaugguuucauuuaguaauuuugauuugguuugacauuuuaaaaugguuuugcuuuauaagguuuuacuacuagggcuuacuuggugcuuugaguugaugguauuucucaauaaagaaauuuaauuuauaaaaguagaggugauuuauaaaaaguaguuauuuagagaugggcaacaaucuauguacugaggaugcacacucagcaagaauuuaauagguauauagcaggguuucucaguguuggcauuauuuacauuuuggacugaagaguuuuuugguguguaguguuggggggcauguccugggcacuguaggaaauuagcagcauuccuggucccuacccaucaaugguacucuccuccccaguuaugauaaucaaaaauaccucuagacaaugccacauuguccugggggugggugggcaaauugcauauaccuugaaaaccaguaguuucuauacuuagaaggggauaauuggccaugaaaugucuuacuugggaaaucuuuggcauuucuaaguguuuuugagaaugugguagcugugugguguauuguuaauggcaaagagaaauggaaacuauaugacaguauguuuuuuacauuuuagaauuugugcuugccuaaaauaaaauaacuuuugcauuagccaccugguucuguuccaaacugaaaaaggguacauucuaaaucauauuucacugauacuguuucauuuuguuagcugacuucaacaguuagguagugauagaaaaagagaaccaagaguacaaauuuuuuuuucuuuauuuuugagacagucucgcucuguugcccaggcuggaguacaguggcgcgaucugggcucacugcaagcuccgccucccagguucacgcuguucuccugccucagccucccaagaagcuggggacuacaggcaccugccaccacgcccagcuaauuuuuuuuuuuuuuuuuuuuguauuuuuaguagagaugggguuucgccguguuagccaggauggucuccaucuccugaccucgugaucugcccgucucggccucccaaagugcugggauuacaggcgugagucaccgcacccggccccaagaguacaauuuaaaggguagcuuauaagcagagcuuuugccauugugcuuguauauagaggauagaguauaauuaacuuauuuuauguuuuuuuuuuuuucaaagggacaugagagauggcuuuagaagaaaaaguuucuacucuucccauuaugcgagagagcggucuccuuauaaaagggacaauacuuuuuucagagaaucaccuguuggccgaaaggauucuccacacagcagaucugguuccagugucaguagcagaagcuacucuccagaaaggagcaaaucauacucuuuccaucagucucaacauagaaguauguauuuuaagacuuuauuuuuuucucucacagucuccucugaugagaauguacugagucagauuuccuucuagguguaagagauuuauuuuuuaaacuuuuuauuuugaaaaauuucaaacuuacagaaaagaugguagaauaguauaacaaacaccauacacacacauuuuuuucaaacuauuugaaguggcauucugcaugacacuuaccuuuaauuucuucagcauguaaaagguuuuuuuuuuuuuuuuuucagagucucgcucugucucccaggcuggaguguaguggcacgaucuuguuucacugcagucuccgccucccggauucaagugauucuccugccccagcauccugaguagcugggaauacaggugugcaccaccaugcccggcuaauuuuuguguuuuuaguagagacgggguuucaccauguuggucaggcuggucucaaacuccugaucucgugauccgcccaccucugccucccaaaguggugggauuacaggugugagccacugcuccuggccagccuuguaaaauuuagagugaaaaccucucuuacucuuuuccaacccccaauuuuauuuuauuuuuauuuuuauuuuauuuuauuuuuauguuuaauuugucaugccugaaccuacaugacauucuguacaaucuuagcaugucaugcuggcugaguugcuuaguauguguuugaauaaauuaaugacacaacuacuuuucuagagaaagcauucuuaucuuucuagacucugcagccugcaguagagcucguucacauaacaguuccuugugccuucuaugugcaaggcacuguguuaauauuauacaaugaugucccugucacuagggaacuagaauauauguuuauauuucucaccagcuaauaccaacuuuaucaauauguuuauauauaacuuugauacaauaauugauaugucauaaaugaguugacaugagcaugucaaggugagaaaaauuaauucacacucugaggauguaagaacaugucauaaaggagaugacauugggcucagccuuauuucagauuucuacaaguaaagaauugucuucuaguuagaaggaauuaugagccaaggugcagaaaucagaaaaguccaggauauuuccuuuucaacguccuucucauuaacugucuuuuuuucaaauaauaagaguuuuaauuuaacagccuuugccucuuacaugaugaaagugauggaaaaccauuuggagucaucagauugucuucccuugaagcuguugcaagauucuugaguuuagcaaacauuuauugucuacucuuugcagagauagauagaguggggcuucccaaaaaacauauuuuuggauacagguauauuaaugaugaugcaggagauaagaagguuauuuuaaggauuuaaaacaaacacaggcugggcacagcagcucaugccuguaauccuugcacuuugggaagccaagguggaaagauuacucgagcccaggaguuugagaccagccugggcaaacauagugagaccccugucucucaaaaaagaauuuaaaaauuagcuggguauggugauguaugcuuguauuuucagcuacucagaaggcugagguaggauugcuugagcccaggagguugaaccugcaguaaacugugaucacgccacugcacucuaaccugggcaacagaacgagacuaugucucuaaaaauaaauaaauaaauaaguaaauaaauaagccacuuccauauauauaucugauuguccaaaaugugcuugggacaguucuggguaacugaaaguuuuauuguggagauuaauguuaacaaguauacaaguauuuuuucuuuugcuucuauauaccccaucccuaccacauaaaaaaaaccuuaagaagauaaacaaucuguaagccaagcuuguccaacccccguccugcaggccgcgugcagcccaggauggguuuggaugcaaccugacacaaguuuguaaacuuucuuaaaacaugaggcuuuuuugcgauuuuuuuuuuuaagcuuaccagcuauuguuacuguuugugucuuuuauguguggcccaagaugauucuucuuccagcacaccccagggaagccaaaagauuggacaccccuacucuaagcacuaaugaaugcucacaugcacagacauauccaaaauuagccagauaccaucuaagacccuuaaaauuuuuucuuucuuuuuuuuuuuuuuuuuuugucugagacggagucuugcucugucacccaggcuggagugcaguggugugaucucaacucacugcaaccuccaccucccaggucaagcaauuuuccugccucagucuccugaguaguugggauuacaagugugcaccaccacgcccagguaauuuuauauuuuaguagagacaggguugcaccauguuggccaagcuggucucgagcuccugacuucaagugauccaccugccucaggcucccaaagugcugggauuacaggcaugagccacugugcucugcccuuacgaccuguuuuugggauguguaugacuuaaauccauauccaauaaugauuuucauuaaagaagaagaaaguaucuuuggaaacugauuaugaaaacuuuuuaacaaagcaugaguaaaagaagcuugagguucuuacuugaaagcuuguaaugaaguuauuaaagauaguuauuagugaauuagucuuauuuuuuauccucaaaaacagaaauuuugggggcgagcaucuucucucuguugaccugcuuugggccucuuaauggccaaaacucuaagaucuugagaugaaaugugguugagccguaacgugaugcuccugucuuaggaucuccaauauccuucacucauccuuugagagcucauaccuuuaauauuugggguaauuuaaaaauaaaguugguagacuaaaauaugggguaaauugaaugaaacagagcauaugacuuuauuaaugccugcaucuagcuaucuaucuaucuuucucuuucuuucuuucuuucuuucuuucuuucuuucuuucuuucuuucuuucuuucuuucuuucaaguuauuuagcuuugaaaguaaaguucuuugaucaagaaaaaguuuguucugggaaaacuccauuuucaaguauuccuuaacuacuugggcugaacuaugaaaauuuuuucuauuuucccuuccuguuuucagaauaguuacauaagauaaucuugcaaaaaagugaauggaggucauauuuuaaacaauaaaugggaaaaguaauuauuuuaccuauuucagauaccaguuuuugcuuuaaaugucacaaauauugcagcaccuggcuuuuuuucaaaagaggacugagacacgggguucugcacuuaucagucacuuaagcugggauaauuagccacguguuaaaauuaaguuuucuaguauaaauugaaauuuugaaaaagacguaaaauauuauuauaaguauaaauaacagguuaaaauaauuaugcccucauuaaaaaaaauuaauuuuuuccuuuuuguucauacuuuuagauuaauuuuuccuauuuuaaugaucauuauugguuugucuauagugauuuuacuacauuuuuaaauucaacugcuuauuucccauuuugugcucacauacauacacacacauuuaauuaaaucucuucuaagccuuuugaguuaaucuuauggaacuuugaacuacuucaaacuaauuauccuucuacauccaacuuguuuucauccuguacuuuacuugcaagaauauucuuacuauaacuuaguugggcugaccuggauaugcaauauuauuuuuaguuccuuuuuguuguccauguucacaugcuagcagugcagauugucccaguuaaccucauguccuuucucccuguguauuaugauacuuuccuagguaaaauuguuuuuuuuauauuuaccuuguauauuuuucacuugaaguuuauuuuuauuauaauuaaucuaaauaucuccacauuugucaauucuaauacuuauuuucuuuuuuucccucuuugaaauaaucccauguuuuccuaucuuacccuuugucauuugccuuuuauuuaagcuauaacauuaaaagugaugaaaaaaaucacuaaguucagucucccacacccauuuuuuguuaaacuguuaguauuucuuuugauaaauuuacuaaaucacaauccaguccuuuuauguagcucauucuuuauaaaagaauuaaaaucuucuucaguaacaucuacuuaauacuaguuauucuucuuagagccauauauaaagauauuucuuccuuuuauguuguaaccuguuacauauuggaggaguacuaucauauucuucauguuuuuuuuuuccagguuuaaauauauuugguuuauuuugcuguuccuuuuauuugucaugguuuccagaccuuuugcuuuccuauuuuuccuucuguuuccuguaauuuguaacaccagaagugaauuuuuauuuuagcaaccacauuucauuacuggauuguaggcaacugaagccuaagcuauuuucacauauaauaccauuaaacaaaaugccucuuaggcuguacuuuuucaggugcaauuguauguguguaguuaaugcauugaaaaaaaaacuagaaauacuacauuuuaucuaauuaacuuuggcuuauucuguuuuauagaauucucaaaaucucauuuagugauucuguauauuagcaccugauaagaacagcuuguauuaucugcaaauuaaguaugcuggauguguuuuguaucaguuguuaauaauuuauguugaggagcauaaggccaacuguagaaaccucuagagaucuguuaaccugaaccuuuuaucagcauuguuuguugcuauucaacaauuaugauccuucaucuuuacuauuaucuuauuuucauauccacuugagaaucucaaggaagacccugucagguguuucuugaaacucuuaaguuauaaaauauuucuucuaucaaaacagugacauaaagauuaucuugcuuuguuguuguaaauccccgguggcuccuagagaugaaacuaccucucuguuaauucauucuaaacauuugcuagggauuaaucccaaauuuaccagagaugcuuacauauuuagguucugugacauuuugguugaauuuuaaaauacuuuuacuuugcaagauuugcaaguuuauuguuuauuuuguuuguuuggccuuuguuuuuucuguagcucuaacuuugggccuagcuucccuuauuuuucuuacgucaacagccauuauuaagaauagaagauauuuuuuaaaaaauacuguuagucauuaguguuuaauucuuucaaaaaauacaucuaagagaacugaaaguguacaguaauuaaaaguacuguuuugagacaaguauauuuggaagauagaguccauuuuugaaugucaaucuaauagaaaaagacauacgucuuaagagcaguuggcuaugaauaaaauuugaagucuccaugaauuuuuugauuauagcugaaauucuuuuuuuaaaaaaacuauucuagacuuauuaguaauguagccgaaauucugauaaaaucuugaaauuuaguucugcuuuuaggugaaggcuuuucuaugcagauuugaagagguaauaggaauauagaaauaagguuuuaucaucagaucauguauauuaggcaacaggaagagaggauaaagucauucucuuagcaacaaaauauccuagcauuucuugguuugaagcccacuaugcuguguucaauacuuacaucucuuaaucaacaaacauauauugaacauaaauuguuugccaagcgagacagauucaaucucugccuucugaguuuaugaucuagucagaaagacaaacaaguaauuaaauaggaauaaacauuuuaggugacaucugaaggguuaguagaaggugaaggaugcuaguggagaagguuuauggggaugaguuacaucauauggagucccuaaaguauaauuuaauaguucccugaaacauuuuaggccaucacuugaucuagacuauuaaugcacuguugaauuagauucuauaacauauucuucuuguuugaggauccauuguuuacucacaagagagcuuuggcuaugaguuuucuagcuaaauccuaggauuauagcuauagcuuuucuggcaucuuaaugaucaagguucuaaaacagaaaucaauuaaugccauaugcauaggcauuuuauuauaucccuguuuuaggacuuaguauauucugucaguagcaaauguucauaaugugugcagaugauguuuuccuuauauguuuaaaaaugagcucacgugguuuuuagcugauguguuaaaggagaacucuacucagaagugugcuuccaaguauucagucaguuggccuuugcuuuaaguuguugcaacucugaccuccccaaaaguuggaucuugagggaagcagaggugaugcaaugcuuucucugccccucuaccuguuucuuuucucucauuuuuuggugucuuuaacaugagaacauuuuucuugugucucuccauuuucuaauucauauguucuugaguaaaucaguagaucucugagaaacauguucuuccuaaccagaagucccaaauucccacaucuucauccaugauccaguaaaaaauuuucuuaucaucuguguagccacauuuucauuuauuuauaucuuaauuucucuucauaucuucagcuguugaagaagagaugaaaguacugucuguguuggugaaguuuguuucuugaugagacuugcacucaaauauaccuguuuugucccuguuugccaagcacugcgcuaagaaucugauaguuugcaagacauagccccuaacuuuaucaucucuuaugauuaugcuguuuuuuuucccugcaguguccuuuuuuuccuaccuggguuaucagugaugaauagcacuugauguaggaggauuggauaaauuugguuagauuuaucauuucuuuucgcaggaaaacacagcagcaagaaaguguauuucuaaaagauccuguuagauugcauucagccauugcauucaaggagucaccaaauacuuugaaacucuugcagaacuuccugaguguguuguguaauguuaagcugcuucuccagcuuuugauuuuaccucaauaggaaaaacauuauauggaaccaguauuugaaauuccuuuuuauuuccuuuuuuuccauuuauucuuucacucaucaauauauagacagggauuuugauuucuguacugccacuuucagaauuuuuuuucugguuucuuuccuccuuccuaauguggaacccauuuucuuuugcaagucacaacaaaggcaggaauguuuucaaccuuuuuaccuugcucucaagcagggagguagugucugcuuacaaagaucaugugugagaugaauuugagguaauggcuaaauagcuaacgaguagcaagccuguuaguuagaaggcagaacaaugagugaaagaggcagauuuuagagacuuuuauauucauuguauuuguuggagccaaauaaaaauagaaaaaaagauuaagguuaguagcaacacucacauuuaaggaacaauaaccaacaaaaacgaaagaggaagggguagcuaugaagauguaagggugcaaacagaaguacaaagauacgaaaaacaaauagcaaaauauuaagaaaaacuuguuuauaaaucauuaaagugcuauaguagaggauaagaagaaugagaccuuuuaguuuuacacgagcacaucagcggaaacuuugggaugaagaguuuuaaguacaguggugguguuucuauuaucucuuguuguguuacaaaaaacaaaaacaaaacaaaaaaaacaaacaaaccccaaaacuuagagaauuaaaacaauaauuacuuacuuguucaugacugcaauuuagcuggguaguuuuacuagucuauuagaagauuguuaaauaguccaagccuaccuaagacaauacuaaugggaaucuguaauuauaugugguaauaccuacagugucucugaaguuuggaaucaaaaucaaacacauccacagcaguguguugguaaacugacucuccaagguuaaaaagauaagauuuguagcauuugcugauaucuguggaguguagauucucaucauaguucagcuaccaacauggaguaacugaacacaaaguuucaaagggaugcaugcaauucacucucaggagcuaauaugaauuggccuaaggcuccaguagcuuucucugaaauaucaccauuaucucuugauucaagaaagaauuugaggcagcuuaaugaaauaaacacuuaauaaaauaggauuaaauaaguggaggaggaauuuuauguaaaaggaaaauaagaauaggaaaguaaaaguaagaauaaaguugguaguacaugaaauaaaugcccauuauaaggcucugaacaguugcuauaggugaacuaaggguuuggccaaaacaaagcuaaaagaaucaagaauaaaguuaguagugcaugaaaugauuguccaucaugaggcucugagcaauugcuguaggugaacuaaggguuuggcuggucgugguggcucacgccuguaaucccagcacuuugggagacugaggcggguggaucacgagguuaggaguucaagaccaggcuggccaagauggugaaaccucgucucuacuaaaaaauacaaaaaaaaauuagccagguguggucgcaggugccuguaaucuuagcuacuugggaggcugagccaggggaauugcuugaacccggggggcggagguugcacugaacugagaucacgccacugcacuccagccugggcaacagagugagacugugucucaaaaaaaaaaaaaaaaaaaaaaaaaaaagcaagaaucaagaauaguguugacaguguaccucacauaaaaacaaaucagcuuaucaggagaaacaaaacuugcuggaugccagagaaagauagugaauaaugagaaaaggauacugcuuccucaacauuauugcaaaaguaagauggcaauauuuucaugauguuucuugaaacauuuuaaggcaagaugcugauagugccaaaacaauucagaaaaaauguuauuuucucagagaaaaaaaaaaaguaaaauuggcaacuugggaucuguaguagaaggauuugaagucauuguuauggaguuuguaucuuacuggaaaaauaccugggagcccugacuacuaguauauuuaggcuguuuagaaagaugauuccauccaugucauuaagaguuugcagacaaggaagcuaacaaaauauaucaagauucuaagugugggauaauuaggggcucaaccaguguccuuuuuuaacugguaggggugauccaucuuucauuuuugacuguguaugcagguguacuccuuucucaggccuuccagugucagcuuuauggauggagagaauucgacuagguacuuucagugaugaauaagaugugaucuuugucuucaacuuucaaugucuugucuuucuaugaaccuuuucucauuccuuucugcccuuguuauccuugacuggucuuauccugacaguuccccuuggcuucuugccuuaaauggagauuuuuuucucccauuauuuauuccccuucacuggugauugcucaggcagcccaacuugaaaguaggguaggaaagaguuuagggccaccagaaaaugcucagaagccccuguucucaucacuccuacuucugaguucuucucuuguuccucuugggcacagaggugcugcuguuaauuccucccugcccaccuuuccauagaguccgugcguccuggugccuccuacaaacggcagaaugaaggaaauccugaaagaggugaguuuugagcuagacucugauuugggauugugaaggggugggagacuugaacugauagcgguuauggaaauggggaaaguguauaacugcuccauuagucuauugugagaaccacaguuagcaguagaccuagguacuaggauuuggggggcauuugugggcugguaucugggcuagccauuccuggaugggaauagccauucuguaggaggcugagaucuguagaauagacaggccauuggaagauaggaccugacaacaguaggaucaagugauuucuguuuacucuuuuuguguucuuucuuuugccauuuguaucauuguuuucuuuauccuuugcugcuugcuuucugcucccauuguugcaacagggacauaugaauauauguggguauaugauaaaccuccugcaccacccuucaguguuccuuugcuuuugcacaugaaauugguugauaacgacuuaaauuagccuuugggcagcuaaaaucaggaaagguccaagacuauacuucgggaugauauguuuguaaaggaaacacuaagcaaaagaucaacagcugcuugugacagguuuuuuuccccucugugucuagcugauaagugcuaaagaauugagccuguaauuaugccuuuaauaagcauaaugugcuaugcugauugguccagugccuugucuccuuugaagggauugcuuaucugaauaggauugggaggucauugcaucuuagguauagaaaagugagguucaucuuuuuaucugauuuucgagugccuacccuuuucuugaaggacuugagcuaaguaggccacagauauuuggaaaugaauaagcuauagcacuuguucuucugggagcuuuugguguaaugggauacacugacacuaucacacuaugaugugaaauuugccacaugcaauggaaauacaauaaggaaugacuuaaguauaucauguucuuggccauuugggauacaguaguggugcuuuugaguuuuaaggucuacaagaacuuuuaaaguugcuuagggugaaagccucuuguaguaccacaaguuaaaagacucuagggcuguaucguucuaaagcuguuggagcuuaaaaacuggaauacucagccuagggcaggaguccucaaccucugcacaauugacauguaaggccaguuaauucuuuguuguuggggugucccccauagcaggacauuugccagcaucccugucuucuacuaaauauaugccaguagcccucucccacuugugacagucaaaaauaucugcacauacuaccaaaugucuguggaggggaggugcaaaauuguccucaguuaagaaccacugggcuagagaaaguguuuugggucuguaggacauuagaaagguguuauucaccacuuuccuaggugguuggaagucuuugagccuccaggaccuuauuuaucuaucuuggcuguggcaggaagagcuuaagaggcuuuuugacugaagcuggcuuugccucaguuucaaagucguuuuaucucugcuuuugcucuugacugcuuugcuguuaauccacuguccagucucgaccagcuucugugugacuccaaauuuuaugccacuuucucuucucauguuauuaauuuuguuaguuuuucuagcaacaaagggcagaggauuauauauuuggcacauauagacaauuuaaugaaauguuuuucuguaacagcucacuguuauuaauuuuuaagaguauauuuaacuaaaccuaucuuuuagggaguuguugaaccugcuaaaguacuauuguuuaaauguauuuucuggcucaaguuucuauaaaaaauaauauacauacagcacuaugugaguaaagugacuaaagguaaagauuagugacuuuaucucauacagguuuauuuuuaaccauuuaacaaauauuugggcauucauuaaugccaggcacugauuagugcucugaauuauagcuuucuaacuuuauguuuaaaacugucuaaacauuucaggaauaucugcuaaaguuccuauguagauccucuugagcuaccccuugauuaacuaguucuccucgguaucuauauaauaacuaccuuuguauuuuuauugugauauaucaaaaauuagcauuuaggagcauggaagaaguagcauucaugguuuuaaaauauguuuugccuuucuugaagucucuguggcuccauguuuacuuacuagcagugcuguggccuagacuggcuucuaugauauccuuugguuccagguuauuucagauuguugauggugcuuagccucugagagguaguuuuagauauuaaccuauuuaauguaauaauguaaugaaaaguuuuaguacuaaaauaaguguaugacccccacauuaauuccauuacaaaauuacuuuaucaaaaacaaauuagcuagaaaaaaaauuacaucuuauguuuucuuauauagauaaagagaggccuguccagucuuugaaaacaucaagagauacuucacccucaagugguucagcaguuucuucaucaaagguuuguuauauuucuaaaaucaguuuaaagaagaauuacaaauugagauggacugacuaguacagaugcuuuuauucuuuacuguuaugccaagggagcuaauuugcugcauuuaaaaacuuaaauuuuuggcuaggugugguggcucaugccuguaaucccaggacuuugagagacugagauuguagggaaaagaaagagagaucagacuauuacugugucuuuguagaaagggaagacauaagaaacuccauuuugaccuguacccugaacaauugcuuugcccugagaugcuguugaucuguaacuuugccccaaccuugagcucacaaaaacauguguuguauggaaucaagguuuaagggaucuagggcugugcaggaugugccuuguuaacaaaauauuuacaagcaguaugcgugguaaaagucaucgccauucucuagucucgauaaaccaggggcacaaugcacugcggaacgccgcagggaccucugcccuggaaagccagguauuguccaagguuucuccccaugugacagucugaaauauggccuugugggaugagaaugaccugaccaucccccagcccaacacccguaaagggucugugcugagguggauuauuaaaagaggaaagccucuugcaguugagauaguggaaggcuacugucuccugccugcccugggaacugaaugucuugguauaaaacccgauuguacauuuguucaguucugagauaggagaaaaaccacccuauggcaggaggcgagacaugcuggcggcaaugcugcuuuguuauucuuuacuccacugagauguuugggcggagagaaacauaaaucuggccuacuugcacauccaggcauaguaccuccccuugaacuuaauugugacacagauuccuuugcucacauguuuucuugcugaccuucucccuauuaucacccugcucuccuacugcauuccucuugcugagauagugaaaauaacaauaaaaacugagggaacucagagaccggugcuggugcagguccuuauuauggugagcgucgguccccugggcccacuuuucuuucucuauacuuugucucugugucuuauuucuuuucucagucucucgucccaccugacgagauauacccacagguguggaggggcaggccaccccuucaugagaugggagaauugcuugaggccaggaguucacaacuagccuugguaacguagcaagacuuuauuuuaaaaauuaaaaauuagccagaugugguggcaugcaccuguaguccuagcuauucaggaggcugaggugagaggaucacuugagcccaggagguugagccagcagugagcuaugauugcaccacugcacucuagccugggugacagagcaagaugcugucucugaaaaauaaaaacaggccgggcaugguggcuuacgccgguaaucccagcacuuugggaggcugaggcggguggaucaugaggucaggaggucgagaccauccuggcuaacacagugaagccgugucucuacuaaaaauacaaagaauuggcugggugugguggcucauguccguaauccuagcacuuugggaggccgaggcaggcggaucaugaggucaagagaucgagaccauccuggccaacguggugaaaccccgucucuacuaaaaauacaaaaaaauuagcuggccgugguggcaggcgccuguagucccagcuacguaggaggcugaggcaggagaauggcuugaacuuaggaggcggaacuugcagugagccgagaucacgccacugcacuccagccugguaacagagugagacuccgucucaaaacaaaaacaaaaauaaacaaacaaaaaaaaaaacaauuagccgggugugguggcacgugccuguagucccagguacuugggaggccaaggcaggagaauugcuugaauccgggaggcggguguugcagugagcugagaucacgccacugcacuccagccugggcgacagagcgagacucugucucaaaaaaacaaaaaacaaaaccgcuuacauuuuaaauaaccacagcuugaaaauagcaacccgaguuucuaugaggaaaaaugggcaguuuucucacugaauuuuuaacacagucuaugccaaauuuaguacuuauugcugcaacccauauucucaucuugaccauaagcagguuggauggguuauaucugguggauugugcuuuuauuuggggaguugggaguguaggcagauaccuaacauguaugguguauuuuuucuuuuauucauacagaaaucuuaguagguacauaucucuauucuauaguagagugagggcucaggaguuauuaauuucuuaaggacauagcuaccccucacuauaccauucuucucauuccuacuuuucuagcaucucaaaacauaaauccucagaaauuaaaaacuugacaaguugcuguuuccaucuguucucuccaguuagaaguucucuucacagauaucauacccuuucucuuagccauaacgguuguuacaucuguuaccugcuuuacuucuuuucauucugccuuuuauacuuuuuggcuuuuuaggaagaguagauaucaccuagcgguauauacugggugucuggggggcagcugcuucccugccucaggaggaaaaaaacagcuucuuugugacaacuuguaucuuuggaacuuucccagaagucugaggguucugggauucuggauuuugaauagcaaagaccaauuggauuaugguucugucuuaaacauaucaagggugcuuuacccaccuggaacacugccuugguuuucaugucagguaauagaugaaagaagaguaaauaguaccugccuaucaaagucacuacaaaaauucaaauuauuauauaugaaauauuuucucugaaauauacugcuaucugaauauaaguuacaacauagaguuuugugcuacauguuaaaaguuuuaguggaaaacaaccauguugaauuuuuaacuacuuuugucugauaguuucauguagaucaagcuugaucuacaugcaacuguggcccaggauggcuuugaauacagcccaacacaaauuccuaaacuuucuuaaaacauuacgugauuuuuuccuuuuuuuuuuuuuuaagcucaucagcuauucuuaguguuaguguauucuaugugugguccaagacaauucuaacguggcccagggaagccaaagauuggaugccccugauguaaauguuugcauuuuuuuuuucacagaccgugaaguuuuuuuuuuuuuuuuuuguauauaaaaauagagauggggucuugcuauguugcccagccugguuucaaacuccuggucucaaaugauccuuccaccuuggccuccuaaagugcugugauuacaggcgugagccacugugccuagccagacuauaaaaucuuaaaauggaaucaaaauaucacaauuuuagauccauaguuauuuuacauauucagaagguagcgcccucuuugauuugcccaaggucacaugguagcuguggggagcuuuaugagcuagauuuccugauuuggugaacucuuugauguaacauuauggcugcccauauguugggauacuuuuucagaguuuguuaguuucaaaugauagguuuucgaaugugcagagagaaugacaauaaguuauaguaggcuuuugcuucauucuuuuugaagggcagaacggaguuucacucugucguccaggcuggagugcaauggcauaaucucggcucacugcaaccuccaccucccagguucaagcaauucuccugccucaaccucccaaguagcugggauuacaggcgccugccaccacaccuggcuaauuuuuguauauguaguagagaugggguuucaccguguuggccaggcuggucuggucucacacuccugaccucaggugauccgcccgccucagccucccaaagugcugggauuacagguaugagccacugcucccagcugcuucauucuuugcuagagagaagucauauaauuguuuuugcucuuuaauuuucucuuaaauagguaugcccccucacccccuggaaaaaaaaacaacuuucuuggauauauuuguguuuguauauguguuuucuucuucuaacuagcuuuuaaaaaaaccuucuauuacugaguaauaauaaaaguauuacuuauaauaccuuuuuaaccuuauauauggacacggcuuuggaaugagcuguuuaagcuuccucaauggcuguagaauauacuucauauagauauauugcuauaauauuccaguaaauguagauggcuagccaguaguuugaugaauuuaacaagguguagaaaaacaucaaaugaccuuuucaguuaaaaaaaugucuaagccaggcacguuggcucaugcuuguaaucucagcacuuugggaggccgaggcaggcggauaaccugagcucaggaguuugagaccagccuggccaacguggugaaauccugucucuacuaaaaauacaaaaauuacccgguuauggugugcgcauuuguacuguuagcuacucgggaggcugagguuggggaaucgcuugaacccaggaggcggagguugcagugagccgagaucgcggcacugcacuugagccugggugacagagugagacugcauucccccucgccccucccaaaaaagccuagauuuaagucccagcucagcauuuauuaaugacuuugagcaggucaccaucauucaguuuuuuaguuuaugaguugggauaauaaagccucucuaaucaccuucauggaauucuauuuaauuaaaguacuucuuuugguucauagauaaaagcacuuuauaaaugguagugccccauaaguucagugcccagcacugucauccacaagagguauauuuggaaucagugaugugacuuuagagaaguaaagcuuaguaauagaagguuuuuuaagaagagaugguuaugcaacuaagcauggcagggcaaagcugaugaaaauguauaccaaggaaguagaauggaaucagagaauuaccuuaacggcccuaaggaaauaauuuuuaaauuugugcuugacaauucauaucuuauuuacaaaauaagccuuuaaacaguacugggggaauuauaucugauccagaaaagacauuuuacuuucuucauuuuuauauugagcccauuggcugauugauuuucagauauguuuuaguauaauagauucacaucagugaauauggaaaagaaagaaacacuaagguaccaagcauuauuguggauacuuccagaucuauuaccuccuucaauucucacaacugcuuugcaaagugagcauuauuaaccccuauuuuguaaaugaagaaaccaaggcucauggugucguaaguuagguguauaaagucaucuaccuagcaagucauuaaacugcgauucaaagccaggucuguauauaacugcaaaguccauaccuuguuuaguauugugugcaguuagauaaaggaacuaguaguaggaucaaaaaaugaaauuuaaguuuaaaaauuuuguguaaggaguaggauuuauguaacucacuguacacuguaauaauagcauaucuguacguuucuguuguauuaggaguuugcuuuacugaaauuuagacauuacuuauuucauuaaauaugcuuaaaggcacaaaguugaaaucaguaugaugucuuuuauauucuaaauauaauuauuauaugaguuaauugucagugucuuuugcuuuguuacuuagaugaauuucuagagucuuauguaaaugaaauuaagaauuagaucuggucuauaugucccaaaggaauugcuacuuaaaguaauuccauguugaauauuuuugaaggaggaaauaaagaauguaccuguucuccauagaaauuuggaggcuuauaugauuuuaaauguaaguggaguguacuucuugguguauuugaaguuuaaaagcccuugagaauuguaacagaaauguucuauuuuuauuagguguuagacaaacccaguaggcuaacugaaaaggaacuugcugaggcugcaagcaagugggcugcugaaaagcuagagaaaucagaugaaaguaacuugccugaaauuucugaguaugagguaaggcauaaugucuccuuuauguuucacaucugaaaguuuugucuggauuuuaaauuaugggcgaaaaauauuugguuuauuccuauacuucaaaauauauccuuauggauuacagguauuaaaauuaccacacagaaugauagucagaauaugaaugacucugaauucaguaaucacgcuuugucugaauguuuccuguaguuuugguguguaagaauaguauaaauauggaguauaagaaaaaugcguuauuuauauacuucuuuuaaugggcuuugcuguuaaaaguaucucaggaaaucaugcuaagccacuaguuauaaaccagugaauucagaacagaaaucuaauuugaccuuggauuguggaccauauuuauauugcuuguuauacuucaugcagauuaucucauaaauaucccaagaaauaaaauuauucauugucugggcaacccgagaccuugaugagucuugaauaccgaaagaugggaacauuuuugggaccauagaaaaagguuuaugacacguuuguauuaacauauuuugaaaugaacugaaaaauuucuguauaaacuguaacaucucuaaaagggaaauauagaaauucuguggucacaauuaagcuuuuagauucaggauuugauacuauaggaauucuuugacaugacagguagagaauauaaaaauccgucccgugacaaauuauuuuuauuugaaggagcauucuggcuuuuugauuuacuuuuggaaugacuuuuauagaauguucuuugauaaaagggaucaagcauugauauuguauguaaaaauaauacuuaacuacaucuuuauacagugaaaagauccuuuccaaaguaacuaauguacacugcucauaaaaaguauaaacccuaucagaacuuacgcaaauagagccuuucuuuuuaaaaaugcugaucugucuuuuagauaucgauuguucuuaagugggucaagguuuccuccuuauuguagcuauaauaauagauauuuaugcauauucuccaguaaauguaucaaaaacaccaagcuguuccuucuugguacuuuuccagcacuauuuaaaagcaugaacaauacuuuucaguaauacauuuaauuggauuauuuugguuauuuucucuaauaauuuagaauaauguuucuacauuaaucauugauauuuaugcuucaaaauugcugcuuuggaauauugguaguuuguuuuauggaaccaaaaacuuucaaaaagaauaauuucuuaauacuucaucuccaauuaacaaggcuuuauuaauuuaugaacauuaauaguauauuuauccucccuucucccaucauuuuuuaucucagguuuuuauaaaagcucacuacuguucucaaauuuaaauauucugcuuggguucucucauuucuugaaugcaucuugacacugaauaauccaugagugacuucggaucuagaaagacuuuuuaaacaucuuuuuuuuccucuaaaauuugcucagaauucgcuagauuucaaauuaaugaaaaguaaauaacccuaaaaaaaaucuguaaguugagucauaggucagacguguucuuuuguuggaucaaaggcaagauaugugagaguagcacugauaaccauaauauguuuauuucuguaugucauuaauguugaacagcagcaucaauuucaucccauucucuaaaauauuuuucuacuuagauugauacuuuuucguacuggaaaucauuugggaaauuuuugagauaauuuuuguaaacuuagucccauaucauauuaauauuuuucucuuauuaauacuuuagcuuauuaauauuuugcuaauuuguucucaggcuauuguuaaauaguuacucauuucagugguccgugcuuuuugagaaauauaauuuuggccuugguccuguaaacugauaucuaauuugacagaauagccuggaaagaagaaaggccuuugaugccaagcaagaguuuggcaaaguacuguguaugugugugugugcaugugcgugucuguuuaaaucuaauuguggcaauauuuuauuuuauaugagccuuuuaaguaaugguucauguacuucagaaacauuguguaaauuucauuauuaugagcugagauagauagaaugaaugcuuaaguuuccaccuugucuucacuugcugcccucauuauaguucuaagcaauuuguuugggaaaacguguaguucauagaaaguccagugaaauugaagguaaauucaauaauauacuuaaauauucaggcauguugugguuccugccacuuuucaguuuuauacuuucaucuucugggcucuacuacagcauuucccaagguauuugacagcauaucugaagggucuuaauggucugaggaagaaaaaaaaagauucuaguagccaguuuauuugagaugcuaaguuuaaaagaguuagguugguuuugauauuucagcacuuuuuagagauuuuaauuuauuauuaauauguucaucgguguucaguaagaggauaauaaaagaguuugcauaauuuaccaaacuuuugacuauguaauuuuuuucacagcauguauuucaggauuaguguuuuaaggcacacuuaaaaaauacuguacuaguuuucuuauaguuuauuuaaauucacuaaauaugcauuguauauccacuugugucagacauugcuuuugagguaccauccuagccaucaagaagguugcagucaaguuuuguagagauauaauuugcuguccuuaaacaaauagcugugagaguuuucuuuugguugucagaaugaaaagaaaauuguuugaaggauauuagaauguccugguagaugagaccuaggcaggaagauuguuugaggccaggaguugcagaccagccugggcaauguaguaaggucuugucacuacaaaaaaaaaaaaaaaaaaaaaaaaaaaaaaaaagcugggugugguggccgcuuagucccagcuacucaggagacuaaggugggaggaucacuugagcccaggaauugaaguuugcagugagcugugaucacaccauggcccuccaggcugggugacagagcaagacccugucucagaaaaaaaagaaauggggacagcggggcagguaugcuggcuuacaccugcaaaaauagugggaccccaucuguacaaaaaaaaaaaaaauccacaaaaaauuagcugggcaugguggcaugugccuguaguucuagcuguucaggaggcugaggugagaggaucuugcuucuggaugauugaggcugcagugagcugugacugcaucacugcacuccagccuggguggcagagcaagaccuagucucaaaaaaaaaaaaaaaagucucaguagaacaggucacuuccugcuguagaggaaaaauuuaaaauuuacgacuuauguuguuuucacauauaggguguuauuuuuggcuucaaugucugugcuuauucugucccuagucuagaaugaccaucuuccauggcucucuuucaaauuuauacucauucaguggaaucacuaguguuggagauaauacaacucaagaucuugauuccacuuuucuaccuacuauaacauuuuaugccacuuuauauuucauugaugaccuuaauuuuuuugccuagugauauauguugaauguaucucaaacacuugcuuuguuuucuguacaguaccucggacauauauaucuaauugaaauacauuuaauuacuaaugagcucuuuuaaauuaacugucaguuuuuuuuccccuuuuucacuugcuuuuuguuucugaaagcuccugucuucucuguuguacuuucuuugcucaccaguuuacacauuguguauaggccuaugucuuaguuuuacauauuguguauaggccuaugucuuaguuuuguguugcaguaacagaacaccagugacugggcaauuuacaaagaauguugcuaguggaauucuuuucuuaaaugauuuuuaugcuuuugguauaagucccuuaacauauguaacucaaacuucuuuaaaaaaaaaacuagguuuguuuguuuuuugagacagugucuggcucugucgccaggcuggagugcaguggcgcuggugugauuuuggcucacugcaaccucugccucccggguucaagugauucucuugcugggauuacaggcaccugccaccacacccagcuaauuuuuguauuuuugguagagacggguuuucaccauguuggccaguauggucuugaucucuugaccucgugauccgccugccucggguuuuuuuuuuuuugguagaucauacauguaugugucagaaauucaaaugacaccaaaguauuuacaauguggcucuucuuugcuacuucuucuaaguuguuacuauugagacaacuccuuugauaauuuuuucuguaguguccuuccagagacagucuaugcauauauguauuccaauacuuaaucucccaccugaccguuuuagacauaauucacaguauauuuauucauuuuuaauuauuggucuaaaacugaagugaucauuauugauuugugggguuuucuuuuuaaugauuucagugaauuauuaggcuacaggagcaaggugauuuaacuucuaaaaauacagccuuuucucauauucccuuuaaauauauuucuuuauuuguguacaacaccucucacuuccauuuggacuuuuucuccucaguauuucguaaacugaucacuuaaggaauagucaagggacaauaauuuuuuaucuguaucuuaauauaaugugaaauaauauuuuggaaucgaauaggccuagaggcuuugucuuaccuaaaauuuaaaaaguaacagccucacuugcuucggcagcacaugcacuaaaaauuggaaugaaacagaagauuagcguggccccugcacaaggauggcacgcaaauucaugaaguguuccauauuaaaaaaaaaaaaguagcagucauuucuucuuuaauccauuucacauaugcucauuaugcauagugaaauggagagaguuuucuuuucuuaaaacauguuaaaucuagcacuuaauauaauuugccaguuagugccuauacacaaccaucugaacugcucuauguuuuuuaagaaaauaauuaaagauuucuaauuccuuuucaaggcgggauccacagcaccauuguuuacugaccagccagaggaaccugagucaaacacaacacaugggauagaauuauuugaagauagucagcuaaccacucgcucuaaagcaauagcaucaaaaaccaaagagauugaacaggugagagucuaguugucuucauguacauaauuuuuguuuguguugcuuugcacauguaaacauuuauugaauaaauaugcuucauuucuuuuuccaccuguaacucuaaaacuacaacuuaaaaaauuauaaaaauuguuugaguugacuucacagucaguuugaucaguauggucccccaccuggauuguuuauuuuuaaauaaaaaacagacuucuuuuuuacagaauauuaauauucuaguuaguaugaagcaauuaaaaauuauuaaaguuaauagggaugggauggaagaaauguucaauguagcaaaauguuagcaaauguuauuuuugaauauugggauuacagauguuucuuauguuuuuucauuauacuuuaagguaguuuccaaauauuaaaggaaaaauaaaggauacuauuuaagucuaguuuuuuagugaagucauucugaaaagcaggacuuuguuuuuaaugugcaacuauuaugggguuauuuucauuuuaugaggauuaaaugaaguaaaugugaaaggguuuuauaaaauguaacauuuuguacaggugcuuauugauguuguuacucucuagugcguugaauaaauguaauuacauugauaauaauauucuaaaaccuauuggaaauuaagaacaaagugaaaacuuuucucuaggugcuguccgauuucuacaucaauuaaauccguuuccuuuuguuggauagggaauggucucaaauccuagaugugaccguguagcuuauguuaaugucacacuaaugugaaaagauaagaaccagaauaggaaauuugucaugcaaaccauuggaguuucaaaaugaagguggugagcaguaucagaugcuuagaggaauauaaggaaaauggagacugagaaaauucuguuuaauuuggugauugggaggcaguugguaccuuucaagauaccaauuaaaugagagcauaaguaaaagguuugcucaguauaucuaucuuuaacacaaagaugaaugucuuuauuuuauauaaaauuacuguccuuuuuuuucuugacauguuuuuauuuccuuuucuccccuuaccauaauggaugcucugugaaaacaagggcuuuguuuuaucuuguuuuauuuacugcuacaucugccaucaccgagaacaguauguguagcaggcuuacaagaaauacuuguggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcaccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaagaaauacuuguuggauggaugacagguggagucauaaaccugcaagugaccuucgaguagucccuaacuacuguauagaaucucacagccuguugcucaggcuguucucaaacucuuggccucaagugauccuccucucugagccucccaaagugcuggaauuauaggugugagccacugugcuaagaugcaguucuuaaaaggagagguucucuuaagaauguaacugguagaaaaacuugauugaaauaacaggggagagcgagacccugucucucucucucucucuuucucucucucucucucucucuuucacacacacacacacacacacacacacacacacacgugcacgcaaguggcuauacucuguaugcuguucgguauucuuagagaucauuccauauuagcccauuauuaauagauauuuacaucuguugugaaccauguuuucaaauacagucccugauuucuccauauuuuuuaaaagauaugcauguauauuuuuaaugaguaaagcauuacauuuaaaaugaacaauucugggagguuuuugguuuaauauuguggaugucacaugccagguuugagaguaaucagaaugugaguuugcagagaaucuuaauuucuugcuuguaccagucaccgucaaccuuucuuaaaaauuguguuuguaaauacaauuaauaaagccuaaaccaaaacaauugcagggaugugccugaaaauauuuuuuaaauauauuauacucuucaaauuacaaaaacuugccaucuguagaaggacgagucucucucuuuuuauuuuuauuugguagauaauaaaugagaaaagaacaaguaccaugaauucguuuuuaaaccucuuuggcucuuucagaacacucuccuaauauaaugcuguuuuaugaaaauguuuauuuuucuaccuauaagcagggguccccaaccccugggcuuguggaccgcuacuggucuguggccuguuaggaacugggcgucacagcaggaggugaguggccauggggaggggggagggaggacaggggagugagcauuaccuccucagcucuacugcuugucagaucagugguggcauuagauugucacagaagcgcagacccuauugugaacugcagacacgagggaucuagguugugugcccucucacuccuuccguggaaaaaauugucuuccucaaaacuggucccuguugccaaaaagguuggugucugcugccuauaaguaugcuaucuuuugaaaaaagagcugauuauauauucaucagguaauuuauaguuaaaauauagauaggaaucauuuuaguuauagggaagguaccauuuugagguguuuuuuguuguuguuuguuuauuuguuuguuuuuugagacagggucuuacucugucgcccaugcuggagugcaguggcacgauuacaccucacugcagccaccaccccccaggcucaagcaauacucccaccucacccuccugaguagcugggacuacaagugugugccaccacucccagcuaauuuuuuuuuguauuuuuuguagagaugggauuucaccuuguuacccauguuggucgccaacuucugggcucgagagaucuacccaccuauuacaggcguaagccaccgcacccggcccauucugagguucuuaaacauaaagaaauagaguaaucagggacacuuggggaaagggauugauuauuuugguguucuuuucuuucuuuuaacuucaaaacacuuauccugaauauuuuuuguuucuguaaagacaauuuuuauuauagucauagcuaugccagcuuuguuaugugaaacuuuacuucuuagccauuuaggaaccccuuuccuuauuacaauuagcuaagaaaaauugaguuaauucagacuuuauuuuguugauuguuauuagcuuuauuaagagucuguuguaagucuaaaucuacuuaauauauuuuuuauuuugaauuccguacuaucaccauuugugcgacuauaugggcuacuuuacuagcuuuucuucgcuuuucccuccaaauaaaaggguugggcugaauaaucuuaggucucuuccugaucuaaaucauacugaaaauuaaaaguuaaauauuacuuuuucuguacacaguuguguguaguaauuucauauuuaacuauagaauuuuaaguuuuuuuuuuaaaccuucuuaaggacacagggcucuuaaauuaaaauaaguuuuuaaauaaccuucgaauauaccacuguuaugugucagucaguaauuaguauuuguugaguuaaugaauugugcagagcagguuuucuuccguagauaggguguuagauuuaauuguaaguguuguagcuguggccauuuucucuucuuacagugucucauuucagcuacuacucauugucugaugauucccaacacucacuagcucuugcuguuucucauauauaaucuguuuuuguuuuacauuuaaagaggcuagaaguaaagauuagugaaauguacagucuugaaaauguuaacuagaguuguggacauggaaaauaaucagcuuuuagcauaugaugcauuccaaugaaauuguuuucaaaguaguggcagcuguaucuauuguuguagguucaagaucuaagcauuucauaguaaccuuacauaauagaaacauucuuuguuuuuccuuuuuaucagagcaaguaaccaauguucuuuaaagugcagcucucaccacuaucuugucuagacaucaagucuacccuacuguauuuaacaauccauuauuaccaaccacuuguucagauuuuacauacauacaguuaguaaaauauacucacauaagauguaccucugaaagucuggauucccaaaacaacuugaaaagagaugauuuauuuugaccaaauuucaaagaguuugaaaguuacaauuuaccagauucuggucaugcuguuacugcagaagcuuguugaaguaaaaguauaaaguuuuuauuuuaagagaaucuaaaagcuaucucuauaagauaauuuguaucauauuuaaaaggaagcaucucuuaaagguaauuuaguuauuuuguaccugauaucucuuuaagugggaagcuugaugaaucuguuaagauguuauauuuacaucaaauauaaaaucuagauaguacagauaccaagucuuauuagaaccauacuuaaaaugauaugaguaccuuaagggaugaggccaucuugcaccuuauccuuggggauguuaccacugaaacaaaaaauacccaguuauaaagcaguuccaguaaagguaauccccauggcauaaacccaaguauaagcuucauuuucuuaccucuucuccucauccacucucuaccaguguuagguaaggauuuuaccuagugguuccaaauuacugucccaugcuacucaauuuuguuuucuuaggucaacaauuuuuuuuagucucugaguauuuuaugguaaggacauuuauaaauggcaugguauaaugaacacuuaguguuuucacaucuuagagaccuuuuccucuuuuuuuuuuuucuuuuuuuugaaacgaggucucacugcauucucuaauuauaaguucucucacagaauugacaaccuauuauaugugaaagccguuuauguaugaaaauuaccauacaggugguuaaugguaguguuaaguaauacuuucugccuguuucuuugcagcuuugcaauauugauuacuuucaaauuacuucuuaagaauauuuuaggcugggcacaguggcucacgccuguaaucccagcacuuuggggggcccaggcggguggaucacuugaggccaggaguucgagaccaggcuggccaacauagugaaacaccaucucuacuaaaaauacaaaaauuagcccaacaugguggugggugccuauaauccucgcuacuuaggaggcugaggcaagagaaucacuugaaccugggaggcagagguugcagugagccgagauugcgcccuugcacuccagccugggcaacaagagcaaaacuccgucucaacaacaacaacaacaacaacaaaaauauuucauagcaaguuugugauauagguuuaccucugaaaggugauuuucuggucagugucaagguuucgacuauuugccucuuaccucuucacuucuuuuguuuuguuguuguuuauuuccuuuuccccaccuccuuccuaauuuguucaaaaugaaauguaaaaauacuauuaaaaaauauuuguuuugcagccggguaugguggcucacaccuguaaucccagcacuuugggaggcugaagcaggcggaucacaaggucaggaguucaagaccagccucaccaacauggugaaacccugucucuacuaaaaauacaaaauuagccgggcgugguggcccaugccuguaaucccagcuacucaggaggcugaggcaggagaaucgcuugaacccaggagacagagguugcagugagccaagaucaugccauugcacucuagccugggugacagagugagacuccgucuaaaaaaauaaaaauaaaauaaauuuuuuuugcuuauuuugggggacuuugugauuuugcuuucacauuuuucauuuggcuugcucuuuuuaucucaguguuccuuaucuguuuugcuuguauacacauagcauaaaaagauuaauguuuccuccuuagaauucucuaccguccuuuuccuaaagcauaaguuguucucauacuuuccccuucaucugucaucucucauuuuuaagaugugaucugucuugaaacaucugcuguccucucuuaacuauuguuuaauucagguauugugccaggagagaacaaauguguauguuuuauaugcacuugagugcugacuacaauuacagugugaguuaauugauauucucaguccauuuauaagaaacauuuuaaaagcugcacuaagaaaaucucauguuuuacuuaaagguaacuugaaaguaaacacuagaagugaauugaugauugucuaaugucugguuuauugggagcuaauuauguuaucuuucguuguuuuucuuuccuuacucuuccucuuucuuuuugcauuuuuuauguuuuugggguuuuaaaaagaaaaccauuauaggaaaucagacaaugcaauauauguuauuucuguuuugaauacuuauuuacaugaguuagcugggggaauauuuguagggguuuuuuggucugccugaaagccaaaucuuaagauuuuuaaucccucaauuacuggaacuugggggaaaagugagcaguucaguguaauuuaauuuuccaguuggcugaaguuagccaugcuaaacucugcuauguuuguuauuauguuuugcuuuuuuuuuaaaaucacuuuuagugauguauguaauacagaaagaagaguguucagaaccuaguuguuaaucugagugauuuuuucuacaaagcaaauacuuguaagaacuaccauucaaggcaagaaauagaauauuaccagcacccaagaauccguucaucuccccuccuaaccuuuacccccuucaagguaacuacuaaauugauucuuaacauuauaguuuagucugguuuuuuuuuuuuuuugagacagagucuugcucugucacccagauuggagugcaguggugcguucuuggcucacugcaaacuccaccuuccggguucaugccauucuccugccucagccucccgaguagcugggacuacaggcacccgccaccaugcccggcuaauuuuuuguauuuuuaguagagaugggguuucccguuagcuaggacggucucgaucuccugaccucgugauccgccugccucagccucccaaagugcugggauuacaggcgugagccaccgugcccggccucuguuuuugaacuuuauacaaauagaaucauauggaauauaguauuugugucuagcaucuuuuguucaaaauuguguuuaugagauucguugauguuguuacauguuauguaucuccuuaugguuuuaauuugcauuugccugauuagugaugcugaggacuguuuccugugguuauuggcacaugaauauccuuuuuuuguaaaacggcuauugaaauucuuguccauuuuucuaauuaguuaucuuuuuuucaguugauuaguagaaguucuuuauauauucugaauacaaggugguuauauguguuguggauauuuuucccauuuuguggcauucuuuugauaucuuugggggaauaaaaguucuuaauuuuauuguaaucuauacuuuucaaucuuuccuauuguuauuugucuuacuauuuaaaauuucuagaagcuuuuuuuauuuuauauuuuacauugaguuauagucaucugaaaaugauuuuauguauuguuuguaucaaauauagcagggaucaaaauuuuuuuccacuuggacaucaauuugaccccaaaccauuuguuggaaagaucauauguuucucccuacucugcauugaccccugaguuauaagacauccauguaagucuguaugaaucuguuucuggacuccauuccauuggucuguugauccugcaacaauacuaccccaucuucauuauuauagcuuuuauaagucuugauauauguagagguagucuuccuaccuuguuuuucuuuuuuaagagugugucuguacuuggagcuuugaauuuuguagaaauuuuagagucaguuuuucaaacucucagagacaauaaacaaagccuguugagauccuggcucaggauaucucaagaaguuguaguucagcuggcagccagggcuacaggguuacagacaugacuggagcugguagauugacuucugugcucauucacaugcuguuggcagaagauuuugguuccuuuccuugccauaugggccucuccacagcacuugcuuaugacauggccuccacuagagcuagugaccuaagaguaaaagagugacaccuuaaugcuuucauugguuuagucuccaagucacauaccaucacuucugccuuguucuguccauuagaagugagucacuaagcccagcccaaaaucaacuggaaggaauuacacaaggaaguaaauguagugauuccucaguauccguggggaauugguuucaggacaccucagagauaccaaaauccauggaugcucaaaucccuuauguaaaauggccuuguauuugcauauaaccuacacacauccuccuguauacuuuaaaucaucucgauuauuuauaauaccuaaugcaauguaaugcuguguaaauaauuguuuguaaauaauugcuauguaaauaauuguacuguguuguuuagggaauaaugaaaaggaaaaaauucaguacauguucaguacagaugcacccauacccauucauuuuucucccccaaauauuuuugaucugugguuuggcaguccauggaugugaaacccauagauacucagagccaacuguaccagaagguagggaucaccgggggcuauuuggagaguuagccaucauauccucccaugauuaguguuauugaaguuagcagguuuauuauucuuuucaaauaacuaacuuuugauuuuauuuaucucuuucuucuuuaguauucuuuauuaauaauuuucuauuuugggcgggcuuaacuugcuauuuaaaaaaaacauuccugagcuggaugcuuauugaucugcagcuuuucuuuuaacauauaaauucugacucuuggccagguaugguggcucacgccuguaaucccagcacuuugggaggcugagggaggagguggaucacuugaggucaggaguuugagaccaaccugaccaacguggcaaaacccugucuguacuaaaaaaauacaaaaauuagccaagugugguggcuuuuuuuuuuuuuaacauuacuuuuaauggcaaaaaccacaauuacuuuugcaccagcccaguagauucuagugcauccacacuauggaauuuuauacaggcaguagaaggauuaacagagaauuaccaaaguacauaaugguguauuacuuuaguaguuagguaaguagcauaggaacuuugguguuaggggaucuggcuuaaaucucaguucaacugcuuaauaauaugugucuuugggaaagucacuuaacuuuucugagccuugcuuugcucaucauuguaaugggauuggugacauuacccacuucauaguaauguuagaaugaagugaguauguauauuuauguugccuaagacauugucaguaaucaaaauaucugcuauuauuguuuuguggauuagccugggaucuugaaauaaggcagaaauuucaguuaaguaacugauaagucacacugagaaaaaacuauuccuuugguaauuccuuguauuguaaauuacaguaguucucccacuuaacuggguucuaagacacccaaugguuuucugaaaccacagauaauacugaacccaauauuuuuccuauacauacauauuuaagauaaaguuuaauuuauaaauuaggcacaguaagagauuaacaacaauaaguaaaauaaaauagaaguauuaaaauaauguaaaacuugugugaauguggucuaccuucucuuucucucaaaauaucuuauuguacuauaaucaccuauuuuuggaccaugguugaccuuggauuacuggaacuauggaaagcaaaacugcugauugggggugaggggacuacuguauagucuuugugaguggauuaaaauuuacuucauuaaaaccaaaaaaaauggacaacuccugucacuuuuaucuagugauuguuucuuaguagaagucaaagaaaagggcagugcagauacuggagaacugaaaugugcagguuggugauaauaugcuguuauauugucaucuccauaauuaaccuaugaugguagugauuguauugaggauaaugagaccugauuuuuguacagaugucuuuuaaagguuaaugugcuugggaaacagucuuuaaaauauauaacagcaguguuacuuagggauagggauuuugucuuucauuuauuauuuuaaucauacaauccccuuguuagagugguaaggaauguuuucuuucaugguaccuuugaaauaaucauuuaugguauguaaauuccuugccagcaaauauaguguauuuccucccauugaaaacuuuccucccauugaaaacugcuuuaagguuuuuuuuucugaacauuguccugaacguauccacuccauugucuuuugcuguuaaagagacuguacugaauuguguugcuuauuucuaucuuuaagauaauugacgauuauuuaucuauuaugugucuguuuucauuaguuucauugucuucuauugggggucucaauuauaauucuugccccagaguucugacaguuuuauauuguucuccaguuuuauauuauaucucugacagcuuuauauuguucuucagaaguuucagaucauaugaaguccuaauuuuauauuguucuccagaaguuucagaucauaugaaguccuaaugauaauaaacauuuuuuaaaucuagaggguuuaaauaguacucauuguaaaucucuaauuaucugcuuuagaaauucuuuguagcuuuggaaaagcuuaaagaaacacuuaggauucugucaguagaggcuuucuuacauacaaauauguuuucauuccauguuuuuuuuuuugcaguacauucucuauugugauugucaaaacuguaaggaccccauguaaagcaaaagaguaaauaauguuaaauugacuuuuuacuugaaucuggcauuaagggaggguaguuugaagcaugucugauuuuuuuaaacuuuguuuuauuuauacuaaaaauauauucuuauucacugaauucaucaguugcauagucaacuguguacaaccagaaguuuaauaucuuuucuuccuaccaauagcuggcauguguucagauaagauacugccuaccuuauuaacaggcugaaaggaaaauuaccuaguuaaucaucuuugcaucauuuggaauuccuugcauaucguagacuugcuguaaauguuuguuuagcaguuaugaaugguacuggaaagggugcuucagucucauguaguuuggcucugucauuugcuaauuccagcuaaugaagauaaauauuacagugagucuucaagaaccuuugcuuuuaagcaguuagaaaguaaaagaagcagcaaaacuguuucauucauuuggaugcaaaaacacagccagccaggcuguaaugguuuucaaaacacacaagauugagaggauuucucauaaaguuaguacauaugacuaaaauauuuauugagauuuauguaaauuauguauucucauuagaucuuuacaacaaccugaauugggaaagaaagaaauuauuuuuauuuuaaaaugcauuuacuuuugauaugcaguuucaccauaauguaucuagguauggauuguuuuugaaauuuauucuguuuaaggugauuuauguuaaauuacgccuucucuaucugagaguuuauauuuuucauuagagcuggaaaauuauaguguuaucucuuugaauauuuaauauccucuauuuucuccuauuuuuauguccuccaguugaaauuaggucgauuuuuuuuuauccuuucauuuuccuuacacuuuuuuguuucuuucauaucuugugaaagacuaucucuaagucuuuaauuguauuuaauuugccauguaauugauccauugaguauauaauauauauauauuuauuucaauagcuuuuagaguacaaguggcuuuuaguuauuuggaugaauuguauagccacacuuguggcugacugccgcaguuacuacuugagauggucacuacagcaguuacuacuguuacuacuugagacugucauuacagcaguuacuacuguuacugcuugagaccgucauuacagcagucacuucuguuacuuccugagaccaucguuacgagacugaacgaagggacgaacauagaaaugauaacaaaaaacaaaagaaacuguuuuaaggaaaggcaacauggggagaagaagucugagauuuuauugcauccaucaccaagcaguguauauuguauucaauaaauagguuuuuuaggcugggcgcgguggcucaugccuguaaucccagcacuuugggaggccgaggcggguggaucaccugaggucaggaguucaagaccagccuggccaacauggugaaacccugucucuacuaaaaagacaaaaauuagcuggguaugguggugcaugccuguagucucagccacucgggaggcugaggcacgagaaucgcuggcacccagagguggagguugcaguguguggagaucgugcccuuguacuccagccugggggauagagugagacucagucucaaaaaaaaaaaaaaaaaaaagggcugggcgcgguaucucacgccuguaaucccagcacuuugggaggccgaggcaggcggaucacgaggucaggaguucgagacuacccuggccaauauggugaaaccccgucucuacuaaaaauacaaaaauuagcugggcgugguggcacgcaucuauagucccagcuacucgagaggcugaggcagaagaauugcuugaacccaggaggcggagguugcagugagccaagaucacgccacugcacuccagccugggcgacagagcgagacucuugucucaaaaaauaaaaaaagaaguaguuuuuuaucccucacccacuccacccuccugcuugugagucuccauaguccauuauaccacucugucugccuucgcauacucaauagcuuagcucucacuugugagaacauaugguauuugguuucaguuuccugaguuacuucacuuagaguauuggcuuccagcucuaucagaauugcuccaaaagauauuauuucauuuuuuuuuuuuacagcugaauaguauuccgugguguauauauaccauauuguuucauugguugauggacacuuagguugguucuauaucuuugcaauugugaauugugcuacaauaaacguauacaugcaggugucuuuuuaauuuuuuuuccuuccguauuguauaaacacaugucuuuuugauauaaugacuccuuuuccuuuggauagauauacaguaguaggauugcuggauuggaugguagaucuacuuuuaauucuuuaaaucuccauacuguuuuccacagagguuguaguaauuuacauucccaccagcugaguaaaaguauucccuuuucacugcauccacaccaacauuauuguuuuuugacuuuuuaauaauugcccuccuggcuaggguaaugugguaucucguuguuuuaauuugcauuucucugaugauuaguuauguugaacauuuuuucguauguuuguuggucauuuguguaucuucuuuugagaauugucuauucaugucauuugcccaccuuuugaggagaugauuauuauuuuuucuugcugauuugaguuccucguagauucuagauauuaguccuuugucagaugcauaguuugcaaauauuuucucccuuucugugaguuguuuccucugcugauuauuucuuuugcuguacagaagcuuuuucauuuaauuagguccuauuuauuuuuguuucuguugcauuugcuucuggggucuuagucauaaauucuuugcuuaggccaauguccagaagaguuuuucccagguuaucuucuagaauuuuuaugguuucagauguuagauuuaagucuuuguuccaucuugaguuguugauuuuuguauaaaggugagagauagagauccgguuucauucuucuauauguggcuauccaguuuuuccagcaccauuuaugcauaggguguccuuuccugaauuuauguuuuuguaugcuuuguugaagaacaguuaauuguaaguauuuggcguuauuucuggguucucuauucuguuccauuggucuaugugccuuauuuuauaccaguaccaugcuguuuugauaacuauauauauguauauguguguguguguguguguguguguguguguguguguguguguguauucuuuugagauggagugucacucucuugcccgggcuggagugcaguggcgccaucucggcucacugcaaccuccaccuccuggguuuaagugauucuccugucucagcuucuggaguagcucggauuacaggcaccugccaccacacccagcuaauuuuuguauuuuuaauagagacgagguuucagccauguuguccaggcuggccucaaacuucugaccacaagugauccgcccaccucagccucccaaagugcugggauuacaggugugagccacugugcccagccgauaacuguaguuuuguaauauaauuugaagccagguaaugugaugccuccagauuuguuuuuggcuuaggauugcuuuggcuauuuggggucuuuuuugguuccauaugaauuuuaggauuguuuuuucuaauucugugaaaaaugauguugguguuuuauuuuauuauuauuuuauuuauuuauuuuuugagacaguguuucacucuuguugcucaggcuggaguucaauggcaccaucucggcucacugcaaucuccgccucccugggucaagcgauucuccugccugucucccgaguagcugggauuacaggcaccugccaccaugcccggcuuauuuuuguauuuuuaguagagaggggguuucaccacguuggccaggcugguccggaacuccugaccucaggugauccaccagccucggccucccaaagugcugggauuacaggugugagccaccgcggccggcgauguugguauuuuaauaggaauugcauugaaucuguagauugcuuuuggcaguaugguccuuuucauuauauugauucuuccaauccaugagcaugggauauguuucuuuuucagcagcuucuuguaauucuccuuguagaaaucuuucaucacucugguuaaggauauuccuagguauuuuauuuuauuuuauuuuuuugcagcuauuguaaaaggauugaguucuugauuugauucucagcuuggucguuguugguguauagcagugcuacugauucauauacacugauuuuguaaccugagacuuuacugaauucguuucucaaaucugggagucuuuuggaggagucuucaacguuuucuagguauauagucaucguugacgaacagcaauaguuugacuuacucauuuucaguuugaaugcccuuuauuucuuucgcuugccugauuguucuggcuaggccuacuccauugaauucuuaacguuaguuauauucuucauuucuagaaguucaauuugguuuucuuugcaaauuuaccuagaauuagauuguuuaucgcucauguuauucucucuuauguauuuaaacguuuuauaaucuguaacugauaauuuuaauauuaaggugucaggguuuuaauucagcuguugucucugcugacucuuacucgugguagcagguucccuugcauguauuauauuuugcgguugugagcuuauauucagaauuuuaaguaugugugaacguggaccuaugcuuacaaauacucaagggcgacugcaugucuuuacuuaagaccacaggccaaaaucugucauuuuuauuuuuguuuuuauuuauuuguauuuuuugagacguagucuugcucugucgcccaggcuggagugcaguggcguaaucucagcucacugcaaccucugccucccggguucaagcaauucuucugccucagccucccgaguagcugggauuacaggcgcaugccaccacacccagcuaauuuguauguuuuuaauagaggcaagguuucaccaucuuggccaggcuggucuuggaacuccugaccucaugauucacccgccucggccucccaaagugcugcgauuacaggcgugagccaccgccccuagccaaaaccugucauuuucuuugaccaacaggcaguuuuuguuuucucauucaucuuuucacagagauccuagcuuuauguagaccccucagauccaacucacucuuacaugagcucgagguaaugucugucaucccuaccaggcucugauucguggcucuuuggggcagccauggcuucaccacuguauuagcguaucacucugauuuuuugcuuucucuucaucaacagcuccugacaguuuaaaagaauguguuuccaaaguuuuugacuuuuaaaagaauguguuucuaaauuuuuugaggcagaagaauuuucugagaaauguaguguguuguuugguccuaucuucauuuuacauguuuaaaaagcucaagugacuuguucaaguuuaugcuagaagugguagaacugugaccacuucuuauuuauugcuuucuaauaugcuuauuugccuuaaacugagauuuaaaaauuaguuccaguuagaaccaaagaaggccuuucuguggaagugacauuugaucagacucuuaaaauucagguaggauucucauagguagagauaggagguaaaagguucuacauaaaggugaaugacgugcaugcaaguaggaaaauagggaacuauagggaauaaucaacaauuaucagucguuuaguguggguaaaaucaucuuacauguguauuuuuaaaaucucgccuccuguacaaaucucgccuccuguacccuucauucucccauucuacuucccagucacagcauuuauugcauugaauucacagaguaugaauuuuuauuuacugugguaaauuagaaggagcuugaauagucuugaauaaugaucacagaaacuuugucuugacuugguagaaauuggaaggaaguguucuguuucaaccccaacagguguagugcaauucaauucuggcauuaaccaccuggaaucagugcauacacacaauuaaagggcacaguguccaacaauacugcccuuacuucagacuucagccucacuuugagaauccccagaucaccugcacuucugucaauuggcuacaaauccaggguuuuccaugacccuguaagauucaagaauaugcuagaacaacucacggaauucaggagaguguuauacuuaugaauacaguuuuauuauaaagggugcaaaucaggaaggaaguguucuguuucaaccuuaacuggucuacugcaacucaauucuggcacuaaccacucagaguuaguacagacccuacaaguuaaaaggcacugucuucaaauaaugacugagaaauuaagguaguauggaaaaggaugggauuauauagauuguauuuuacugaaauuuguagauuuauauuuuacugaauuuugaagguagaauaaagauaauagauagcaaugcaguaucauuuuaugagauagguggaucagagccagaugguugaaaaauuugaaagccagaaaaaaaguguuugaauucuaugaugggcuuguggaugaauuuugaauacaugaguauuaugauuaagauguuuguuggaggauuagauuggcuauacagaaauguuuggcuacuuuuugagggagggauaaugagagccuaaguuaaauugguagagucugaaaugcagaagaauaagugcaugagaguuuguggcaggcaaguaaguaaaacuuagcgaccgauuugucuguucaucuguuuacuuuugggcacuugugaaagaagaaggguagaaugagagacugaagaggaaaaacagaauaacugauaaagcaagaggggcuaucaguagcacagauauaggaacuaaucuugaaaauucggagaaacacuuuucugagauaggaggaaaggaaaauaaaggacaacauuuuugagguggauaggagaugaguuugggaaagaggcaguuuugcuaagaguagggggaaaugggauagggaggagggggaguccuaucagcaguuggauuuccugaauugggcgugcaaagggcuuagaauaccccauauguuacauguugguauggaagucaacaagagagacuaaggaguuaauaguggaucaaauaauugcaguuuuggacuuuuuccaacaauucacagccuccuuuaaguaagcguagaaaggcaaaccggauuauuuauccauaauugaccaaguaaaaacacuucaaauguuauuaaauaaaaguugcccccugauaagguggugaagaugaugauuuuauagaaaaaaaaaaugacgcaaacuuagucucuuuuacuuuuuaacucaguguuuauuugccaagaaguucgaccaguucugaguaacuagauuauugggacauuucaaaauuaaaaagacaagugauaauaguuaaacuuauauccauaacucagcugaacuauugaucauaaugcuucuaaagagggaaaaaagaaaaaaaaaagcccuaguuuuuuuuuuuguuuuuuuuuuguuuuuuuuuuuuuugagacagagucucgcucugucgcccaggcuggagugcuguggcguggucucagcucacugcaagcuccgccuccuggguucacgccauucuccugccucagccuccuacguagcugggacuacaggccccugccaccaagcccagcuaauuuuuuguauuuuuagucgagacaggguuucacuguguuagccaggauggucucgaucucaugaccucgugaucugccccgccucgaccacugcucccggcccucuuuuuuuuuuuuuuuuuuuuuuuuuuaaucaacgcaggaaauggggaacguauuuaaaauuucccaccuaaaaggaaugaacaauacuauuuuaaaacaaagaugagcacugcagaauauuuugaaacucagccuccguaaccaaauggaguauugcaauaauuuuuuuuuccugacguguaaacguguuaaaugcaauggcuucccuauuugaaauccuccagugguuucccauuauacuuagaauaaaaauccaaagucuucaccauggcuauagagaccugcuaacacuguauacuaccucacccuccaaauuucuuucauguuacccucauggcucacuguucugcagucauaguggccuccucucuacugggcaugcauuuuccccuucuugagagccuuucuugauuaugacuucuacuaagcauucucucucuggccucugcuaaaugucacccuuucccuaaaauuuuucuuuaucucccugaccaaucuaaguaguucuccaucauugaaccuacuuuauuuccuuuauaauaacuuaucacaauuauacauuuuuuuuguuuuuauacauuuuaaaaauaucuuuccagcuaaaaagagaguuuccugaggauaggcacuacauguuuuuuucaccacuuguacugagccuucacuuaguaacuccucagauguuuguugaaugaauuaaugcuuucuaaguauuaagugcuuuauuacauucucucauuuaauccucacaaaagguaagauauuauuauaauucccgcauuacaaauaaggaaacuguaucccacaaauauauaaaaucauuauuugucaguuaaaaauaaaauuuaaaauaaaaacaaagaaauuggggcuuugaguaggguuaccuagcaccccaaacuuagggcuucaugaccauaaaaucuucauccuucugccacauuucccugucagcucauuaauaguuuaaauucuuucauauguguguuuuaaaguaagagagaaugacauuuuaaaugcuuagagcauguuuuucuuuuuuuuucuugagauggagucucacucuguugcccaggcuggagugaaguggugugaucucggcucacugcaaccucugccucccggguucaagugauucuccugccucagccucccgaauaacugggauuacaggcacccaccaccacaccuuuuauauuuuuaauagagacgggguuucaccauguuggcuaagcuggucuugaacuccugaccucaggugauccgccugccucagcuucccagagugcugggauuacaggcgugagccaccacgccuggccuuuauacuuuucuauauaguaguugcaucuauggaaauuaaaaauugaagaguagggugguuuuuaguuucacuuuugaagauugaauuguaauuaaguuauaucuguguuguuuaguaugaauaagaaguuacuuguguuggucauuuuuggccuaaauagaaagaaaauaacuuauaccugugguaauauuuuuacauuuuuuccuuuccauguggcauauuuguggauaugaguggcuaauuucccaagauuauaacaaguugauucuuauuguacaaaguaguugaauuugaaaccuucauguguaauuauaucuguacaugaugacuugaaugcuaagaaagcaauuuaaccugauuucuauauggauaguugcgaguguguucaguaugugaggagaaugauuguugcugcuucugcugcuucuagcagaaauauaggauaucauagucaaaacugacuuuuaaaguuauauuuagguuguuccaauuuaauuaacaugacuucuuugccaucaaaaaauagaguacagaaugcagcugcuacacaauugagcuauaugggguaaauacuggcuugaaucacuggagaggauucaguguuuagaggaaaaauuuagagcuuuccugucacaccuacacaauggacugaaaauuuuuccuuuuguuuuuacauauaauauguuuaccuuuuaauuauugcuucaucuuaauaauauacuucuuaaauagugucaucuugaaugguacaacucuuggacuaguuuuguuugagaguguguguauacuuuuuuuuuugaaaaagacaauauaaauagguuuuuagacauuuugaaacuugucucuuuguguguguguguuugucucuuuugguguuuauuguuuucuggcagaaauuguaugacugugcagugaagcaggguaucucuaaaugauuuuuuuuuuuuuucugagauggagucucacuuucuugcgcaggcuagggagugcgguggcaccaucucagcucacugcaaccucugcuucccagguucaagugauucuccugccucagacuccugaguagcugagauuacaagugugugccaccacacccagcuacauauccuuccuuccuucccuccuucccucccgcccuccccuccccuccccuccccuccccucccucccucucucucucucucucucauuuugcuaagccaacugucagcaagauucuguguguauuuuucauauaugaauaauugguacuaaauacugagaaguuuuauuugucaaaaacaaaacagugauaacauuagauuagcuuucaggauacuguguuuuaggcuuuucacuauuuugaaaugacauuauaaugucaacugucuucccugguugauuucagaacuuguuuguuacaauucaccuuccauguaauucuaaaucuauuaugguuuuaauuauaaucuuaaccaaggaauaauuuuuauugaccaccuccuuuugaacagauuuauucacugauaucaguuugcauguggaucaguugguuaggaugaucaaaaugucuaauuaaaauuugagccaaagcuagaauauuugauuuuauaguuuuagauaaaucagagauaauuaaaaaucaacuuuuucucagccuuacacugggaggcucugagguaguuaaaaaggaagcaaaagaagugguucuguccucaagauaauggaggagguaggaaggacagaaaaauacauacauuucuuaaauauuuagaguaaccuggaaaaauugauccagaaagacucugugaaaacuaucuuuauuuuauugauugauugauugauugauugagauggaguuuugcucuguugcccaggcuggaguacagugguccguucuugccucacugcaaccuccugcuucccagguucaagcgauucuccugucucagccucccuaguagcugggauuacaggcaugcaccaccaugccuggcuaauuuuuguauuuuuaguagcgaugggguuucaccguguuguucaggcugcucucgaacuccugaccuuaggcgauccacccgccucagccuuccaaagugcugggauuacaagcaugagccauuacgcugagcugugacaaauaucuuaaacaaaauuuugaagaaauuagagaagcagccagggaaaugcagauggcauaugagagaagguaaaaugcuuuagaauguauaguagauaguauuuuaaugggugaugagaaaguuuuaguagcuaagauuuuguugaauuuaaguggaucagaucagaagccagaggagcaguauacugggaagguuggaguuuuuuuuuuugguguaggauuuuuguuauuuuguuuuuauuuuaauuuuacuuuaaggaagauggcaccugugaauaagaaaguuuagaauaaaaauaggcuagaagcaaaacugcuagaaagaaagcugcugugcugugauguaacagugcuguauugguuaggucugugcuaguguuaugaguguagaaauaguaagaccagaaguaagagugcacagggucagauuucagcacuaaugguaccucuaaaggcauguaaucaucccuuuuaaaaauacuacaauaauuuagcaguuaauuuuuacaaaugauuuaguguuuuucagaaaauaagucaaaccauaaauaauaauuucuggacuuuuaaauacuacaacacaaauaacacuaaacccucagagagcaaagccacauuuugauguuuaugcuuuuuauugugauaggacacugaaaauguguaugaggagaagaaugguuuaaugccuuuuuccaggauguguuuauaugaaaaauuucugucuauguuguaucuacaugagcacaugguaauuuuccaugaaguaagguuaaaggggaaaugacagcguacuguuucuuuuggcucuugugcuaaguuggucagccuucugacucuuaucugaaccaaucaaauguucagcacugcuaaaacaaagauuuuuauuucuggcuuucccuguuauucuuuccuaaaauugacgagucauuccaguuuuagugauuuuacuaaccaaaaaaguuacaauguuguaaacuaauaguucaaauuuaaaaaaucaauuuuaauaaacaugcuacguacugaaaauauguauggcaagguucauuugauuuuuaaggauuucaguagaauuucuuaguuauaacacuaccauuuuugcccuuguaauuucuaauaaauagaaauacugaguuguguuccuuaauacuggcuuaccccaaauuauuugcaaacaaaacauuaauuugacuggauuccuaccucaaauccuuggcuguagguaaauucuauuucaaaaagacuucuugaaaacaagauugauaucuucauuuacuaaaauuuaauagcacugugcuuaguaacuaacacccgguauuuaccuugagcauaaaguggaaguagcaauaugacuaguugauguaauaaugacagcaugguucuaacauuaguauguucauuuuugugcacaguauuauucuaaguauuucucugauucuuggaaggaacuuaauaucauuugagaagucaguagcaguuuauauuuguauugccaacuggacaaaucaagauuaauuuuaauucauauaccaauuacucuaugaauuuugcuuauauggacuagaaaauaucuacagacagaucuugaaaauauggacuuccauuuauauauaauaguauuuauggauuuuccccacuguacauaaugccuucagagauaaaaguaaaauaaugaauuauuuuaaauauuaauuaauuuuagccuacuuuuaaucuaccugauaccacaguuccuauuuuuaaaaugaaacugugcuauuuauauuaguuaugaguaauaccuuucuucuggaaagaaaaaacgcaucuuggaaguauucagagugguauuguauguuaccuaauugaaaaguccgucucugggagaaguaugauuaaguagacugauaauauucuauuauccuacauuucuauaugaugagcugaaagcagauacauuauucuuuuuuccaguagaaguagcaauagcuauauuuucaaaggaaacuuuaaggauuaguaauuguuuagcuuuuaacaugcaaauuuuuuuuuuuuuucugagacugagucucacucuguugcccagguuggagugcaguggcaugaucucaacucacugcaaccucugccuccugguucaagugauucugcugccucagcuucccaaguugcugggacuacaggcaugagccaccacacccagcuaauuuuuacauuuuuaguagagauaggguuuuaccauguuggccaggcuggucucaaacuccugaccucaggugaucugcccaccucggugucccaaagugcugggauuauagacgugagccacugcaccuggccgaccauggaaaauuauagccuaucuuuaauuauguugaauagaggcuugugaagcaccuuugauggguuuugcaauuacauugaugagaacauagaucuauaacaucaugauggcguuucugccaauguuaaagcacugcugauaggcagauaggcugcagugcaaguauaauugcacaggccugcacugcucccagaaggccagguaacaucuauuccaugaagcaggcuaucaugguagguaucuggagaaaguuuaaaaacauuauaaaacccacucaaacuaccuucagcaaguaaaggcaaaguauugaaaauuugcaggguuucucauguaacaggacagaaaccaaauuuagaaccuggaacuggaagaccacgaggcaacuuauuuucuuccauaauuucccuuucuucccuugccuccuuuccccaccuuccugccaucccuguuuccuagguauuccuugguaaugucaacaucaaaccaguuuuuuauaaguuagugaacucuaggauucaucuuuauuacuaaaacucuuaaauccugucuucuacaaauacauauuuuucaguuggcauauaauguaaauacagcuucaggggcuggccuaucuuaggagguugaggagggagcagcuaaacagaaacugccuauuuacuggagcuguagguaauccugaccacccugcacuagcacuuucugauccuguuuaccuccuagcuacccccacucgcuucagccacaaaaaaagagauuauggcauacauuuugaaagucucccagaaauacugcaugagcaaagacuuauuuuucuugggcugaaaagucacgauaccuggauacuauaaaaaaaugaaaguuuuucuaagcauacagaauauuuaaacuauuuacaaaauuguuacagaaaacaaaaagaaaaaaagcauaauaacacguguaguaacauaauacaguguuaagacauggagaaauuucauaguaacaaaaguaacuucuacuaaaaucagcuuuccaauauagaauuuuuuccucagguuuuuauuuuuauuuuauuuuauguauguauguauguauguauguauguauguauguauguauguacuuguuuauuuuugagauagaguuucgcucuugcugcccaggcugaagugcaguggcgcgaucucggcucacugcaaccucccccucccaguucaagcaauucucccaccucagccucccaaguagcugggauuacaggugugcaccaccaugccuggcuaauuuuuuuuuuuuuuuuuuuguauuuuuaguagagacaggguuucaccauggccaggcuggucuugaacuccugaccucaggugaucugccugccucggccucccagagugcugggauuacaggcgugagccacugcgcccagccuauuuuauuuuauugagauggagucuugcucugucgcccaggcuggagugcaguggugcuaucucagcccacugcaaccucugccucccggguucaagcaguucuccucccucagccuccugaguagcugggauuacaggcgcaugccaccaugcucaguuaauuuuuguguuuuuuuaguagagaugagguuucaccauguuggccaggcuggucucgaacuccugaccuugugauccaccugccucggccucccagaguguugggauuacaggcgugagccacugugcccagccuccucagguuuuuaaaaugacuuuuauuuuuaaaaaguuaauaugugcaucauggguaacaaaaaacacaggaagcaagggacaaagucauccauaauuacaagcaguuuacaguuugauguguccuucuagguccuguguguguauacacgauacaggauuuuaauauugaaagaaaugggauaguagagugaaugugccugguccacuggaucaucugucaaaagaaacuaaggaagaacuugccgccucugcaggauaauuugaaaaugucccauuucaaccauaaaaugcucuuuaaccaaccaaagcauaaguagcuuacagaauaauaaugcuuuucccagcauggggcagauggcugaucugaccuauuuauuucuaucuuaguggcaucccugaagcuauauggaaaaauaauccacguuucaaauuucacuagaggaaugacuugaauaacuuaaaguacaguauuagacuugacaccacacacacacacacacacacacacacacacacacacacacacacacacacacacacccucaugcauugucucauggcaguuaggaaucauaaucagaugaccugccuuccagaccccuccaaaccaguuucuuuacacuacucuucaaaaccaagcaaguucauuuaucuuugcuaaggauuuaguucagucagggcuucauuucuauuuuggauuuuaauaauuaucuugaguuuguagcagcaguaugauaaggagugaauuugaaaucuaggcuaugaauguuuauuguauuucuuacaguuaacuccuuuaaucucucugcuucacuauuuuuauaaaaaaaggccaauaacuccagagugcuuuugaggauucugguacauaaaauaauacaaaggucuauaugaaaauguuaaguuaguaacuuaauacuucuaauuugccaggaauuuuuaaaugucauuauauuugaauaagcaaauaaaaagaccuuuagaauuguaacccacagccauccuuagacauggagaccuuugcuaggauuccuccccauucuccaaaaauuguucuuagguggugaggccucccugaauugagaacucaacucauuggacccaguaacaguuaaaacuucuauguucugagacauaacuucuguaucuucagaagauaaugcgaccuauauauugaauugucucugaccucuuuggugguagaugagcugggaaggaaguggagggggugggucuugaaauagcuaagcugcuucccgcuuagucauuccugcugacaaauuucucuccuguuggagaguaacuggguggaucucgcgccgugcagguuucucaaaccaauguaagacuuuuuuucacuucgagaacuggcuguugccaguuaauuacuuucuuuuagccuuagucagaucuaaaaugugaccuuuuguacagucaggacauugcacuuuucugauaauauuaaauuauuucaugaagacuggacuaccucaucugugaaauuguaaaaagauuuauuugaaguuauuguguuuaaaauuuuucuuuggauaauucucaaauauuucuuuuguaagaaauagcuguauauaaaaauuaauucaguguuuacauaagaauuuugccuuuuuaagcaaaaagaaaagucuggaggcaucacauuaccugauuucaaacuauacuguaaggccauagucaccaaaaacaucaugguacuggcauaaaaacaagcacauagaucaauggaacagaauagagaacccagaaauuaacccaaauacuuacagccaacugaucuucgacaaagcaaacaaaaacauaaaguggggaaaggacacccuauucaacaaauggugcugccaauguaggagaaugaaacuggauccucaucucccaccuuauacaaaaaucaacucaagauggauuaaggacuuacuuacaucuacgaccugaaacuauaaaaauuguagaagacaacuuaggaaaaacccuucuagacauuggcuuaggcaaggauuucaugaccaagaacccaaaagcaaaugcaauaaagacaaagauaaauagcugagacuuaauuaaacuaaagagcuuuuacacagcaaaaggaacagucagcaaagugaacagacaacccacagagugggagaagaucuuuacaaucuguacaucugacaaaggacuaauacccagaaucuauaacgaacucaaucaaaucagcaagaaaaaaaacaaucacaucaaaaagugggcuaaggacaugaauagacaauucuaaaaagaagacauacaaauggccaaaaaauauaugaaaaaaugcucaacaucacuaaugaucagagaaaugcaaaucaaaaccacaaugcaguaccaccuuacuccugcaagaauggccguaaucaaaaaaaucaaaaaacaguagauguuuggcauggauguggugaagagggaacacuucuacacugcaggugggaauguaaacuaguacagccauuauggaaaacgguguggagauuccuuaaagaacuaaaaguagaacuaccauuugauccagcaaucccacuacuggguaucuacccagaggaaaagaagucauuauaugaaaaagauacuuguacacauauauuuauagcagcacaacuugcaacugugaaaucaugggaccaacccaaauguccaucagucaacgaguggauaaagaaacugugguauguauauauacaauagauuacuacuuagccauaaaaaggaacaaauuaguggcauuuggaaugagcggggugagauuggagacuguuauucuaagugaagucacuaacucaggaauggaaauccaaacaucguauguucucacucauaugugggagcuaagcuauguggggugcaaaggcauaagaaagacacaguggacuuuggagacucaggggaaaagagugggaggggggugagggauaaaaaagaccacauauugggugcaguguauacugccugcucaggugaugaguacaccaaaaucucacagaucaccaccauagaacuuacucauguaaccaaacaucaccuguuccccaauaaccaauggaaaguuuuaauacuuaauuaaaaaaaaugaaguuugccuuuuuaacuucuuuuuuuuuuuuuuuuuaacuuaagggacuuucuaagugacagauaucguuuagggagcugaauugccaucuuaaacugugaucuguuucauuaugauggauguuuuggacaugacuugggaaaugugcaaauuaagccuacuccuccuugcuuuuauuaaauaauuuuuauuauucucagacacgacaauaucaaaagccaaaugaaauuuuaucauauugcacaauauuuguacccauuuucucagcauuuagaacuuuaaagccuauuuuauuauguauuuaauugccuuucauccuguguucauuaugaauauuuuucuuuagauuuagccuuuuuauauguuuugcaucuuagaaauucuuuucccaagccaguaauugacauugaauacaaaauuacuuuucucaaaauucacugagcaaugaauacauugguuuuuuuccuaaucaacagucuuuaguuguuuguuuauugccuuuugaaugagagaaaaaaugucuacaguguuucuaccauaaguuauuuuaagucuaagaauuuggucuuugccuuaccugcucaugucuagcuccauuuugauugcagucuacuaucuuucccaaaacuucccuauauuccaagauucauuacuguuuaaacacucuaugcuuuuuugcuuccaaggugcuuagaacaguucacgcugucuuagugcucccugcaacucccaugaucuuuuauuuggaauaauuacaacacuuuauauuuauuuuauggcauuuaccauauucugccuuguuguuugguuauuuuuaauguguuggucuuuuuacuagaauguaaaguccuugaacagagcuuguuguacucugaccaauuccagugcuuuaacauagaaggugagcucuagcuguguggcaggcacauuuaucugucauucacacucaugucagcauuugcagauucauuaauaucuaacccauaucgagaagaugcaaagcucauccuccagggucaaagcagaacagauccaucuucauuuuauuuugaaaauuuuuguauacccaucaccuggauucuauaauuaagcuuuugcucuauuuguuuugucacuuaucuuuccauuucuggauguaauaagaaauauauauuuggcuucugcccccauuucuuggcacacagcuuggaaucuuaaagugaugugucuuuuuguaugugaaugagguaaccaauggccgggggagcuccuggauagccucuguuuaggggcugauugcccagggaaaccaaccauguguuuagagaguuggaacuuucagccuacccccuugaccucuaaaagggguggagagggacugaagguugagccgcucaccaaaggccaaugaucuaaucaacuguguuuuugugaugggucuucgauuuuagcugcucuucucucucugucucugacacagacacacaccccuacagucacacacacacacacacacccuuacaguugauacuugaacaacucagggauuugugaugcuguccccccgccacccuuaacauuugaaaauucaaauguaacuuuugacugucccaaaacuugacuacagauagucugcuguugaccuaucaauaacauagucaguuaacacauauuuuguaugcuauacauauuacauauacuauauucuuuuuuugguuuuguuuuguuuuguuuuuuugagacggaguacccaggcuggcguguagagugcuauggugugaucuuggcucacugcaaccuccgccuucccgguucaagcaauucugccccagccucccaaauagcugggauuacaggcacccaccaccacgcccagcuaaauuuuguauuuuuagucgagacgggguuucaccauguuggccagucuggucucaaacuccugaccucaggugaucuacccaccucagccucccaaagugcugggauuaugagcgugagccaccgugccuggccaauacacuguguuaucucuuuuuuuuggaagaucaauguuuauuuacuaucugcauacaaaaacauauugcacaucaaacaacugaaauuaaacaaaacaagauaaaaaagauacucuacugaagacuaacauguaguuuauauagaauaagccuucuggaaauuaguauuuucaguaguuccaguuaugucugaauggacaugacuaauucagcuuaguguuuuaacuaaagcuauguuuuauuuuuaaauacuguacacuuuaauaaauaaaccaaacaaacccucaagguggaacagucacugccaaauaucacccagugucccugcagaugagaguuuaauaaauguauuccaguggucugcagauuuuucucuauaaagcauuuaaaaaacauauuaaaacagaccaguuuccaaacuaaacuaauggagaaauuacaguucagugcaaaauauuuuagacugcauuuuauucuaguuuuccucagaugaagaagugguugcauauuaaaaauguaacaaaagcagccagugcuuucauaaagaauauuauguuagggaucccaccucacccaccaccccccaucugccauauuuugaaaagaaaauaacauuucuuauagccagcaacuuuuuuuuaauguuacauauacuauucucaaggaacaucugaugauuuauaacccaguaggugucaaaguauguuuaacauaugauuuauucaggaucccuccccuuuuugaauuccaaaugguagaacugaaagugcgaugcaaagacuggcgauccauauucuaucuuuggcaagcuuguacaagcacuguuguaaauguaauguaaaagaacuguaaacuaggaacuucuucaguuuaugaaacaccauucaggacugcuacuucuugacuguuuucuucuuuuaagguauuaaucuuuucuucuccuggaguaugcuguagcuuagaaaugucauugccagaagcacuagucgggcuauuuauugccuuuucugaaggaccaugcucuucaaucacauauuuugccuagcccauuuucaauaacugaagcuguaucagauucagucauuccauccaucagaacagcaucuucaucaguccuucgucuacgagaccucguaugacgauuaguacugugaugagauuugcuggcaucagugucugcagucugaucugauucugauuaucaaguacgcuguauggauugcugucuggaucuuugggcacagaacugauggaggauuugccaccacgugguccaccacgaccucgacccccugaaacacuucugcaucuuccuccugggcaucuccugcugucacgcugaugucggcugucucgaucaucuucuucaaugaccaaucacucagcuugucuuuacccucagauucuauuucagagggguuagacagcuuagaauuuguaccauaacuggagguguaauuagggcccugacaaccucugccucuuccacuaugagaccuagaaccaaucuguuauggcugcucauuaaucuguaggcauuccauucuuagcuguucuacuuccuuuagauaagcaauaugguacucuaaaagaacuugcacauuuccaaugguuucuuuagugccaacaaauacaaauggaaucauacugucuucucuggguaguuuauuuucacuguccccuucaauucucaccggaaccauaucagauuuguccacuauuucuugaauaacuuugccauuuuuuccaauuacuuuuccagugagauucuuagaaaccugaauaaaauccuccacaaauuccaagaaaccucuagccuuuuuuacagcaccagcacucucuauagauucuaaauguuccagugucuucaucuagcucaaugcgguaacuccaggaaccuuccuagcuugcugaauguuacuaccauguguuccuauugccacacccauuaaauuuucucucacaacaaauuccucaggaaaagcugcugcaaguuguuuugugcauucugaaugcuuagugaucucuucauuucuggucauaagcaucagcuucauacaaauacuucacaaacgcaugucacucaagauguuuacuuucuucacaguugcuucacuggcagacagugucauuagcuguguuguuucuggaugguaaaaaauucugcaugcuccuacugcuuucuuaaaaucuuuaugugcauuuucauuagcacacgccucucucauauccucaggaaaauccacugugcauuuaaagacgguauuuuuuuuugacaguuuuauuuuuauugacaggccaaaguuguucaaaugugacuauuucauuguaaguagcgucacaagcaguauauucaaugacauaaaauucuccuuucaucauccaaacuuuagccacccaccauccacauggcucuuggucauuugcucuugaauauaccucuacuucaucuccuucacuaauuuauuuuuuuauaucagaugguggagguaaucuaaccucauuaaauggaaccuggcauucugguugccaauuauuuucaaaagcaacuguaagggaguugcuuacuuaagggagaaugcaguggugcguucucugcucacugcaaguucugccucccggguucaugccauucuccugccucagucucccggguagcugggacuacaggugcccaccaccaugccuggcuaauuuuuucuauuuuuuaguagagacgggguuucacuguguuagccaggauggucucgaucuccugaccucgugauccaccugccucagccucccaauugcugggauuacaggcgugagccaccgcacccggcccacacuguauucuuaaaguaagcuagaggaaauaaaauguuauuaagaaaauaauaagacagcauauauuuacuauucauuaaguggaaguggauuaucauagagaucuucauccuccuugucuucacauugaauaagcugaggaaagauaaguuggucuugccaucuuagggguggcagagguagaagaaaauccacauauaagugcacccacucaauccaaaccuguauuguucaaggaccaacugugugagaugauagauauuacuaucuauauguaucccauaacauguuguaaaccuuaaauacacacaauaaaauuuauuuuaaaaaaacauaacaccaccaaaaguucaggguuuggagagcuucuggguugcugaacagguagagcugcuacaaaggugguauacucagagugggcacaacagcuccauaccuguucccccauaccuugcccuacauaucucuucuaucuggcuguuccugaguuguauccuuuuauaauaaacaguauuuguggagcuggagaccauuuuccuuagcaaacuaacauaggaacacaaaaccaaauaccacauguucucauuuguaagugggaucagaaugaugagaauacauggacacaagcgggggaacaacacacacuggggccuguuggaggcuggggaaugagggagggagaguaucaggaagaauagcuaauggaugcugggcuuaauaccuaagugaugggaugaucauaaaaguuggaaauaaaaauaaauaaaugguauuuguaaguaaagcacuuucugugagcugcucuugcaaaugauugaacccaaggaggggcuuguaagaacccucaguuuauaguugccuggucagaaguuuuggaggccugggaccugugaauugguuucuguauuggggguuagucuugugggacugaguccuuagccuaugggaucuuaacccaguuggugucugcuggggaacugaugugugggcaugccagaagugaaguguugaguauuaugagugaggguacaguaggagaggaaauaaauuacuguuucuuuauguuuuuguuuuuguuuuguuuuuugagacggagucuugcucugucuccugggcuggagugcaacggcgcgaucucagcucacugcaaccuuggucucccggguugaagcaauucuccugccucacccuccccaguagcugggacuacaggugcaugccaccauggcuggcuaauuuuuguauuuuuaguagagacaggcauucaccauguuggccaggcuggucuugaacccugaccucaggcaaucugcccgcccuggccucccaaagugcugggauuacaggcgugagccaccgcgcccagcccuguuuaggucuuacauuuaaauuuuguggaaucugguuuuggcauuaacuauucugcaaugauuacauuauuuggaauuauuucuuuuuuauauguggaauuauuucuuuuugucuaguauauuaugauugaaaaaacuaauaagcugaaagggauaaaaaagucauaauuaaggauuaaucuuugguugaauucuauauauuuauaaauuggucuguauuuguguaugagaauucuauaaacauugauugcugaggcuuuuuagcauguccuuaauuuauaauugguuuugcaguugcuuccuuuugugguuguaauaauuucacucacauauugaauguaggcacuauagcucugauccauguguucauaaugcauuucuuagcaaccaccaguguucuuuuuaggagcuguguuuuuaagaggcauuggggcugcagcuuugaggaggacucaaaagauaucuuuuucuauuaauacagcacaagcagcaacauagauuacaauaguuuugacaccuucugcauuacuauagaccaaaauuaaaggguuuaaauuuaucuccaguauuuaauaucaauguguuaucgcuuuuuuccuggccucaucaacacauuaaacauuaugaaugguuccuuguauauuacgccccaauuggaguuucuuuuuuuuaacuuauuuuuauauaccuuucauuaaaaguuguagaacauuuuacagaugcuaauuauauuucacaaugcuccuuuaaaaguuguaagcuuuuauuuuccacuuuaaugguaaaauaguugcaaauauguauuuaauuuacuagaucaccacuuaaccaugacaacuuucccuucuuuuuacuccucaguccuccaugacaacucugcuaaauagaauugucugcagugaugaaaauguuuuauauccucauguccaguauggcagccacuagcguuugaaauagagcuagugugacugggaaacagaauuaauucuauuucacuaauuaaaaauaaaauauagucacauauggcuaguggcuacuguauuggacagcacagcucuccagucuccaccaucccaacaaacugcuauugugguuuaccugcuaauugccaaauccagucaauauguuucuuugaucuuucucuggcauuugauugacuguguccuuauuuuauaaacucuuucuuuggcaucugugccuucacugucucuugauucuuaauuuuucugcggaugauaucgaugguuuuagaugucugcacuuggcucuuacauugucuuaaagcacacuuuagcuauucauucaacauuuacuggguaucaguuuuguggugcuaggaagaacuuacucccuccuucaggaaauuccccuggccucagcuggcauuacugcuaaagauuauaaaaucaaucucuuccucacuugcguuuauuucuucagaaguccagacucauguacuuaacuuccuauugauaguugguucugguugucucaugagugccucaagugacuacuuaguacugaacuuaucuccacuccuauauaaaagcaaaaaaccuuccaccuauuacucuucacauuaucauacaucuacugcuucuuaauuauaauaucccccccuuauccuuaggggauauguuccaggauccucaguggaucccugaaacucagauaguacugaacccuguguauacucuguuuuaccaauccgacaacugagagggcuacuaagugacuaacagguggguaguauauaaagauugaauaugggacaaagggaggauuuaugucuugggcaggaugaagcaggauggcacaagaucucaucauacuacucagaacagcaugcaguuuaaaacuuaaggauuguuuguuucuggaguuuuccauuuaauauuuuuggacugcaguuuacagcagguaacugaaaucucagauaaaguggggacugcuguacuuguaaagccucuaaucucaucuuucuuucacacaucuugucauauuuauuguccuggcucucaggagcaggaacccaaagcauagauucuugcucauuuuucucuuccugauacauccaaagguuccaauuucuacuuguagcucuuucccucuuuguuaauuuaucaguugaugucuaagcuccuugaaggagcucuucaugaucucguuucagggugaauauccuaugcucuaggugugcuaagccaauaguauuucccccaaacaccguuuccuuuuccuuuucuuuguuuuccuagagagaacuuaucaacucuaacaccauuuucuacuacucccuucuauagacaaagucagaacaguuguuucuccucuuuccaucaucaucacuauagcugccuuagauuaaaugcuuccuaugugucaggcacuauucugaguguucuguauuaucuuauuuaauucuuaaacagcacagucagcuguagguacugaaacucgggcacaaaaguuaagaaaccuuuuuuucuuuuuucacuuuugugugauuauuuuugggaaaaaaauuuaauuuuauuuuuuggagcuguuuuagauuuauagaaaaccugcaagagcauagagaguucuuauaugcccguucucccuacacaguuuccccuauuauuaacauuuugcauuacugugauacacuuguuaugauugaugaaccaauauugauauauuaauauuaacuaaaguccauaguuuacauuaggauucacucuuugucuccuacaguucugugaauuuugacaaauguauaauauaucauucaguauccuaccauacagucccauacagcauaauuucaucugccuaagaaauguccuauguuccaccuguuugucccuuccacuuuccccuggcaacuuaugaucucuuuagugucuauggguuuuuguuuuuguuuuuuuaauaaccagaaugucauauaguugguaucauaguguauaaccuuuucagacuggcuucuuucacuuaagauucuuucgugucauuuuguggcuugauagcucauuucuuuugaugaaaaauauuccauuguaugaguauacugcaguuuguccauuuauccauuaaagaacaucuuggaugcuuccaauuuuuggcaguuauaauaauguugauauaaagauuuguaugcagguuuuuguguagacauaaguuuucaacuuauuuggauaaauacuuagcagugggauugcuggauuguaugguaagacuggguuuugcuuuguaagaaacugcuggacugucuaccaaagugguuguaccauuuuauauucccaccaacaaugaaggagaguucuguggcucuacauuuuugacagaaauugguggugucaaauuuuuuuguggauuuuaagcuguggauuuacauuuaaaucaaauuuaaauuuaaguuguggauuuuaagcauucuaauagauguguagugguaucucacuacucaucaucguuuuaauuuucaguuuccuaauaacaaaugauguugaacaauuuuucauauguucauuugccaucugaaugucugcuuuggugaggugucauucaguuuuuugccuguuuuauaauuggguuguuucuuacuguuuuuuuguuuuuuguuuuuguuuuguuuuuugagacagagucucacucuguagcucaggcuggagugcaguggcacgaucucagcucaccgcaaccccugccucccagguucaggugauucuccugccucagucucccgaguagcugggauuacaggcaugcgucaccacgcccggcuaauuuuucauauuuuuaguagagauggggguuucaucauauuggucaggcuggucucaaacuccugaccucgugauccgccugccucagccucccaaagugcugggauuacagguaugagccacugcgcccggcccucuuauuguugaguuauaaguucuuugcauauuuuagauacuaguuuaucacauacguguuuugcaaagauuuucuccgagucuguagcuuguuuguucaugcccuuaacagugucuuucacaaagcacagauuuuuaaauuuuaaugaaauccaauuuauugggguuuuucuuggauugucuuugauguuauauuuaaaagucgucaccaaacucaagaucaccuagauuuuuuccucuguuaucuucuguaaauauuauaguuuugcauuuauauuuaggucugcgauccauuuugaguuaacauauuuuugaaagguauaagaucugugucuagauuauuuauuuugcauguagauagauaaccaguuguucaaguacugcucaacuuguugaaguucaaugaagucuugaacguaacugucaaguugaagacuaucuuuucuccauugaauuacuucugugcucuguuuuaaaagaucaguucacuguauuuguaugggucuguaucuggacuguccuguccuugaucuuucugucuguucuucugccaauggcauacaaucuugauuacuguagcuuuaaaguaagguguguuguuuuuuguuuguuuucuuguuuguuuguuuugagacaaggucucgcucugucacccagacuggagugcaguggcacgaucucggcucacugcgacgucugccucccagguucagcuauucuccugccuccgccuccugaguagcugggacuacagacagugccaucaugcccagcuaauuuuuguauuuuuaguagagacagcguuucacuaacacugucuguuuguuggccaggcuggucucaaacuccugaccuaaggugaucugccugccucagccucccaaagugcugggauuacaggcgugagccaccuuuacaguaaguuuugaaauuggauagugucagucuuuugacuuuuuuccuuuuuuucuucaauauuauauucauuauuauggguuuccugccuuucuguauaaacuuuaaaaucaguuugucaauauucacaaaauuaauuacugggauuuucauugagacuauauugaaauuuauguaggucaaguugggaagcacuuguauuuuaacaguauugacucuuccugucaauucuugggcuaucucucuauaucuuauuuauauguuacuuauauuuauuuauauuaauacauauuuauauaguuuauauuuuauuuauauucuauuuauuuauaucuucuuucauugguauuuuauaguuuuccucauauaaaucuuguauauauuuuguuagacuuauacuuaaggguuuuuuuccagugcuaauauaaaugguguuguguuuuaguuucaaauuacauuugcucauuacugguauauaggaaagcaauuaauugacuuuuguauauuaagaaauccugcauccugcaaccaugcuauaaucacauauuaguuccaguggauuuuguguguuauuuagaaguguguuguuuaaucuucacauacucugagauuuuucagcuagcuuucuguuguugaguucuaauuccauugugaucugaaagcauacuuuauaugauaccuauuauuucaaauuuaagguuuuaugacccagaauguugucuaacuugguuaauaguccaugagaaccugagaauaauauauaaaguucaaaacagguuucacuggacccaaaucagaaugucugcagggcugcguuuacuuuggaggcucuagggagaauauauucccuugcguuucccaguuucuagaggccgccaccuucccaaguagcugggguuacagacacgcgccaccgcgcccagccaauuuuuuguauuuuuaguagagaugggguuucgccauguuggccaggcuaaucuggaacuccugaccucaggugauccacccgcuuccacuucccaaauugcuaagcuaacaggugugagacaccgcacccggccacuaaacagaauuuguuaucugaucaugauucaaacaaagaaucuaaaguuaggggcucagaaacuuuuuucuuccaacaaauaaaugaacaaagucauugauaugucuucccuagccuuuguucuuauucucaucucuagucugauguccuuugaguagacugccuuacacugacaaaugccaugccaaacuucuauauucaguaauguaguuuguuaauguuuuccuucucauucagguauugucagcagaucucauggauagagguuuaaauggccucugguaauagugacaaugcaagggcgagaaagguuccgcuuucuuuuuugugucucucuuuuagaugucagcaucauaauucugccaacucaguuagcuaaguauuuggcuaguuauuuucauucucagcuaaccagaauguguuuuaccuuuuagguuuaccgacaagacugugaaacuuucgggaugguggugaaaaugcugauugaaaaagauccuucauuagaaaagucuauacaguuugcauugaggcagaauuuacaugaaauaggugagcgguguguugaagaacucaagcauuucauugcagaguaugauacuuccacucaagauuuuggagagccuuuuuagauuuuucugcucaggcuaaaaaaaaaaaaaaacaguuucuaaaaauuuuuuuuccuggauuguguaaauccuuaauauauggaauuuuugugaugcagagaaauacuuuaugauaguugacaacauuucaguauuaaauaaacaucuaaaauagucuguuuaaaauguuugauucaaauuuuuguauuuuuuguagagaugggguucaccauguuggccaggcuagucucuaacuccuggccucaagugaucugccugccucagccucucaaaguguugagauuacaggcgugagccaccgcucccugcccaacacauauaccaucugaaaauguuagaauucugaguugugauuuuauugacuuguugcuugcuuuuucuuaggcuuuguaacuuguaauauguuaaaguguacuauccuaauaaacugaauacuuugguaucuuagagaauauuugcuuugagaguaauucucauucaaugauaaaauagagcacuuaaaucucugagagauaccucagaaaaaaauccguuuuuccaaguaaugaacucagugucuucuauuacaauaauccugaaacuccugacucucucacugauguaugagucuuaaauaauaucauauacaagacuaauaaauagaagaugcaguuugagguggaaggugagggauauuuuaaguuucggacuguaggaaaucagucagggugguaggagaagcuauaaggaaagacgcaaaccuucuuggaaggcugggagguuuugcaaagcuucagagagaauaaagcugaaggcagcuaauucucuuaccccgaggcugagggcgaagaguagguaacaagguaguguaaagaaauuuaucuagauaaguuuguuuacauauguccuccagaaaccaacccuugaucagugcaagacugcucccugcaaaggggggcgacaauguucauuacucacaaauuguguuggcuucaggccuuuggcguucugucuguaccgaauaaauacaagcggcuccagcuuaucaggacugcacucucuuuugggcugcgcuaaagccggcaguccccuagccauucuuacacaaaauaccugcgucugaauacuccuuucauccggucgcucggccagagucugcaggacagacuuggcagcagguacccccugugaggaacacugaaauggaucacgacggaacccccgaaaacgaaggcgaagagacugcgcagucaguaagucauuggugcccgcucgggauuuccaaguucaggggaauucucaagcuaggguuucaucaugggacaacagcuauccacacaacagaaacaguauauaaaaguauugaaacaacugcuuaaagcuagcagagccucgguuucgcaggcucaauuaagggacccagugcaaacuguuguuucccauaacccaugguccccagaagaaggcacgcuggaccuagagcuuugggaaaaaguggggagaaaucuuaaacgauaucaugcacaagggcaaugggucccaguaaaaucuuuaacguuaugggccuuaguuaaggcuacuuuggccuugcucuacacagaagagccuaagaagggaaaggaggaggaaccaucaccuuaucgccuccucuuccucccucaguccugccguuaccagauaaagauaccaaagaggaaacggagguuuucccugagcccccucccccaauaaauuggaaaaaagacaacagauacacuacagcuaugggacccuguuuuaggcaagcggcauuagaaggggaccucuuggccugcccagugauacaaaauugacaaggcaaucaaguauaugaacccauuacuuuuuaugcuuauaaagagauaagaaaaagcauuagagaaaauggagcugcuaguagcccauuuacgaaaggauuaauuaaggccauagcagacaacuuccauauaacccuauaggacuggucagugcuagcuaaaacaauuuuagaggccagucaguaccuccccuggaggacagaauuugaugaauuauauaaacagcaaaccucuuucuaguaguagaacacuggccuuuaaagggagagaaauuacaacugagccaguaaauuaguugagcaauuaaaagccggccauauagaaccaucaaacagcccuuggaauuugcccauuuucgucauucccaaaaggucuggcaaauggagacuuuugcauggcuuacaagcuaucaaugcuaauuugcaaucuauggggccccuucaacaggcucccuucccccgcagcaguuucucaagauuggccuauaguuguuacugacuuaaaagacugcuuuuauacuauuccccuugcagaacaggacagagaaaaauuugcauuuacaauaccagcuaucaacaaugaaaggcuagcucaccuauuuuauuagaaaguacuuucucaagcaaugcugaacaguccuaccaugugucaguauuauguaaaucaggcuuugcuccccaggagaaaagaauauccuaguugcaagauuauucauuuuauggaugauauuuuacuagcagcuccaauggagccaguacuuuugaguuuauaugccucugucauaaggaauacacaguuaagagguuuaaucauagcaccugaaaaaguacagauguccucaccuuagaaauaucuuuacauacuaacuuccuggucaauaagaccucaaaagguuaaauuaaauacuagcaacuaacauaccuuaaauaauuaucaaaaauugcuaggcgauauuaacuaucuuugccccaccuugggcauaacuacugauaaauuacagaaccuguuuucuauccuaaaaggcaguauagcccuagacucuccuagguauuuaacccccacagcaaaaagagaaauugaggaaaucaagcuauuucucagaggcaacuagaucacauagacccacaauacucaguccaauuguuuguucuuccuauuaaacauuuccccuacaggauuaauaggacagauggccccagggcugcacuuccuagaauagguuuuuugcucacauaccaggacuaaaacacuaucucccuauauccagcuaguuaguaaagucaucuauacagacagcggaugaugccaucaguugcuagguuaugacccugaugucauaagaauucccuugaguaaaaaacaauuugaagcagucuugccccuaucucuagaccuucagauagcacucucugauuaugcaggccauauaaaacaugcccuuccugcugacaaacuacuucaguucuuaucuaguacuucuguaguuauuccuacaaagguaguuuccucccccauaccuaacgcuguaaugcuuuuuaccgauggcucucguaaaaauggaaaagcggcuaucugguggaaaccacauaacucccucacuccaucgagauuuacuaguacucagagagcugagguuggagcccuaauauuggcccuagaaacuuuuucuguucagcccaucaauauuguuagugacucugcuuacucuguuuauuuauugcagaaccuugaaacagcccucauuaagucuacucucgagccggcccugugugccuuuuuucuuugacuucaguaauugcuaaaucaauguacacauucuauuuuuaucacacauauuugagcccacagcucacugccugacccacuggcuuauggcaaugaucaagcagaccugcagguuaugaugucacugcuuaaccaagccacccaaucacaucaauuuuuccaccaaaauuagagaaacuuaacuaaacaaugucaacuuacccagagacuagcuaaacaaauuauccugcaaugcccagauugccagcucacaggcacguccccuccuucaacagguguuaacccuagaggacuagaaccuaaucaguuauggcaaacagauguuacacaugucccugaauuuggaaaacuaagauauauacauguauccguugacaccuauucucaccuaauuagcgcacaugcucuuccuggaaaguccaccccaucugucauuaaacaucuuuuaacuuuuauguuuauggggcagcccacaaaaauuaaaacuuaauaaugguccggcuuaugccagcucacucaacaauuuugucacacuuggagcguccaacauuccacaggcaucccguacaacccccaaggacaggccguaguagaacgugcccacuucacccuuaaaaauaugcucagaaaacaauggagaauaugaguaaagacccugcaacacuacuagcacaagccuuacuuacccuuaauuucugaaauuuagaugauaaauuucagucagcuauagaaaagcacuuugcuaaaaccucuccagacauaaaacugcaguuuuauggaaagauguaaauaguaauauauggcaugguccaaauguuuugcuaacauggggaagaggauaugcuuguguucacauccccucaggcccucuuuggauuccagcacgacgcaucaaaccauaccauaguggggcuaggacccaaccaaguaccagaaaugaaggaaacgacccugcaggccccgcagcccccgcaggccccgcagccccugcagccccggaagaaacggguucgucggacgacacagcuucgucggacgacaggagccccagacauuaccugggggaugcugaagaagacaacucaggaggcugagaggauccugcuccgaacacagacaccauucacuccagaaaauuuguuccuugcuaugcucucuguuguacauugcaacucacgcaagguauugguccuuuuuauucucucacuuugccuguuacccguaccuacuauacccuauuaagcccauuuucuaaaucugccuuuuuucagcccuauucccuucccagcgucuagcagugugacuuuuuagcuaggagggacuaacauacccccagugggguuccucaguaacagccauauggaaggauaugcaaaaaaaaaucucuccuagaaagacccccacuccugggggucgcuucuuaguuagaaaagaauauuacuaauuauacucauguuugucucuuguuguuuacuaauucuaggauguaaagccagaaaacaagcaguaacugcuaugccugacaaaacuguugcugcacacaucuguacucgucaaucaacaaaaccugaugcaaaaaacagaaaaggggugauguaggagauggucagguugguaggagaagcuauaaggaaagacgcaauuggaaggucgggagguuuuccaaagcuucaggagagaauaaagcugaaggcagcuuuauuaauuaauucucuuacccugaggcugagggcgaacaguagguagcaagggaguguaaaggaauuuaucuagauaaguuuguuuacuuaugcccuccggaaaucaugcaagacugcucccugcaaaggggggcgacaauguucauuacucacaaauuguguuggcuucaggccuuugguauucugucucuacugaauaaauacaaaugguuccagccuaucaggacugcacucucuucucggcugcacuaaagcuggcacucccccagccguucucaugcaaaauaccugugucagaauacuccuuucauccaucacucagccagagucuucaggacagacuccgcaugggacuuguccaaaaaaacucuaaucaaaagaggaaaauuuuggaauaugccaggaauaguggaauuuuauuuuuuaaauuuuuuuauaggcccauaugcucuaucucaagaaacaagaugauuguaacauguccaugauuaaacuauuggcagauuauugcuguguuaaucucuguagucuaaugaguucuuuguucuguucugcugccuuuuacguuuucuuguccuuucaaaaguguucuugaaagaaacaaagcgaauaggcaguuagcacagcacagcuaccccuuaccaagcagucuauggaaacaaccccucauccaaaucauggguuaguuaagaaucuaacuggggcaauuaagaugaauuccacucacuuccuggucacuucagcagcccagcggcauugagccaaaauauacaauucuguguuauuagugaggaaacuuuaaaacucauguuuguuauuacuuacuacccaauuucauuauccucccuuccucuuuccauuucuauucucucucacuugaauucuggcauuauuuuuaguggccucuacugauaauaccuacccuagaguacauaaaaauuauauuaaaagaggaaguagcaguaugcauaauuuuaacagauucuauaaugggugccucaaaauauguauugugccauuccgcaaauuuaaaagcuaauugaggacaauuuuuuuuuaauuuccuaaaugagaccaccuuggauuuuuauuuuugccauuuagauguuuauacuuauuuagcuuuuauaaaacauaagccaagcuaaaucccacauaacaacucugguauucuucccucauaugagcagugauuuuauuuguuacccaccuuagauagacuaagaaaguucuagucuuguuucuccuucuccccgcuucccugggguuuuuccuuaccauaaguauucugguccgaggguucaguuccuuuagucaagaugucacaaguuuaaaaacaaaacuugagaaacuaccaaaggcucaggaguuguccacuuuguugaaauccauuaaauuagagaagucucacuaacagauguauuuaaauauagguacaacaaauaauuucuuuuucuccccuuccccaaauuacagucagcauuuaaagcuguuuauggcuugccaucagcauuauucugguaggcuuguuaguguuaaaaucuauuugauuuuuuuuuuuuuuuuuugccucuuaaagucuaauuuuaggauggaugaauucagauguuuaccagaguguguauuuuacauaauguucuugauuaaaaagacuuguuuguaaauuauccguuguuuuugcauaugcccaguugaugugauaaaauuuucauugucuugccauauaaagccuugguuaucaacagguggaauguagauauuguaaagcuuuuugugaauuaaaagugcaaaauaaagcaaccacauuuaagu

SEQ ID NO: 192577 - RNA, 29041 nt, Homo sapiens
gagccgcuggcgccacuagagaagggcgagcggcgcggcagagugcggcgcagcgcagcuccugagguaagauggcggugcucuuuccucuaagcucuugcgguugggcugcuauuucgcucuuuuugucagcucagagcugcuacuccgccucaaagcagugucagagucagucuccuuccugcaggcuuccaggagccaggaucuccggugacuggagccguaggacaaaauggcgcucgcauaggcuuccgaggccaggcccagucgugcgcucugaggcaggccgggacaaaggcggcgugcggggaggcggcguggccgccgcguggggcugguguugucgcuucccuucgugcugcagcugugcgaguccugaagauacauucagcguggugugguucgggguggggccgggcauggagggacacgcuaaagggaggcaaagccacagaugccuguggagacuuggggagggcggcggggacuuacggagcguaccuuacggggacgacuucugcauguccuuuggaaacuguccgcgcgaucuguguggagcaggaauuuucgggaaggguaagggcuuuuuggucuuucguuugaccccgcagguuuugguuaugaacaggauucggauucacgucuugccaaccaaucgggggaggaucacuccagugcccaggucucaggaaccucugucuugugcauucacucaucguccaugcucucacccucgucuggaggggcaggaguuuugcauuaagcauauccuugaagacaagaaugcacccuucaagcaguguaguuauauaucgacgaagaauggaaaaagaugucccaaugcugccccaaagccagagaagaaagauggguauauauguauagauauauaugucguuuuucuuaaagcgaggggguaugugauaugaugcgggcuucagcauagcugccgcguuugagauuuuguccuuguaaauuugggguuaugguuguauccuuggaaaacugaaaaaacggugaagacuggaaagacccuugaguuggauuacuuaguucaccucuuugguucuuuucccuuaucuguaaaauaaaggcauauucuaaauuagucuuuuuuuuuuuuuuuuuuuuuuuaagagagauggggucuugcuauuuugaccaggccggucucaaacuccuggccucaagguauccucccaucucggccucccagagugcugggauuacaggcgugagcgaccgcgcccggcccuaaaguuaauuuuuuggcgggggggcggcgcacagauucuugcuuuauuccccaggcuggagugcaguggagaucucggcucacugcaaccuccuccuuccagguucaagcgauucuccugccuccuaaguaguugggacuuaaggcgugcgccacuaugcccggcuaauuuuuguacuuuuuaguagagacgggguuucaccauguuggccaggcuuguuuugaacugcugaccucaggugauccauccgccucggccucccagaguguugggauuacaggagugagccaccgcaccuggccccuaaaauucuucuuaauggagggguguguggcucuauuuggcuguccaugaauuuuguuaaauaacaugcaaaguuauauauguguguauucuucuguaagaggcuucauaguuuucaucauguaugcaaagguauccaugcaaaaacauaaccugacuagauaauuuuuuacguaucuuauaguuuuaaaauugugucccuggcuggucgcaguggcucaugccuguaaucccagcacuuugggaggccacgggaggaggaucacuugaggccaggaguuggagaccaacccaggcaauacagugagaccccgucucuacagaagauuaaaaaacucgcugggcauaguggcguggacauguaguccccacuacuugggaggcugaggugggaggaucacuugagccugggaguuccagaccagacuuggcaacauagacuucguuucuacaaaaaacuaaaaaaaauuugcugggcacaguggugcaugccuauaguucuagcuacuuugaggcugaggcaggaggaucgcuugaaccaagcaguuuaaggcuacagugaacuaugauugcaccacugcacuuuagccugggcaacagagcaagacccaaucccuugccucagccucccaaagugcugggauuacaagggugaaccacuucauccguccuguuauuucccuuuaauaaagucaaaugaguugaccuugggccaguuaaauuccucugacuugcauuuuuagaaaugaauguaauagucauuuuaauucccuaaaaaugauuuaaagauuagggacugugaacauuauugaacgcuuucaagaaggaacuuauaaaauauuaauguuuugucucuucaggguguccuucugugcugaacauguccguaggaaugcccuggcacuucaugcucaaaugaagaagaccaacccagggccugugggugaaacacuccugugccagcugagcucauaugcuaagacagagcuggggucucagacuccagaaaguagucgcagugaagccagccgaauacuagguaaggaccuucucuccuggaaugaaaaaggaggaagaaaguuaagggggaacuauuuuggguuagcacaaugccuugaucuauuuggcaauauuguuaauucaucaggaauuuggugagaaugcugggauugcuuuguuguuuaccaguucuuuugaauuugaaguuguguuugccuagguuuacuuuccugaguuggugaccauuucuuucauugcuuuuuuaaugcucagcagcuuuguuagguaauuucaggaaacaguaauuuuaaguugauuuuucuguuugagagggcaugguuuacucauuuauguuguaaguaaucuuacuuggguuguauuuucuuaaagcguuuuuauuugccaguaccuuuguacuaaguguuuuuuuuuuuguuuuguuuuuaaaauuucaagguuuggguugauaaaaguaaucuaguuuugugugguggaguuacagaggugggaagucuuaauggcugcucucccuuccuugccucagaugaagacagcuggagugauggggagcaggaacccauuacuguggaucagacauggagaggugacccugacagugaagcugauagcauagacagugaucaagaagauccccuaaaguaaguuguaacuccacauaaggcauuugaaauguaguuaguauguggaauguagugcugcaugcuguuaauaaauuaguaaccuaggaggguugaagacagcuauuugucagcaguaagagguucuguauauaaaaguggcaugguucauugucgucuugcuucaaggcaggaugauucuuuuuuagaagccuuguaauuuaaaaaaaguuugaacaccaaauucuacguaugagaaaguauaggggagaaaacaggaaauuuagacaugggagugugggagguggauugagaaauggucagaccaguuuagagaagagaaaaugguugugaaugggugcuuggccuaaaccucaggaauaaugugauuguaguugaauacuucugcaaaaugucguguuuaugggauuuauaaauuuuuuaaaguuauauauuguuuuaaauugacaauuguacaauguaugggguacagugugauguuuggauacuuguaaaccuugugucaugaucaaaucaggguaauuagcauauucaucagcucaagcauuuaguguuuuuuuguguguggauuuuuuuuuuaaaaagaagaauaaaaagguauucaagaguuugguuucaugccuaagaaagagaaaccgauuuagaaacccaaaagugauuauaucuuaaucagguuuauaucuuaguaagcuucugcucuucacuuaacccaucaucaccguaggaguuguagaagcauaaaaacauuaccacucuggagucucauauuucugugucucaaggucuggguguaguuuuuaaaaauguuugccugcugacuucugugucuuaacacuuuguacugacaguuuauguaaagggacuguaaauaguggaagggguaauuucuagauugacuauugggcuuuuguucuugcaauagcauuuucuucauuacuuuggauucuuugguuuauaagaagucauuuaggguuacauuuucuccugacccugcuuagcuucugagaucagaggagguugggcauguuccggauaguauggccguauguuaggguuacguuuucugaguagaauaauuucauccauuucuauugaguaaucucacuguggucaacuauucaggaaguacuaguuuagaaaacccaucuaaguaguuggaaagggaaugacuguucucuugcaggauucucucacaaauaguaacuuaaaccaacauauucauuccuuuuuuuuuuuuuuuuuuuuuuuuuugagauggagucuugcacugucacccaggcuggagugcaguggcaugaucucaguucacugcaaccuccgccucccagguucaagcaauucuccugccucagccucccucccaaguagcugggauuauaggcacccaccaccacacccagguaauuuuuuguauuuuuaguagagaugggguuucaccauguuggccaggcuggucucgaauuccugaccucgugauucaccugccucggccucccaaagugcugggauuacaggcaugagccaucaggcccagcuucauuccuuuuuuuuccauugugguucuagauggccaaacuugcugcuuugaagagauguaugcucucuaggguuacaaagggagugucguuuggugugguaaacacucagcuuaaggucgagaaacuugauuuuguuaguaaucuagaguggaucagucucuaggaggcacauggaugcugauuuaacuuacaggaggcugcuguauaaaccaaaauaccaggucauuuuaugagaaauacaaauguggaaaguacuaggcaguugaugucacucucuccuagaggaaacauguucagaagagaaaauaaagccccaaauauggucagcuauuaggcaacuaaguauaaggcuuucguuaauuuuccucagugagauuauuuuuuaaaaaaauuuagacccacuaaauuuaugcauuuuuaggcauguaaauagaguuguucagugucuccuuaugauuacauauuacuaucuucuuauauuuaauaauauaguaauuuaguaguauguccacugaguaaaauucuuuucauuaagaauuuuuaucuuagggcaccagugucuuugucaucaauaggaucacuuuuugaaucaucuaauaguuuaaccacauuuaucuucaauugcuuguuacacaaagggcaauuuuauauuguuuaugauguugcuagagacuugauccuaacuagaauauuguuggcauagauuuuuuaaacuuccuguuaguauauauaugauuucccucaaaguaaccacuuacuuaauuguuuuguuaaaaguaaagcuuguuuauggccaggcguagugacuuacgcauguaauccucgcacuuuuuuuuuuugacacgaaguuucacucuugucacccaggcuggagugcaauggugcgaucucagcucacugcaaccuccgccucccggguucaaaugauuuuccugccucagccucccgaguagcugggauuacaggugcccgccaccacacccagcugauuuuuguguuuuuaguagagacgggguuucuccauguuggcaggcuggucuugaacuccugaucugaggugaucugcccgucagccucccaaagugcugggauuacagggacgaaccagugcgcccagugauccuagcacuuugggaggucgaggugggaggauugcuugagcccaggaguucgagaccagccugggcaacauagggagacaccgucucuacgaaagauuuaaaaauuagccagacgugguggugcacguggucuguagucuuaacuacucgagaggcucaaguaggaggauggcuugagccugggagguugaggcucugugaucgugccacugcauuccagucugggcaacagagggagacccuaucucauacacacagaaaaaauaaauaaaagcuugucuacaacaucuaauacuuaagaaauuuuauccuuaagguaauuguuaaauuuucauuucccuuuuuuaaauaauaauuguaucauaugaccucuauaaacaucuauaacuuguuuggcugaagguuauuucacauuauugaaucuucaucauuguuuuccaaauaaauuuggagaaugcccuuuauaagagagacuauuuaguagaauauaaggugagacccucuuuuuugaagaugaaugcuaauaauaaaaccuugacuuuaauuugugcauaccagagcaaggggaauuaguacauaauuuuaauguccggcucugaaagucuggcgcauucaucuuuaaguaaaugagccaucuguuacaugaaccagccggcauucauuuaguagguugcuuacugcccccaccaaaugauuucuaauaacuucuaauaguaauggcuucagauagguacauuucaguuccagaccauugguuaaauucucuucugacagggugcagugaaauuaauuuuuuaaaacaauuuuuauuuuucucauuuucaguauucaaaaagugaauuucauuuuaacaaacucuauauuagguuaaggccucaguauuuuagguuacagacagguuaauguaggcauaacccauuuuucugaagauguaacuuagucaccuugugaaaccguuauguauuuauuuuugagacggacucucacucuguugccaggcuggagcgcaguggcacgaucucagcucacugcaaccuuugccuccuggguucaagcaauucuucugccucagccucccuaguagcugggacuacaggcgcacgccgcugugcccggcuaauuucuuucuuuuuuuuguauuuuaguagagaugggguuucaccauguugcccaggcuggucucaaacuccagagcucaggcaguaugcccaccucggucucccaaagugcuagaauuacaggcuugagccaccgugcccagccaacuguuacauauuuuuaaagccuuuucacauuuucugauagucuguuagcuuuugucauuucuguaauuugcugguuuuauuuuauuuuauuuauuuuuaaauuuauuuuuuauuaauuuuauuuuauuauauauuauuuuuauuuauuuauuuaauuuguuuauuuuauuuaauuuuuuauuuuuggagacagagucucguucugucgcccaggcuggagcgcgguggugcgaucucggcucacuguaaucucugccuaccagguucaagugauucuccugccucagccucccgaguagcugggauuauaggugcuugccaccauaccuggcuaauuuuuguauuuuuaguagagaggcuguuuugccauguuggccaggcuggucucgaacuccugaccucaagugauccacccaccuuggccuugugcaccacaccuggcccuuugcugguuuuauuaaccauguuuugauuuuucuuaauuucuuuucacuuuuacuucagaauauaguuaaguaccucuuauacacagguaauauuggcuuuuguuuauauuuaugaagaaauuuuggcagaaauuacuugcucucaguccuaaaguuaauuuuguauauucuguguauuucagugccuuaacagcuaguuuuuaaaaauaaagcagaggcuggccacaguggcucacgccuguaauccuagcacuuugggaggccgagucggguggaaugccugaacucaggaguuugagaccagccugggaaacauggugaaaccccaucucuacuaaaaauacaaaaaauaaaaaaauuagccaggugugguggcacacgccugcaaucucaacuacuguggaggcugaggcacgagaauugcuugaacccgggaggcggagguugcagugagccaacauugugccacuucagugcagccugggaaacagagcaagacucugucuuaaaaacgaaaaaguaauaaagcauaauuuuuugacuuaaaauuaguauaauuuauguguuuugccuuuucaauaaaauuuuuacucaguaugaaacuuaagguauauagcuuguucuuuguauuuauguaaugaucagacggugagugaaacaaaauuuuuaaaauucaaaguuauucacuuauuuauuuauuuauuuauuuauuuuugagacauggucuugcucugucacccagguuggagugcaguggcgccaucucagcucacugcagccucccacucccaggcugaagugauccuuucaccucagucuccugaguaucugggacuacagguauacaccaccgugcccagcuaacuuuuguauuuuuuguauugacaggguuuuaucauguuacagcccaggcuggucuugaacucccaggcucaagcaaucugccugccucggccucccaaagugcugggauuacaggcgugagcuaucacaccuggccucaucucuuaauuuugauugcauaaaucagagccagagaacagucuaccauauauuaaucacuagcaaaacuuuuagaaguucuuuuuuuuuuuuuuucuuuuuuugagauggagucuugcucugucacccaggcuggaaugcaguggcacgaucucagcucacugcaaccucugccucccggguucaagcaauucuccugccccagccucccgaguagcugggauuauaggcgcccaccaccauaccugguugauuuucguauuuucaguagagacgggguuucgccauguuggccaggcuggucuugaacaccugaccucaggugauucgccugccuuggccucccaaggugcuaggauuacaggugugagccaccgugccuggccagauauucuuuuaguuuauaauuggcagcaaagcuuaaucaaguugauauggauccgugccagaucuuuggcaauuaaggguuaaccuaggguacugaauuuugagaauauugucaagaaaauuagcugaggacaggguauagcccauuuugacuaguuauuugaggguccauaugagcuccaauauaggccuauauuuuuuaaacaauuacaaauuuuggcugggcacaguggcucaugccuguaaucccaccacuuugggaggccgaggcuggaagaucgaucugaggucaggaguuaagaccagccugaccaacauggagaaaccccaucucuacugaaaauauaaaaauuagcugggcguggugguaggugccuguaaugccagcuacuugggaggcugagacaggagaaucacuugaaccugggaagcggagguugcagugagccaagguugugccacugcacuccagccugggugacagagcaagacugucucaaaaaaaaaaauuauuugauguugguaucuuuagugcuuuaauuaaaauauauugccaggugcaguagcuuaugcguuuaauuccagcacuuugugaggcugaggcgggagcaucgcuuaaacccagggguucaagccuggacaacauggugaaaucccaucucuacaaaaaauacaaaaauuaaccaagugggguggugcacaccuguagucccagcuacucggcaggcugacgugggaggaucgcuugagcccaggaagcaaagguuauagugagcugugauugauugcaccacugcacuccauccugggugacaagagugagaccuuaucucaaaaaaaaaauauauauauauauauauauauauacguauauauauauauacauguauauauauauacguauauauacauguauauauguauaugugaaagauacauguuaauugaacacuuuaaagcugucuugacugguaagugaugauuucauaucaaaacauuaagaauguagauuaauaaaaguuuaaaguguuccgcauguucacuuucuuuucaacauaaugcaaauagcugggaaaaauaagacauuucuccuucccccauuuugggaaaucacagauuaguauucuuucuuggagauuuucucuuuuguuuuauuuaauaacaacuugaaugguacaauguuuugcaaaaacauuaaggugauuaugucaccacuuguuaaauaacaaacuuagucugacaucucuacucuuucaaacuuggguuuuauuauuauuguuuucuuaugcuuugcugaauucuguuuuauuccagacaugcuggugucuacacagcagaagaaguggcccugauuaugcgugaaaagcuaauucguuugcagucguuguauauugaucaguuuaaacgacuucagcaucugcucaaggagaagaagcgccgauacuuacauaaucgcaaaguggaacaugaagcucuaggcaaguuuuaugccaguuccaacaagcuguuguggguuuaacaugugaauuugguaguacagucaugugucacuuaaugauggggauacauacuuuguuaggugauuuuugucauucaaacuucauggagugacucacgcuaacguaggugguauagccugcaacauaccuaggcugcaaaccuguacaagcauguuacuguacugaauacugugggcaguuguaacagugguauuuguguaccuaaacacaucuaaacagagaaaagguacaguuaaauuauggcauaaaagauuuuaaaaaugggcacuuagcaugaauggagcuuguaggacuggaaguuauuuugggcgagugagugaguggugagucaaugggaaggccuagcacauuauuauuuacuacuuuagacguuauaaguacuguacacuuaagcuguacuaaauuuauaaaaaaaguuucuucaauaauaaauuaacccuuagcuuacuguaacuuuuuuacuuucauuuuuuuuuuuuuuuaauugagacggacauggagucucacucuguugcccaggcuggagugcaguggcaugaucucagcucacugcaaccucugcuuccuagguucaagcaguucucccaccucagccucccaaguagcugggauuacaggcacauuccaccaugcccggcuaauuuuuuuauuuuuaguagaggggggguuuugccauguuggccaggcugcucucggaacuccugacuucaagugaucccccuaccuuggccucccaaagugcugggauuucaggcaugagccacugcgccuggccuauaagcuuuuuuuuaaagagacagaaucuugcugugucacugaggccagagugcaguagcguaguccucacucacugcagccuucaacuccuggacucaggcuauccugccucagccuccugaguaacuaggacuacagaugcaccaccacacucagcuaauuuuuaaauuuuuguagagacagggucucgcuauguugcccagguuagucuugaacuccugggcucaagugauccuccgaccguggcuucccaaagugcugggauugauuacaggcaugagccacugcaccuggccuuuauaaacuuaaaaaaauuuuuaagaaaaacuucuggacucuguaauaacacuuagcuuaaaacacaaacacuguacagcuguacaaaaauuuuuuuuauaucccuauaagcuuuucuaguuuuaauuaaaaaaaaauccuuuuaaacuucuguuaaaaacuaagaugcaaacacguacauuagccuaggccuacaugggccuagugucacugucuuucaccuccacaucuugucccaguggaaggucuucggggacaaucucaugcagcgaacugucaucucaugauaacaaugucuucugcaauacuuucugagagaacugccugaggcuguuuuacauuuaacuuuuuuuuuuuaauaaauagaguggaguacauucuaaggauaaauauaguaaauauauaaaccaguaacauaguuguuuauuaucgaguauuagguacugugcauaauuguaggugcuagauuuuuuuuuuuuuuuuugugauauagucucacucugucgccaggcuggagugcagugugugaucuuggcucacugcaaccuccaccucccggguucaagcgauucuccugccucagccuccugaguaacugggacuauaggcgcaugccaccacgcccagcuaauuuuuguauuuuuaguagagaugggguuucaccauguuggccaggauguucucaaucuccugaucuggugaucugcccgccuugggcucccaaaaagugcugggauuacaggugugagccacuguguccagccugugcuagacuuguauauaacuggcagugcaguagguuuggucaccagcaucaccacaaauguguggguugaacuaugaugucacuaggcaauaagaauuuuucagcuuuggccgggugcgguggcucaugccuguaaucccagcacuuugggaggccaaggcaggcggaucaugaggucaggagaucgagaccacaaugaaacccugucucuacuaaaaauacaaaaaaaaaauuagccgggcgugguggcgggcaccuguagucccagcuacucaggaggcugaggcaggagaauggcgugaaccuggggggcggagcuugcagugagccaagauugcgccacugcacuccagccuggacaacagagcgagacugugccucaaaaaaaaaaaaaauuuuuuuuccagcuuuguuauaaucuuaugggaccaccauaguauguauggucaaugauugauuaaaaagugguuauauagugcaugacuauaauuagauuuauuucugucuugguaccuggauugggggucauuugcuuuugaaacugccuaucuuaugcccaaggauuuuccuguuuacuuguugacuuggagacguaaccuugauggauugcuuggcaaauaacaucuugacucuuguaacucuaggcaguagucuccugacuggcccagagggacuuuuggccaaagaacgagagaacuuaaagcgauuaaaaugucugcgacgauaccgccagcgcuauggaguggaagccuuacugcauaggcaguugaaggaacggagaaugcuggccacagauggugcugcccaacagguaauuuguguguauaccuuuaagguauauacguucacuuuauuuauuguuuuuauuuuuucgagacggagucucgcacugucacucgggcuggagugcaguggugcgaugucggcucacugagaucucucaaccucugccucccaguuucaagcaauucuccugccucagccucccgaguagcugggauuacaggugcccaccaccaugcgcccagcuaauguuuuuguauuuuuugggguuucacuauguuggccaggcuggucuccaaugccugaccucgugaucuacccaccucggccucccaaaguguugggauugcagacaugagccaccgugccuguucauguucacuuuauuuacaaaguuagaguaauugucaaaacacuauguccagucuuuuuuugagacagaguuucaaucuuguugcccaggcuggagugcaauggcgccgucuuggcucaccgcagcauccaccuccuggguucaagugauucuccucccucagccuccugaguagcuaggauuacaggcaugugccaccaugucuggcugauuuuguauuuuuaguagagacgggguuucuccauguuggucaggcuggucuugaacucccuauguccagucuuggaucugaaaucugacuuuuugcacauggguuauagugaaagcacuuagcuugaagucaggagacauggauucuagugugaguccccacugaccagcucugugucugcacaguuagcuuaaauuuucugggccucaguauucucaucugcauauugaguaguugggaaaaguuucuaaguccuugguucagauauucuucaguucagaaauaagcacagguuaauccuaaauugcuugggaaucuuguuuuaaaaggugggaagguagaauaggagcaauugaaugucaggaaguaagguuaauaggaagaagaauuaagugaucauucuuaaauuuguuuuucagacccuuggucucuguuucaguaagaguaauuuuguuucauuuguugagauuccacuuaaggcugcaauuucagaguucuguugguaaaagacaaaauuuguguuaaauaggcuauaucacacuuuuagaauauggagagguguauuugggauugagguugacucauucuuuaugcacuagguuuuaaaguuuuuugucuuuugcauaauauuggugaaucuauuuuuguuaaauguugaauuucuagccuuuaggaugugcuuuucuuauauaacuauuuucaucguaauuguuuguguguucuuuugugggucuauuuuaucugucuuuuuccauuucaggcccauaccacucguuccagucagaggugcuuggccuuuguggaugauguucguuguuccaaucagucucuuccaaugaccagacacugccuuacccguaucuuuuuacucugccuguuaaggcugugguuugcuaguuugaagacuagugggaaucucugugcuaguuugcuuaauugaaggauuuuguuuuccuuuggcccugaaucaaggccagcaguuugcugaagcuguugguuucaagcaggagccuaaagaauugucuuucuauggucuguuggccauuucauaacuuuggaaauguaauggucaauucauuagaaagaaacaugagucguuuuucauagaugugggcuaauauuuauuuauagccuuaauacuugggucccaaaauauacauaaaauauuuguaauugucucaagguuucugauuuaacuugcuuauuaggauccuaaugcuguuaaaucuaauuauaaacuuaaaaaauuacuguggguuuuccaccccaguugaaaggaugauuuugcacugugaacuucuaguauuauccuuuugugugguuagggcccucacuucuguauuuuauuuuauuuuuuauuuuuuggagauggaguuuugcucuagucucccaggcuggagugcaauggcgugaucucggcucacugcaaccuccaccucacugcacccuccgccucccgaguucaagcgauucuccgaguagcugggauuauaggcacguaccacaauaccuggcuaauguuuguauuauuaguagagaugggguuucaccauguuggccaggcuggucucgagcuccugaccucaggugauccacccgccuuggcuucccagaaugcugggauuacaggaguaagccacugugcccggcuuuuauuuuuuuauuuguguuuuuugagacagggucucacacuguuauccaggcuggagugcaguggcucagucauagcucacugcagccuuaacuccugggucaagcaauucuccuaccucagccuucugaauagcugggacuauguaugugugccaccaugccuggcuaauuauuuauuuuauuuuauuauuaauuauauuuuuugaggcagagucucgcugugucgcccaggcuggagugcaguggugugaucucggcucacugcaacuuccaccuccuggguucaagcaauucuugugugucauccuccugaguagcugggauuacaggcacgugccaccacgccuggcuaauuuuuguauuuuuaguagagaugggguuucaccauguuggccagguuggucucaaauuccugaccucaagugaucugccugccucggccucccaaaguguugggauuacaggcaugagccacugcaccuggccuauuuuuuuuuuuuuuauuuuuuguagagucaauuuucaauauguugcccaggcuggucucaaacugcugggcuuaagcagucugccaguccuuuccuccccaaaugcugggcuuacagucaucagccacuguaccuggccuuuauaaacuuaaaaaagaaacuuggcucuuuaaaaaguuuucuuuuuuuaauuuuuuugagacagagucuuacucuguugcccaaguuggagugcaguggcaugaugauggcuuacugccgugaucugcugggcuuaaacgaucuucccaccucagccaccagaguagcugggacuacaggcaugugcuaccacguccagcuaauuuuauuuaauuuuuguagagagguugugucacuauguuucccaggcuggucucgaacuucugagcucaugugauccucccgccucagccucccaaagugcuaggauuacaguugugagccaccaugcccagucucuugacucuuuugugauaacacuuagucacugugccuggccucuaacuugcauacuuuaaacaucauucaaauuagaaguuugcuauuuccaaaaaugagaugcuuuuuuucuucuuuucaauuaauuugccuuugaaccaucauaaugucucuugauucuguuaaaggacuacauuuggcauugggccuucaaacuuuuuugaguuguugauugaauugugaaagugcuuauuuauuauaggcauugagaaaaauuucgcaguaaaagcacuuguuaauuaaauaggauugcuggauuucauuugcuuggcaagaaaugccaaauauuuggaaauuaaaacuuauuuucuuuauuuguuuuuuuugagacagaaucugacucugucacccaggcuggagugcaguaccgugaucucagcuugcugcauccuccacuccccuggguacaagcgauucuccugccucagccucccaaguagcugggauugcaggugccugccaccgugcccagcuaauuuuuguauuuuuaguagagaugggguuucaccguguuagccaggauggucucgaucuccugaccuugugaucugccugccuuggccucccaaagugcugggauuacaggcaugagccacagcgcccggccacuuauuuucuuuaauagggagaggagaaggagaaccucuucuuagucuuuugacaggaagcugauuuuuauuuugcuuauuaaauauuuuacuaauuuauuaauuacaacagaugucugauaagagauuauuguucuuaauauauaaaaugguugugcaaaguaaugaaaaacucuaaagauaaaugcuuacagccuggacaauacaguaagaccucaucucuaaagaaaaagaagaaagaaaaauuaucuggucacgauggcaugugacuguaguccuagcuaccugggaggauuuuuugagccuaggaguuugaagcugaagugaggaucaugccacugcauucuacuuugggugacagaggaaaacccugucucuaaaaaaaaaaaaaaaaaaaaaaaagcgggcgcaguggcucacaccuguaauuccagcacuuugggaggccaagauggguggaucacgaggucaggaguucaagaccagccuggccaagauggugaaaccucaucucuacuaaaaauacaaaaaaaacuagccaggcaugguggcggguuccuguaauccuugcuacuugggaggcugaggcagagaauugcuugaaccugggagguggagguugcagugggaggaguucacgccacugcacuccagccugggcaacagagugagacuccaucucaaaaaaaaaaaaaaaaaaaaaaggccaggugcgguggcucacgccuguaaucccggcacuuugggaggccgaggcgggcagaucacgaggucaggaggucgagaccauccuggcuaacacggcaaaaccccaucucuacuaaaaauacaaaaauuagccgggugcgguggugggcgccuguagucccagcuacugaagaggcugaggugggagaauggcaugaacuugggaggcggagcuugcagugagcugagguuuugcgccacugcacuccagccugggcgacagaugugagacucugugucaaaaaaaaaaaaaaauugcuuaaaacauaauugggcagaggcuaugggcagauuuaaaagaagauagaaaaggcuaauagggccgggcaaaguggcucucaccuguaaucucagcacuuugggaggcugagguggguggaucaccugaggucagggguucgagaccagcuuugccaauauggugaaaccccaucucuacuaaauauacaaaaauuagccaggcguggugaugggcacccguaaucccagcuacucgggaggcugaggcaggagaaucgcuugaacccggaaggcggaggcggugagccgauaucgugccauugcacuccagccugggcgacagagugagacucugucucaaaaaaaaaaaaaaaaaaaaaaggcuaauaguuaaaaguguguaucuucacuauaaauacaguuggccuuugaacaauucaugggguuagggugcugacccccuacacaguugaaaauuuguauauaauuuuugauucucccaaaauuuaacugcuaauagccuuauggcuuacuguugaucagaagccuuaucaacaacauagcuuccuaacacauauuuuauauguuuauaugucuuauauauuguguucuuaaaauaaacuaggaaaaaguguuacuaagaaaaucauaagagaaaauauauuuacuguuuauuaaauggaaguggauuaucauagagguccuuauucucauggucuuuuuguuaaguggagggggaaguguuauugucugugggaugacagaggcagaagaaaaugcacguguaaguagacccgugcaguucaagcuuguguuguuaaaggucaacuguaaauaggaaauaaggaaaauuaaaaaucuauaaaauugauauuuguacauauauuuguuuuaaaauaaaauuuaaaauauacaauuuuucaaaaaugagucagugaauuucaaaaguaggugagaguauggugaaauugacccuucuaaauauugccagugggaauauaaauagauaaaagcuuuuuggaaagcaaucugacaguaauucauauuuccucauaugguaauuuuuaccucugggaauuuauuuuaaggagauaaucaaaugcagaccaauauuuuuacaugaaauauucuuccaacuugagacagccuuaacauuuuuagagcuggagaauagguagauaaauuaaugacacaacauaguguggaauauuuucaggcauuaaauauauuuaacagaauuuaugaaugacagcaaaaugauagugacauuccaggauauggaauucuguacggugucugaaauugcaugaaaccaaauacuggaagggaacaauacagaaaugugauaauuugugcauggugugguugugaaugcccuuuuuucacuguucuuuuauuuuuuguuuuuuuaaggcgagcaugaauuacuuuuauaagggaaaaaacucaguuuacagauacuaaggacuauuuuagauauuauaauacuguagucaaauagcuuauuaaaauauaaauauaaagcaaaauugaaaauguauuugaaaagagaagggaaguauuuuuuuuccuuuuaugcucuuuccuuuccacuccauaguugccuaagucacuuacccuuccuuaaguccuuaucccagagaaagaugcgacugccauuggugaccuguuaacucuuuacuguggucuaauggagacagcacucgacugaaagugaaggacccagacucuaguuguagguuaaccauucccuucuuuuuaccucuuuugccccaucugaaaggaaagcggguggaggaugauggggggaguccuuuuuuaggauauugugguauuaaauacauaagagacuugugaaaguccuuugaauuccaauaaaaaaaaguucuuggccaggcgugguggcucacgccuguaaucccaacacuuugggaggcugaggcgggcugaucaccugaggucaggaguuagagaccagccuggccaacauggcgaaacccugucucuacuagaaguauaaaaaucagccgggugugauggcaggugccuguaaucccagcuacuuuggagucugcggcaggagaaucucuugaacccaggaggcagagguugcagugagccgagaucacgccacugcauucuagccugggugacagagcgagacuucguguaaaaaaaauuucugguugaaacauuuaauggauaauauuuuaaauauuaagagugggcuucuuaagcacauuagauauugcuuagauuuucuuaagcgcauagugcaaaucugaugauucccauuagauucauauguuuauucauuugaucauucaauaaauauuuguuugccuuguacuaucuucuguuucuuuagaguagugguuuucaacugggggccauuuuguuuuccaguuggcaauguguggagaaauuuuugguuguuacaacucagauggaggugcuacugacagcuaguggauagaggccaggaaugcugcuauacauccuucuuccaacaaagauguaccuggccuacaguguugguagugccacaguugucacacccugcuugagaguuuaguuauuuccaaguaugcauugaaagaaauagcuuuauucaaggaaguucauaugguuuuaaaaauuauaauguauguuaguuuuuuuauuuaaaaaaauuaccauaaaaguuuugaguugaaaauuauaacuccauaauucagguacuaucaguuuaagaaaaauuguguuuucugguuaaaaauaagucaaauuuuaaaauaauguuuauuaaucuaggaagauaaccagguaguuaacagauuucaagaaaugguagcacuugcauaaaauguguuuuguaaaguaacuugaauuuuauuguaucuaaucaucucaauuuugguucauccuacagagcuucuuugcuaacuuggaaauauagcccuuuucuucuucuaccuuuaacaaaaguuguuaauagaguccuuggaauguuucuagaauacuuuuuuuuuucaaugggccuucauacacaaaauuuucuucuuccuuuaggaucauaaaaggauuccucuguacuagcacacuccccuaaaaaaaaaaggcauguauauuuaauuucuuguuaggauaugauaccuagugacuuuuacuagagcucuguuucccccuauuccaguggugcuuuaaaugaauuuaucauguaaucaucuuuggaaacgagguccaagaaauuguugcaaacuuugccagucugcuaagggagcagagacauuguaucgcuugacucuuuuggaagggcuguuuaggggcauuuucaaggcuauuugcauuugccacuacauguuucuucugaauauguguguguuccuaggaguguuacugcuacuugcuuaagggagaaugggauggugucuaguuuaaaugaccaggauccugaaaaggagguuggggacaaguuuuaaauuacugguagagcuagaauuugaugcuaguaaaugacauuuauuuugagaaguaacuuuaaaaauugcuaacugcauuugguauucuguaucaaauguaguuguaauuuaucuuauauaguccacaccuugaguuuuauguggcagacaaugcuauuuguauuuuaugcuuucgauagauuguguuuuauuucccuugaccauuuuucuacagauauuugucaggauacgaaucagguucucuucaagugcugccagggaucugaagagguacccugcaacaaaccuguuccuguaagccucucugaggaucccugcugcccacugcauuuccaguugccuccucagauguauaagcccgagcagguacugucugugccagacgaucuggaagccggccccauggaucuguacuugagugcugcugagcuucagcccacugagaguuuaccucuggaguucagugauguaaguuagagaagcucugcuuugguucaggcccuugagacaaagccuuauuuauuaauggugagaauagguuagucuuugugguuaggagaaucgacaaaguuuuugaagugauauauacguauaguuguauuuauauguuagcauauucauuuagagaaaucuacccuaccuuauauuuuuuuccagacucuucccauaccuuuuuagggauacaauuuacauacuauaaauugcacucuuugaaaguguauaauugagugauuuuuaguauauucgcaaaguuacgcaacuaccaccacuaucuaauuucagaagguuuucaccaucuccaaaagaaacucaguaccuauuaugacacucuucauuuucuucuccccucagccccuggccacgaugaaucuacuuuuugucucugauuuugcuuauucuggacauuucauaucaauguaauaguauauguauccuuuugugucuugcuuguuucacuuagcauaauguuuucaagguuuauccauacuauaauauguaucaauacuucauuccuuuuugugacugaauuaauauuccauuguuuggaaauaccacgcuuuaaaaauauaucaguugauggauauuugugcuguuucuacuuucuggcuauuaaggaauauacuguuaagaacuuuugagacagaguuucugucgguggcaugagccaccacgcccagcuuaguuaucauuuuuauaacuuuuuuuuuuuuaaauuggggucuugcucuguugcucaggcuggagugcaguggcaugaucauggcuccgugcagccucgaacuccugggcuuaagugauccuccugucucagccucccaaguagcugggacuauagguuuaugccaccaugcccagccaauuuuuuauuuuuuguauagaugagaucucccuauguugcaugggcuggucuucaacuccuaggcucaagugauccucuuaccuuggccucaagugauccucuuaccuuggccucccaaagugcugggauuacaagugugaaccacugugccuggccacuauaacuuggcuuuuuuuuuuuuagacugagucuuguucuguuguucaagcuggagugcagugaugugaucucagcucacugcagccucugccuucaggguucaagugauucuugugcuucacccuccuggguagcugggacuacaggugugcgccagcaggccuugcugauuuuuguauuuuuuguagagacaggguuucaccauguuggccaggcuggucucuaacuccuggccucaagugacccacccaccuuggccucccaaagugcugggauuauaggcaugauucaccauuccuggcguauaacuguuaaugauaacuuuggugauuuuacuugcgggaagacuaggcaucagauauuaauaugaguaaaaacacagccguucauucuggauauuugcuuguuuucugugcuuugaugcaaggaugguuggcaaguaguaacuuaacaccuuaaucuuacuacuuuugaguuccuucucucucauucucuauugcugguuuuggagauaguaacaaaacguggauucucuuauuuuaucuuuauuuauuuuuugagacggagucuuggucugucgcccagacuggagugcaguggcacgaucucggcucacugcaaccuucaccaucuggguucaagcaauucuccuguuccugccucccgaguagcugggauuacaggugugugccaccaugucuggcuaauuuuuguauuuuuuaguagagaugggguuucgccauguuggccaggcuggucucgaucuccuaaccucaggugauccacuccccucagcuuccccaaagugcugagauuauagacaugagacaucgcgcccagcugaaaacauggauucucuuuauauccugauacuucaauuuuuaaaacacuccuguuuuaauaggcauuuuugcugauuuucuuauuuuaggauccuuuucccaguuuaaaaucuuauaaaagacaacccuuuguauauaugagaaaagccuuuucugaaaacauacacauuccauuauuaucuugagauuuagaugccuuuugauucaguguuuaaauaauuccaagcuagucauuauuauuuuugacagagucucgcucugucaccuaggcuggagugcauuggcgugaucucggcucacugcacugucugccuccuggguucaagcgauucuccggucuaagccuuccgaguaguugggauuacaggugcgccccacugugcuuggcuaauuuuuguauuuuuaguagagacaggguuucaccauguuggccaggcuggucucaagcuccuggccucaaguguuucgcccaccuuggccucccaaagugcuaggauuacaggcgugagccaccgugcccauuccaagcuaauuguuuauguaagaauugcacaugggccgggugcgguggcugacgcuuguaauccuagcacuuugggaguccgagacggguagaucaccugaggucaggaguucuagacuagccuggccaacauggugaaacuccgucucuaccaaaaauacaacaauuagcuggaugugguggcacgcgccuguaaucccagcuacuggggaggcugaggcaggagaaucgcuugaacccaggagguggagguugcagugagccaagaucuugccauugcacuccagccuggguaacaagagugaaacucugucucacacacacgcacgcacacacacacacacaaauugcacauaguaaaagaaugggagaaaacagauuuauagucuuaauggugugagaacacugguuucuguggguaguacagaaguuuccaacucaccugaaaaugaaugguagguugaguguauccugugcccuauguuucugcuuaaauugagcagcuuuauuuuauuauuuuuuuuugagacagagucuugcucuguugcccagacuggagugcaguggugcagucucggcucacugcaaccucugccuccuggguucaagcaauucuccugccucaguguccugaguagcugggacuacagguaugugccaagacgccuggcuaauuuuuguauuuuuaguagagaugggguuucaccauguuggccaggcugguaauuuuuuguggagacuggguuucaccauguuagccaggauggucucaaucucuugaccucaugauccgcccaccuuggccucccaaaguguuaggauugcaggcgugagccacugcacccggccugagcagcuuuaaguagauuuuaaaauuauauauauucuuuaaugugaagauguugugauucucauuuuuggugauuagcacaccaacaaaugggaaaggauugcaaauucuuagauuuauuuaaaagcguagaacuaagcuucucgugaagcuagaugaauagaaacacggagcaucuauaaacuggauuaaacauagggggguacaaaccuccuggauauuuuuaauucuuaggaagaaggagaauuuagcaccagacucuugaaaagcaguggcaugaaaguuaguuugauauauuguuugaguuuguauugccuuaggcccugaaucaagaccaaugguuugcuguagcuguugguuucaaacaggagcuaagagugaugucuuccuuguggucuguuggcuauucaguauuccagugcgaauugccaauucaguuggaagaaacauagucuagaauguaaugucauuuuuuuuuuuuuuuuuuuuacagagcaaaacuauguuaggcuuaagaaccagggaguuggccgggcgugguggcucaugccuguaaucccagcacuuugggaggcugaggugggccaaucacuggucgggagaucaaggccauccuggcuaacauggugaaacccugucucuacuaaaaauacaaaaaauuagcugggcgugguggcacacgcccauagucccagcuacuggggaggcugaggcaggagaaucacuugaacccaggaggcggagguugcagugagccgagaucacgucacugcacuccagccugggcgacagagcgagacucugucucaaaaaaaaaaaaaacaaaacaaaaaaaaccagguuguugcucugucgggauagggacuuaaccaaaauaauauuuccuagccauucagaggaacugugaguuuucuguuguccuuccuuucuuccuaccuucucccuuucccuuguuggagcuuguuugcuugcuuuguggcuguuaggauauuaaucaggcaaucuuguauuacccagcaauauuuaauuuuaacguagcauuguucauauuuaaauuaaucacuggugaacuuacauguucauuacagguagccucagagaauaugcuuuuuuaaaaaauauuuuuuuaauuguaguaaaacauacauaacaaaauuuuacucuuuuaaccuauguauguauguguguaaguagguggguagguagagauggagucuugcugugucacccaggcuggucuugaauuccuggccucaagugauccucccacuucggcuucccaagguguuguuaucauaggcaugagccacugcaccuggccguuuuuaaguguacaagucagugguguuaugaacauuuaccauguuguacagcuaucaccauuuucuguuccagaacuuuuucaucaacccaaacagaaacuuuguacuuuuuaaacaguaacucucuccuuucccuuuccccuguucccuacuauucuccguuucuacuuuguguuucugugaauuuuccuagaauuuuuuuuuuuuuugagacagggucuggcucugccacccagguuagagugcagaggugcagucucggcucacugcagccucugcgucccaagcuugagggauccucccaccucaaccuccagaguagcugggacuacaggugugugccaccgcgccuggcuuauuuuugcaguuuuuguagagacgggguuucaccauguugcccaggcuggucuugaacuccugggcucaagugauaugccuaccuuggccucccaaagugcugggauuagaggugugguggccagaauuuuguuuuuuaaucuacuguauuggucuauguuuuacacuuggcagcaaaagcucucagugcuuuuggaucuuguuucauuuguuggacgcucuuguaaaauuuuuuuuuuauuaaagguaggcuaggguugagggagacagcagaguauugcuuuaaaguuugcugaaaaacaugccaacuuuauuacuguuucccuugguauugcugaugggcuuuucucuuuuuucuaggacuuggauguugugggugaugguaugcaguguccuccuucaccuuugcuuuuugauccuucacuaacccuugaagaucauuuagucaaagaaauugcugaagacccaguggauauuuuggcaagugaagaacagucccaccuguuucccucauguagugaccuggccaggcagaggguucccugcuagauagcaugugcuccuggaggggaguggggugucaucacuaguauaaagaugcuccacaugucucucacuuauugaauaccauauaagcaaagcacuuuuaaaaaugcccuacucugcuccuguguacccuuguugcuguaguucuccagaugggcucuuagaacaccuaauggcccgugauccucauaucccagaguaggacauacauuuauuuaaauaaaagcuugagacaaggaaucuagggaaaucauaccuucugagggagaguucaucacugaaauuguucucauuguagaaggaccaguaaaguaaugugauuugaguucuguccgugagccuuggguagaauuccaguggcccugacugaagaccagcaguuguacuguggcuguugguuucaagcagaggccuaaaggacugucuuccuguggucuguuggcuguucugggaccucaguagggaauggcuauuucauuuggaagaaacaaccuacagcucaccaucccauuggaagaggcucaggaauaggcucuuccaagggacuaggauagcuaauaugggaagagcaucuguccagaauuaauuucuguuguauuguucuuauugcuaguuuaaguggccacugauaagucagauucauacuucagaccacagugaaugaauuacuaacugaagugccuuuauuucuuuuaacagggccagaugcagauggcuggagaugggugcagaucccagggaucucgaaauucugagaaagccucugcaccauugucucagaguggauuggcuacugcaaaugggaagccagaacccacuucuauuaguugauaguuuggggaaccauuuuacuuugguggauuuaaauuucucguucuucaaagaaguauuucugaucaucucucacaaaacacaggcaacccagacuaccuuguuuuucuucuggauugaguauuauagucaaacguaaagccaaauuuugaggacguggaccguggguuucuucccacucagggcaaggaagagaaagagagauaaucccuaucaaagcuucugggauuauuugggacuauaccuaaaaggaaagugacaucuuuguaaugggauuucccaagucauggauagaaauccacuuaaguagcuaggugggagcugucuuugugaguggugucuuugagauacugauggcccuaauaucgguuaucucuaucugaagaccugcaguuuagcuuuucuucaccucuacuuaauugggcagucuuuaaccccuuucccuggugaacucuggcuuuuuauccucugagaaaacagcccacaggacuggguccuccuuauccgucuugcuuuuaaccuauguaaauuucugugguugcuaucuuauguaaaauauaguaaaaauuuauuguauauaguuucuauuaaauguuaaagaaaauguuaugaaaauaucaaacagucaccugaauugaaugcauguuuuguuugagaauauaguuucuuuuucgcgguuuuggggaccugucucugaugggaaagggaaguugggacagaugauacuuccaucccaagaaguaaauaaaucuucaguagcucauuuugguuuugcuuugaaggaagaaguaaaugaaaaggggcaggacuuauuaaagcccaucaguuccaa
